US007655785B1

(12) United States Patent
Bentwich

(10) Patent No.: US 7,655,785 B1
(45) Date of Patent: Feb. 2, 2010

(54) BIOINFORMATICALLY DETECTABLE GROUP OF NOVEL REGULATORY OLIGONUCLEOTIDES AND USES THEREOF

(75) Inventor: Itzhak Bentwich, Kfar Daniel (IL)

(73) Assignee: Rosetta Genomics Ltd., Rehovot (IL)

( * ) Notice: Subject to any disclaimer, the term of this patent is extended or adjusted under 35 U.S.C. 154(b) by 666 days.

(21) Appl. No.: 10/708,953

(22) Filed: Apr. 2, 2004

Related U.S. Application Data

(63) Continuation-in-part of application No. 10/708,204, filed on Feb. 16, 2004, and a continuation of application No. 10/707,980, filed on Jan. 29, 2004, and a continuation-in-part of application No. 10/707,975, filed on Jan. 29, 2004, now abandoned, and a continuation-in-part of application No. 10/707,147, filed on Nov. 24, 2003, and a continuation-in-part of application No. PCT/IL03/00970, filed on Nov. 16, 2003, which is a continuation of application No. 10/604,985, filed on Aug. 29, 2003, now abandoned, which is a continuation-in-part of application No. 10/651,227, filed on Aug. 29, 2003, which is a continuation of application No. 10/605,924, filed on Aug. 29, 2003, which is a continuation-in-part of application No. 10/649,653, filed on Aug. 28, 2003, which is a continuation of application No. 10/605,923, filed on Aug. 28, 2003, which is a continuation-in-part of application No. 10/604,926, filed on Aug. 27, 2003, which is a continuation of application No. 10/345,201, filed on Jan. 16, 2003, which is a continuation-in-part of application No. 10/321,503, filed on Dec. 18, 2002, which is a continuation-in-part of application No. 10/310,914, filed on Dec. 6, 2002, which is a continuation-in-part of application No. 10/293,338, filed on Nov. 14, 2002, which is a continuation of application No. 10/604,727, filed on Aug. 13, 2003, and a continuation of application No. 10/604,726, filed on Aug. 13, 2003.

(60) Provisional application No. 60/468,251, filed on May 7, 2003.

(51) Int. Cl.
| C12N 15/00 | (2006.01) |
| A61K 31/70 | (2006.01) |
| C07H 21/04 | (2006.01) |

(52) U.S. Cl. .................. 536/24.1; 536/23.1; 536/24.3; 536/24.5; 435/320.1; 514/44

(58) Field of Classification Search ........................ None
See application file for complete search history.

(56) References Cited

U.S. PATENT DOCUMENTS

| 6,573,099 | B2 | 6/2003 | Graham |
| 2002/0086356 | A1 | 7/2002 | Tuschl et al. |
| 2002/0150891 | A1* | 10/2002 | Hood et al. .................. 435/6 |
| 2003/0108923 | A1 | 6/2003 | Tuschl et al. |
| 2003/0228691 | A1 | 12/2003 | Lewis et al. |
| 2004/0053411 | A1 | 3/2004 | Cullen et al. |

FOREIGN PATENT DOCUMENTS

| WO | WO 01/68836 | 9/2001 |
| WO | WO 01/75164 | 10/2001 |
| WO | WO 02/44321 | 6/2002 |
| WO | WO 02/094185 | 11/2002 |
| WO | WO 03/029459 | 4/2003 |
| WO | WO 03/070884 | 8/2003 |
| WO | WO 03/070903 | 8/2003 |
| WO | WO 03/070918 | 8/2003 |
| WO | WO 03/074654 | 9/2003 |
| WO | WO 2004/009779 | 1/2004 |

OTHER PUBLICATIONS

John, B., et al. (2004) Human MicroRNA Targets. PLoS Biology v.2(22):1862-1879.*
Lee, R. C., R. L. Feinbaum and V. Ambros. The *C. elegans* heterochronic gene lin-4 encodes small RNAs with antisense complementarity to lin-14 Cell Dec. 3, 1993 843-854 75.
Wightman, B., I. HA and G. Ruvkun. Posttranscriptional regulation of the heterochronic gene lin-14 by lin-4 mediates temporal pattern formation in *C. elegans* Cell Dec. 3, 1993 855-862 75.
Gallinaro, H., L. Domenjoud and M. Jacob. Structural study of the 5' end of a synthetic premessenger RNA from adenovirus. Evidence for a long-range exon-intron interaction J Mol Biol Jul. 15, 1994 205-225 240.
Lu, C. and R. Bablanian. Characterization of small nontranslated polyadenylylated RNAs in vaccinia virus-infected cells Proc Natl Acad Sci U S A Mar. 5, 1996 2037-2042 93.
Crawford, E. D., E. P. Deantoni, R. Etzioni, V. C. Schaefer, R. M. Olson and C. A. Ross. Serum prostate-specific antigen and digital rectal examination for early detection of prostate cancer in a national community-based program. The Prostate Cancer Education Council Urology Jun. 1996 863-869 47.

(Continued)

*Primary Examiner*—Sean R McGarry
*Assistant Examiner*—Jennifer Pitrak
(74) *Attorney, Agent, or Firm*—Teddy C. Scott, Jr.; Polsinelli Shughart PC

(57) ABSTRACT

The present invention relates to a first group of novel oligonucleotides, here identified as Genomic Address Messenger or GAM oligonucleotide, and a second group of novel operon-like polynucleotides, here identified as Genomic Record or GR polynucleotide. GAM oligonucleotides selectively inhibit translation of known 'target' genes, many of which are known to be involved in various diseases. Nucleic acid molecules are provided respectively encoding 15454 GAM precursors oligonucleotides, and 681 GR polynucleotides, as are vectors and probes both comprising the nucleic acid molecules, and methods and systems for detecting GAM oligonucleotides and GR polynucleotides and specific functions and utilities thereof, for detecting expression of GAM oligonucleotides and GR polynucleotides, and for selectively enhancing and selectively inhibiting translation of the respective target genes thereof.

18 Claims, 31 Drawing Sheets

OTHER PUBLICATIONS

Engdahl HM, Hjalt TA, Wagner EG. A two unit antisense RNA cassette test system for silencing of target genes. Nucleic Acids Res. Aug. 15, 1997 3218-27 25.

Dsouza, M., N. Larsen and R. Overbeek. Searching for patterns in genomic data Trends Genet Dec. 1997 497-498 13.

Moss, E. G., R. C. Lee and V. Ambros. The cold shock domain protein LIN-28 controls developmental timing in *C. elegans* and is regulated by the lin-4 RNA Cell 1997 637 88.

Fire, A., S. Xu, M. K. Montgomery, S. A. Kostas, S. E. Driver and C. C. Mello. Potent and specific genetic interference by double-stranded RNA in *Caenorhabditis elegans* Nature Feb. 19, 1998 806-811 391.

Waterhouse, P. M., M. W. Graham and M. B. Wang. Virus resistance and gene silencing in plants can be induced by simultaneous expression of sense and antisense RNA Proc Natl Acad Sci U S A Nov. 10, 1998 13959-13964 95.

Ngo, H., C. Tschudi, K. Gull and E. Ullu. Double-stranded RNA induces mRNA degradation in *Trypanosoma brucei* Proc Natl Acad Sci U S A Dec. 8, 1998 14687-14692 95.

Verma, S. and F. Eckstein. Modified oligonucleotides: synthesis and strategy for users Annu Rev Biochem *No date in Pubmed* 1998 99-134 67.

Wuchty, S., W. Fontana, I. L. Hofacker and P. Schuster. Complete suboptimal folding of RNA and the stability of secondary structures Biopolymers Feb. 1999 145-165 49.

Mathews, D. H., J. Sabina, M. Zuker and D. H. Turner. Expanded sequence dependence of thermodynamic parameters improves prediction of RNA secondary structure J Mol Biol May 21, 1999 911-940 288.

Chang, P. L. Encapsulation for somatic gene therapy Ann N Y Acad Sci Jun. 18, 1999 146-158 875.

Zhang, M. Q. Large-scale gene expression data analysis: a new challenge to computational biologists Genome Res Aug. 1999 681-688 9.

Grisaru, D., M. Sternfeld, A. Eldor, D. Glick and H. Soreq. Structural roles of acetylcholinesterase variants in biology and pathology Eur J Biochem Sep. 1999 672-686 264.

Fire, A. RNA-triggered gene silencing Trends Genet Sep. 1999 358-363 15.

Tabara, H., M. Sarkissian, W. G. Kelly, J. Fleenor, A. Grishok, L. Timmons, A. Fire and C. C. Mello. The rde-1 gene, RNA interference, and transposon silencing in *C. elegans* Cell Oct. 15, 1999 123-132 99.

Ryo, A., Y. Suzuki, K. Ichiyama, T. Wakatsuki, N. Kondoh, A. Hada, M. Yamamoto and N. Yamamoto. Serial analysis of gene expression in HIV-1-infected T cell lines FEBS Lett Nov. 26, 1999 182-186 462.

Olsen, P. H. and V. Ambros. The lin-4 regulatory RNA controls developmental timing in *Caenorhabditis elegans* by blocking LIN-14 protein synthesis after the initiation of translation Dev Biol Dec. 15, 1999 671-680 216.

Tuschl, T., P. D. Zamore, R. Lehmann, D. P. Bartel and P. A. Sharp. Targeted mRNA degradation by double-stranded RNA in vitro Genes Dev Dec. 15, 1999 3191-3197 13.

Reinhart, B. J., F. J. Slack, M. Basson, A. E. Pasquinelli, J. C. Bettinger, A. E. Rougvie, H. R. Horvitz and G. Ruvkun. The 21-nucleotide let-7 RNA regulates developmental timing in *Caenorhabditis elegans* Nature Feb. 24, 2000 901-906 403.

Pitt, J. N., J. A. Schisa and J. R. Priess. P granules in the germ cells of *Caenorhabditis elegans* adults are associated with clusters of nuclear pores and contain RNA Dev Biol Mar. 15, 2000 315-333 219.

Hammond, S. M., E. Bernstein, D. Beach and G. J. Hannon. An RNA-directed nuclease mediates post-transcriptional gene silencing in *Drosophila* cells Nature Mar. 16, 2000 293-296 404.

Slack, F. J., M. Basson, Z. Liu, V. Ambros, H. R. Horvitz and G. Ruvkun. The lin-41 RBCC gene acts in the *C. elegans* heterochronic pathway between the let-7 regulatory RNA and the LIN-29 transcription factor Mol Cell Apr. 2000 659-669 5.

Fortier, E. and J. M. Belote. Temperature-dependent gene silencing by an expressed inverted repeat in *Drosophila* Genesis Apr. 2000 240-244 26.

Mourrain, P., C. Beclin, T. Elmayan, F. Feuerbach, C. Godon, J. B. Morel, D. Jouette, A. M. Lacombe, S. Nikic, N. Picault, K. Remoue, M. Sanial, T. A. Vo and H. Vaucheret. Arabidopsis SGS2 and SGS3 genes are required for posttranscriptional gene silencing and natural virus resistance Cell May 26, 2000 533-542 101.

Sijen, T. and J. M. Kooter. Post-transcriptional gene-silencing: RNAs on the attack or on the defense? Bioessays Jun. 2000 520-531 22.

Brenner, S., M. Johnson, J. Bridgham, G. Golda, D. H. Lloyd, D. Johnson, S. Luo, S. McCurdy, M. Foy, M. Ewan, R. Roth, D. George, S. Eletr, G. Albrecht, E. Vermaas, S. R. Williams, K. Moon, T. Burcham, M. Pallas, R. B. Dubridge, J. Kirchner, K. Fearon, J. Mao and K. Corcoran. Gene expression analysis by massively parallel signature sequencing (MPSS) on microbead arrays Nat Biotechnol Jun. 2000 630-634 18.

Ryo, A., Y. Suzuki, M. Arai, N. Kondoh, T. Wakatsuki, A. Hada, M. Shuda, K. Tanaka, C. Sato, M. Yamamoto and N. Yamamoto. Identification and characterization of differentially expressed mRNAs in HIV type 1-infected human T cells AIDS Res Hum Retroviruses Jul. 1, 2000 995-1005 16.

Nilsson, M., G. Barbany, D. O. Antson, K. Gertow and U. Landegren. Enhanced detection and distinction of RNA by enzymatic probe ligation Nat Biotechnol Jul. 2000 791-793 18.

Kent, W. J. and A. M. Zahler. Conservation, regulation, synteny, and introns in a large-scale *C. briggsae-C. elegans* genomic alignment Genome Res Aug. 2000 1115-1125 10.

Kennerdell, J. R. and R. W. Carthew. Heritable gene silencing in *Drosophila* using double-stranded RNA Nat Biotechnol Aug. 2000 896-898 18.

Smith, N. A., S. P. Singh, M. B. Wang, P. A. Stoutjesdijk, A. G. Green and P. M. Waterhouse. Total silencing by intron-spliced hairpin RNAs Nature Sep. 21, 2000 319-320 407.

Voinnet, O., C. Lederer and D. C. Baulcombe. A viral movement protein prevents spread of the gene silencing signal in *Nicotiana benthamiana* Cell Sep. 29, 2000 157-167 103.

Metter MF, Aufsatz W, van der Winden J, Matzke MA, Matzke AJ. Transcriptional silencing and promoter methylation triggered by double-stranded RNA. EMBO J. Oct. 2000 5194-201 19.

Yang, D., H. Lu and J. W. Erickson. Evidence that processed small dsRNAs may mediate sequence-specific mRNA degradation during RNAi in *Drosophila* embryos Curr Biol Oct. 5, 2000 1191-1200 10.

Anandalakshmi, R., R. Marathe, X. GE, J. M. Herr, Jr., C. Mau, A. Mallory, G. Pruss, L. Bowman and V. B. Vance. A calmodulin-related protein that suppresses posttranscriptional gene silencing in plants Science Oct. 6, 2000 142-144 290.

Fagard, M., S. Boutet, J. B. Morel, C. Bellini and H. Vaucheret. AGO1, QDE-2, and RDE-1 are related proteins required for post-transcriptional gene silencing in plants, quelling in fungi, and RNA interference in animals Proc Natl Acad Sci U S A Oct. 10, 2000 11650-11654 97.

Pasquinelli, A. E., B. J. Reinhart, F. Slack, M. Q. Martindale, M. I. Kuroda, B. Maller, D. C. Hayward, E. E. Ball, B. Degnan, P. Muller, J. Spring, A. Srinivasan, M. Fishman, J. Finnerty, J. Corbo, M. Levine, P. Leahy, E. Davidson and G. Ruvkun. Conservation of the sequence and temporal expression of let-7 heterochronic regulatory RNA Nature Nov. 2, 2000 86-89 408.

Llave, C., K. D. Kasschau and J. C. Carrington. Virus-encoded suppressor of posttranscriptional gene silencing targets a maintenance step in the silencing pathway Proc Natl Acad Sci U S A Nov. 21, 2000 13401-13406 9.

Cogoni, C. and G. Macino. Post-transcriptional gene silencing across kingdoms Curr Opin Genet Dev Dec. 2000 638-643 10.

Elbashir, S. M., W. Lendeckel and T. Tuschl. RNA interference is mediated by 21- and 22-nucleotide RNAs Genes Dev Jan. 15, 2001 188-200 15.

Bernstein, E., A. A. Caudy, S. M. Hammond and G. J. Hannon. Role for a bidentate ribonuclease in the initiation step of RNA interference Nature Jan. 18, 2001 363-366 409.

Vaucheret, H. and M. Fagard. Transcriptional gene silencing in plants: targets, inducers and regulators Trends Genet Jan. 2001 29-35 17.

Thomas, C. L., L. Jones, D. C. Baulcombe and A. J. Maule. Size constraints for targeting post-transcriptional gene silencing and for RNA-directed methylation in *Nicotiana benthamiana* using a potato virus X vector Plant J Feb. 2001 417-425 25.

Galyam, N., D. Grisaru, M. Grifman, N. Melamed-Book, F. Eckstein, S. Seidman, A. Eldor and H. Soreq. Complex host cell responses to antisense suppression of ACHE gene expression Antisense Nucleic Acid Drug Dev Feb. 2001 51-57 11.

Sharp, P. A. RNA interference—2001 Genes Dev Mar. 1, 2001 485-490 15.

Mallory, A. C., L. Ely, T. H. Smith, R. Marathe, R. Anandalakshmi, M. Fagard, H. Vaucheret, G. Pruss, L. Bowman and V. B. Vance. HC-Pro suppression of transgene silencing eliminates the small RNAs but not transgene methylation or the mobile signal Plant Cell Mar. 2001 571-583 13.

Matzke, M. A., A. J. Matzke, G. J. Pruss and V. B. Vance. RNA-based silencing strategies in plants Curr Opin Genet Dev Apr. 2001 221-227 11.

Schisa, J. A., J. N. Pitt and J. R. Priess. Analysis of RNA associated with P granules in germ cells of *C. elegans* adults Development Apr. 2001 1287-1298 128.

Di Serio, F., H. Schob, A. Iglesias, C. Tarina, E. Bouldoires and F. Meins, Jr. Sense- and antisense-mediated gene silencing in tobacco is inhibited by the same viral suppressors and is associated with accumulation of small RNAs Proc Natl Acad Sci U S A May 22, 2001 6506-6510 98.

Elbashir, S. M., J. Harborth, W. Lendeckel, A. Yalcin, K. Weber and T. Tuschl. Duplexes of 21-nucleotide RNAs mediate RNA interference in cultured mammalian cells Nature May 24, 2001 494-498 411.

Piccin, A., A. Salameh, C. Benna, F. Sandrelli, G. Mazzotta, M. Zordan, E. Rosato, C. P. Kyriacou and R. Costa. Efficient and heritable functional knock-out of an adult phenotype in *Drosophila* using a GAL4-driven hairpin RNA incorporating a heterologous spacer Nucleic Acids Res Jun. 15, 2001 E55-55 29.

Vance, V. and H. Vaucheret. RNA silencing in plants—defense and counterdefense Science Jun. 22, 2001 2277-2280 292.

Argaman, L., R. Hershberg, J. Vogel, G. Bejerano, E. G. Wagner, H. Margalit and S. Altuvia. Novel small RNA-encoding genes in the intergenic regions of *Escherichia coli* Curr Biol Jun. 26, 2001 941-950 11.

Grishok, A., A. E. Pasquinelli, D. Conte, N. Li, S. Parrish, I. Ha, D. L. Baillie, A. Fire, G. Ruvkun and C. C. Mello. Genes and mechanisms related to RNA interference regulate expression of the small temporal RNAs that control *C. elegans* developmental timing Cell Jul. 13, 2001 23-34 106.

Hutvagner, G., J. McLachlan, A. E. Pasquinelli, E. Balint, T. Tuschl and P. D. Zamore. A cellular function for the RNA-interference enzyme Dicer in the maturation of the let-7 small temporal RNA Science Aug. 3, 2001 834-838 293.

Hammond, S. M., S. Boettcher, A. A. Caudy, R. Kobayashi and G. J. Hannon. Argonaute2, a link between genetic and biochemical analyses of RNAi Science Aug. 10, 2001 1146-1150 293.

Vaucheret, H., C. Beclin and M. Fagard. Post-transcriptional gene silencing in plants J Cell Sci Sep. 2001 3083-3091 114.

Wesley, S. V., C. A. Helliwell, N. A. Smith, M. B. Wang, D. T. Rouse, Q. Liu, P. S. Gooding, S. P. Singh, D. Abbott, P. A. Stoutjesdijk, S. P. Robinson, A. P. Gleave, A. G. Green and P. M. Waterhouse. Construct design for efficient, effective and high-throughput gene silencing in plants Plant J Sep. 2001 581-590 27.

Mattick, J. S. and M. J. Gagen. The evolution of controlled multitasked gene networks: the role of introns and other noncoding RNAs in the development of complex organisms Mol Biol Evol Sep. 2001 1611-1630 18.

Carter, R. J., I. Dubchak and S. R. Holbrook. A computational approach to identify genes for functional RNAs in genomic sequences Nucleic Acids Res Oct. 1, 2001 3928-3938 29.

Moss, E. G. RNA interference: its a small RNA world Curr Biol Oct. 2, 2001 R772-775 11.

Ketting, R. F., S. E. Fischer, E. Bernstein, T. Sijen, G. J. Hannon and R. H. Plasterk. Dicer functions in RNA interference and in synthesis of small RNA involved in developmental timing in *C. elegans* Genes Dev Oct. 15, 2001 2654-2659 15.

Ruvkun, G. Molecular biology. Glimpses of a tiny RNA world Science Oct. 26, 2001 797-799 294.

Lee, R. C. and V. Ambros. An extensive class of small RNAs in *Caenorhabditis elegans* Science Oct. 26, 2001 862-864 294.

Lau, N. C., L. P. Lim, E. G. Weinstein and D. P. Bartel. An abundant class of tiny RNAs with probable regulatory roles in *Caenorhabditis elegans* Science Oct. 26, 2001 858-862 294.

Lagos-Quintana, M., R. Rauhut, W. Lendeckel and T. Tuschl. Identification of novel genes coding for small expressed RNAs Science Oct. 26, 2001 853-858 294.

Itaya, A., A. Folimonov, Y. Matsuda, R. S. Nelson and B. Ding. Potato spindle tuber viroid as inducer of RNA silencing in infected tomato Mol Plant Microbe Interact Nov. 2001 1332-1334 14.

Mattick, J. S. Non-coding RNAs: the architects of eukaryotic complexity EMBO Rep Nov. 2001 986-991 2.

Elbashir, S. M., J. Martinez, A. Patkaniowska, W. Lendeckel and T. Tuschl. Functional anatomy of siRNAs for mediating efficient RNAi in *Drosophila melanogaster* embryo lysate Embo J Dec. 3, 2001 6877-6888 20.

Ambros, V. microRNAs: tiny regulators with great potential Cell Dec. 28, 2001 823-826 107.

Blaszczyk, J., J. E. Tropea, M. Bubunenko, K. M. Routzahn, D. S. Waugh, D. L. Court and X. Ji. Crystallographic and modeling studies of RNase III suggest a mechanism for double-stranded RNA cleavage Structure Dec. 2001 1225-1236 9.

Crete, P., S. Leuenberger, V. A. Iglesias, V. Suarez, H. Schob, H. Holtorf, S. Van Eeden and F. Meins. Graft transmission of induced and spontaneous post-transcriptional silencing of chitinase genes Plant J Dec. 2001 493-501 28.

Smallridge, R. A small fortune Nat Rev Mol Cell Biol Dec. 2001 867 2.

Eddy, S. R. Non-coding RNA genes and the modern RNA world Nat Rev Genet Dec. 2001 919-929 2.

Lu, C. M. miRNA bead detection Genaco Biomedical Products PHS 398 2001 1.

Matzke, M., A. J. Matzke and J. M. Kooter. RNA: guiding gene silencing 2001 1080 293.

Grosshans, H. and F. J. Slack. Micro-RNAs: small is plentiful J Cell Biol Jan. 7, 2002 17-21 156.

Meshorer, E., C. Erb, R. Gazit, L. Pavlovsky, D. Kaufer, A. Friedman, D. Glick, N. Benarie and H. Soreq. Alternative splicing and neuritic mRNA translocation under long-term neuronal hypersensitivity Science Jan. 18, 2002 508-512 295.

Paddison, P. J., A. A. Caudy and G. J. Hannon. Stable suppression of gene expression by RNAi in mammalian cells Proc Natl Acad Sci U S A Feb. 5, 2002 1443-1448 99.

Moss, E. G. MicroRNAs: hidden in the genome Curr Biol Feb. 19, 2002 R138-140 12.

Banerjee, D. and F. Slack. Control of developmental timing by small temporal RNAs: a paradigm for RNA-mediated regulation of gene expression Bioessays Feb. 2002 119-129 24.

Elbashir, S. M., J. Harborth, K. Weber and T. Tuschl. Analysis of gene function in somatic mammalian cells using small interfering RNAs Methods Feb. 2002 199-213 26.

Han, Y. and D. Grierson. Relationship between small antisense RNAs and aberrant RNAs associated with sense transgene mediated gene silencing in tomato Plant J Feb. 2002 509-519 29.

Nicholson, R. H. and A. W. Nicholson. Molecular characterization of a mouse cDNA encoding Dicer, a ribonuclease III ortholog involved in RNA interference Mamm Genome Feb. 2002 67-73 13.

Puerta-Fernandez, E., A. Barroso-Deljesus and A. Berzal-Herranz. Anchoring hairpin ribozymes to long target RNAs by loop-loop RNA interactions Antisense Nucleic Acid Drug Dev Feb. 2002 1-9 12.

Giordano, E., R. Rendina, I. Peluso and M. Furia. RNAi triggered by symmetrically transcribed transgenes in *Drosophila melanogaster* Genetics Feb. 2002 637-648 160.

Martens, H., J. Novotny, J. Oberstrass, T. L. Steck, P. Postlethwait and W. Nellen. RNAi in Dictyostelium: the role of RNA-directed RNA polymerases and double-stranded RNase Mol Biol Cell Feb. 2002 445-453 13.

Mourelatos, Z., J. Dostie, S. Paushkin, A. Sharma, B. Charroux, L. Abel, J. Rappsilber, M. Mann and G. Dreyfuss. miRNPs: a novel class of ribonucleoproteins containing numerous microRNAs Genes Dev Mar. 15, 2002 720-728 16.

Seggerson, K., L. Tang and E. G. Moss. Two genetic circuits repress the *Caenorhabditis elegans* heterochronic gene lin-28 after translation initiation Dev Biol Mar. 15, 2002 215-225 243.

Morel, J. B., C. Godon, P. Mourrain, C. Beclin, S. Boutet, F. Feuerbach, F. Proux and H. Vaucheret. Fertile hypomorphic Argonaute (ago1) mutants impaired in post-transcriptional gene silencing and virus resistance Plant Cell Mar. 2002 629-639 14.

Catalanotto, C., G. Azzalin, G. Macino and C. Cogoni. Involvement of small RNAs and role of the qde genes in the gene silencing pathway in Neurospora Genes Dev Apr. 1, 2002 790-795 16.

Boutla, A., K. Kalantidis, N. Tavernarakis, M. Tsagris and M. Tabler. Induction of RNA interference in *Caenorhabditis elegans* by RNAs derived from plants exhibiting post-transcriptional gene silencing Nucleic Acids Res Apr. 1, 2002 1688-1694 30.

Pasquinelli, A. E. and G. Ruvkun. Control of developmental timing by micrornas and their targets Annu Rev Cell Dev Biol Epub 2002 Apr. 2, 2002 495-513 18.

Paddison, P. J., A. A. Caudy, E. Bernstein, G. J. Hannon and D. S. Conklin. Short hairpin RNAs (shRNAs) induce sequence-specific silencing in mammalian cells Genes Dev Apr. 15, 2002 948-958 16.

Beclin, C., S. Boutet, P. Waterhouse and H. Vaucheret. A branched pathway for transgene-induced RNA silencing in plants Curr Biol Apr. 16, 2002 684-688 12.

Eddy, S. R. Computational genomics of noncoding RNA genes Cell Apr. 19, 2002 137-140 109.

Lagos-Quintana, M., R. Rauhut, A. Yalcin, J. Meyer, W. Lendeckel and T. Tuschl. Identification of tissue-specific microRNAs from mouse Curr Biol Apr. 30, 2002 735-739 12.

Kent, W. J. Blat—the Blast-like alignment tool Genome Res Apr. 2002 656-664 12.

Hutvagner, G. and P. D. Zamore. RNAi: nature abhors a double-strand Curr Opin Genet Dev Apr. 2002 225-232 12.

Nilsson, M., J. Baner, M. Mendel-Hartvig, F. Dahl, D. O. Antson, M. Gullberg and U. Landegren. Making ends meet in genetic analysis using padlock probes Hum Mutat Apr. 2002 410-415 19.

Pasquinelli, A. E. MicroRNAs: deviants no longer Trends Genet Apr. 2002 171-173 18.

Lai, E. C. Micro RNAs are complementary to 3' UTR sequence motifs that mediate negative post-transcriptional regulation Nat Genet Apr. 2002 363-364 30.

Schwarz, D. S. and P. D. Zamore. Why do miRNAs live in the miRNP? Genes Dev May 1, 2002 1025-1031 16.

Brantl, S. Antisense-RNA regulation and RNA interference Biochim Biophys Acta May 3, 2002 15-25 1575.

Li, H., W. X. Li and S. W. Ding. Induction and suppression of RNA silencing by an animal virus Science May 17, 2002 1319-1321 296.

Zamore, P. D. Ancient pathways programmed by small RNAs Science May 17, 2002 1265-1269 296.

Chen, S., E. A. Lesnik, T. A. Hall, R. Sampath, R. H. Griffey, D. J. Ecker and L. B. Blyn. A bioinformatics based approach to discover small RNA genes in the *Escherichia coli* genome Biosystems Mar.-May 2002 157-177 65.

Lee, N. S., T. Dohjima, G. Bauer, H. Li, M. J. Li, A. Ehsani, P. Salvaterra and J. Rossi. Expression of small interfering RNAs targeted against HIV-1 rev transcripts in human cells Nat Biotechnol May 2002 500-505 20.

Draghici, S. Statistical intelligence: effective analysis of high-density microarray data Drug Discov Today Jun. 1, 2002 S55-63 7.

Silhavy, D., A. Molnar, A. Lucioli, G. Szittya, C. Hornyik, M. Tavazza and J. Burgyan. A viral protein suppresses RNA silencing and binds silencing-generated, 21- to 25-nucleotide double-stranded RNAs Embo J Jun. 17, 2002 3070-3080 21.

Ayash-Rashkovsky, M., Z. Weisman, J. Diveley, R. B. Moss, Z. Bentwich and G. Borkow. Generation of Th1 immune responses to inactivated, gp120-depleted HIV-1 in mice with a dominant Th2 biased immune profile via immunostimulatory [correction of imunostimulatory] oligonucleotides—relevance to AIDS vaccines in developing countries Vaccine Jun. 21, 2002 2684-2692 20.

Tabara, H., E. Yigit, H. Siomi and C. C. Mello. The dsRNA binding protein RDE-4 interacts with RDE-1, DCR-1, and a DExH-box helicase to direct RNAi in *C. elegans* Cell Jun. 28, 2002 861-871 109.

Bettencourt, R., O. Terenius and I. Faye. Hemolin gene silencing by ds-RNA injected into *Cecropia pupae* is lethal to next generation embryos Insect Mol Biol Jun. 2002 267-271 11.

Hooper, N. M. and A. J. Turner. The search for alpha-secretase and its potential as a therapeutic approach to Alzheimer s disease Curr Med Chem Jun. 2002 1107-1119 9.

Liu, Q., S. Singh and A. Green. High-oleic and high-stearic cottonseed oils: nutritionally improved cooking oils developed using gene silencing J Am Coll Nutr Jun. 2002 205S-211S 21.

Zeng, Y., E. J. Wagner and B. R. Cullen. Both natural and designed micro RNAs can inhibit the expression of cognate mRNAs when expressed in human cells Mol Cell Jun. 2002 1327-1333 9.

McManus, M. T., C. P. Petersen, B. B. Haines, J. Chen and P. A. Sharp. Gene silencing using micro-RNA designed hairpins Rna Jun. 2002 842-850 8.

Reinhart, B. J., E. G. Weinstein, M. W. Rhoades, B. Bartel and D. P. Bartel. MicroRNAs in plants Genes Dev Jul. 1, 2002 1616-1626 16.

McCaffrey, A. P., L. Meuse, T. T. Pham, D. S. Conklin, G. J. Hannon and M. A. Kay. RNA interference in adult mice Nature Jul. 4, 2002 38-39 418.

Hannon, G. J. RNA interference Nature Jul. 11, 2002 244-251 418.

Dennis, C. The brave new world of RNA Nature Jul. 11, 2002 122-124 418.

Jacque, J. M., K. Triques and M. Stevenson. Modulation of HIV-1 replication by RNA interference Nature Jul. 25, 2002 435-438 418.

Cullen, B. R. RNA interference: antiviral defense and genetic tool Nat Immunol Jul. 2002 597-599 3.

Ma, C. and A. Mitra. Intrinsic direct repeats generate consistent post-transcriptional gene silencing in tobacco Plant J Jul. 2002 37-49 31.

Novina, C. D., M. F. Murray, D. M. Dykxhoorn, P. J. Beresford, J. Riess, S. K. Lee, R. G. Collman, J. Lieberman, P. Shankar and P. A. Sharp. siRNA-directed inhibition of HIV-1 infection Nat Med Jul. 2002 681-686 8.

Pomerantz, R. J. RNA interference meets HIV-1: will silence be golden? Nat Med Jul. 2002 659-660 8.

Zeng, Y. and B. R. Cullen. RNA interference in human cells is restricted to the cytoplasm Rna Jul. 2002 855-860 8.

Xiang, C. C., O. A. Kozhich, M. Chen, J. M. Inman, Q. N. Phan, Y. Chen and M. J. Brownstein. Amine-modified random primers to label probes for DNA microarrays Nat Biotechnol Jul. 2002 738-742 20.

Llave, C., K. D. Kasschau, M. A. Rector and J. C. Carrington. Endogenous and silencing-associated small RNAs in plants Plant Cell Jul. 2002 1605-1619 14.

Rhoades, M. W., B. J. Reinhart, L. P. Lim, C. B. Burge, B. Bartel and D. P. Bartel. Prediction of plant microRNA targets Cell Aug. 23, 2002 513-520 110.

Hipfner, D. R., K. Weigmann and S. M. Cohen. The bantam gene regulates *Drosophila* growth Genetics Aug. 2002 1527-1537 161.

Liu, Q., S. P. Singh and A. G. Green. High-stearic and High-oleic cottonseed oils produced by hairpin RNA-mediated post-transcriptional gene silencing Plant Physiol Aug. 2002 1732-1743 129.

Stoutjesdijk, P. A., S. P. Singh, Q. Liu, C. J. Hurlstone, P. A. Waterhouse and A. G. Green. hpRNA-mediated targeting of the *Arabidopsis* FAD2 gene gives highly efficient and stable silencing Plant Physiol Aug. 2002 1723-1731 129.

Suzuma, S., S. Asari, K. Bunai, K. Yoshino, Y. Ando, H. Kakeshita, M. Fujita, K. Nakamura and K. Yamane. Identification and characterization of novel small RNAs in the aspS-yrvM intergenic region of the *Bacillus subtilis* genome Microbiology Aug. 2002 2591-2598 148.

Milligan, L., T. Forne, E. Antoine, M. Weber, B. Hemonnot, L. Dandolo, C. Brunel and G. Cathala. Turnover of primary transcripts is a major step in the regulation of mouse H19 gene expression EMBO Rep Aug. 2002 774-779 3.

Hamilton, A., O. Voinnet, L. Chappell and D. Baulcombe. Two classes of short interfering RNA in RNA silencing Embo J Sep. 2, 2002 4671-4679 21.

Lee, Y., K. Jeon, J. T. Lee, S. Kim and V. N. Kim. MicroRNA maturation: stepwise processing and subcellular localization Embo J Sep. 2, 2002 4663-4670 21.

Klahre, U., P. Crete, S. A. Leuenberger, V. A. Iglesias and F. Meins, Jr. High molecular weight RNAs and small interfering RNAs induce systemic posttranscriptional gene silencing in plants Proc Natl Acad Sci U S A Sep. 3, 2002 11981-11986 99.

Park, W., J. Li, R. Song, J. Messing and X. Chen. Carpel Factory, a Dicer homolog, and HEN1, a novel protein, act in microRNA metabolism in *Arabidopsis thaliana* Curr Biol Sep. 3, 2002 1484-1495 12.

Jiang, M. and J. Milner. Selective silencing of viral gene expression in HPV-positive human cervical carcinoma cells treated with siRNA, a primer of RNA interference Oncogene Sep. 5, 2002 6041-6048 21.

Martinez, J., A. Patkaniowska, H. Urlaub, R. Luhrmann and T. Tuschl. Single-stranded antisense siRNAs guide target RNA cleavage in RNAi Cell Sep. 6, 2002 563-574 110.

Allshire, R. Molecular biology. RNAi and heterochromatin—a hushed-up affair Science Sep. 13, 2002 1818-1819 297.

Reinhart, B. J. and D. P. Bartel. Small RNAs correspond to centromere heterochromatic repeats Science Sep. 13, 2002 1831 297.

Volpe, T. A., C. Kidner, I. M. Hall, G. Teng, S. I. Grewal and R. A. Martienssen. Regulation heterochromatic silencing and histone H3 lysine-9 methylation by RNAi Science Sep. 13, 2002 1833-1837 297.

Baulcombe, D. DNA events. An RNA microcosm Science Sep. 20, 2002-2003 297.

Llave, C., Z. Xie, K. D. Kasschau and J. C. Carrington. Cleavage of Scarecrow-like mRNA targets directed by a class of *Arabidopsis* miRNA Science Sep. 20, 2002 2053-2056 297.

Mochizuki, K., N. A. Fine, T. Fujisawa and M. A. Gorovsky. Analysis of a piwi-related gene implicates small RNAs in genome rearrangement in tetrahymena Cell Sep. 20, 2002 689-699 110.

Hutvagner, G. and P. D. Zamore. A microRNA in a multiple-turnover RNAi enzyme complex Science Sep. 20, 2002 2056-2060 297.

Coburn, G. A. and B. R. Cullen. Potent and specific inhibition of human immunodeficiency virus type 1 replication by RNA interference J Virol Sep. 2002 9225-9231 76.

Caudy, A. A., M. Myers, G. J. Hannon and S. M. Hammond. Fragile X-related protein and VIG associate with the RNA interference machinery Genes Dev Oct. 1, 2002 2491-2496 16.

Ishizuka, A., M. C. Siomi and H. Siomi. A *Drosophila* fragile X protein interacts with components of RNAi and ribosomal proteins Genes Dev Oct. 1, 2002 2497-2508 16.

Voinnet, O. RNA silencing: small RNAs as ubiquitous regulators of gene expression Curr Opin Plant Biol Oct . 2002 444-451 5.

Golden, T. A., S. E. Schauer, J. D. Lang, S. Pien, A. R. Mushegian, U. Grossniklaus, D. W. Meinke and A. Ray. Short Integuments1/Suspensor1/Carpel Factory, a Dicer homolog, is a maternal effect gene required for embryo development in *Arabidopsis* Plant Physiol Oct. 2002 808-822 130.

Merkle, I., M. J. Van Ooij, F. J. Van Kuppeveld, D. H. Glaudemans, J. M. Galama, A. Henke, R. Zell and W. J. Melchers. Biological significance of a human enterovirus B-specific RNA element in the 3' nontranslated region J Virol Oct. 2002 9900-9909 76.

Froeyen, M. and P. Herdewijn. RNA as a target for drug design, the example of Tat-TAR interaction Curr Top Med Chem Oct. 2002 1123-1145 2.

Carmell, M. A., Z. Xuan, M. Q. Zhang and G. J. Hannon. The Argonaute family: tentacles that reach into RNAi, developmental control, stem cell maintenance, and tumorigenesis Genes Dev Nov. 1, 2002 2733-2742 16.

Provost, P., D. Dishart, J. Doucet, D. Frendewey, B. Samuelsson and O. Radmark. Ribonuclease activity and RNA binding of recombinant human Dicer Embo J Nov. 1, 2002 5864-5874 21.

Zhang, H., F. A. Kolb, V. Brondani, E. Billy and W. Filipowicz. Human Dicer preferentially cleaves dsRNAs at their termini without a requirement for ATP Embo J Nov. 1, 2002 5875-5885 21.

Mallory, A. C., B. J. Reinhart, D. Bartel, V. B. Vance and L. H. Bowman. A viral suppressor of RNA silencing differentially regulates the accumulation of short interfering RNAs and micro-RNAs in tobacco Proc Natl Acad Sci U S A Nov. 12, 2002 15228-15233 99.

Gottesman, S. Stealth regulation: biological circuits with small RNA switches Genes Dev Nov. 15, 2002 2829-2842 16.

Calin, G. A., C. D. Dumitru, M. Shimizu, R. Bichi, S. Zupo, E. Noch, H. Aldler, S. Rattan, M. Keating, K. Rai, L. Rassenti, T. Kipps, M. Negrini, F. Bullrich and C. M. Croce. Frequent deletions and downregulation of micro- RNA genes miR15 and miR16 at 13q14 in chronic lymphocytic leukemia Proc Natl Acad Sci U S A Nov. 26, 2002 15524-15529 99.

Gaudilliere, B., Y. Shi and A. Bonni. RNA interference reveals a requirement for myocyte enhancer factor 2A in activity-dependent neuronal survival J Biol Chem Nov. 29, 2002 46442-46446 277.

Jones, L. Revealing micro-RNAs in plants Trends Plant Sci Nov. 2002 473-475 7.

Schauer, S. E., S. E. Jacobsen, D. W. Meinke and A. Ray. DICER-LIKE1: blind men and elephants in *Arabidopsis* development Trends Plant Sci Nov. 2002 487-491 7.

Okazaki, Y., M. Furuno, T. Kasukawa, J. Adachi, H. Bono, S. Kondo, et al. Analysis of the mouse transcriptome based on functional annotation of 60,770 full-length cDNAs Nature Dec. 5, 2002 563-573 420.

Dennis, C. Small RNAs: the genome's guiding hand? Nature Dec. 19-26, 2002 732 420.

Uchida, N., S. Hoshino, H. Imataka, N. Sonenberg and T. Katada. A novel role of the mammalian GSPT/eRF3 associating with poly(A)-binding protein in Cap/Poly(A)-dependent translation J Biol Chem Dec. 27, 2002 50286-50292 277.

Huttenhofer, A., J. Brosius and J. P. Bachellerie. RNomics: identification and function of small, non-messenger RNAs Curr Opin Chem Biol Dec. 2002 835-843 6.

Wood, N. T. Unravelling the molecular basis of viral suppression of PTGS Trends Plant Sci 2002 384 7.

Cohen, O., C. Erb, D. Ginzberg, Y. Pollak, S. Seidman, S. Shoham, R. Yirmiya and H. Soreq. Neuronal overexpression of "readthrough" acetylcholinesterase is associated with antisense-suppressible behavioral impairments Mol Psychiatry *No date in pubmed* 2002 .874-885 7.

Mlotshwa, S., O. Voinnet, M. F. Mette, M. Matzke, H. Vaucheret, S. W. Ding, G. Pruss and V. B. Vance. RNA silencing and the mobile silencing signal Plant Cell *No date in pubmed* 2002 S289-301 14 Suppl.

Tang, G., B. J. Reinhart, D. P. Bartel and P. D. Zamore. A biochemical framework for RNA silencing in plants Genes Dev Jan. 1, 2003 49-63 17.

Kawasaki, H. and K. Taira. Short hairpin type of dsRNAs that are controlled by tRNA(Val) promoter significantly induce RNAi-mediated gene silencing in the cytoplasm of human cells Nucleic Acids Res Jan. 15, 2003 700-707 31.

Ashrafi, K., F. Y. Chang, J. L. Watts, A. G. Fraser, R. S. Kamath, J. Ahringer and G. Ruvkun. Genome-wide RNAi analysis of *Caenorhabditis elegans* fat regulatory genes Nature Jan. 16, 2003 268-272 421.

Kamath, R. S., A. G. Fraser, Y. Dong, G. Poulin, R. Durbin, M. Gotta, A. Kanapin, N. Le Bot, S. Moreno, M. Sohrmann, D. P. Welchman, P. Zipperlen and J. Ahringer. Systematic functional analysis of the *Caenorhabditis elegans* genome using RNAi Nature Jan. 16, 2003 231-237 421.

Tuschl, T. Functional genomics: RNA sets the standard Nature Jan. 16, 2003 220-221 421.

Iyer, L. M., E. V. Koonin and L. Aravind. Evolutionary connection between the catalytic subunits of DNA-dependent RNA polymerases and eukaryotic RNA-dependent RNA polymerases and the origin of RNA polymerases BMC Struct Biol Jan. 28, 2003 1 3.

Shi, Y. Mammalian RNAi for the masses Trends Genet Jan. 2003 9-12 19.

Cerutti, H. RNA interference: traveling in the cell and gaining functions? Trends Genet Jan. 2003 39-46 19.

Zeng, Y. and B. R. Cullen. Sequence requirements for micro RNA processing and function in human cells Rna Jan. 2003 112-123 9.

Kawasaki, H., E. Suyama, M. Iyo and K. Taira. siRNAs generated by recombinant human Dicer induce specific and significant but target site-independent gene silencing in human cells Nucleic Acids Res Feb. 1, 2003 981-987 31.

Reiner, A., D. Yekutieli and Y. Benjamini. Identifying differentially expressed genes using false discovery rate controlling procedures Bioinformatics Feb. 12, 2003 368-375 19.

Doench, J. G., C. P. Petersen and P. A. Sharp. siRNAs can function as miRNAs Genes Dev Feb. 15, 2003 438-442 17.

Gupta, V., A. Cherkassky, P. Chatis, R. Joseph, A. L. Johnson, J. Broadbent, T. Erickson and J. Dimeo. Directly labeled mRNA produces highly precise and unbiased differential gene expression data Nucleic Acids Res Feb. 15, 2003 e13 31.

Boffelli, D., J. McAuliffe, D. Ovcharenko, K. D. Lewis, I. Ovcharenko, L. Pachter and E. M. Rubin. Phylogenetic shadowing of primate sequences to find functional regions of the human genome Science Feb. 28, 2003 1391-1394 299.

Kasschau, K. D., Z. Xie, E. Allen, C. Llave, E. J. Chapman, K. A. Krizan and J. C. Carrington. P1/HC-Pro, a viral suppressor of RNA silencing, interferes with *Arabidopsis* development and miRNA unction Dev Cell Feb. 2003 205-217 4.

Carmell, M. A., L. Zhang, D. S. Conklin, G. J. Hannon and T. A. Rosenquist. Germline transmission of RNAi in mice Nat Struct Biol Feb. 2003 91-92 10.

Dostie, J., Z. Mourelatos, M. Yang, A. Sharma and G. Dreyfuss. Numerous microRNPs in neuronal cells containing novel microRNAs Rna Feb. 2003 180-186 9.

Lagos-Quintana, M., R. Rauhut, J. Meyer, A. Borkhardt and T. Tuschl. New microRNAs from mouse and human Rna Feb. 2003 175-179 9.

Wilson, J. A., S. Jayasena, A. Khvorova, S. Sabatinos, I. G. Rodrigue-Gervais, S. Arya, F. Sarangi, M. Harris-Brandts, S. Beaulieu and C. D. Richardson. RNA interference blocks gene expression and RNA synthesis from hepatitis C replicons propagated in human liver cells Proc Natl Acad Sci U S A Mar. 4, 2003 2783-2788 100.

Lim, L. P., M. E. Glasner, S. Yekta, C. B. Burge and D. P. Bartel. Vertebrate microRNA genes Science Mar. 7, 2003 1540 299.

Maniataki, E., A. E. Martinez De Alba, R. Sagesser, M. Tabler and M. Tsagris. Viroid RNA systemic spread may depend on the interaction of a 71-nucleotide bulged hairpin with the host protein VirP1 Rna Mar. 2003 346-354 9.

Ambros, V., B. Bartel, D. P. Bartel, C. B. Burge, J. C. Carrington, X. Chen, G. Dreyfuss, S. R. Eddy, S. Griffiths-Jones, M. Marshall, M. Matzke, G. Ruvkun and T. Tuschl. A uniform system for microRNA annotation Rna Mar. 2003 277-279 9.

Findley, S. D., M. Tamanaha, N. J. Clegg and H. Ruohola-Baker. Maelstrom, a *Drosophila* spindle-class gene, encodes a protein that colocalizes with Vasa and RDE1/AGO1 homolog, Aubergine, in nuage Development Mar. 2003 859-871 130.

Hershberg, R., S. Altuvia and H. Margalit. A survey of small RNA-encoding genes in *Escherichia coli* Nucleic Acids Res Apr. 1, 2003 1813-1820 31.

Zhou, A., S. Scoggin, R. B. Gaynor and N. S. Williams. Identification of NF-kappa B-regulated genes induced by TNFalpha utilizing expression profiling and RNA interference Oncogene Apr. 3, 2003 2054-2064 22.

Brennecke, J., D. R. Hipfner, A. Stark, R. B. Russell and S. M. Cohen. bantam encodes a developmentally regulated microRNA that controls cell proliferation and regulates the proapoptotic gene hid in *Drosophila* Cell Apr. 4, 2003 25-36 113.

Lim, L. P., N. C. Lau, E. G. Weinstein, A. Abdelhakim, S. Yekta, M. W. Rhoades, C. B. Burge and D. P. Bartel. The microRNAs of *Caenorhabditis elegans* Genes Dev Apr. 15, 2003 991-1008 17.

Xu, P., S. Y. Vernooy, M. Guo and B. A. Hay. The *Drosophila* microRNA Mir-14 suppresses cell death and is required for normal fat metabolism Curr Biol Apr. 29, 2003 790-795 13.

Xie, Z., K. D. Kasschau and J. C. Carrington. Negative feedback regulation of Dicer-Like1 in *Arabidopsis* by microRNA-guided mRNA degradation Curr Biol Apr. 29, 2003 784-789 13.

Carmichael, G. G. Antisense starts making more sense Nat Biotechnol Apr. 2003 371-372 21.

Yelin, R., D. Dahary, R. Sorek, E. Y. Levanon, O. Goldstein, A. Shoshan, A. Diber, S. Biton, Y. Tamir, R. Khosravi, S. Nemzer, E. Pinner, S. Walach, J. Bernstein, K. Savitsky and G. Rotman. Widespread occurrence of antisense transcription in the human genome Nat Biotechnol Apr. 2003 379-386 21.

Boutet, S., F. Vazquez, J. Liu, C. Beclin, M. Fagard, A. Gratias, J. B. Morel, P. Crete, X. Chen and H. Vaucheret. *Arabidopsis* HEN1: a genetic link between endogenous miRNA controlling development and siRNA controlling transgene silencing and virus resistance Curr Biol May 13, 2003 843-848 13.

Ambros, V., R. C. Lee, A. Lavanway, P. T. Williams and D. Jewell. MicroRNAs and other tiny endogenous RNAs in *C. elegans* Curr Biol May 13, 2003 807-818 13.

Liang, X. S., J. Q. Lian, Y. X. Zhou, Q. H. Nie and C. Q. Hao. A small yeast RNA inhibits HCV IRES mediated translation and inhibits replication of poliovirus in vivo World J Gastroenterol May 2003 1008-1013 9.

Grad, Y., J. Aach, G. D. Hayes, B. J. Reinhart, G. M. Church, G. Ruvkun and J. Kim. Computational and experimental identification of *C. elegans* microRNAs Mol Cell May 2003 1253-1263 11.

Abrahante, J. E., A. L. Daul, M. Li, M. L. Volk, J. M. Tennessen, E. A. Miller and A. E. Rougvie. The *Caenorhabditis elegans* hunchback-like gene lin-57/hbl-1 controls developmental time and is regulated by microRNAs Dev Cell May 2003 625-637 4.

Lin, S. Y., S. M. Johnson, M. Abraham, M. C. Vella, A. Pasquinelli, C. Gamberi, E. Gottlieb and F. J. Slack. The *C elegans* hunchback homolog, hbl-1, controls temporal patterning and is a probable microRNA target Dev Cell May 2003 639-650 4.

Zamvil, S. S. and L. Steinman. Diverse targets for intervention during inflammatory and neurodegenerative phases of multiple sclerosis Neuron Jun. 5, 2003 685-688 38.

Ambros, V. MicroRNA pathways in flies and worms: growth, death, fat, stress, and timing Cell Jun. 13, 2003 673-676 113.

Moss, E. G. and L. Tang. Conservation of the heterochronic regulator Lin-28, its developmental expression and microRNA complementary sites Dev Biol Jun. 15, 2003 432-442 258.

Smalheiser, N. R. EST analyses predict the existence of a population of chimeric microRNA precursor-mRNA transcripts expressed in normal human and mouse tissues Genome Biol Epub 2003 Jun. 18, 2003 403 4.

Kawasaki, H. and K. Taira. Hes1 is a target of microRNA-23 during retinoic-acid-induced neuronal differentiation of NT2 cells Nature Jun. 19, 2003 838-842 423.

Lai, E. C., P. Tomancak, R. W. Williams and G. M. Rubin. Computational identification of *Drosophila* microRNA genes Genome Biol Epub 2003 Jun. 30, 2003 R42 4.

No author listed. Whither RNAi? Nat Cell Biol Jun. 2003 489-490 5.

Bartel, B. and D. P. Bartel. MicroRNAs: at the root of plant development? Plant Physiol Jun. 2003 709-717 132.

Dykxhoorn, D. M., C. D. Novina and P. A. Sharp. Killing the messenger: short RNAs that silence gene expression Nat Rev Mol Cell Biol Jun. 2003 457-467 4.

Saunders, L. R. and G. N. Barber. The dsRNA binding protein family: critical roles, diverse cellular functions Faseb J Jun. 2003 961-983 17.

Steinman, L. and S. Zamvil. Transcriptional analysis of targets in multiple sclerosis Nat Rev Immunol Jun. 2003 483-492 3.

Qi, Y. and B. Ding. Inhibition of cell growth and shoot development by a specific nucleotide sequence in a noncoding viroid RNA Plant Cell Jun. 2003 1360-1374 15.

Jackson, A. L., S. R. Bartz, J. Schelter, S. V. Kobayashi, J. Burchard, M. Mao, B. Li, G. Cavet and P. S. Linsley. Expression profiling reveals off-target gene regulation by RNAi Nat Biotechnol Jun. 2003 635-637 21.

Bashirullah, A., A. E. Pasquinelli, A. A. Kiger, N. Perrimon, G. Ruvkun and C. S. Thummel. Coordinate regulation of small temporal RNAs at the onset of *Drosophila* metamorphosis Dev Biol Jul. 1, 2003 1-8 259.

Sempere, L. F., N. S. Sokol, E. B. Dubrovsky, E. M. Berger and V. Ambros. Temporal regulation of microRNA expression in *Drosophila melanogaster* mediated by hormonal signals and broad-Complex gene activity Dev Biol Jul. 1, 2003 9-18 259.

Heetebrij, R. J., E. G. Talman, M. A. V Velzen, R. P. Van Gijlswijk, S. S. Snoeijers, M. Schalk, J. Wiegant, F. V D Rijke, R. M. Kerkhoven, A. K. Raap, H. J. Tanke, J. Reedijk and H. J. Houthoff. Platinum(II)-based coordination compounds as nucleic acid labeling reagents: synthesis, reactivity, and applications in hybridization assays Chembiochem Jul. 7, 2003 573-583 4.

Borodina, T. A., H. Lehrach and A. V. Soldatov. Ligation-based synthesis of oligonucleotides with block structure Anal Biochem Jul. 15, 2003 309-313 318.

Johnson, S. M., S. Y. Lin and F. J. Slack. The time of appearance of the *C. elegans* let-7 microRNA is transcriptionally controlled utilizing a temporal regulatory element in its promoter Dev Biol Jul. 15, 2003 364-379 259.

Carrington, J. C. and V. Ambros. Role of microRNAs in plant and animal development Science Jul. 18, 2003 336-338 301.

Smale, S. T. The establishment and maintenance of lymphocyte identity through gene silencing Nat Immunol Jul. 2003 607-615 4.

Bridge, A. J., S. Pebernard, A. Ducraux, A. L. Nicoulaz and R. Iggo. Induction of an interferon response by RNAi vectors in mammalian cells Nat Genet Jul. 2003 263-264 34.

Seitz, H., N. Youngson, S. P. Lin, S. Dalbert, M. Paulsen, J. P. Bachellerie, A. C. Ferguson-Smith and J. Cavaille. Imprinted microRNA genes transcribed antisense to a reciprocally imprinted retrotransposon-like gene Nat Genet Jul. 2003 261-262 34.

Zeng, Y., R. Yi and B. R. Cullen. MicroRNAs and small interfering RNAs can inhibit mRNA expression by similar mechanisms Proc Natl Acad Sci U S A Aug. 19, 2003 9779-9784 100.

Schramke, V. and R. Allshire. Hairpin RNAs and retrotransposon LTRs effect RNAi and chromatin-based gene silencing Science Aug. 22, 2003 1069-1074 301.

Wiznerowicz, M. and D. Trono. Conditional suppression of cellular genes: lentivirus vector-mediated drug-inducible RNA interference J Virol Aug. 2003 8957-8961 77.

Lau, N. C. and D. P. Bartel. Censors of the genome Sci Am Aug. 2003 34-41 289.

Houbaviy, H. B., M. F. Murray and P. A. Sharp. Embryonic stem cell-specific MicroRNAs Dev Cell Aug. 2003 351-358 5.

Aravin, A. A., M. Lagos-Quintana, A. Yalcin, M. Zavolan, D. Marks, B. Snyder, T. Gaasterland, J. Meyer and T. Tuschl. The small RNA profile during *Drosophila melanogaster* development Dev Cell Aug. 2003 337-350 5.

McManus, M. T. MicroRNAs and cancer Semin Cancer Biol Aug. 2003 253-258 13.

Baner, J., A. Isaksson, E. Waldenstrom, J. Jarvius, U. Landegren and M. Nilsson. Parallel gene analysis with allele-specific padlock probes and tag microarrays Nucleic Acids Res Sep. 1, 2003 e103 31.

Boutla, A., C. Delidakis and M. Tabler. Developmental defects by antisense-mediated inactivation of micro-RNAs 2 and 13 in *Drosophila* and the identification of putative target genes Nucleic Acids Res Sep. 1, 2003 4973-4980 31.

Palatnik, J. F., E. Allen, X. Wu, C. Schommer, R. Schwab, J. C. Carrington and D. Weigel. Control of leaf morphogenesis by microRNAs Nature Sep. 18, 2003 257-263 425.

Klein, R. J. and S. R. Eddy. Rsearch: finding homologs of single structured RNA sequences BMC Bioinformatics Sep. 22, 2003 44 4.

Caudy, A. A., R. F. Ketting, S. M. Hammond, A. M. Denli, A. M. Bathoorn, B. B. Tops, J. M. Silva, M. M. Myers, G. J. Hannon and R. H. Plasterk. A micrococcal nuclease homologue in RNAi effector complexes Nature Sep. 25, 2003 411-414 425.

Lee, Y., C. Ahn, J. Han, H. Choi, J. Kim, J. Yim, J. Lee, P. Provost, O. Radmark, S. Kim and V. N. Kim. The nuclear RNase III Drosha initiates microRNA processing Nature Sep. 25, 2003 415-419 425.

Sledz, C. A., M. Holko, M. J. De Veer, R. H. Silverman and B. R. Williams. Activation of the interferon system by short-interfering RNAs Nat Cell Biol Sep. 2003 834-839 5.

Bergmann, A. and M. E. Lane. HIDden targets of microRNAs for growth control Trends Biochem Sci Sep. 2003 461-463 28.

Khvorova, A., A. Reynolds and S. D. Jayasena. Functional siRNAs and miRNAs exhibit strand bias Cell Oct. 17, 2003 209-216 115.

Schwarz, D. S., G. Hutvagner, T. Du, Z. Xu, N. Aronin and P. D. Zamore. Asymmetry in the assembly of the RNAi enzyme complex Cell Oct. 17, 2003 199-208 115.

Abbott, A. L. Heterochronic genes Curr Biol Oct. 28, 2003 R824-825 13.

Hake, S. MicroRNAs: a role in plant development Curr Biol Oct. 28, 2003 R851-852 13.

Carthew, R. W. Making and breaking with nucleases and small RNAs Nat Struct Biol Oct. 2003 776-777 10.

Krichevsky, A. M., K. S. King, C. P. Donahue, K. Khrapko and K. S. Kosik. A microRNA array reveals extensive regulation of microRNAs during brain development Rna Oct. 2003 1274-1281 9.

Mattick, J. S. Challenging the dogma: the hidden layer of non-protein-coding RNAs in complex organisms Bioessays Oct. 2003 930-939 25.

Nelson, P., M. Kiriakidou, A. Sharma, E. Maniataki and Z. Mourelatos. The microRNA world: small is mighty Trends Biochem Sci Oct. 2003 534-540 28.

Michael, M. Z., O. C. SM, N. G. Van Holst Pellekaan, G. P. Young and R. J. James. Reduced accumulation of specific microRNAs in colorectal neoplasia Mol Cancer Res Oct. 2003 882-891 1.

Allinson, T. M., E. T. Parkin, A. J. Turner and N. M. Hooper. Adams family members as amyloid precursor protein alpha-secretases J Neurosci Res Nov. 1, 2003 342-352 74.

Kawasaki, H. and K. Taira. Retraction: Hes1 is a target of microRNA-23 during retinoic-acid-induced neuronal differentiation of NT2 cells Nature Nov. 6, 2003 100 426.

Saxena, S., Z. O. Jonsson and A. Dutta. Small RNAs with imperfect match to endogenous mRNA repress translation. Implications for off-target activity of small inhibitory RNA in mammalian cells J Biol Chem Nov. 7, 2003 44312-44319 278.

Basyuk, E., F. Suavet, A. Doglio, R. Bordonne and E. Bertrand. Human let-7 stem-loop precursors harbor features of RNase III cleavage products Nucleic Acids Res Nov. 15, 2003 6593-6597 31.

Stevenson, M. Dissecting HIV-1 through RNA interference Nat Rev Immunol Nov. 2003 851-858 3.

Wienholds, E., M. J. Koudijs, F. J. Van Eeden, E. Cuppen and R. H. Plasterk. The microRNA-producing enzyme Dicer1 is essential for zebrafish development Nat Genet Nov. 2003 217-218 35.

Gibbs, W. W. The unseen genome: gems among the junk Sci Am Nov. 2003 26-33 289.

Chang, J., P. Provost and J. M. Taylor. Resistance of human hepatitis delta virus RNAs to dicer activity J Virol Nov. 2003 11910-11917 77.

Wang, D., A. Urisman, Y. T. Liu, M. Springer, T. G. Ksiazek, D. D. Erdman, E. R. Mardis, M. Hickenbotham, V. Magrini, J. Eldred, J. P. Latreille, R. K. Wilson, D. Ganem and J. L. Derisi. Viral discovery and sequence recovery using DNA microarrays PLoS Biol Nov. 2003 E2 1.

Aukerman, M. J. and H. Sakai. Regulation of flowering time and floral organ identity by a MicroRNA and its APETALA2-like target genes Plant Cell Nov. 2003 2730-2741 15.

Finnegan, E. J. and M. A. Matzke. The small RNA world J Cell Sci Dec. 1, 2003 4689-4693 116.

Enright, A. J., B. John, U. Gaul, T. Tuschl, C. Sander and D. S. Marks. MicroRNA targets in *Drosophila* Genome Biol Epub 2003 Dec. 12, 2003 R1 5.

Rosok, O. and M. Sioud. Systematic identification of sense-antisense transcripts in mammalian cells Nat Biotechnol Jan (Epub Dec. 14, 2003) 2004 104-108 22.

Yi, R., Y. Qin, I. G. Macara and B. R. Cullen. Exportin-5 mediates the nuclear export of pre-microRNAs and short hairpin RNAs Genes Dev Dec. 15, 2003 3011-3016 17.

Cao, X., W. Aufsatz, D. Zilberman, M. F. Mette, M. S. Huang, M. Matzke and S. E. Jacobsen. Role of the DRM and CMT3 methyltransferases in RNA-directed DNA methylation Curr Biol Dec. 16, 2003 2212-2217 13.

Ye, K., L. Malinina and D. J. Patel. Recognition of small interfering RNA by a viral suppressor of RNA silencing Nature Dec. 18, 2003 874-878 426.

Johnston, R. J. and O. Hobert. A microRNA controlling left/right neuronal asymmetry in *Caenorhabditis elegans* Nature Dec. 18, 2003 845-849 426.

Xayaphoummine, A., T. Bucher, F. Thalmann and H. Isambert. Prediction and statistics of pseudoknots in RNA structures using exactly clustered stochastic simulations Proc Natl Acad Sci U S A Dec. 23, 2003 15310-15315 100.

Lewis, B. P., I. H. Shih, M. W. Jones-Rhoades, D. P. Bartel and C. B. Burge. Prediction of mammalian microRNA targets Cell Dec. 26, 2003 787-798 115.

Robinson, W. H., P. J. Utz and L. Steinman. Genomic and proteomic analysis of multiple sclerosis. Opinion Curr Opin Immunol Dec. 2003 660-667 15.

Gibbs, W. W. The unseen genome: beyond DNA Sci Am Dec. 2003 106-113 289.

Stark, A., J. Brennecke, R. B. Russell and S. M. Cohen. Identification of *Drosophila* MicroRNA targets PLoS Biol Dec. 2003 E60 1.

Stein, T. D. and J. A. Johnson. Genetic programming by the proteolytic fragments of the amyloid precursor protein: somewhere between confusion and clarity Rev Neurosci *no date in pubmed* 2003 317-341 14.

Szymanski, M., M. Z. Barciszewska, M. Zywicki and J. Barciszewski. Noncoding RNA transcripts J Appl Genet *No Datein Pubmed* 2003 1-19 44.

Griffiths-Jones, S. The microRNA Registry Nucleic Acids Res Jan. 1, 2004 D109-111 32.

Chen, C. Z., L. Li, H. F. Lodish and D. P. Bartel. MicroRNAs modulate hematopoietic lineage differentiation Science Jan. 2, 2004 83-86 303.

Kim, J., A. Krichevsky, Y. Grad, G. D. Hayes, K. S. Kosik, G. M. Church and G. Ruvkun. Identification of many microRNAs that copurify with polyribosomes in mammalian neurons Proc Natl Acad Sci U S A Jan. 6, 2004 360-365 101.

Ohno, M., E. A. Sametsky, L. H. Younkin, H. Oakley, S. G. Younkin, M. Citron, R. Vassar and J. F. Disterhoft. BACE1 deficiency rescues memory deficits and cholinergic dysfunction in a mouse model of Alzheimer's disease Neuron Jan. 8, 2004 27-33 41.

Vella, M. C., E. Y. Choi, S. Y. Lin, K. Reinert and F. J. Slack. The C. elegans microRNA let-7 binds to imperfect let-7 complementary sites from the lin-41 3'UTR Genes Dev Jan. 15, 2004 132-137 18.

Kao, S. C., A. M. Krichevsky, K. S. Kosik and L. H. Tsai. BACE1 suppression by RNA interference in primary cortical neurons J Biol Chem Jan. 16, 2004 1942-1949 279.

Hofacker, I. L., B. Priwitzer and P. F. Stadler. Prediction of locally stable RNA secondary structures for genome-wide surveys Bioinformatics Jan. 22, 2004 186-190 20.

Ruvkun, G., B. Wightman and I. Ha. The 20.years it took to recognize the importance of tiny RNAs Cell Jan. 23, 2004 S93-96, 92 p following S96 116.

Bartel, D. P. MicroRNAs: genomics, biogenesis, mechanism, and function Cell Jan. 23, 2004 281-297 116.

Han, M. H., S. Goud, L. Song and N. Fedoroff. The Arabidopsis double-stranded RNA-binding protein HYL1 plays a role in microRNA-mediated gene regulation Proc Natl Acad Sci U S A Jan. 27, 2004 1093-1098 101.

Hartig, J. S., I. Grune, S. H. Najafi-Shoushtari and M. Famulok. Sequence-specific detection of MicroRNAs by signal-amplifying ribozymes J Am Chem Soc Jan. 28, 2004 722-723 126.

Nishitsuji, H., T. Ikeda, H. Miyoshi, T. Ohashi, M. Kannagi and T. Masuda. Expression of small hairpin RNA by lentivirus-based vector confers efficient and stable gene-suppression of HIV-1 on human cells including primary non-dividing cells Microbes Infect Jan. 2004 76-85 6.

Ota, T., Y. Suzuki, T. Nishikawa, T. Otsuki, T. Sugiyama, R. Irie, A., et al. Complete sequencing and characterization of 21,243 full-length human cDNAs Nat Genet Jan. 2004 40-45 36.

Colciaghi, F., E. Marcello, B. Borroni, M. Zimmermann, C. Caltagirone, F. Cattabeni, A. Padovani and M. Di Luca. Platelet APP, ADAM 10 and BACE alterations in the early stages of Alzheimer disease Neurology Feb. 10, 2004 498-501 62.

Boden, D., O. Pusch, R. Silbermann, F. Lee, L. Tucker and B. Ramratnam. Enhanced gene silencing of HIV-1 specific siRNA using microRNA designed hairpins Nucleic Acids Res Feb. 13, 2004 1154-1158 32.

Sempere, L. F., S. Freemantle, I. Pitha-Rowe, E. Moss, E. Dmitrovsky and V. Ambros. Expression profiling of mammalian microRNAs uncovers a subset of brain-expressed microRNAs with possible roles in murine and human neuronal differentiation Genome Biol Epub 2004 Feb. 16, 2004 R13 5.

Scacheri, P. C., O. Rozenblatt-Rosen, N. J. Caplen, T. G. Wolfsberg, L. Umayam, J. C. Lee, C. M. Hughes, K. S. Shanmugam, A. Bhattacharjee, M. Meyerson and F. S. Collins. Short interfering RNAs can induce unexpected and divergent changes in the levels of untargeted proteins in mammalian cells Proc Natl Acad Sci U S A Feb. 17, 2004 1892-1897 101.

Xie, Z., L. K. Johansen, A. M. Gustafson, K. D. Kasschau, A. D. Lellis, D. Zilberman, S. E. Jacobsen and J. C. Carrington. Genetic and functional diversification of small RNA pathways in plants PLoS Biol May (Epub Feb. 18, 2004) 2004 E104 2.

Cawley, S., S. Bekiranov, H. H. Ng, P. Kapranov, E. A. Sekinger, D. Kampa, A. Piccolboni, V. Sementchenko, J. Cheng, A. J. Williams, R. Wheeler, B. Wong, J. Drenkow, M. Yamanaka, S. Patel, S. Brubaker, H. Tammana, G. Helt, K. Struhl and T. R. Gingeras. Unbiased mapping of transcription factor binding sites along human chromosomes 21 and 22 points to widespread regulation of noncoding RNAs Cell Feb. 20, 2004 499-509 116.

Dandekar, D. H., K. N. Ganesh and D. Mitra. HIV-1 Tat directly binds to NFkappaB enhancer sequence: role in viral and cellular gene expression Nucleic Acids Res Feb. 23, 2004 1270-1278 32.

Hutvagner, G., M. J. Simard, C. C. Mello and P. D. Zamore. Sequence-specific inhibition of small RNA function PLoS Biol Apr (Epub Feb. 24, 2004) 2004 E98 2.

Schmittgen, T. D., J. Jiang, Q. Liu and L. Yang. A high-throughput method to monitor the expression of microRNA precursors Nucleic Acids Res. Feb. 25, 2004 e43 32.

Stremlau, M., C. M. Owens, M. J. Perron, M. Kiessling, P. Autissier and J. Sodroski. The cytoplasmic body component TRIM5alpha restricts HIV-1 infection in Old World monkeys Nature Feb. 26, 2004 848-853 427.

Bohnsack, M. T., K. Czaplinski and D. Gorlich. Exportin 5 is a RanGTP-dependent dsRNA-binding protein that mediates nuclear export of pre-miRNAs Rna Feb. 2004 185-191 10.

Demidov, V. V. and M. D. Frank-Kamenetskii. Two sides of the coin: affinity and specificity of nucleic acid interactions Trends Biochem Sci Feb. 2004 62-71 29.

Maquat, L. E. Nonsense-mediated mRNA decay: splicing, translation and mRNP dynamics Nat Rev Mol Cell Biol Feb. 2004 89-99 5.

Nijholt, I., N. Farchi, M. Kye, E. H. Sklan, S. Shoham, B. Verbeure, D. Owen, B. Hochner, J. Spiess, H. Soreq and T. Blank. Stress-induced alternative splicing of acetylcholinesterase results in enhanced fear memory and long-term potentiation Mol Psychiatry Feb. 2004 174-183 9.

Sengupta, P. Taking sides in the nervous system with miRNA Nat Neurosci Feb. 2004 100-102 7.

Zerhouni, B., J. A. Nelson and K. Saha. Isolation of CD4-independent primary human immunodeficiency virus type 1 isolates that are syncytium inducing and acutely cytopathic for CD8+ lymphocytes J Virol Feb. 2004 1243-1255 78.

Jin, P., D. C. Zarnescu, S. Ceman, M. Nakamoto, J. Mowrey, T. A. Jongens, D. L. Nelson, K. Moses and S. T. Warren. Biochemical and genetic interaction between the fragile X mental retardation protein and the microRNA pathway Nat Neurosci Feb. 2004 113-117 7.

Lai, E. C., C. Wiel and G. M. Rubin. Complementary miRNA pairs suggest a regulatory role for miRNA:miRNA duplexes Rna Feb. 2004 171-175 10.

Metzler, M., M. Wilda, K. Busch, S. Viehmann and A. Borkhardt. High expression of precursor microRNA-155/BIC RNA in children with Burkitt lymphoma Genes Chromosomes Cancer Feb. 2004 167-169 39.

Doench, J. G. and P. A. Sharp. Specificity of microRNA target selection in translational repression Genes Dev Mar. 1, 2004 504-511 18.

Liang, X. S., J. O. Lian, Y. X. Zhou and M. B. Wan. Inhibitor RNA blocks the protein translation mediated by hepatitis C virus internal ribosome entry site in vivo World J Gastroenterol Mar. 1, 2004 664-667 10.

Calin, G. A., C. Sevignani, C. D. Dumitru, T. Hyslop, E. Noch, S. Yendamuri, M. Shimizu, S. Rattan, F. Bullrich, M. Negrini and C. M. Croce. Human microRNA genes are frequently located at fragile sites and genomic regions involved in cancers Proc Natl Acad Sci U S A Mar. 2, 2004 2999-3004 101.

Juarez, M. T., J. S. Kui, J. Thomas, B. A. Heller and M. C. Timmermans. microRNA-mediated repression of rolled leaf1 specifies maize leaf polarity Nature Mar. 4, 2004 84-88 428.

Kidner, C. A. and R. A. Martienssen. Spatially restricted microRNA directs leaf polarity through ARGONAUTE1 Nature Mar. 4, 2004 81-84 428.

Zamore, P. D. Plant RNAi: How a viral silencing suppressor inactivates siRNA Curr Biol Mar. 9, 2004 R198-200 14.

Wang, J. F., H. Zhou, Y. Q. Chen, Q. J. Luo and L. H. Qu. Identification of 20 microRNAs from Oryza sativa Nucleic Acids Res Mar. 12, 2004 1688-1695 32.

Jack, T. Molecular and genetic mechanisms of floral control Plant Cell Epub 2004 Mar. 12, 2004 S1-17 16 Suppl.

Roth, M. E., L. Feng, K. J. McConnell, P. J. Schaffer, C. E. Guerra, J. P. Affourtit, K. R. Piper, L. Guccione, J. Hariharan, M. J. Ford, S. W. Powell, H. Krishnaswamy, J. Lane, L. Guccione, G. Intrieri, J. S.

Merkel, C. Perbost, A. Valerio, B. Zolla, C. D. Graham, J. Hnath, C. Michaelson, R. Wang, B. Ying, C. Halling, C. E. Parman, D. Raha, B. Orr, B. Jedrzkiewicz, J. Liao, a. Tevelev, M. J. Mattessich, D. M. Kranz, M. Lacey, J. C. Kaufman, J. Kim, D. R. Latimer and P. M. Lizardi. Expression profiling using a hexamer-based universal microarray Nat Biotechnol Apr (Epub Mar. 14, 2004) 2004 418-426 22.

Rajewsky, N. and N. D. Socci. Computational identification of microRNA targets Dev Biol Mar. 15, 2004 529-535 267.

Winkler, W. C., A. Nahvi, A. Roth, J. A. Collins and R. R. Breaker. Control of gene expression by a natural metabolite-responsive ribozyme Nature Mar. 18, 2004 281-286 428.

Kuwabara, T., J. Hsieh, K. Nakashima, K. Taira and F. H. Gage. A small modulatory dsRNA specifies the fate of adult neural stem cells Cell Mar. 19, 2004 779-793 116.

Chen, X. A microRNA as a translational repressor of APETALA2 in Arabidopsis flower development Science Mar. 26, 2004 2022-2025 303.

Carmell, M. A. and G. J. Hannon. RNase III enzymes and the initiation of gene silencing Nat Struct Mol Biol Mar. 2004 214-218 11.

Davidson, B. L. and H. L. Paulson. Molecular medicine for the brain: silencing of disease genes with RNA interference Lancet Neurol Mar. 2004 145-149 3.

Kawasaki, H., R. Wadhwa and K. Taira. World of small RNAs: from ribozymes to siRNA and miRNA Differentiation Mar. 2004 58-64 72.

Meister, G., M. Landthaler, Y. Dorsett and T. Tuschl. Sequence-specific inhibition of microRNA- and siRNA-induced RNA silencing Rna Mar. 2004 544-550 10.

Nelson, P. T., A. G. Hatzigeorgiou and Z. Mourelatos. miRNP:mRNA association in polyribosomes in a human neuronal cell line Rna Mar. 2004 387-394 10.

Floyd, S. K. and J. L. Bowman. Gene regulation: ancient microRNA target sequences in plants Nature Apr. 1, 2004 485-486 428.

Dorsett, Y. and T. Tuschl. siRNAs: applications in functional genomics and potential as therapeutics Nat Rev Drug Discov Apr. 2004 318-329 3.

Mallory, A. C. and H. Vaucheret. MicroRNAs: something important between the genes Curr Opin Plant Biol Apr. 2004 120-125 7.

Ogita, S., H. Uefuji, M. Morimoto and H. Sano. Application of RNAi to confirm theobromine as the major intermediate for caffeine biosynthesis in coffee plants with potential for construction of decaffeinated varieties Plant Mol Biol Apr. 2004 931-941 54.

Storz, G., J. A. Opdyke and A. Zhang. Controlling mRNA stability and translation with small, noncoding RNAs Curr Opin Microbiol Apr. 2004 140-144 7.

Kim, V. N. MicroRNA precursors in motion: exportin-5 mediates their nuclear export Trends Cell Biol Apr. 2004 156-159 14.

Jabri, E. RISCy business Nat Struct Mol Biol Apr. 2004 300 11.

Nakahara, K. and R. W. Carthew. Expanding roles for miRNAs and siRNAs in cell regulation Curr Opin Cell Biol Apr. 2004 127-133 16.

Harley VR et al. Endocrine Reviews 2003;24(4):466-487.

Brennecke J. PLoS Biology 2005;3(3):e85.

Doench JG and Sharp PA. Genes Dev, 2004;18(5):504-11.

Enright AJ. Genome Biology 2003;5:R1.

Lai EC. Nature Genetics 2002;30:363-4.

Lai EC. Genome Biology 2004;5:115.

Lewis BP. Cell 2003;115:787-98.

Stark A. PLoS Biology 2003;1(3):397-409.

Vella MC. Chemistry & Biology 2004;11:1619-23.

Wagner CK et al. Endocrinology 2004;145(3):1046-9.

\* cited by examiner

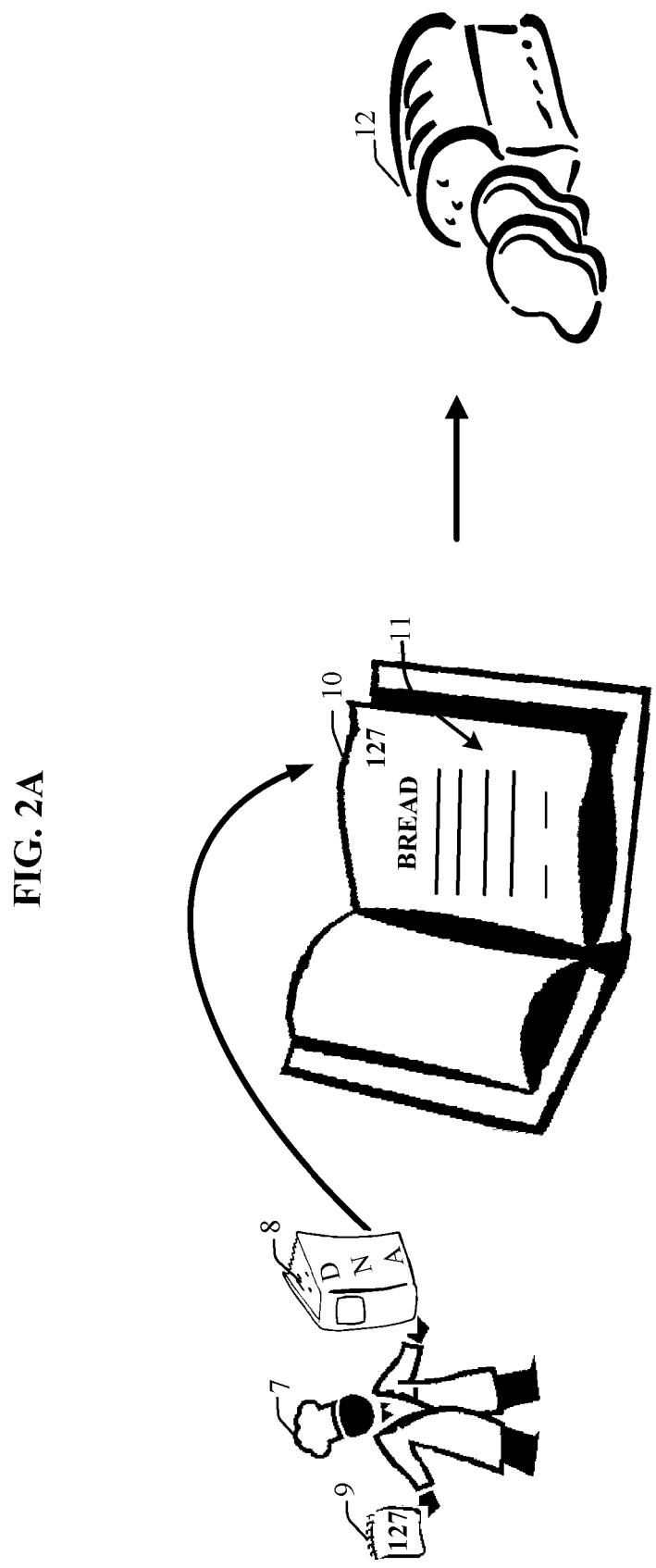

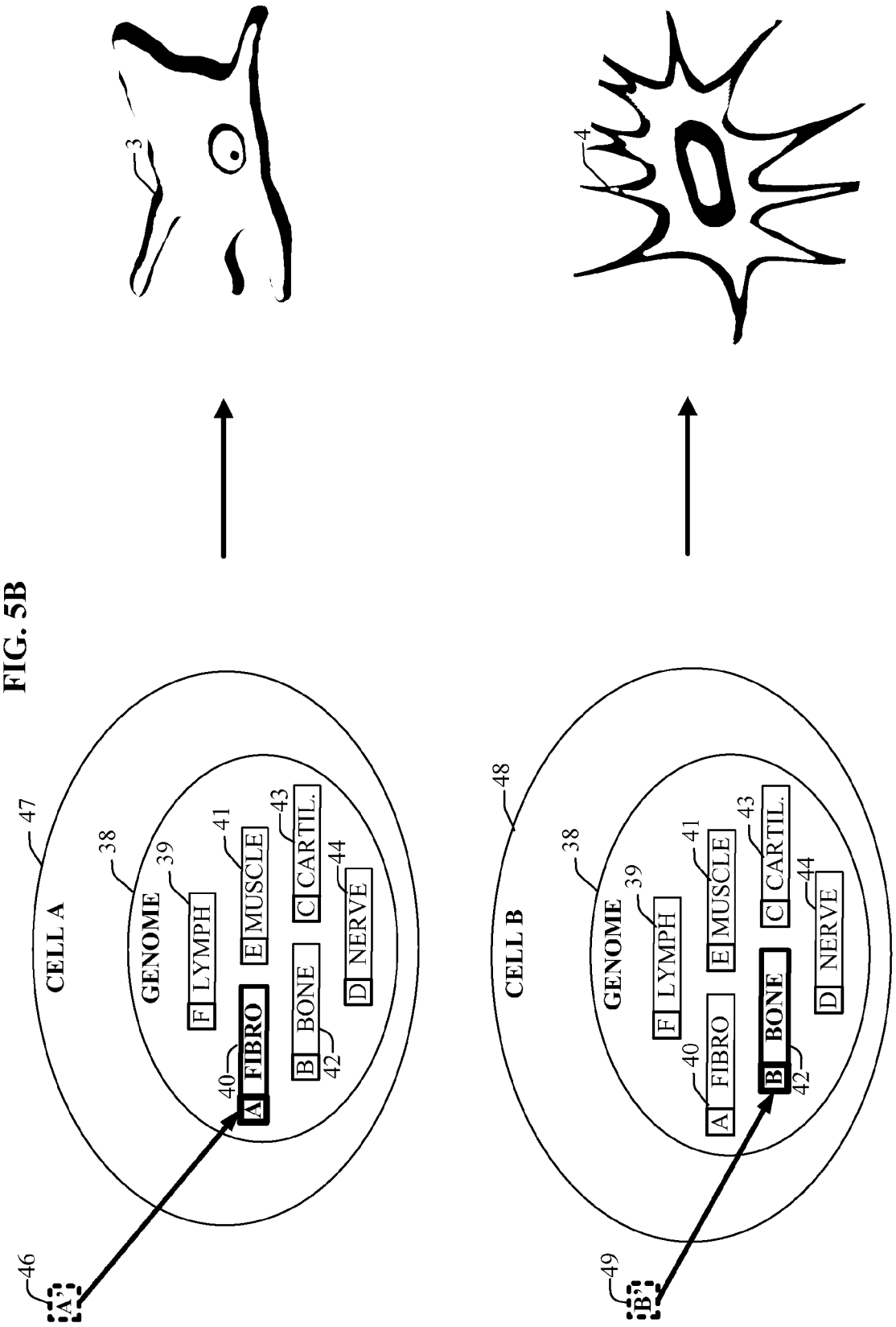

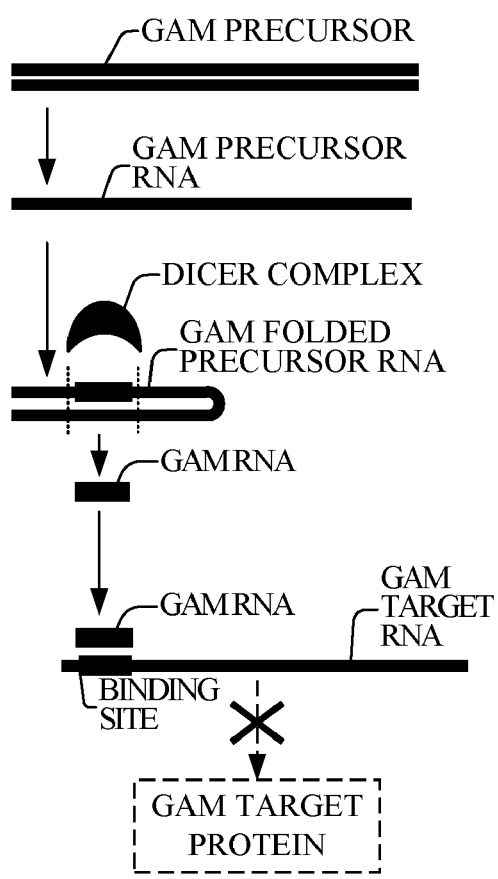
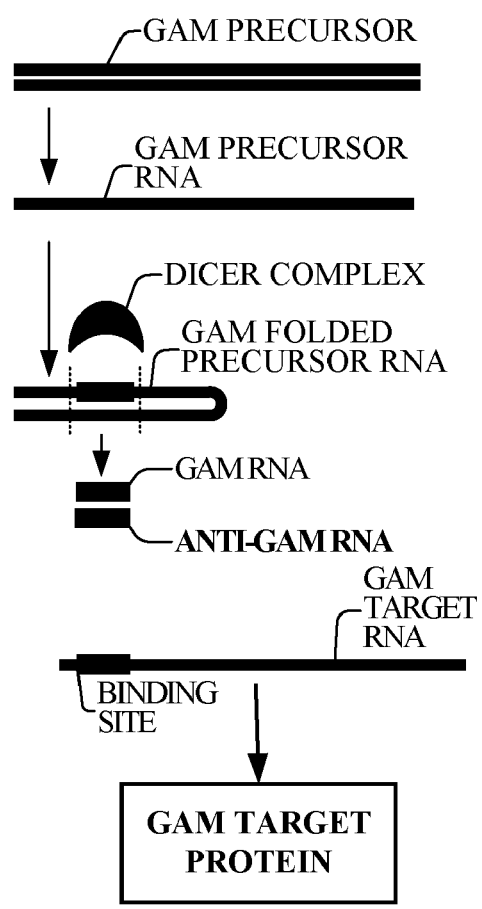
FIG. 20A
FIG. 20B

FIG. 21B

| GAM Detection Group | Published Hairpins Detection | Background Hairpins Filtering | Lab Validation of Human GAMs | | |
|---|---|---|---|---|---|
| | | | Sent | Positive | % Success |
| A | 382 | ~2850000 (95 %) | 101 | 37 | 37% |
| Overall | 440 | ~3000000 | 168 | 52 | 31% |

FIG.22B

| NUMBER | NAME | SEQ ID NO | SEQUENCE (5 TO 3) | SEQUENCED |
|---|---|---|---|---|
| 1 | has-miR-21 | 2254511 | TAGCTTATCAGACTGATGTTGA | + |
| 2 | has-miR-27b | 2254512 | TTCACAGTGGCTAAGTTCTGCA | + |
| 3 | has-miR-186 | 2254513 | AAAGAATTCTCCTTTTGGGCTT | + |
| 4 | has-miR-93 | 2254514 | AAGTGCTGTTCGTGCAGGTAGT | + |
| 5 | has-miR-26a | 2254515 | TCAAGTAATCCAGGATAGGCTG | + |
| 6 | has-miR-191 | 2254516 | AACGGAATCCCAAAAGCAGCTG | + |
| 7 | has-miR-31 | 2254517 | GGCAAGATGCTGGCATAGCTGT | + |
| 8 | has-miR-92 | 2254518 | TATTGCACTTGTCCCGGCCTGT | + |
| 9 | GAM3418-A | 2254519 | ATCACATTGCCAGGGATTACCA | + |
| 10 | GAM26-A | 2254520 | GAAGTTTGAAGCCTGTTGTTCA | + |
| 11 | GAM281-A | 2254521 | CACTGCACTCCAGCCTGGGCAA | |
| 12 | GAM7553-A | 2254522 | TAGGTAGTTTCCTGTTGTTGGG | + |
| 13 | GAM5385-A | 2254523 | TCACAGTGAACCGGTCTCTTTC | + |
| 14 | GAM2608-A | 2254524 | TAAGGTGCATCTAGTGCAGTTA | |
| 15 | GAM1032-A | 2254525 | CTAGACTGAAGCTCCTTGAGGA | + |
| 16 | GAM3431-A | 2254526 | TAATACTGCCGGGTAATGATGG | |
| 17 | GAM7933-A | 2254527 | TAGCAGCACATAATGGTTTGAA | |
| 18 | GAM3298-A | 2254528 | AAAGTGCTCATAGTGCAGGTAG | + |
| 19 | GAM7080-A | 2254529 | TTTCCACAGCGGCCAATTCTTC | + |
| 20 | GAM895-A | 2254530 | AGCTGCCAGTTGAAGAACATTT | |
| 21 | GAM3770-A | 2254531 | AAGTTAAGAGCTCCCAGGCCTG | |
| 22 | GAM337162-A | 2254532 | ACTGCACTCCAGCCTGGGCAAC | + |
| 23 | GAM8678-A | 2254533 | GTGTTCCAGGAAGTCGTCTTGA | |
| 24 | GAM2033-A | 2254534 | TCAAGCTCATTCCTCTAACCTC | |
| 25 | GAM7776-A | 2254535 | CATTGCACTCCAGCCTGGGCAA | + |
| 26 | GAM145-A | 2254536 | ACATGATCTCCTCACTCTAGGA | |
| 27 | GAM25-A | 2254537 | AATTGCTTGAACCCAGGAAGTG | + |
| 28 | GAM7352-A | 2254538 | TGTTTAAGTAGCTTATTTATCT | |
| 29 | GAM337624-A | 2254539 | TCTAAGAGAAAGGAAGTTCAGA | + |
| 30 | GAM1479-A | 2254540 | GAAGGCAGTAGGTTGTATAGTT | + |
| 31 | GAM2270-A | 2254541 | ATCACATTGCCAGTGATTACCC | + |
| 32 | GAM7591A | 2254542 | TTGGAGTAATTCAGTATAGGTT | + |
| 33 | GAM8285-A | 2254543 | AGTAGACAGTGGCAACATAGTC | |
| 34 | GAM6773-A | 2254544 | CTAGCCTGTTTGTCCTCACCCC | + |
| 35 | GAM336818-A | 2254545 | TGAGGTGGGATCCCGAGGCC | + |
| 36 | GAM336487-A | 2254546 | TGGCTAGGTAAGGGAAG | + |
| 37 | GAM337620-A | 2254547 | AATCATCATTATTTTGAAGTTTA | + |
| 38 | GAM336809-A | 2254548 | TAAGGCATTTTTATGGT | + |
| 39 | GAM5346-A | 2254549 | GCTGTTGTTAAGGGCACTTGGG | |
| 40 | GAM8554-A | 2254550 | TTCATGGGAGCAGGTGGTACAG | |
| 41 | GAM2701-A | 2254551 | ACTGCACTCCAGTCTGGGTGAC | |
| 42 | GAM7957-A | 2254552 | TCACTGCAACCTCTGCCTCCCG | |
| 43 | GAM391-A | 2254553 | CAGATCACATCCATCCGTCACC | |
| 44 | GAM6633-A | 2254554 | GCACTCAAGCCTGGGTTACAGA | |
| 45 | GAM19 | 2254555 | AGAGAGTGGCAGGTCTGTTCCT | |
| 46 | GAM8358-A | 2254556 | GATGAGGCAGCACTTGGG | |
| 47 | GAM3229-A | 2254557 | TGAGGTGGGAGAATTGCTTGAA | |
| 48 | GAM7052-A | 2254558 | CATGTAATCCCAGCTACTCAGG | |
| 49 | GAM3027-A (mmu-miR-29c) | 2254559 | TAGCACCATTTGAAATCGGTTA | + |
| 50 | GAM21 (mmui-miR-130b) | 2254560 | CAGTGCAATGATGAAAGGGCAT | + |
| 51 | GAM oligonucleotide (mmu-miR 30e) | 2254561 | TGTAAACATCCTTGACTGGAAG | + |

FIG. 24A

EST72223 (705 nt.)

Chr.X

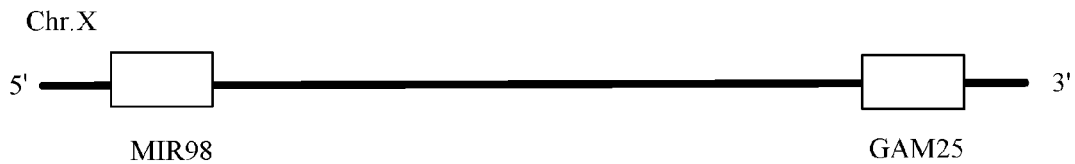

EST72223 sequence:

CCCTTATTAGAGGATTCTGCTCATGCCAGGGTGAGGTAGTAAGTTGTATTG
TTGTGGGGTAGGGATATTAGGCCCCAATTAGAAGATAACTATACAACT   MIR98
TACTACTTTCCCTGGTGTGTGGCATATTCACACTTAGTCTTAGCAGTGTTGCC
TCCATCAGACAAAGTTGTAGATGTTCCTTGGATAATTTGGACTGGAAGAAAAGA
GACATGGAAGGGGACAGATGGTGTTTAGGGTGAGGCAGATGTCATTATAAAGT
GACTTGTCTTTCATTAATTGGAGCATATAATTATTTTACCTTTGGGCATGAACTC
ATTTTGCTATTCTTCAACTGTGTAATGATTGCATTTTATTAGTAATAGAACAGGA
ATGTGTGCAAGGGAATGGAAAGCATACTTTAAGAATTTTGGGCCAGGCGCGGT
GGTTCATGCCTGTAATCCCAGCATTTTTGGGAGGCCGAGGCGGGTGGATCAC
CTGAGGTCAGGAGTTCGAGACCAACCTGGCCAACACGGCGAAACCCCGCCTC
TACTCAAATACAAAAATTAGCCAGGCTTGGTGACACTCGCCTGTGGTCCCAGC
TACTCAGGAGGCTGAGGCAGGAGAATTGCTTGAACCCAGGAAGTGGAG  GAM25
GCTTCAGTGAGCTGAGAACACGCCACTGCACTCCAGTCCTGGGCAAC
AGAGCAAGACTCTGTCTCAGGAAAAAAAAAG

FIG. 24B

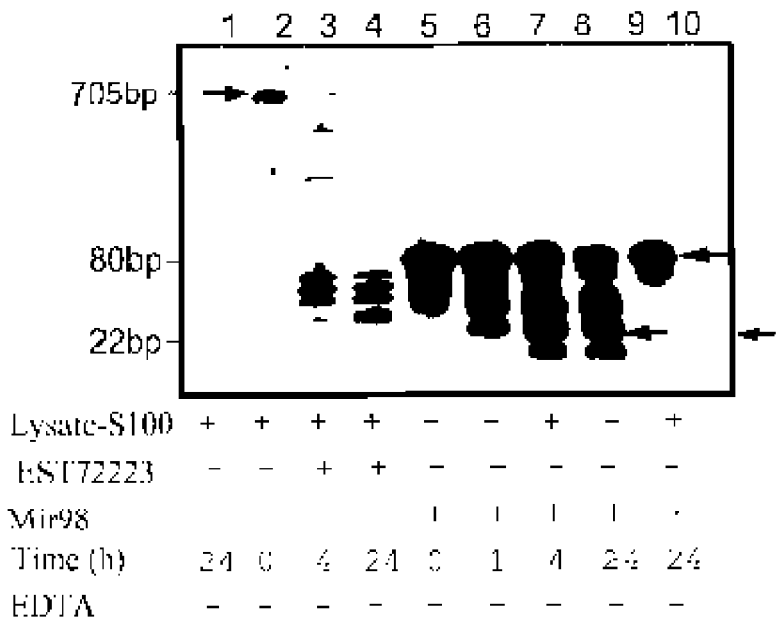

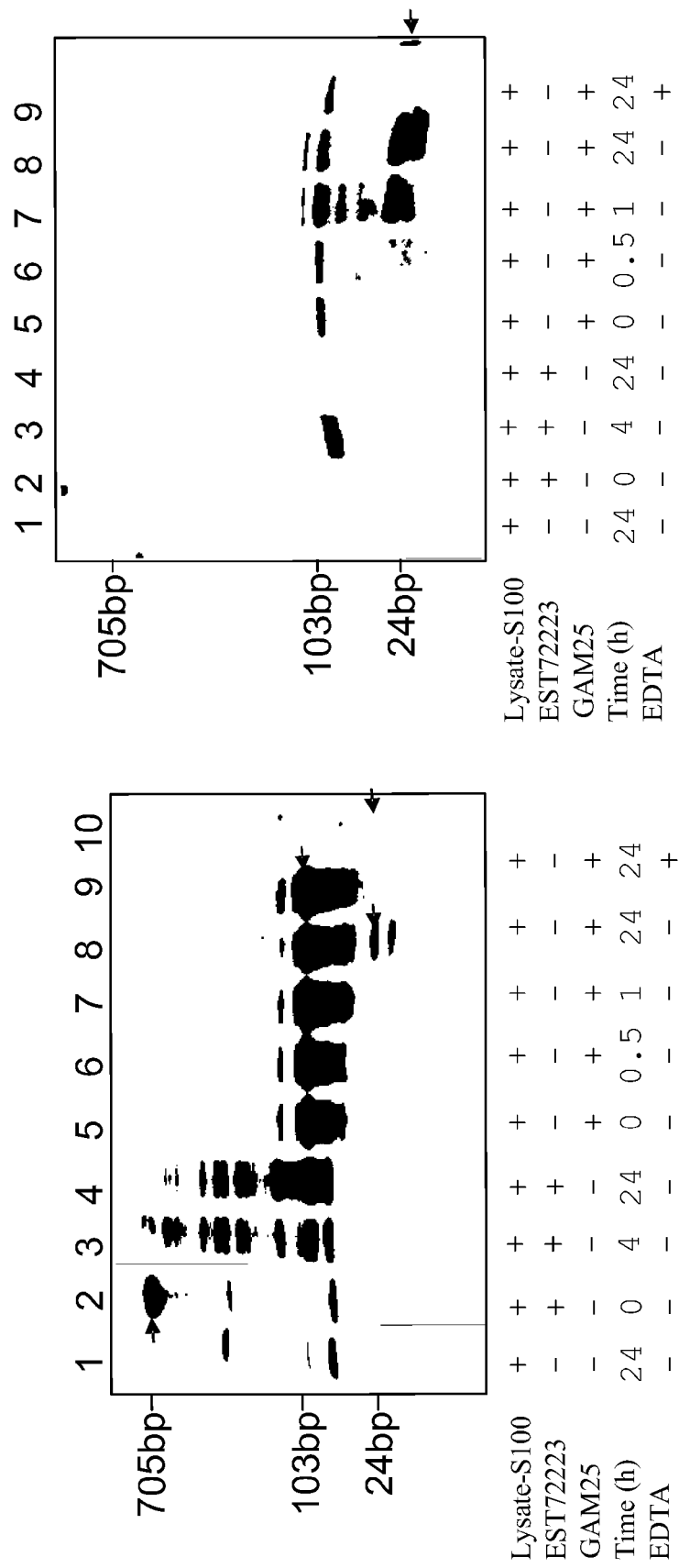

BIOINFORMATICALLY DETECTABLE GROUP OF NOVEL REGULATORY OLIGONUCLEOTIDES AND USES THEREOF

CROSS REFERENCE TO RELATED APPLICATIONS

The present application is a continuation-in-part of U.S. application Ser. No. 10/708,204, filed Feb. 16, 2004, and a continuation of U.S. application Ser. No. 10/707,980, filed Jan. 29, 2004, and continuation-in-part of U.S. application Ser. No. 10/707,975 now abandoned, filed Jan. 29, 2004, and continuation-in-part of U.S. application Ser. No. 10/707,147, filed Nov. 24, 2003, and continuation-in-part of International Applc. No. PCT/IL2003/000970, filed Nov. 16, 2003, which is a continuation of U.S. application Ser. No. 10/604,985 now abandoned filed Aug. 29, 2003, which is a continuation-in-part of U.S. application Ser. No. 10/651,227 filed Aug. 29, 2003, which is a continuation of U.S. application Ser. No. 10/605,924 filed Aug. 29, 2003; which is a continuation-in-part of U.S. application Ser. No. 10/649,653 filed Aug. 28, 2003; which is a continuation of U.S. application Ser. No. 10/605,923 filed Aug. 28, 2003; which is a continuation-in-part of U.S. application Ser. No. 10/604,926 filed Aug. 27, 2003; which is a continuation of U.S. application Ser. No. 10/345,201 filed Jan. 16, 2003, which is a continuation-in-part of U.S. application Ser. No. 10/321,503 filed Dec. 18, 2002, which is a continuation-in-part of U.S. application Ser. No. 10/310,914 filed Dec. 6, 2002, which is a continuation-in-part of U.S. application Ser. No. 10/293,338 filed Nov. 14, 2002, which is a continuation of U.S. application Ser. No. 10/604,727 filed Aug. 13, 2003. U.S. application Ser. No. 10/293,338 is also a continuation of U.S. application Ser. No. 10/604,726 filed Aug. 13, 2003. U.S. application Ser. No. 10/604,985 claims the benefit of U.S. Provisional Applc. Ser. No. 60/468,251 filed May 7, 2003. Each of these applications is incorporated herein by reference.

REFERENCES CITED

Altschul, S. F., Gish, W., Miller, W., Myers, E. W., and Lipman, D. J. (1990). Basic local alignment search tool. J. Mol. Biol. 215, 403-410.

Ambros, V., Lee, R. C., Lavanway, A., Williams, P. T., and Jewell, D. (2003). MicroRNAs and Other Tiny Endogenous RNAs in C. elegans 1. Curr. Biol. 13, 807-818.

Dan Gusfield, Algorithms on strings, trees, and sequences: computer science and computational biology, Cambridge University Press, 1997.

Elbashir, S. M., Lendeckel, W., and Tuschl, T. (2001). RNA interference is mediated by 21- and 22-nucleotide RNAs. Genes Dev. 15, 188-200.

Gibbs, W. W. (2003). The unseen genome: gems among the junk. Sci. Am. 289, 46-53.

Gussow, D. and Clackson, T. (1989). Direct clone characterization from plaques and colonies by the polymerase chain reaction. Nucleic Acids Res. 17, 4000.

Hamosh A, Scott A F, Amberger J, Bocchini C, Valle D and McKusick V A. (2002). Online Mendelian Inheritance in Man (OMIM), a knowledgebase of human genes and genetic disorders. Nucleic Acids Res. 30: 52-55.

Jenuth, J. P. (2000). The NCBI. Publicly available tools and resources on the Web. Methods Mol. Biol. 132, 301-312.

Kirkness, E. F. and Kerlavage, A. R. (1997). The TIGR human cDNA database. Methods Mol. Biol. 69, 261-268.

Lagos-Quintana, M., Rauhut, R., Lendeckel, W., and Tuschl, T. (2001). Identification of novel genes coding for small expressed RNAs. Science 294, 853-858.

Lau, N. C., Lim, L. P., Weinstein, E. G., and Bartel, D. P. (2001). An abundant class of tiny RNAs with probable regulatory roles in Caenorhabditis elegans. Science 294, 858-862.

Lau, N. C. and Bartel, D. P. (2003). Censors of the genome. Sci. Am. 289, 34-41.

Lim, L. P., Glasner, M. E., Yekta, S., Burge, C. B., and Bartel, D. P. (2003). Vertebrate microRNA genes. Science 299, 1540.

Mathews, D. H., Sabina, J., Zuker, M., and Turner, D. H. (1999). Expanded sequence dependence of thermodynamic parameters improves prediction of RNA secondary structure. J. Mol. Biol. 288, 911-940.

Reinhart, B. J., Slack, F. J., Basson, M., Pasquinelli, A. E., Bettinger, J. C., Rougvie, A. E., Horvitz, H. R., and Ruvkun, G. (2000). The 21-nucleotide let-7 RNA regulates developmental timing in Caenorhabditis elegans. Nature 403, 901-906.

Southern, E. M. (1992). Detection of specific sequences among DNA fragments separated by gel electrophoresis. 1975. Biotechnology 24, 122-139.

Tom M. Mitchell, Machine Learning, McGraw Hill, 1997.

Wightman, B., Ha, I., and Ruvkun, G. (1993). Posttranscriptional regulation of the heterochronic gene lin-14 by lin-4 mediates temporal pattern formation in C. elegans. Cell 75, 855-862.

Zhang, H., Kolb, F. A., Brondani, V., Billy, E., and Filipowicz, W. (2002). Human Dicer preferentially cleaves dsRNAs at their termini without a requirement for ATP. EMBO J. 21, 5875-5885.

Zuker, M. (2003). Mfold web server for nucleic acid folding and hybridization prediction. Nucleic Acids Res. 31, 3406-3415.

BACKGROUND OF THE INVENTION

1. Field of the Invention

The present invention relates to a group of bioinformatically detectable novel human oligonucleotides, here identified as Genomic Address Messenger or GAM oligonucleotides.

All of which are believed to be related to the micro RNA (miRNA) group of oligonucleotides.

2. Description of Prior Art

Micro RNAs (miRNA), are short ~22 nt non-coding regulatory RNA oligonucleotides, found in a wide range of species, believed to function as specific gene translation repressors, sometimes involved in cell-differentiation.

The ability to detect novel miRNAs is limited by the methodologies used to detect such oligonucleotides. All miRNAs identified so far either present a visibly discernable whole body phenotype, as do Lin-4 and Let-7 (Wightman, B., Ha, I., and Ruvkun, G., Cell 75:855-862 (1993); Reinhart et al. Nature 403: 901-906 (2000)), or produce sufficient quantities of RNA so as to be detected by the standard molecular biological techniques.

Studies reporting miRNAs (Lau et al., Science 294:858-862 (2001), Lagos-Quintana et al., Science 294: 853-858 (2001)) discovered 93 miRNAs in several species, by sequencing a limited number of clones (300 by Lau and 100 by Lagos-Quintana) of small segments (i.e. size fractionated) RNA. MiRNAs detected in these studies therefore, represent the more prevalent among the miRNA oligonucleotide family, and can not be much rarer than 1% of all small ~20 nt-long RNA oligonucleotides.

The aforesaid studies provide no basis for detection of miRNA oligonucleotides which either do not present a visually discernable whole body phenotype, or are rare (e.g. rarer than 0.1% of all size fractionated ~20 nt-long RNA segments expressed in the tissues examined), and therefore do not produce significant enough quantities of RNA so as to be detected by standard biological techniques.

Reference is made to the sequence listing submitted herewith. The sequence listing consists of a file named "SequenceListing.txt" (342,255 KB, Jul. 15, 2009), and is hereby incorporated by reference herein.

Brief Description of Sequence Listing, Large Tables and Computer Program Listing A sequence listing is attached to the present invention, comprising 2254510 genomic sequences, is contained in a file named SEQ_LIST.txt (342238 KB, 31 Mar. 2004), and is hereby incorporated by reference herein.

Large tables relating to genomic sequences are attached to the present application, appear in 11 table files (size, creation date), incorporated herein: TABLE__1.txt (35,428 KB, Mar. 31, 2004); TABLE__2.txt (165,249 KB, Mar. 31, 2004); TABLE__3.txt (2,837 KB, Mar. 31, 2004); TABLE__4.txt (8,105 KB, Mar. 31, 2004); TABLE__5.txt (3,048 KB, Mar. 31, 2004); TABLE__6.txt (169,488 KB, Mar. 31, 2004); TABLE__7.txt (268,106 KB, Mar. 31, 2004); TABLE__8__1.txt (378,907 KB, Oct. 25, 2005); TABLE__8__2.txt (374,279 KB, Oct. 25, 2005); TABLE__9__1.txt (419,922 KB, Oct. 25, 2005); TABLE__9__2.txt (415,145 KB, Oct. 25, 2005); TABLE__10.txt (4,315 KB, Mar. 31, 2004) and TABLE__11.txt (36 KB, Mar. 31, 2004), all of which are incorporated by reference herein.

A computer program listing of a computer program constructed and operative in accordance with a preferred embodiment of the present invention is enclosed on an electronic medium in computer readable form, and is hereby incorporated by reference herein. The computer program listing is contained in 6 files, the name, sizes and creation date of which are as follows: AUXILARY_FILES.txt (117K, 14-Nov-03); EDIT_DISTANCE.txt (144K, 24-Nov-03); FIRST-K.txt (96K, 24-Nov-03); HAIRPIN_PREDICTION.txt (19K, 25-Mar-04); TWO_PHASED_SIDE_SELECTOR.txt (4K, 14-Nov-03); and TWO_PHASED_PREDICTOR.txt (74K, 14-Nov-03).

SUMMARY OF THE INVENTION

The present invention discloses over a thousand novel human regulatory microRNA-like (miRNA) oligonucleotides referred to here as Genomic Address Messenger (GAM) oligonucleotides, which GAM oligonucleotides are detectable using a novel bioinformatic approach, and go undetected by conventional molecular biology methods. Each GAM oligonucleotide specifically inhibits translation of one of more target genes by hybridization of an RNA transcript encoded by the GAM, to a site located in an untranslated region (UTR) of the mRNA of one or more of the target genes.

Accordingly, the invention provides several substantially pure nucleic acids (e.g., genomic DNA, cDNA or synthetic DNA) each comprising a novel human GAM oligonucleotide, vectors comprising the DNAs, probes comprising the DNAs, a method and system for selectively modulating translation of known target genes utilizing the vectors, and a method and system utilizing the GAM probes to modulate expression of target genes.

The present invention represents a scientific breakthrough, disclosing novel miRNA-like oligonucleotides the number of which is dramatically larger than previously believed existed. Prior-art studies reporting miRNAs ((Lau et al., Science 294: 858-862 (2001), Lagos-Quintana et al., Science 294: 853-858 (2001)) discovered 93 miRNAs in several species, including 21 in human, using conventional molecular biology methods, such as cloning and sequencing.

Molecular biology methodologies employed by these studies are limited in their ability to detect rare miRNA oligonucleotides, since these studies relied on sequencing of a limited number of clones (300 clones by Lau and 100 clones by Lagos-Quintana) of small segments (i.e. size fractionated) of RNA. MicroRNAs detected in these studies therefore, represent the more prevalent among the miRNA oligonucleotide family, and are typically not be much rarer than 1% of all small ~20 nt-long RNA oligonucleotides present in the tissue from the RNA was extracted.

Recent studies state the number of miRNA oligonucleotides to be limited, and describe the limited sensitivity of available methods for detection of miRNA: The estimate of 255 human miRNA oligonucleotides is an upper bound implying that no more than 40 miRNA oligonucleotides remain to be identified in mammals (Lim et al., Science, 299:1540 (2003)); Estimates place the total number of vertebrate miRNA genes at about 200-250 (Ambros et al. Curr. Biol. 13:807-818 (2003)); and Confirmation of very low abundance miRNAs awaits the application of detection methods more sensitive than Northern blots (Ambros et al. Curr. Biol. 13:807-818 (2003)).

The oligonucleotides of the present invention represent a revolutionary new dimension of genomics and of biology: a dimension comprising a huge number of non-protein coding oligonucleotides which modulate expression of thousands of proteins and are associated with numerous major diseases. This new dimension disclosed by the present invention dismantles a central dogma that has dominated life-sciences during the past 50 years, a dogma which has emphasized the importance of protein coding regions of the genome, holding non-protein coding regions to be of little consequence, often dubbing them junk DNA.

Indeed, only in November, 2003 has this long held belief as to the low importance of non-protein coding regions been vocally challenged. As an example, an article titled The Unseen Genome—Gems in the Junk (Gibbs, W. W. Sci. Am. 289:46-53 (2003)) asserts that the failure to recognize the importance of non-protein-coding regions may well go down as one of the biggest mistakes in the history of molecular biology. Gibbs further asserts that what was dammned as junk because it was not understood, may in fact turn out to be the very basis of human complexity. The present invention provides a dramatic leap in understanding specific important roles of non-protein coding regions.

An additional scientific breakthrough of the present invention is a novel conceptual model disclosed by the present invention, which conceptual model is preferably used to encode in a genome the determination of cell-differentiation, utilizing oligonucleotides and polynucleotides of the present invention.

In various preferred embodiments, the present invention seeks to provide an improved method and system for specific modulation of the expression of specific target genes involved in significant human diseases. It also provides an improved method and system for detection of the expression of novel oligonucleotides of the present invention, which modulate these target genes. In many cases the target genes may be known and fully characterized, however in alternative embodiments of the present invention, unknown or less well characterized genes may be targeted.

A Nucleic acid is defined as a ribonucleic acid (RNA) molecule, or a deoxyribonucleic acid (DNA) molecule, or complementary deoxyribonucleic acid (cDNA), comprising either naturally occurring nucleotides or non-naturally occurring nucleotides.

Substantially pure nucleic acid, Isolated Nucleic Acid, Isolated Oligoucleotide and Isolated Polynucleotide are defined as a nucleic acid that is free of the genome of the organism from which the nucleic acid is derived, and include, for example, a recombinant nucleic acid which is incorporated into a vector, into an autonomously replicating plasmid or virus, or into the genomic nucleic acid of a prokaryote or eukaryote at a site other than its natural site; or which exists as a separate molecule (e.g., a cDNA or a genomic or cDNA fragment produced by PCR or restriction endonuclease digestion) independent of other nucleic acids.

An Oligonucleotide is defined as a nucleic acid comprising 2-139 nucleotides, or preferably 16-120 nucleotides. A Polynucleotide is defined as a nucleic acid comprising 140-5000 nucleotides, or preferably 140-1000 nucleotides.

A Complementary sequence is defined as a first nucleotide sequence which reverses complementary of a second nucleotide sequence: the first nucleotide sequence is reversed relative to a second nucleotide sequence, and wherein each nucleotide in the first nucleotide sequence is complementary to a corresponding nucleotide in the second nucleotide sequence (e.g. ATGGC is the complementary sequence of GCCAT).

Hybridization, Binding and Annealing are defined as hybridization, under in-vivo physiologic conditions, of a first nucleic acid to a second nucleic acid, which second nucleic acid is at least partially complementary to the first nucleic acid.

A Hairpin Structure is defined as an oligonucleotide having a nucleotide sequence that is 50-140 nucleotides in length, the first half of which nucleotide sequence is at least partially complementary to the second part thereof, thereby causing the nucleic acid to fold onto itself, forming a secondary hairpin structure.

A Hairpin Shaped Precursor is defined as a Hairpin Structure which is processed by a Dicer enzyme complex, yielding an oligonucleotide which is about 19 to about 24 nucleotides in length.

"Inhibiting translation" is defined as the ability to prevent synthesis of a specific protein encoded by a respective gene by means of inhibiting the translation of the mRNA of this gene. For example, inhibiting translation may include the following steps: (1) a DNA segment encodes an RNA, the first half of whose sequence is partially complementary to the second half thereof; (2) the precursor folds onto itself forming a hairpin-shaped precursor; (3) a Dicer enzyme complex cuts the hairpin shaped precursor yielding an oligonucleotide that is approximately 22 nt in length; (4) the oligonucleotide binds complementarily to at least one binding site, having a nucleotide sequence that is at least partially complementary to the oligonucleotide, which binding site is located in the mRNA of a target gene, preferably in the untranslated region (UTR) of a target gene, such that the binding inhibits translation of the target protein.

A "Translation inhibitor site" is defined as the minimal nucleotide sequence sufficient to inhibit translation.

There is thus provided in accordance with a preferred embodiment of the present invention a bioinformatically detectable isolated oligonucleotide which is endogenously processed from a hairpin-shaped precursor, and anneals to a portion of a mRNA transcript of a target gene, wherein binding of the oligonucleotide to the mRNA transcript represses expression of the target gene, and wherein the oligonucleotide has at least 80% sequence identity with a nucleotide sequence selected from the group consisting of SEQ ID NOs: 1-14676.

There is further provided in accordance with another preferred embodiment of the present invention a bioinformatically detectable isolated oligonucleotide which is endogenously processed from a hairpin-shaped precursor, and anneals to a portion of a mRNA transcript of a target gene selected from the group consisting of genes shown in Table 11, Row 1, wherein binding of the oligonucleotide to the mRNA transcript represses expression of the target gene, and wherein the oligonucleotide has at least 80% sequence identity with a nucleotide sequence selected from the group consisting of SEQ ID NOs: 1-14676.

There is still further provided in accordance with another preferred embodiment of the present invention a bioinformatically detectable isolated oligonucleotide having a nucleotide sequence selected from the group consisting of SEQ ID NOs: 1-14676.

There is additionally provided in accordance with another preferred embodiment of the present invention a bioinformatically detectable first oligonucleotide which is a portion of a mRNA transcript of a target gene, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs: 1-14676.

There is moreover provided in accordance with another preferred embodiment of the present invention a bioinformatically detectable first oligonucleotide which is a portion of a mRNA transcript of a target gene selected from the group consisting of genes shown in Table 11 row 1, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs: 1-14676.

There is further provided in accordance with another preferred embodiment of the present invention a bioinformatically detectable oligonucleotide having a nucleotide sequence selected from the group consisting of SEQ ID NOs: 1-14676.

There is still further provided in accordance with another preferred embodiment of the present invention a bioinformatically detectable isolated oligonucleotide which anneals to a portion of a mRNA transcript of a target gene associated with Addisons disease, which target gene is selected from the group consisting of genes shown in Table 11, row 2, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 3 and 14677-15272, and (b) the complement of a sequence selected from the group consisting of SEQ ID NOs: 378232 and 377922-378929.

There is additionally provided in accordance with another preferred embodiment of the present invention a bioinformatically detectable first oligonucleotide which is a portion of a mRNA transcript of a target gene selected from the group consisting of genes shown in Table 11 row 2, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:3 and 14677-15272.

There is moreover provided in accordance with another preferred embodiment of the present invention a bioinformatically detectable isolated oligonucleotide which anneals to a portion of a mRNA transcript of a target gene associated with Adenovirus, which target gene is selected from the group consisting of genes shown in Table 11, row 3, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 4 and 15273-15329, and (b) the complement of a sequence selected from the group consisting of SEQ ID NOs: 378982 and 378930-379029.

There is further provided in accordance with another preferred embodiment of the present invention a bioinformatically detectable first oligonucleotide which is a portion of a mRNA transcript of a target gene selected from the group consisting of genes shown in Table 11 row 3, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:4 and 15273-15329.

There is still further provided in accordance with another preferred embodiment of the present invention a bioinformatically detectable isolated oligonucleotide which anneals to a portion of a mRNA transcript of a target gene associated with Adrenal cortical carcinoma, which target gene is selected from the group consisting of genes shown in Table 11, row 4, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 2, 4 and 15330-16657, and (b) the complement of a sequence selected from the group consisting of SEQ ID NOs: 379943, 380776 and 379030-381893.

There is additionally provided in accordance with another preferred embodiment of the present invention a bioinformatically detectable first oligonucleotide which is a portion of a mRNA transcript of a target gene selected from the group consisting of genes shown in Table 11 row 4, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:2, 4 and 15330-16657.

There is moreover provided in accordance with another preferred embodiment of the present invention a bioinformatically detectable isolated oligonucleotide which anneals to a portion of a mRNA transcript of a target gene associated with Aids, which target gene is selected from the group consisting of genes shown in Table 11, row 5, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 2, 3, 4, 5, 6, 7, 8, 9 and 16658-22991, and (b) the complement of a sequence selected from the group consisting of SEQ ID NOs: 383072, 383073, 384083, 384982, 395441, 396067, 397674, 398184 and 381894-400528.

There is further provided in accordance with another preferred embodiment of the present invention a bioinformatically detectable first oligonucleotide which is a portion of a mRNA transcript of a target gene selected from the group consisting of genes shown in Table 11 row 5, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:2, 3, 4, 5, 6, 7, 8, 9 and 16658-22991.

There is still further provided in accordance with another preferred embodiment of the present invention a bioinformatically detectable isolated oligonucleotide which anneals to a portion of a mRNA transcript of a target gene associated with Alzheimer, which target gene is selected from the group consisting of genes shown in Table 11, row 6, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 2, 3, 4, 5, 6, 7, 8, 9 and 22992-34834, and (b) the complement of a sequence selected from the group consisting of SEQ ID NOs: 404508, 420735, 423944, 435112, 440-497, 441931, 446-451, 450239 and 400529-460892.

There is additionally provided in accordance with another preferred embodiment of the present invention a bioinformatically detectable first oligonucleotide which is a portion of a mRNA transcript of a target gene selected from the group consisting of genes shown in Table 11 row 6, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:2, 3, 4, 5, 6, 7, 8, 9 and 22992-34834.

There is moreover provided in accordance with another preferred embodiment of the present invention a bioinformatically detectable isolated oligonucleotide which anneals to a portion of a mRNA transcript of a target gene associated with Amyloidosis, which target gene is selected from the group consisting of genes shown in Table 11, row 7, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 1, 2, 3, 4, 5 and 34835-36785, and (b) the complement of a sequence selected from the group consisting of SEQ ID NOs: 460919, 462509, 463079, 463677, 463827 and 460893-465-427.

There is further provided in accordance with another preferred embodiment of the present invention a bioinformatically detectable first oligonucleotide which is a portion of a mRNA transcript of a target gene selected from the group consisting of genes shown in Table 11 row 7, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:1, 2, 3, 4, 5 and 34835-36785.

There is still further provided in accordance with another preferred embodiment of the present invention a bioinformatically detectable isolated oligonucleotide which anneals to a portion of a mRNA transcript of a target gene associated with Amyotrophic Lateral Sclerosis, which target gene is selected from the group consisting of genes shown in Table 11, row 8, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 1, 4, 7 and 36786-39744, and (b) the complement of a sequence selected from the group consisting of SEQ ID NOs: 467837, 470539, 470925 and 465-428-471746.

There is additionally provided in accordance with another preferred embodiment of the present invention a bioinformatically detectable first oligonucleotide which is a portion of a mRNA transcript of a target gene selected from the group consisting of genes shown in Table 11 row 8, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:1, 4, 7 and 36786-39744.

There is moreover provided in accordance with another preferred embodiment of the present invention a bioinformatically detectable isolated oligonucleotide which anneals to a portion of a mRNA transcript of a target gene associated with Anal cancer, which target gene is selected from the group consisting of genes shown in Table 11, row 9, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 1 and 39745-39979, and (b) the complement of a sequence selected from the group consisting of SEQ ID NOs: 471800 and 471747-471906.

There is further provided in accordance with another preferred embodiment of the present invention a bioinformatically detectable first oligonucleotide which is a portion of a mRNA transcript of a target gene selected from the group consisting of genes shown in Table 11 row 9, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:1 and 39745-39979.

There is still further provided in accordance with another preferred embodiment of the present invention a bioinformatically detectable isolated oligonucleotide which anneals to a portion of a mRNA transcript of a target gene associated with Anorexia Nervosa, which target gene is selected from the group consisting of genes shown in Table 11, row 10, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 4, 8 and 39980-40538, and (b) the complement of a sequence selected from the group consisting of SEQ ID NOs: 472-404, 472-408 and 471907-473060.

There is additionally provided in accordance with another preferred embodiment of the present invention a bioinformatically detectable first oligonucleotide which is a portion of a mRNA transcript of a target gene selected from the group consisting of genes shown in Table 11 row 10, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:4, 8 and 39980-40538.

There is moreover provided in accordance with another preferred embodiment of the present invention a bioinformatically detectable isolated oligonucleotide which anneals to a portion of a mRNA transcript of a target gene associated with Asthma, which target gene is selected from the group consisting of genes shown in Table 11, row 11, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 2, 3, 4, 5, 7, 9 and 40539-44830, and (b) the complement of a sequence selected from the group consisting of SEQ ID NOs: 473069, 474333, 474580, 478106, 481841, 482515 and 473061-483-490.

There is further provided in accordance with another preferred embodiment of the present invention a bioinformatically detectable first oligonucleotide which is a portion of a mRNA transcript of a target gene selected from the group consisting of genes shown in Table 11 row 11, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:2, 3, 4, 5, 7, 9 and 40539-44830.

There is still further provided in accordance with another preferred embodiment of the present invention a bioinformatically detectable isolated oligonucleotide which anneals to a portion of a mRNA transcript of a target gene associated with Atopic dermatitis, which target gene is selected from the group consisting of genes shown in Table 11, row 12, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 2, 4, 7 and 44831-46240, and (b) the complement of a sequence selected from the group consisting of SEQ ID NOs: 483-494, 484-470, 485-473 and 483-491-486113.

There is additionally provided in accordance with another preferred embodiment of the present invention a bioinformatically detectable first oligonucleotide which is a portion of a mRNA transcript of a target gene selected from the group consisting of genes shown in Table 11 row 12, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:2, 4, 7 and 44831-46240.

There is moreover provided in accordance with another preferred embodiment of the present invention a bioinformatically detectable isolated oligonucleotide which anneals to a portion of a mRNA transcript of a target gene associated with Atrial fibrillation, which target gene is selected from the group consisting of genes shown in Table 11, row 13, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 1 and 46241-46979, and (b) the complement of a sequence selected from the group consisting of SEQ ID NOs: 486156 and 486114-487523.

There is further provided in accordance with another preferred embodiment of the present invention a bioinformatically detectable first oligonucleotide which is a portion of a mRNA transcript of a target gene selected from the group consisting of genes shown in Table 11 row 13, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:1 and 46241-46979.

There is still further provided in accordance with another preferred embodiment of the present invention a bioinformatically detectable isolated oligonucleotide which anneals to a portion of a mRNA transcript of a target gene associated with Autism, which target gene is selected from the group consisting of genes shown in Table 11, row 14, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 3, 7, 9 and 46980-50847, and (b) the complement of a sequence selected from the group consisting of SEQ ID NOs: 487792, 489338, 495239 and 487524-497639.

There is additionally provided in accordance with another preferred embodiment of the present invention a bioinformatically detectable first oligonucleotide which is a portion of a mRNA transcript of a target gene selected from the group consisting of genes shown in Table 11 row 14, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:3, 7, 9 and 46980-50847.

There is moreover provided in accordance with another preferred embodiment of the present invention a bioinformatically detectable isolated oligonucleotide which anneals to a portion of a mRNA transcript of a target gene associated with Barrett Esophagus, which target gene is selected from the group consisting of genes shown in Table 11, row 15, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 4 and 50848-52075, and (b) the complement of a sequence selected from the group consisting of SEQ ID NOs: 498378 and 497640-500427.

There is further provided in accordance with another preferred embodiment of the present invention a bioinformatically detectable first oligonucleotide which is a portion of a mRNA transcript of a target gene selected from the group consisting of genes shown in Table 11 row 15, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:4 and 50848-52075.

There is still further provided in accordance with another preferred embodiment of the present invention a bioinformatically detectable isolated oligonucleotide which anneals to a portion of a mRNA transcript of a target gene associated with Basal cell carcinoma, which target gene is selected from the group consisting of genes shown in Table 11, row 16, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 1 and 52076-54148, and (b) the complement of a sequence selected from the group consisting of SEQ ID NOs: 503527 and 500428-504726.

There is additionally provided in accordance with another preferred embodiment of the present invention a bioinformatically detectable first oligonucleotide which is a portion of a mRNA transcript of a target gene selected from the group consisting of genes shown in Table 11 row 16, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:1 and 52076-54148.

There is moreover provided in accordance with another preferred embodiment of the present invention a bioinformatically detectable isolated oligonucleotide which anneals to a portion of a mRNA transcript of a target gene associated with Beta Thalassemia, which target gene is selected from the group consisting of genes shown in Table 11, row 17, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 1 and 54149-54833, and (b) the complement of a sequence selected from the group consisting of SEQ ID NOs: 504750 and 504727-505912.

There is further provided in accordance with another preferred embodiment of the present invention a bioinformatically detectable first oligonucleotide which is a portion of a mRNA transcript of a target gene selected from the group consisting of genes shown in Table 11 row 17, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:1 and 54149-54833.

There is still further provided in accordance with another preferred embodiment of the present invention a bioinformatically detectable isolated oligonucleotide which anneals to a portion of a mRNA transcript of a target gene associated with Bipolar Disorder, which target gene is selected from the group consisting of genes shown in Table 11, row 18, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 2, 3, 4, 6, 9 and 54834-59154, and (b) the complement of a sequence selected from the group consisting of SEQ ID NOs: 508649, 509702, 511790, 512551, 513055 and 505913-516790.

There is additionally provided in accordance with another preferred embodiment of the present invention a bioinformatically detectable first oligonucleotide which is a portion of a mRNA transcript of a target gene selected from the group consisting of genes shown in Table 11 row 18, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:2, 3, 4, 6, 9 and 54834-59154.

There is moreover provided in accordance with another preferred embodiment of the present invention a bioinformatically detectable isolated oligonucleotide which anneals to a portion of a mRNA transcript of a target gene associated with Bladder cancer, which target gene is selected from the group consisting of genes shown in Table 11, row 19, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 1, 2, 4, 6, 7 and 59155-64410, and (b) the complement of a sequence selected from the group consisting of SEQ ID NOs: 524632, 524817, 526807, 528540, 529737 and 516791-530989.

There is further provided in accordance with another preferred embodiment of the present invention a bioinformatically detectable first oligonucleotide which is a portion of a mRNA transcript of a target gene selected from the group consisting of genes shown in Table 11 row 19, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:1, 2, 4, 6, 7 and 59155-64410.

There is still further provided in accordance with another preferred embodiment of the present invention a bioinformatically detectable isolated oligonucleotide which anneals to a portion of a mRNA transcript of a target gene associated with Breast cancer, which target gene is selected from the group consisting of genes shown in Table 11, row 20, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 1, 2, 3, 4, 5, 6, 7, 8, 9 and 64411-78554, and (b) the complement of a sequence selected from the group consisting of SEQ ID NOs: 537713, 563181, 580355, 582931, 588228, 590654, 596577, 618193, 633000 and 530990-689986.

There is additionally provided in accordance with another preferred embodiment of the present invention a bioinformatically detectable first oligonucleotide which is a portion of a mRNA transcript of a target gene selected from the group consisting of genes shown in Table 11 row 20, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:1, 2, 3, 4, 5, 6, 7, 8, 9 and 64411-78554.

There is moreover provided in accordance with another preferred embodiment of the present invention a bioinformatically detectable isolated oligonucleotide which anneals to a portion of a mRNA transcript of a target gene associated with Burkitt lymphoma, which target gene is selected from the group consisting of genes shown in Table 11, row 21, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 2, 3, 4, 5 and 78555-80110, and (b) the complement of a sequence selected from the group consisting of SEQ ID NOs: 690108, 692809, 693052 and 689987-693112.

There is further provided in accordance with another preferred embodiment of the present invention a bioinformatically detectable first oligonucleotide which is a portion of a mRNA transcript of a target gene selected from the group consisting of genes shown in Table 11 row 21, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:2, 3, 4, 5 and 78555-80110.

There is still further provided in accordance with another preferred embodiment of the present invention a bioinformatically detectable isolated oligonucleotide which anneals to a portion of a mRNA transcript of a target gene associated with Carcinoid, which target gene is selected from the group consisting of genes shown in Table 11, row 22, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 7 and 80111-80708, and (b) the complement of a sequence selected from the group consisting of SEQ ID NOs: 693404 and 693113-694254.

There is additionally provided in accordance with another preferred embodiment of the present invention a bioinformatically detectable first oligonucleotide which is a portion of a mRNA transcript of a target gene selected from the group consisting of genes shown in Table 11 row 22, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:7 and 80111-80708.

There is moreover provided in accordance with another preferred embodiment of the present invention a bioinformatically detectable isolated oligonucleotide which anneals to a portion of a mRNA transcript of a target gene associated with Cerebrovascular Accident, which target gene is selected from the group consisting of genes shown in Table 11, row 23, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 2, 4, 5 and 80709-81325, and (b) the complement of a sequence selected from the group consisting of SEQ ID NOs: 694366, 695294 and 694255-695530.

There is further provided in accordance with another preferred embodiment of the present invention a bioinformatically detectable first oligonucleotide which is a portion of a mRNA transcript of a target gene selected from the group consisting of genes shown in Table 11 row 23, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:2, 4, 5 and 80709-81325.

There is still further provided in accordance with another preferred embodiment of the present invention a bioinformatically detectable isolated oligonucleotide which anneals to a portion of a mRNA transcript of a target gene associated with Cervical cancer, which target gene is selected from the group consisting of genes shown in Table 11, row 24, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 2, 3, 4, 5, 7, 8 and 81326-86234, and (b) the complement of a sequence selected from the group consisting of SEQ ID NOs: 698866, 699633, 700140, 703176, 706969 and 695531-707027.

There is additionally provided in accordance with another preferred embodiment of the present invention a bioinformatically detectable first oligonucleotide which is a portion of a mRNA transcript of a target gene selected from the group consisting of genes shown in Table 11 row 24, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:2, 3, 4, 5, 7, 8 and 81326-86234.

There is moreover provided in accordance with another preferred embodiment of the present invention a bioinformatically detectable isolated oligonucleotide which anneals to a portion of a mRNA transcript of a target gene associated with Cholestasis, which target gene is selected from the group consisting of genes shown in Table 11, row 25, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 2 and 86235-86695, and (b) the complement of a sequence selected from the group consisting of SEQ ID NOs: 707553 and 707028-707756.

There is further provided in accordance with another preferred embodiment of the present invention a bioinformatically detectable first oligonucleotide which is a portion of a mRNA transcript of a target gene selected from the group consisting of genes shown in Table 11 row 25, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:2 and 86235-86695.

There is still further provided in accordance with another preferred embodiment of the present invention a bioinformatically detectable isolated oligonucleotide which anneals to a portion of a mRNA transcript of a target gene associated with Chronic obstructive pulmonary disease, which target gene is selected from the group consisting of genes shown in Table 11, row 26, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 9 and 86696-87220, and (b) the complement of a sequence selected from the group consisting of SEQ ID NOs: 708469 and 707757-708943.

There is additionally provided in accordance with another preferred embodiment of the present invention a bioinformatically detectable first oligonucleotide which is a portion of a mRNA transcript of a target gene selected from the group consisting of genes shown in Table 11 row 26, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:9 and 86696-87220.

There is moreover provided in accordance with another preferred embodiment of the present invention a bioinformatically detectable isolated oligonucleotide which anneals to a portion of a mRNA transcript of a target gene associated with Cirrhosis, which target gene is selected from the group consisting of genes shown in Table 11, row 27, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 2, 4, 8 and 87221-90071, and (b) the complement of a sequence selected from the group consisting of SEQ ID NOs: 712312, 714322, 714659 and 708944-715262.

There is further provided in accordance with another preferred embodiment of the present invention a bioinformatically detectable first oligonucleotide which is a portion of a mRNA transcript of a target gene selected from the group consisting of genes shown in Table 11 row 27, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:2, 4, 8 and 87221-90071.

There is still further provided in accordance with another preferred embodiment of the present invention a bioinformatically detectable isolated oligonucleotide which anneals to a portion of a mRNA transcript of a target gene associated with Colorectal cancer, which target gene is selected from the group consisting of genes shown in Table 11, row 28, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 1, 2, 3, 4, 5, 6, 7, 8, 9 and 90072-103599, and (b) the complement of a sequence selected from the group consisting of SEQ ID NOs: 727396, 728779, 751651, 754078, 762029, 775468, 783181, 801412, 804645 and 715263-825119.

There is additionally provided in accordance with another preferred embodiment of the present invention a bioinformatically detectable first oligonucleotide which is a portion of a mRNA transcript of a target gene selected from the group consisting of genes shown in Table 11 row 28, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:1, 2, 3, 4, 5, 6, 7, 8, 9 and 90072-103599.

There is moreover provided in accordance with another preferred embodiment of the present invention a bioinformatically detectable isolated oligonucleotide which anneals to a portion of a mRNA transcript of a target gene associated with Coronary artery disease, which target gene is selected from the group consisting of genes shown in Table 11, row 29, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 2, 4, 5, 8 and 103600-104724, and (b) the complement of a sequence selected from the group consisting of SEQ ID NOs: 825764, 826087, 827311 and 825120-827584.

There is further provided in accordance with another preferred embodiment of the present invention a bioinformatically detectable first oligonucleotide which is a portion of a mRNA transcript of a target gene selected from the group consisting of genes shown in Table 11 row 29, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:2, 4, 5, 8 and 103600-104724.

There is still further provided in accordance with another preferred embodiment of the present invention a bioinformatically detectable isolated oligonucleotide which anneals to a portion of a mRNA transcript of a target gene associated with Coronary disease, which target gene is selected from the group consisting of genes shown in Table 11, row 30, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 2, 4, 5 and 104725-106952, and (b) the complement of a sequence selected from the group consisting of SEQ ID NOs: 828298, 828430, 830870 and 827585-832456.

There is additionally provided in accordance with another preferred embodiment of the present invention a bioinformatically detectable first oligonucleotide which is a portion of a mRNA transcript of a target gene selected from the group consisting of genes shown in Table 11 row 30, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:2, 4, 5 and 104725-106952.

There is moreover provided in accordance with another preferred embodiment of the present invention a bioinformatically detectable isolated oligonucleotide which anneals to a portion of a mRNA transcript of a target gene associated with Crohn disease, which target gene is selected from the group consisting of genes shown in Table 11, row 31, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 1, 2, 4, 9 and 106953-109974, and (b) the complement of a sequence selected from the group consisting of SEQ ID NOs: 834114, 834946, 835661, 837892 and 832457-839285.

There is further provided in accordance with another preferred embodiment of the present invention a bioinformatically detectable first oligonucleotide which is a portion of a mRNA transcript of a target gene selected from the group consisting of genes shown in Table 11 row 31, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:1, 2, 4, 9 and 106953-109974.

There is still further provided in accordance with another preferred embodiment of the present invention a bioinformatically detectable isolated oligonucleotide which anneals to a portion of a mRNA transcript of a target gene associated with Cushing Syndrome, which target gene is selected from the group consisting of genes shown in Table 11, row 32, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 3 and 109975-111300, and (b) the complement of a sequence selected from the group consisting of SEQ ID NOs: 840315 and 839286-842219.

There is additionally provided in accordance with another preferred embodiment of the present invention a bioinformatically detectable first oligonucleotide which is a portion of a mRNA transcript of a target gene selected from the group consisting of genes shown in Table 11 row 32, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:3 and 109975-111300.

There is moreover provided in accordance with another preferred embodiment of the present invention a bioinformatically detectable isolated oligonucleotide which anneals to a portion of a mRNA transcript of a target gene associated with Cystic fibrosis, which target gene is selected from the group consisting of genes shown in Table 11, row 33, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 1, 3, 7 and 111301-112941, and (b) the complement of a sequence selected from the group consisting of SEQ ID NOs: 842289, 843698, 844210 and 842220-845733.

There is further provided in accordance with another preferred embodiment of the present invention a bioinformatically detectable first oligonucleotide which is a portion of a mRNA transcript of a target gene selected from the group consisting of genes shown in Table 11 row 33, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:1, 3, 7 and 111301-112941.

There is still further provided in accordance with another preferred embodiment of the present invention a bioinformatically detectable isolated oligonucleotide which anneals to a portion of a mRNA transcript of a target gene associated with Cytomegalovirus, which target gene is selected from the group consisting of genes shown in Table 11, row 34, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 3 and 112942-113819, and (b) the complement of a sequence selected from the group consisting of SEQ ID NOs: 846249 and 845734-847315.

There is additionally provided in accordance with another preferred embodiment of the present invention a bioinformatically detectable first oligonucleotide which is a portion of a mRNA transcript of a target gene selected from the group consisting of genes shown in Table 11 row 34, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:3 and 112942-113819.

There is moreover provided in accordance with another preferred embodiment of the present invention a bioinformatically detectable isolated oligonucleotide which anneals to a portion of a mRNA transcript of a target gene associated with Deafness, which target gene is selected from the group consisting of genes shown in Table 11, row 35, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 1, 2, 3, 4, 5 and 113820-118195, and (b) the complement of a sequence selected from the group consisting of SEQ ID NOs: 848649, 852182, 852375, 853644, 855958 and 847316-857712.

There is further provided in accordance with another preferred embodiment of the present invention a bioinformatically detectable first oligonucleotide which is a portion of a mRNA transcript of a target gene selected from the group consisting of genes shown in Table 11 row 35, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:1, 2, 3, 4, 5 and 113820-118195.

There is still further provided in accordance with another preferred embodiment of the present invention a bioinformatically detectable isolated oligonucleotide which anneals to a portion of a mRNA transcript of a target gene associated with Dementia, which target gene is selected from the group consisting of genes shown in Table 11, row 36, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 8 and 118196-121289, and (b) the complement of a sequence selected from the group consisting of SEQ ID NOs: 857749 and 857713-865105.

There is additionally provided in accordance with another preferred embodiment of the present invention a bioinformatically detectable first oligonucleotide which is a portion of a mRNA transcript of a target gene selected from the group consisting of genes shown in Table 11 row 36, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:8 and 118196-121289.

There is moreover provided in accordance with another preferred embodiment of the present invention a bioinformatically detectable isolated oligonucleotide which anneals to a portion of a mRNA transcript of a target gene associated with Depressive Disorder, which target gene is selected from the group consisting of genes shown in Table 11, row 37, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 1, 2, 4, 9 and 121290-122885, and (b) the complement of a sequence selected from the group consisting of SEQ ID NOs: 865184, 865199, 865494, 868209 and 865106-868820.

There is further provided in accordance with another preferred embodiment of the present invention a bioinformatically detectable first oligonucleotide which is a portion of a mRNA transcript of a target gene selected from the group consisting of genes shown in Table 11 row 37, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:1, 2, 4, 9 and 121290-122885.

There is still further provided in accordance with another preferred embodiment of the present invention a bioinformatically detectable isolated oligonucleotide which anneals to a portion of a mRNA transcript of a target gene associated with Diabetes Mellitus, which target gene is selected from the group consisting of genes shown in Table 11, row 38, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 1, 2, 3, 4, 5, 6, 7, 8, 9 and 122886-133924, and (b) the complement of a sequence selected from the group consisting of SEQ ID NOs: 873495, 876489, 890935, 905639, 907865, 912792, 912900, 914377, 914914 and 868821-917960.

There is additionally provided in accordance with another preferred embodiment of the present invention a bioinformatically detectable first oligonucleotide which is a portion of a mRNA transcript of a target gene selected from the group consisting of genes shown in Table 11 row 38, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:1, 2, 3, 4, 5, 6, 7, 8, 9 and 122886-133924.

There is moreover provided in accordance with another preferred embodiment of the present invention a bioinformatically detectable isolated oligonucleotide which anneals to a portion of a mRNA transcript of a target gene associated with Diabetic Neuropathies, which target gene is selected from the group consisting of genes shown in Table 11, row 39, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 9 and 133925-134125, and (b) the complement of a sequence selected from the group consisting of SEQ ID NOs: 918115 and 917961-918306.

There is further provided in accordance with another preferred embodiment of the present invention a bioinformatically detectable first oligonucleotide which is a portion of a mRNA transcript of a target gene selected from the group consisting of genes shown in Table 11 row 39, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:9 and 133925-134125.

There is still further provided in accordance with another preferred embodiment of the present invention a bioinformatically detectable isolated oligonucleotide which anneals to a portion of a mRNA transcript of a target gene associated with Down Syndrome, which target gene is selected from the group consisting of genes shown in Table 11, row 40, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 2, 3, 4, 5, 8, 9 and 134126-138186, and (b) the complement of a sequence selected from the group consisting of SEQ ID NOs: 918604, 918827, 923948, 924864, 928441, 928497 and 918307-929194.

There is additionally provided in accordance with another preferred embodiment of the present invention a bioinformatically detectable first oligonucleotide which is a portion of a mRNA transcript of a target gene selected from the group consisting of genes shown in Table 11 row 40, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:2, 3, 4, 5, 8, 9 and 134126-138186.

There is moreover provided in accordance with another preferred embodiment of the present invention a bioinformatically detectable isolated oligonucleotide which anneals to a portion of a mRNA transcript of a target gene associated with *E. coli*, which target gene is selected from the group consisting of genes shown in Table 11, row 41, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 7 and 138187-138875, and (b) the complement of a sequence selected from the group consisting of SEQ ID NOs: 930567 and 929195-930609.

There is further provided in accordance with another preferred embodiment of the present invention a bioinformatically detectable first oligonucleotide which is a portion of a mRNA transcript of a target gene selected from the group consisting of genes shown in Table 11 row 41, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:7 and 138187-138875.

There is still further provided in accordance with another preferred embodiment of the present invention a bioinformatically detectable isolated oligonucleotide which anneals to a portion of a mRNA transcript of a target gene associated with EBV, which target gene is selected from the group consisting of genes shown in Table 11, row 42, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 2, 4 and 138876-140216, and (b) the complement of a sequence selected from the group consisting of SEQ ID NOs: 930864, 930991 and 930610-932977.

There is additionally provided in accordance with another preferred embodiment of the present invention a bioinformatically detectable first oligonucleotide which is a portion of a mRNA transcript of a target gene selected from the group consisting of genes shown in Table 11 row 42, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:2, 4 and 138876-140216.

There is moreover provided in accordance with another preferred embodiment of the present invention a bioinformatically detectable isolated oligonucleotide which anneals to a portion of a mRNA transcript of a target gene associated with Encephalitis, which target gene is selected from the group consisting of genes shown in Table 11, row 43, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 2, 3, 4, 5 and 140217-141989, and (b) the complement of a sequence selected from the group consisting of SEQ ID NOs: 934591, 935231, 935922, 936660 and 932978-937142.

There is further provided in accordance with another preferred embodiment of the present invention a bioinformatically detectable first oligonucleotide which is a portion of a mRNA transcript of a target gene selected from the group consisting of genes shown in Table 11 row 43, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:2, 3, 4, 5 and 140217-141989.

There is still further provided in accordance with another preferred embodiment of the present invention a bioinformatically detectable isolated oligonucleotide which anneals to a portion of a mRNA transcript of a target gene associated with Endometrial carcinoma, which target gene is selected from the group consisting of genes shown in Table 11, row 44, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 1, 2, 4, 5 and 141990-146429, and (b) the complement of a sequence selected from the group consisting of SEQ ID NOs: 937700, 945056, 945576 and 937143-947495.

There is additionally provided in accordance with another preferred embodiment of the present invention a bioinformatically detectable first oligonucleotide which is a portion of a mRNA transcript of a target gene selected from the group consisting of genes shown in Table 11 row 44, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:1, 2, 4, 5 and 141990-146429.

There is moreover provided in accordance with another preferred embodiment of the present invention a bioinformatically detectable isolated oligonucleotide which anneals to a portion of a mRNA transcript of a target gene associated with Epilepsy, which target gene is selected from the group consisting of genes shown in Table 11, row 45, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 4, 6, 7, 8, 9 and 146430-150366, and (b) the complement of a sequence selected from the group consisting of SEQ ID NOs: 948495, 948823, 950041, 957222, 957491 and 947496-958361.

There is further provided in accordance with another preferred embodiment of the present invention a bioinformatically detectable first oligonucleotide which is a portion of a mRNA transcript of a target gene selected from the group consisting of genes shown in Table 11 row 45, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:4, 6, 7, 8, 9 and 146430-150366.

There is still further provided in accordance with another preferred embodiment of the present invention a bioinformatically detectable isolated oligonucleotide which anneals to a portion of a mRNA transcript of a target gene associated with Esophageal cancer, which target gene is selected from the group consisting of genes shown in Table 11, row 46, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 2, 4, 5 and 150367-157081, and (b) the complement of a sequence selected from the group consisting of SEQ ID NOs: 965109, 965621, 967984 and 958362-977920.

There is additionally provided in accordance with another preferred embodiment of the present invention a bioinformatically detectable first oligonucleotide which is a portion of a mRNA transcript of a target gene selected from the group consisting of genes shown in Table 11 row 46, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:2, 4, 5 and 150367-157081.

There is moreover provided in accordance with another preferred embodiment of the present invention a bioinformatically detectable isolated oligonucleotide which anneals to a portion of a mRNA transcript of a target gene associated with Gestational Diabetes, which target gene is selected from the group consisting of genes shown in Table 11, row 47, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 4 and 157082-157975, and (b) the complement of a sequence selected from the group consisting of SEQ ID NOs: 978234 and 977921-979856.

There is further provided in accordance with another preferred embodiment of the present invention a bioinformatically detectable first oligonucleotide which is a portion of a mRNA transcript of a target gene selected from the group consisting of genes shown in Table 11 row 47, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:4 and 157082-157975.

There is still further provided in accordance with another preferred embodiment of the present invention a bioinformatically detectable isolated oligonucleotide which anneals to a portion of a mRNA transcript of a target gene associated with Hemolytic anemia, which target gene is selected from the group consisting of genes shown in Table 11, row 48, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 5 and 157976-159408, and (b) the complement of a sequence selected from the group consisting of SEQ ID NOs: 980916 and 979857-982618.

There is additionally provided in accordance with another preferred embodiment of the present invention a bioinformatically detectable first oligonucleotide which is a portion of a mRNA transcript of a target gene selected from the group consisting of genes shown in Table 11 row 48, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:5 and 157976-159408.

There is moreover provided in accordance with another preferred embodiment of the present invention a bioinformatically detectable isolated oligonucleotide which anneals to a portion of a mRNA transcript of a target gene associated with Hepatitis, which target gene is selected from the group consisting of genes shown in Table 11, row 49, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 1, 2, 4 and 159409-162998, and (b) the complement of a sequence selected from the group consisting of SEQ ID NOs: 982753, 987503, 989853 and 982619-990063.

There is further provided in accordance with another preferred embodiment of the present invention a bioinformatically detectable first oligonucleotide which is a portion of a mRNA transcript of a target gene selected from the group consisting of genes shown in Table 11 row 49, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:1, 2, 4 and 159409-162998.

There is still further provided in accordance with another preferred embodiment of the present invention a bioinformatically detectable isolated oligonucleotide which anneals to a portion of a mRNA transcript of a target gene associated with Hepatocellular carcinoma, which target gene is selected from the group consisting of genes shown in Table 11, row 50, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 2, 4, 5, 6, 8, 9 and 162999-169899, and (b) the complement of a sequence selected from the group consisting of SEQ ID NOs: 993716, 993916, 1005318, 1007352, 1007621, 1009512 and 990064-1010372.

There is additionally provided in accordance with another preferred embodiment of the present invention a bioinformatically detectable first oligonucleotide which is a portion of a mRNA transcript of a target gene selected from the group consisting of genes shown in Table 11 row 50, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:2, 4, 5, 6, 8, 9 and 162999-169899.

There is moreover provided in accordance with another preferred embodiment of the present invention a bioinformatically detectable isolated oligonucleotide which anneals to a portion of a mRNA transcript of a target gene associated with Herpes, which target gene is selected from the group consisting of genes shown in Table 11, row 51, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 2, 4, 5 and 169900-170780, and (b) the complement of a sequence selected from the group consisting of SEQ ID NOs: 1010547, 1011819 and 1010373-1012009.

There is further provided in accordance with another preferred embodiment of the present invention a bioinformatically detectable first oligonucleotide which is a portion of a mRNA transcript of a target gene selected from the group consisting of genes shown in Table 11 row 51, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:2, 4, 5 and 169900-170780.

There is still further provided in accordance with another preferred embodiment of the present invention a bioinformatically detectable isolated oligonucleotide which anneals to a portion of a mRNA transcript of a target gene associated with HIV, which target gene is selected from the group consisting of genes shown in Table 11, row 52, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 2, 3, 4, 5, 6, 7, 8, 9 and 170781-182163, and (b) the complement of a sequence selected from the group consisting of SEQ ID NOs: 1016403, 1020340, 1021892, 1025469, 1034095, 1036559, 1039213, 1059225 and 1012010-1066060.

There is additionally provided in accordance with another preferred embodiment of the present invention a bioinformatically detectable first oligonucleotide which is a portion of a mRNA transcript of a target gene selected from the group consisting of genes shown in Table 11 row 52, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:2, 3, 4, 5, 6, 7, 8, 9 and 170781-182163.

There is moreover provided in accordance with another preferred embodiment of the present invention a bioinformatically detectable isolated oligonucleotide which anneals to a portion of a mRNA transcript of a target gene associated with Hodgkin Disease, which target gene is selected from the group consisting of genes shown in Table 11, row 53, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 4, 7 and 182164-184872, and (b) the complement of a sequence selected from the group consisting of SEQ ID NOs: 1070393, 1070600 and 1066061-1072255.

There is further provided in accordance with another preferred embodiment of the present invention a bioinformatically detectable first oligonucleotide which is a portion of a mRNA transcript of a target gene selected from the group consisting of genes shown in Table 11 row 53, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:4, 7 and 182164-184872.

There is still further provided in accordance with another preferred embodiment of the present invention a bioinformatically detectable isolated oligonucleotide which anneals to a portion of a mRNA transcript of a target gene associated with HTLV, which target gene is selected from the group consisting of genes shown in Table 11, row 54, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 3 and 184873-185735, and (b) the complement of a sequence selected from the group consisting of SEQ ID NOs: 1073162 and 1072256-1073988.

There is additionally provided in accordance with another preferred embodiment of the present invention a bioinformatically detectable first oligonucleotide which is a portion of a mRNA transcript of a target gene selected from the group consisting of genes shown in Table 11 row 54, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:3 and 184873-185735.

There is moreover provided in accordance with another preferred embodiment of the present invention a bioinformatically detectable isolated oligonucleotide which anneals to a portion of a mRNA transcript of a target gene associated with Hypercholesterolemia, which target gene is selected from the group consisting of genes shown in Table 11, row 55, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 2, 3, 4, 5, 6, 9 and 185736-187896, and (b) the complement of a sequence selected from the group consisting of SEQ ID NOs: 1074582, 1074720, 1075037, 1075126, 1075843, 1078670 and 1073989-1078934.

There is further provided in accordance with another preferred embodiment of the present invention a bioinformatically detectable first oligonucleotide which is a portion of a mRNA transcript of a target gene selected from the group consisting of genes shown in Table 11 row 55, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:2, 3, 4, 5, 6, 9 and 185736-187896.

There is still further provided in accordance with another preferred embodiment of the present invention a bioinformatically detectable isolated oligonucleotide which anneals to a portion of a mRNA transcript of a target gene associated with Hyperlipidemia, which target gene is selected from the group consisting of genes shown in Table 11, row 56, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 6 and 187897-188796, and (b) the complement of a sequence selected from the group consisting of SEQ ID NOs: 1080228 and 1078935-1080845.

There is additionally provided in accordance with another preferred embodiment of the present invention a bioinformatically detectable first oligonucleotide which is a portion of a mRNA transcript of a target gene selected from the group consisting of genes shown in Table 11 row 56, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:6 and 187897-188796.

There is moreover provided in accordance with another preferred embodiment of the present invention a bioinformatically detectable isolated oligonucleotide which anneals to a portion of a mRNA transcript of a target gene associated with Hypertension, which target gene is selected from the group consisting of genes shown in Table 11, row 57, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 2, 3, 4, 5, 6 and 188797-192961, and (b) the complement of a sequence selected from the group consisting of SEQ ID NOs: 1085210, 1085664, 1087844, 1089045, 1089716 and 1080846-1091130.

There is further provided in accordance with another preferred embodiment of the present invention a bioinformatically detectable first oligonucleotide which is a portion of a mRNA transcript of a target gene selected from the group consisting of genes shown in Table 11 row 57, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:2, 3, 4, 5, 6 and 188797-192961.

There is still further provided in accordance with another preferred embodiment of the present invention a bioinformatically detectable isolated oligonucleotide which anneals to a portion of a mRNA transcript of a target gene associated with Hypertrophic cardiomyopathy, which target gene is selected from the group consisting of genes shown in Table 11, row 58, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 1, 8 and 192962-193617, and (b) the complement of a sequence selected from the group consisting of SEQ ID NOs: 1091710, 1091785 and 1091131-1092040.

There is additionally provided in accordance with another preferred embodiment of the present invention a bioinformatically detectable first oligonucleotide which is a portion of a mRNA transcript of a target gene selected from the group consisting of genes shown in Table 11 row 58, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:1, 8 and 192962-193617.

There is moreover provided in accordance with another preferred embodiment of the present invention a bioinformatically detectable isolated oligonucleotide which anneals to a portion of a mRNA transcript of a target gene associated with Infertility, which target gene is selected from the group consisting of genes shown in Table 11, row 59, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 1, 2, 3, 4 and 193618-195919, and (b) the complement of a sequence selected from the group consisting of SEQ ID NOs: 1092671, 1093478, 1093837, 1095824 and 1092041-1096852.

There is further provided in accordance with another preferred embodiment of the present invention a bioinformatically detectable first oligonucleotide which is a portion of a mRNA transcript of a target gene selected from the group consisting of genes shown in Table 11 row 59, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:1, 2, 3, 4 and 193618-195919.

There is still further provided in accordance with another preferred embodiment of the present invention a bioinformatically detectable isolated oligonucleotide which anneals to a portion of a mRNA transcript of a target gene associated with Insulin-Dependent Diabetes Mellitus, which target gene is selected from the group consisting of genes shown in Table 11, row 60, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 1, 2, 3, 4, 5, 6, 7, 8, 9 and 195920-203885, and (b) the complement of a sequence selected from the group consisting of SEQ ID NOs: 1099174, 1100156, 1102360, 1104859, 1106580, 1108401, 1109682, 1111400, 1116325 and 1096853-1121723.

There is additionally provided in accordance with another preferred embodiment of the present invention a bioinformatically detectable first oligonucleotide which is a portion of a mRNA transcript of a target gene selected from the group consisting of genes shown in Table 11 row 60, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:1, 2, 3, 4, 5, 6, 7, 8, 9 and 195920-203885.

There is moreover provided in accordance with another preferred embodiment of the present invention a bioinformatically detectable isolated oligonucleotide which anneals to a portion of a mRNA transcript of a target gene associated with Intestinal Neoplasms, which target gene is selected from the group consisting of genes shown in Table 11, row 61, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 3, 8 and 203886-206003, and (b) the complement of a sequence selected from the group consisting of SEQ ID NOs: 1123085, 1126105 and 1121724-1126428.

There is further provided in accordance with another preferred embodiment of the present invention a bioinformatically detectable first oligonucleotide which is a portion of a mRNA transcript of a target gene selected from the group consisting of genes shown in Table 11 row 61, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:3, 8 and 203886-206003.

There is still further provided in accordance with another preferred embodiment of the present invention a bioinformatically detectable isolated oligonucleotide which anneals to a portion of a mRNA transcript of a target gene associated with Kidney Failure, which target gene is selected from the group consisting of genes shown in Table 11, row 62, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 1, 3, 4, 8 and 206004-207959, and (b) the complement of a sequence selected from the group consisting of SEQ ID NOs: 1127252, 1128714, 1130019, 1130111 and 1126429-1130552.

There is additionally provided in accordance with another preferred embodiment of the present invention a bioinformatically detectable first oligonucleotide which is a portion of a mRNA transcript of a target gene selected from the group consisting of genes shown in Table 11 row 62, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:1, 3, 4, 8 and 206004-207959.

There is moreover provided in accordance with another preferred embodiment of the present invention a bioinformatically detectable isolated oligonucleotide which anneals to a portion of a mRNA transcript of a target gene associated with Leukemia, which target gene is selected from the group consisting of genes shown in Table 11, row 63, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 1, 2, 3, 4, 5, 6, 7, 8, 9 and 207960-219782, and (b) the complement of a sequence selected from the group consisting of SEQ ID NOs: 1139319, 1143895, 1148321, 1152010, 1167196, 1176875, 1179489, 1188269, 1190430 and 1130553-1192133.

There is further provided in accordance with another preferred embodiment of the present invention a bioinformatically detectable first oligonucleotide which is a portion of a mRNA transcript of a target gene selected from the group consisting of genes shown in Table 11 row 63, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:1, 2, 3, 4, 5, 6, 7, 8, 9 and 207960-219782.

There is still further provided in accordance with another preferred embodiment of the present invention a bioinformatically detectable isolated oligonucleotide which anneals to a portion of a mRNA transcript of a target gene associated with Lung cancer, which target gene is selected from the group consisting of genes shown in Table 11, row 64, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 1, 2, 3, 4, 5, 6, 7, 8, 9 and 219783-233017, and (b) the complement of a sequence selected from the group consisting of SEQ ID NOs: 1192848, 1206194, 1212204, 1231034, 1237185, 1254223, 1265270, 1275904, 1278916 and 1192134-1281827.

There is additionally provided in accordance with another preferred embodiment of the present invention a bioinformatically detectable first oligonucleotide which is a portion of a mRNA transcript of a target gene selected from the group consisting of genes shown in Table 11 row 64, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:1, 2, 3, 4, 5, 6, 7, 8, 9 and 219783-233017.

There is moreover provided in accordance with another preferred embodiment of the present invention a bioinformatically detectable isolated oligonucleotide which anneals to a portion of a mRNA transcript of a target gene associated with Lupus Erythematosus, which target gene is selected from the group consisting of genes shown in Table 11, row 65, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 2, 4, 5 and 233018-236892, and (b) the complement of a sequence selected from the group consisting of SEQ ID NOs: 1282550, 1286608, 1289906 and 1281828-1290763.

There is further provided in accordance with another preferred embodiment of the present invention a bioinformatically detectable first oligonucleotide which is a portion of a mRNA transcript of a target gene selected from the group consisting of genes shown in Table 11 row 65, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:2, 4, 5 and 233018-236892.

There is still further provided in accordance with another preferred embodiment of the present invention a bioinformatically detectable isolated oligonucleotide which anneals to a portion of a mRNA transcript of a target gene associated with Lymphoma, which target gene is selected from the group consisting of genes shown in Table 11, row 66, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 1, 2, 3, 4, 5, 8, 9 and 236893-245820, and (b) the complement of a sequence selected from the group consisting of SEQ ID NOs: 1294513, 1296922, 1299883, 1305370, 1307574, 1310857, 1313187 and 1290764-1323487.

There is additionally provided in accordance with another preferred embodiment of the present invention a bioinformatically detectable first oligonucleotide which is a portion of a mRNA transcript of a target gene selected from the group consisting of genes shown in Table 11 row 66, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:1, 2, 3, 4, 5, 8, 9 and 236893-245820.

There is moreover provided in accordance with another preferred embodiment of the present invention a bioinformatically detectable isolated oligonucleotide which anneals to a portion of a mRNA transcript of a target gene associated with Megaloblastic anemia, which target gene is selected from the group consisting of genes shown in Table 11, row 67, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 3 and 245821-246395, and (b) the complement of a sequence selected from the group consisting of SEQ ID NOs: 1323625 and 1323488-1324618.

There is further provided in accordance with another preferred embodiment of the present invention a bioinformatically detectable first oligonucleotide which is a portion of a mRNA transcript of a target gene selected from the group consisting of genes shown in Table 11 row 67, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:3 and 245821-246395.

There is still further provided in accordance with another preferred embodiment of the present invention a bioinformatically detectable isolated oligonucleotide which anneals to a portion of a mRNA transcript of a target gene associated with Melanoma, which target gene is selected from the group consisting of genes shown in Table 11, row 68, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 1, 2, 3, 4, 5, 8, 9 and 246396-255510, and (b) the complement of a sequence selected from the group consisting of SEQ ID NOs: 1325755, 1329827, 1344554, 1344822, 1346246, 1347255, 1350673 and 1324619-1355010.

There is additionally provided in accordance with another preferred embodiment of the present invention a bioinformatically detectable first oligonucleotide which is a portion of a mRNA transcript of a target gene selected from the group consisting of genes shown in Table 11 row 68, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:1, 2, 3, 4, 5, 8, 9 and 246396-255510.

There is moreover provided in accordance with another preferred embodiment of the present invention a bioinformatically detectable isolated oligonucleotide which anneals to a portion of a mRNA transcript of a target gene associated with Multiple Myeloma, which target gene is selected from the group consisting of genes shown in Table 11, row 69, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 2, 3, 4, 5, 7, 9 and 255511-260801, and (b) the complement of a sequence selected from the group consisting of SEQ ID NOs: 1356299, 1357626, 1358102, 1359792, 1363307, 1364428 and 1355011-1369725.

There is further provided in accordance with another preferred embodiment of the present invention a bioinformatically detectable first oligonucleotide which is a portion of a mRNA transcript of a target gene selected from the group consisting of genes shown in Table 11 row 69, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:2, 3, 4, 5, 7, 9 and 255511-260801.

There is still further provided in accordance with another preferred embodiment of the present invention a bioinformatically detectable isolated oligonucleotide which anneals to a portion of a mRNA transcript of a target gene associated with Multiple Sclerosis, which target gene is selected from the group consisting of genes shown in Table 11, row 70, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 2, 3, 4, 5, 6, 7 and 260802-270006, and (b) the complement of a sequence selected from the group consisting of SEQ ID NOs: 1373644, 1376311, 1380037, 1386570, 1401556, 1402175 and 1369726-1402294.

There is additionally provided in accordance with another preferred embodiment of the present invention a bioinformatically detectable first oligonucleotide which is a portion of a mRNA transcript of a target gene selected from the group consisting of genes shown in Table 11 row 70, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:2, 3, 4, 5, 6, 7 and 260802-270006.

There is moreover provided in accordance with another preferred embodiment of the present invention a bioinformatically detectable isolated oligonucleotide which anneals to a portion of a mRNA transcript of a target gene associated with *Mycoplasma*, which target gene is selected from the group consisting of genes shown in Table 11, row 71, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 7 and 270007-270127, and (b) the complement of a sequence selected from the group consisting of SEQ ID NOs: 1402440 and 1402295-1402560.

There is further provided in accordance with another preferred embodiment of the present invention a bioinformatically detectable first oligonucleotide which is a portion of a mRNA transcript of a target gene selected from the group consisting of genes shown in Table 11 row 71, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:7 and 270007-270127.

There is still further provided in accordance with another preferred embodiment of the present invention a bioinformatically detectable isolated oligonucleotide which anneals to a portion of a mRNA transcript of a target gene associated with Myocardial Infarction, which target gene is selected from the group consisting of genes shown in Table 11, row 72, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 2, 4, 5, 9 and 270128-273123, and (b) the complement of a sequence selected from the group consisting of SEQ ID NOs: 1402767, 1404818, 1409126 and 1402561-1409743.

There is additionally provided in accordance with another preferred embodiment of the present invention a bioinformatically detectable first oligonucleotide which is a portion of a mRNA transcript of a target gene selected from the group consisting of genes shown in Table 11 row 72, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:2, 4, 5, 9 and 270128-273123.

There is moreover provided in accordance with another preferred embodiment of the present invention a bioinformatically detectable isolated oligonucleotide which anneals to a portion of a mRNA transcript of a target gene associated with Myopathy, which target gene is selected from the group consisting of genes shown in Table 11, row 73, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 1, 3, 4, 5, 8 and 273124-277208, and (b) the complement of a sequence selected from the group consisting of SEQ ID NOs: 1411884, 1415279, 1416040, 1416101, 1416399 and 1409744-1418387.

There is further provided in accordance with another preferred embodiment of the present invention a bioinformatically detectable first oligonucleotide which is a portion of a mRNA transcript of a target gene selected from the group consisting of genes shown in Table 11 row 73, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:1, 3, 4, 5, 8 and 273124-277208.

There is still further provided in accordance with another preferred embodiment of the present invention a bioinformatically detectable isolated oligonucleotide which anneals to a portion of a mRNA transcript of a target gene associated with Non-Insulin-Dependent Diabetes Mellitus, which target gene is selected from the group consisting of genes shown in Table 11, row 74, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 1, 2, 3, 4, 5, 7, 9 and 277209-286107, and (b) the complement of a sequence selected from the group consisting of SEQ ID NOs: 1422612, 1428492, 1429976, 1431402, 1437363, 1441110, 1444472 and 1418388-1449420.

There is additionally provided in accordance with another preferred embodiment of the present invention a bioinformatically detectable first oligonucleotide which is a portion of a mRNA transcript of a target gene selected from the group consisting of genes shown in Table 11 row 74, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:1, 2, 3, 4, 5, 7, 9 and 277209-286107.

There is moreover provided in accordance with another preferred embodiment of the present invention a bioinformatically detectable isolated oligonucleotide which anneals to a portion of a mRNA transcript of a target gene associated with Nonsmall cell lung cancer, which target gene is selected from the group consisting of genes shown in Table 11, row 75, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 2, 3, 4, 5, 7, 8, 9 and 286108-297453, and (b) the complement of a sequence selected from the group consisting of SEQ ID NOs: 1449455, 1462227, 1466142, 1479753, 1481270, 1492650, 1501017 and 1449421-1503474.

There is further provided in accordance with another preferred embodiment of the present invention a bioinformatically detectable first oligonucleotide which is a portion of a mRNA transcript of a target gene selected from the group consisting of genes shown in Table 11 row 75, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:2, 3, 4, 5, 7, 8, 9 and 286108-297453.

There is still further provided in accordance with another preferred embodiment of the present invention a bioinformatically detectable isolated oligonucleotide which anneals to a portion of a mRNA transcript of a target gene associated with Obesity, which target gene is selected from the group consisting of genes shown in Table 11, row 76, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 1, 2, 3, 4, 5, 6, 8 and 297454-302887, and (b) the complement of a sequence selected from the group consisting of SEQ ID NOs: 1504767, 1511905, 1512173, 1513271, 1513396, 1515436, 1516295 and 1503475-1518557.

There is additionally provided in accordance with another preferred embodiment of the present invention a bioinformatically detectable first oligonucleotide which is a portion of a mRNA transcript of a target gene selected from the group consisting of genes shown in Table 11 row 76, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:1, 2, 3, 4, 5, 6, 8 and 297454-302887.

There is moreover provided in accordance with another preferred embodiment of the present invention a bioinformatically detectable isolated oligonucleotide which anneals to a portion of a mRNA transcript of a target gene associated with Osteoarthritis, which target gene is selected from the group consisting of genes shown in Table 11, row 77, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 2, 4, 5, 7 and 302888-304404, and (b) the complement of a sequence selected from the group consisting of SEQ ID NOs: 1520245, 1520246, 1521185 and 1518558-1521862.

There is further provided in accordance with another preferred embodiment of the present invention a bioinformatically detectable first oligonucleotide which is a portion of a mRNA transcript of a target gene selected from the group consisting of genes shown in Table 11 row 77, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:2, 4, 5, 7 and 302888-304404.

There is still further provided in accordance with another preferred embodiment of the present invention a bioinformatically detectable isolated oligonucleotide which anneals to a portion of a mRNA transcript of a target gene associated with Osteoporosis, which target gene is selected from the group consisting of genes shown in Table 11, row 78, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 1, 2 and 304405-306066, and (b) the complement of a sequence selected from the group consisting of SEQ ID NOs: 1524207, 1525522 and 1521863-1525625.

There is additionally provided in accordance with another preferred embodiment of the present invention a bioinformatically detectable first oligonucleotide which is a portion of a mRNA transcript of a target gene selected from the group consisting of genes shown in Table 11 row 78, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:1, 2 and 304405-306066.

There is moreover provided in accordance with another preferred embodiment of the present invention a bioinformatically detectable isolated oligonucleotide which anneals to a portion of a mRNA transcript of a target gene associated with Ovarian cancer, which target gene is selected from the group consisting of genes shown in Table 11, row 79, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 3, 4 and 306067-306673, and (b) the complement of a sequence selected from the group consisting of SEQ ID NOs: 1525926, 1526754 and 1525626-1526881.

There is further provided in accordance with another preferred embodiment of the present invention a bioinformatically detectable first oligonucleotide which is a portion of a mRNA transcript of a target gene selected from the group consisting of genes shown in Table 11 row 79, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:3, 4 and 306067-306673.

There is still further provided in accordance with another preferred embodiment of the present invention a bioinformatically detectable isolated oligonucleotide which anneals to a portion of a mRNA transcript of a target gene associated with Pagets Disease, which target gene is selected from the group consisting of genes shown in Table 11, row 80, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 2, 4, 5 and 306674-307098, and (b) the complement of a sequence selected from the group consisting of SEQ ID NOs: 1527098, 1527099 and 1526882-1527691.

There is additionally provided in accordance with another preferred embodiment of the present invention a bioinformatically detectable first oligonucleotide which is a portion of a mRNA transcript of a target gene selected from the group consisting of genes shown in Table 11 row 80, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:2, 4, 5 and 306674-307098.

There is moreover provided in accordance with another preferred embodiment of the present invention a bioinformatically detectable isolated oligonucleotide which anneals to a portion of a mRNA transcript of a target gene associated with Pancreatic cancer, which target gene is selected from the group consisting of genes shown in Table 11, row 81, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 2, 4 and 307099-308722, and (b) the complement of a sequence selected from the group consisting of SEQ ID NOs: 1529097, 1529673 and 1527692-1531107.

There is further provided in accordance with another preferred embodiment of the present invention a bioinformatically detectable first oligonucleotide which is a portion of a mRNA transcript of a target gene selected from the group consisting of genes shown in Table 11 row 81, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:2, 4 and 307099-308722.

There is still further provided in accordance with another preferred embodiment of the present invention a bioinformatically detectable isolated oligonucleotide which anneals to a portion of a mRNA transcript of a target gene associated with Pancreatitis, which target gene is selected from the group consisting of genes shown in Table 11, row 82, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 1, 2, 4 and 308723-310671, and (b) the complement of a sequence selected from the group consisting of SEQ ID NOs: 1533367, 1533459, 1533900 and 1531108-1534150.

There is additionally provided in accordance with another preferred embodiment of the present invention a bioinformatically detectable first oligonucleotide which is a portion of a mRNA transcript of a target gene selected from the group consisting of genes shown in Table 11 row 82, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:1, 2, 4 and 308723-310671.

There is moreover provided in accordance with another preferred embodiment of the present invention a bioinformatically detectable isolated oligonucleotide which anneals to a portion of a mRNA transcript of a target gene associated with Parkinson, which target gene is selected from the group consisting of genes shown in Table 11, row 83, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 1, 2, 4, 5, 8 and 310672-315566, and (b) the complement of a sequence selected from the group consisting of SEQ ID NOs: 1538745, 1540648, 1542324, 1543008 and 1534151-1546112.

There is further provided in accordance with another preferred embodiment of the present invention a bioinformatically detectable first oligonucleotide which is a portion of a mRNA transcript of a target gene selected from the group consisting of genes shown in Table 11 row 83, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:1, 2, 4, 5, 8 and 310672-315566.

There is still further provided in accordance with another preferred embodiment of the present invention a bioinformatically detectable isolated oligonucleotide which anneals to a portion of a mRNA transcript of a target gene associated with Pituitary tumor, which target gene is selected from the group consisting of genes shown in Table 11, row 84, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 4 and 315567-318091, and (b) the complement of a sequence selected from the group consisting of SEQ ID NOs: 1548490 and 1546113-1551863.

There is additionally provided in accordance with another preferred embodiment of the present invention a bioinformatically detectable first oligonucleotide which is a portion of a mRNA transcript of a target gene selected from the group consisting of genes shown in Table 11 row 84, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:4 and 315567-318091.

There is moreover provided in accordance with another preferred embodiment of the present invention a bioinformatically detectable isolated oligonucleotide which anneals to a portion of a mRNA transcript of a target gene associated with Polyposis coli, which target gene is selected from the group consisting of genes shown in Table 11, row 85, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 1 and 318092-319885, and (b) the complement of a sequence selected from the group consisting of SEQ ID NOs: 1552495 and 1551864-1555475.

There is further provided in accordance with another preferred embodiment of the present invention a bioinformatically detectable first oligonucleotide which is a portion of a mRNA transcript of a target gene selected from the group consisting of genes shown in Table 11 row 85, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:1 and 318092-319885.

There is still further provided in accordance with another preferred embodiment of the present invention a bioinformatically detectable isolated oligonucleotide which anneals to a portion of a mRNA transcript of a target gene associated with Prostate cancer, which target gene is selected from the group consisting of genes shown in Table 11, row 86, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 1, 2, 3, 4, 5, 6, 7, 8, 9 and 319886-331776, and (b) the complement of a sequence selected from the group consisting of SEQ ID NOs: 1560176, 1567745, 1567746, 1570725, 1572754, 1585351, 1586318, 1590104, 1601618 and 1555476-1616125.

There is additionally provided in accordance with another preferred embodiment of the present invention a bioinformatically detectable first oligonucleotide which is a portion of a mRNA transcript of a target gene selected from the group consisting of genes shown in Table 11 row 86, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:1, 2, 3, 4, 5, 6, 7, 8, 9 and 319886-331776.

There is moreover provided in accordance with another preferred embodiment of the present invention a bioinformatically detectable isolated oligonucleotide which anneals to a portion of a mRNA transcript of a target gene associated with Renal cell carcinoma, which target gene is selected from the group consisting of genes shown in Table 11, row 87, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 1, 2, 4, 5, 6, 8, 9 and 331777-339379, and (b) the complement of a sequence selected from the group consisting of SEQ ID NOs: 1623084, 1624645, 1630149, 1631365, 1632279, 1632601, 1634960 and 1616126-1638267.

There is further provided in accordance with another preferred embodiment of the present invention a bioinformatically detectable first oligonucleotide which is a portion of a mRNA transcript of a target gene selected from the group consisting of genes shown in Table 11 row 87, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:1, 2, 4, 5, 6, 8, 9 and 331777-339379.

There is still further provided in accordance with another preferred embodiment of the present invention a bioinformatically detectable isolated oligonucleotide which anneals to a portion of a mRNA transcript of a target gene associated with Rheumatoid arthritis, which target gene is selected from the group consisting of genes shown in Table 11, row 88, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 2, 3, 4, 5, 7, 8 and 339380-345777, and (b) the complement of a sequence selected from the group consisting of SEQ ID NOs: 1647854, 1648450, 1652438, 1652821, 1654347, 1655395 and 1638268-1656864.

There is additionally provided in accordance with another preferred embodiment of the present invention a bioinformatically detectable first oligonucleotide which is a portion of a mRNA transcript of a target gene selected from the group consisting of genes shown in Table 11 row 88, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:2, 3, 4, 5, 7, 8 and 339380-345777.

There is moreover provided in accordance with another preferred embodiment of the present invention a bioinformatically detectable isolated oligonucleotide which anneals to a portion of a mRNA transcript of a target gene associated with Schizophrenia, which target gene is selected from the group consisting of genes shown in Table 11, row 89, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 1, 2, 3, 4, 5, 6, 7, 9 and 345778-353664, and (b) the complement of a sequence selected from the group consisting of SEQ ID NOs: 1661647, 1664279, 1666399, 1671735, 1676144, 1676419, 1677821 and 1656865-1680643.

There is further provided in accordance with another preferred embodiment of the present invention a bioinformatically detectable first oligonucleotide which is a portion of a mRNA transcript of a target gene selected from the group consisting of genes shown in Table 11 row 89, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:1, 2, 3, 4, 5, 6, 7, 9 and 345778-353664.

There is still further provided in accordance with another preferred embodiment of the present invention a bioinformatically detectable isolated oligonucleotide which anneals to a portion of a mRNA transcript of a target gene associated with Sickle cell anemia, which target gene is selected from the group consisting of genes shown in Table 11, row 90, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 1 and 353665-353965, and (b) the complement of a sequence selected from the group consisting of SEQ ID NOs: 1680710 and 1680644-1681178.

There is additionally provided in accordance with another preferred embodiment of the present invention a bioinformatically detectable first oligonucleotide which is a portion of a mRNA transcript of a target gene selected from the group consisting of genes shown in Table 11 row 90, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:1 and 353665-353965.

There is moreover provided in accordance with another preferred embodiment of the present invention a bioinformatically detectable isolated oligonucleotide which anneals to a portion of a mRNA transcript of a target gene associated with Skin Neoplasms, which target gene is selected from the group consisting of genes shown in Table 11, row 91, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 1, 2, 3, 4, 5, 8 and 353966-357211, and (b) the complement of a sequence selected from the group consisting of SEQ ID NOs: 1682122, 1682809, 1685015, 1688065, 1688674 and 1681179-1689188.

There is further provided in accordance with another preferred embodiment of the present invention a bioinformatically detectable first oligonucleotide which is a portion of a mRNA transcript of a target gene selected from the group consisting of genes shown in Table 11 row 91, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:1, 2, 3, 4, 5, 8 and 353966-357211.

There is still further provided in accordance with another preferred embodiment of the present invention a bioinformatically detectable isolated oligonucleotide which anneals to a portion of a mRNA transcript of a target gene associated with Small cell carcinoma, which target gene is selected from the group consisting of genes shown in Table 11, row 92, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 2, 3, 4, 5, 6, 7, 8, 9 and 357212-366028, and (b) the complement of a sequence selected from the group consisting of SEQ ID NOs: 1691592, 1695929, 1698522, 1704710, 1711184, 1712841, 1713491, 1713961 and 1689189-1718935.

There is additionally provided in accordance with another preferred embodiment of the present invention a bioinformatically detectable first oligonucleotide which is a portion of a mRNA transcript of a target gene selected from the group consisting of genes shown in Table 11 row 92, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:2, 3, 4, 5, 6, 7, 8, 9 and 357212-366028.

There is moreover provided in accordance with another preferred embodiment of the present invention a bioinformatically detectable isolated oligonucleotide which anneals to a portion of a mRNA transcript of a target gene associated with Stroke, which target gene is selected from the group consisting of genes shown in Table 11, row 93, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 9 and 366029-366240, and (b) the complement of a sequence selected from the group consisting of SEQ ID NOs: 1719291 and 1718936-1719322.

There is further provided in accordance with another preferred embodiment of the present invention a bioinformatically detectable first oligonucleotide which is a portion of a mRNA transcript of a target gene selected from the group consisting of genes shown in Table 11 row 93, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:9 and 366029-366240.

There is still further provided in accordance with another preferred embodiment of the present invention a bioinformatically detectable isolated oligonucleotide which anneals to a portion of a mRNA transcript of a target gene associated with Thrombocytopenia, which target gene is selected from the group consisting of genes shown in Table 11, row 94, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 2, 5 and 366241-367479, and (b) the complement of a sequence selected from the group consisting of SEQ ID NOs: 1720002, 1720143 and 1719323-1721893.

There is additionally provided in accordance with another preferred embodiment of the present invention a bioinformatically detectable first oligonucleotide which is a portion of a mRNA transcript of a target gene selected from the group consisting of genes shown in Table 11 row 94, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:2, 5 and 366241-367479.

There is moreover provided in accordance with another preferred embodiment of the present invention a bioinformatically detectable isolated oligonucleotide which anneals to a portion of a mRNA transcript of a target gene associated with Thrombosis, which target gene is selected from the group consisting of genes shown in Table 11, row 95, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 3 and 367480-368957, and (b) the complement of a sequence selected from the group consisting of SEQ ID NOs: 1722618 and 1721894-1724998.

There is further provided in accordance with another preferred embodiment of the present invention a bioinformatically detectable first oligonucleotide which is a portion of a mRNA transcript of a target gene selected from the group consisting of genes shown in Table 11 row 95, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:3 and 367480-368957.

There is still further provided in accordance with another preferred embodiment of the present invention a bioinformatically detectable isolated oligonucleotide which anneals to a portion of a mRNA transcript of a target gene associated with Thyroid carcinoma, which target gene is selected from the group consisting of genes shown in Table 11, row 96, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 2, 4 and 368958-370099, and (b) the complement of a sequence selected from the group consisting of SEQ ID NOs: 1726360, 1727668 and 1724999-1727777.

There is additionally provided in accordance with another preferred embodiment of the present invention a bioinformatically detectable first oligonucleotide which is a portion of a mRNA transcript of a target gene selected from the group consisting of genes shown in Table 11 row 96, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:2, 4 and 368958-370099.

There is moreover provided in accordance with another preferred embodiment of the present invention a bioinformatically detectable isolated oligonucleotide which anneals to a portion of a mRNA transcript of a target gene associated with Thyroiditis, which target gene is selected from the group consisting of genes shown in Table 11, row 97, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 3, 9 and 370100-371570, and (b) the complement of a sequence selected from the group consisting of SEQ ID NOs: 1728962, 1729375 and 1727778-1730405.

There is further provided in accordance with another preferred embodiment of the present invention a bioinformatically detectable first oligonucleotide which is a portion of a mRNA transcript of a target gene selected from the group consisting of genes shown in Table 11 row 97, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:3, 9 and 370100-371570.

There is still further provided in accordance with another preferred embodiment of the present invention a bioinformatically detectable isolated oligonucleotide which anneals to a portion of a mRNA transcript of a target gene associated with Transitional cell carcinoma, which target gene is selected from the group consisting of genes shown in Table 11, row 98, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 1 and 371571-372890, and (b) the complement of a sequence selected from the group consisting of SEQ ID NOs: 1732939 and 1730406-1733000.

There is additionally provided in accordance with another preferred embodiment of the present invention a bioinformatically detectable first oligonucleotide which is a portion of a mRNA transcript of a target gene selected from the group consisting of genes shown in Table 11 row 98, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:1 and 371571-372890.

There is moreover provided in accordance with another preferred embodiment of the present invention a bioinformatically detectable isolated oligonucleotide which anneals to a portion of a mRNA transcript of a target gene associated with Tuberculosis, which target gene is selected from the group consisting of genes shown in Table 11, row 99, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 1, 2, 3, 4, 5 and 372891-373841, and (b) the complement of a sequence selected from the group consisting of SEQ ID NOs: 1733202, 1733678, 1733814, 1734089, 1734449 and 1733001-1734692.

There is further provided in accordance with another preferred embodiment of the present invention a bioinformatically detectable first oligonucleotide which is a portion of a mRNA transcript of a target gene selected from the group consisting of genes shown in Table 11 row 99, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:1, 2, 3, 4, 5 and 372891-373841.

There is still further provided in accordance with another preferred embodiment of the present invention a bioinformatically detectable isolated oligonucleotide which anneals to a portion of a mRNA transcript of a target gene associated with Turner Syndrome, which target gene is selected from the group consisting of genes shown in Table 11, row 100, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 2 and 373842-373977, and (b) the complement of a sequence selected from the group consisting of SEQ ID NOs: 1734716 and 1734693-1734755.

There is additionally provided in accordance with another preferred embodiment of the present invention a bioinformatically detectable first oligonucleotide which is a portion of a mRNA transcript of a target gene selected from the group consisting of genes shown in Table 11 row 100, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:2 and 373842-373977.

There is moreover provided in accordance with another preferred embodiment of the present invention a bioinformatically detectable isolated oligonucleotide which anneals to a portion of a mRNA transcript of a target gene associated with Ulcerative colitis, which target gene is selected from the group consisting of genes shown in Table 11, row 101, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 1, 2, 4 and 373978-376540, and (b) the complement of a sequence selected from the group consisting of SEQ ID NOs: 1735019, 1735846, 1736563 and 1734756-1739752.

There is further provided in accordance with another preferred embodiment of the present invention a bioinformatically detectable first oligonucleotide which is a portion of a mRNA transcript of a target gene selected from the group consisting of genes shown in Table 11 row 101, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:1, 2, 4 and 373978-376540.

There is still further provided in accordance with another preferred embodiment of the present invention a bioinformatically detectable isolated oligonucleotide which anneals to a portion of a mRNA transcript of a target gene associated with Urinary calculi, which target gene is selected from the group consisting of genes shown in Table 11, row 102, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 2, 4 and 376541-376853, and (b) the complement of a sequence selected from the group consisting of SEQ ID NOs: 1739998, 1740265 and 1739753-1740424.

There is additionally provided in accordance with another preferred embodiment of the present invention a bioinformatically detectable first oligonucleotide which is a portion of a mRNA transcript of a target gene selected from the group consisting of genes shown in Table 11 row 102, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:2, 4 and 376541-376853.

There is moreover provided in accordance with another preferred embodiment of the present invention a bioinformatically detectable isolated oligonucleotide which anneals to a portion of a mRNA transcript of a target gene associated with Ventricular tachycardia, which target gene is selected from the group consisting of genes shown in Table 11, row 103, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 2, 7, 9 and 376854-377741, and (b) the complement of a sequence selected from the group consisting of SEQ ID NOs: 1740600, 1740700, 1741971 and 1740425-1742188.

There is further provided in accordance with another preferred embodiment of the present invention a bioinformatically detectable first oligonucleotide which is a portion of a mRNA transcript of a target gene selected from the group consisting of genes shown in Table 11 row 103, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:2, 7, 9 and 376854-377741.

There is still further provided in accordance with another preferred embodiment of the present invention a bioinformatically detectable isolated oligonucleotide which anneals to a portion of a mRNA transcript of a target gene associated with Virus Diseases, which target gene is selected from the group consisting of genes shown in Table 11, row 104, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOs: 2, 4, 5 and 377742-377921, and (b) the complement of a sequence selected from the group consisting of SEQ ID NOs: 1742226, 1742388 and 1742189-1742399.

There is additionally provided in accordance with another preferred embodiment of the present invention a bioinformatically detectable first oligonucleotide which is a portion of a mRNA transcript of a target gene selected from the group consisting of genes shown in Table 11 row 104, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs:2, 4, 5 and 377742-377921.

There is moreover provided in accordance with another preferred embodiment of the present invention a method for bioinformatic detection of microRNA oligonucleotides, the method including: bioinformatically detecting a hairpin shaped precursor oligonucleotide, bioinformatically detecting an oligonucleotide which is endogenously processed from the hairpin shaped precursor oligonucleotide, and bioinformatically detecting a target gene of the oligonucleotide wherein the oligonucleotide anneals to at least one portion of a mRNA transcript of the target gene, and wherein the binding represses expression of the target gene, and the target gene is associated with a disease.

BRIEF DESCRIPTION OF DRAWINGS

FIGS. 5A and 5B are schematic diagrams, which when taken together, illustrate a 'genomic records' concept of the conceptual model of the present invention, addressing the genomic differentiation enigma;

FIGS. 20A and 20B are simplified diagrams, which when taken together illustrate a mode of oligonucleotide therapy applicable to novel oligonucleotides of the present invention;

FIG. 21B is a table summarizing laboratory validation results which validate efficacy of a bioinformatic oligonucleotide detection system constructed and operative in accordance with a preferred embodiment of the present invention;

FIG. 22A and FIG. 22B are a picture and a summary table of laboratory results validating the expression of novel human oligonucleotides detected by a bioinformatic oligonucleotide detection engine constructed and operative in accordance with a preferred embodiment of the present invention, thereby validating the efficacy of the oligonucleotide detection engine of the present invention;

FIG. 24A is an annotated sequence of EST72223 (SEQ ID NO: 225462) comprising known human mRNA oligonucleotide MIR98 and novel human oligonucleotide CAM25 PRECURSOR detected by the oligonucleotide detection system of the present invention. The sequence of EST72223 includes the four marked sequences: the sequence of the miRNA-98 hairpin in bold (SEQ ID NO: 2254589), the sequence of the mature miRNA-98 in bold and underlined (SEQ ID NO: 2254590), the sequence of the GAM25 hairpin in bold (SEQ ID NO: 2254591) and the sequence of the mature miRNA of GAM25 in bold and underlined (SEQ ID NO: 2254592); and FIGS. 24B, 24C and 24D are pictures of laboratory results demonstrating laboratory confirmation of expression of known human oligonucleotide MIR98 and of novel bioinformatically detected human GAM25 RNA respectively, both of FIG. 24A, thus validating the bioinformatic oligonucleotide detection system of the present invention;

BRIEF DESCRIPTION OF SEQUENCES

A Sequence Listing of genomic sequences of the present invention designated SEQ ID NO:1 through SEQ ID: 2254510 is attached to this application, and is hereby incorporated herein. The genomic listing comprises the following nucleotide sequences: nucleotide sequences of 15454 GAM precursors of respective novel oligonucleotides of the present invention; nucleotide sequences of 14676 GAM RNA oligonucleotides of respective novel oligonucleotides of the present invention; and nucleotide sequences of 496883 target gene binding sites of respective novel oligonucleotides of the present invention.

DETAILED DESCRIPTION

Figure 1:
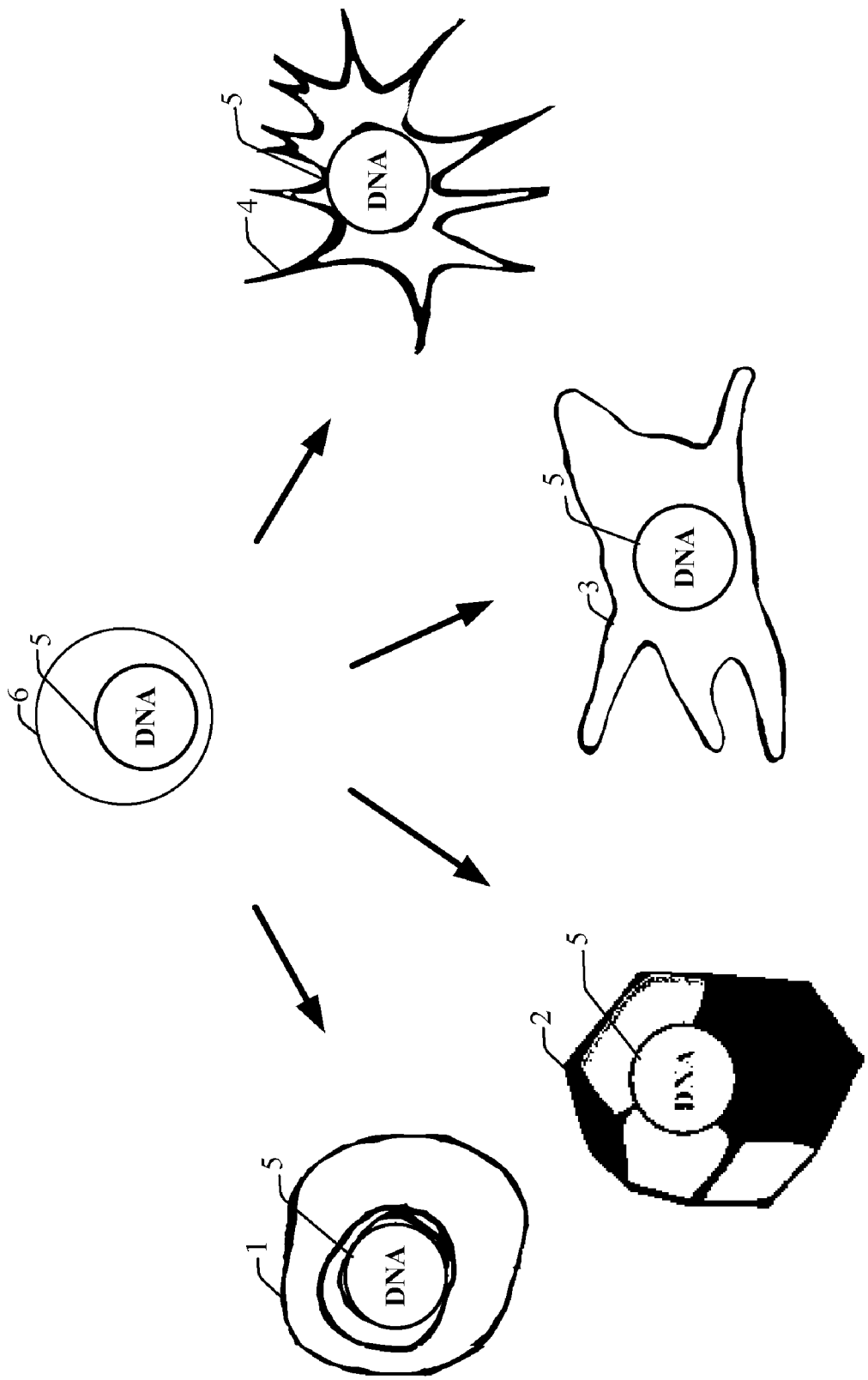
FIG. 1 is a simplified diagram illustrating a genomic differentiation enigma that the present invention addresses.

Reference is now made to FIG. 1 which is a simplified diagram providing a conceptual explanation of a genomic differentiation enigma, which the present invention addresses, inter alia.

FIG. 1 depicts various types of cells in an organism, such as a cartilage cell designated by reference numeral 1, a liver cell designated by reference numeral 2, a fibroblast cell designated by reference numeral 3, and a bone cell designated by reference numeral 4, all containing identical DNA designated by reference numeral 5. Notwithstanding that the various types of cells are all derived from an initial fertilized egg cell designated by reference numeral 6, each of these cells expresses different proteins and accordingly acquire a different shape and function.

The present invention proposes inter alia that the inevitable conclusion from the foregoing is, however, strikingly simple: the genome must contain a modular differentiation coding system. The genome of each cell must include multiple modules or records, possibly a different one for each cell type, as well as a mechanism causing each cell at its inception to be instructed which one of the multiple records governs its behavior.

This modular code concept may be somewhat difficult to grasp, since most persons are accustomed to view things from an external viewpoint. An architect, for example, looks at a plan of a building, which details exactly where each element (block, window, door, electrical switch, etc.) is to be placed relative to all other elements, and, using the plan, instructs builders to place these elements in their designated places. This is an example of an external viewpoint: the architect is external to the plan, which itself is external with respect to the physical building, and with respect to its various elements. The architect may therefore act as an "external organizing agent": seeing the full picture and the relationships between all elements, and being able to instruct from the outside where to place each of them.

According to a preferred embodiment of the present invention, genomic differentiation coding works differently, without any such external organizing agent. It comprises a smart block (the first cell), which is the architect and the plan, and which continuously duplicates itself, somehow knowing when to manifest itself as a block and when as a window, door, or electrical switch.

Reference is now made to FIGS. 2A-4 which are schematic diagrams which, when taken together, provide an analogy that illustrates a conceptual model of the present invention, addressing the genomic differentiation enigma.

Reference is now made to FIG. 2A. An imaginary talented chef, designated by reference numeral 7, is capable of preparing any meal provided that he is given specific written cooking instructions. This chef 7 is equipped with two items: (a) a thick recipe book, designated by reference numeral 8, and (b) a small note, designated by reference numeral 9, having a number scribbled on it. The recipe book 8 comprises multiple pages, each page detailing how to prepare a specific meal. The small note 9 indicates the page to be opened, and therefore the meal to be prepared. The chef looks at the page number written on the note, opens the recipe book to the appropriate page, and prepares the meal according to the written instructions on this page. In the example shown in FIG. 2A, the chef 7 is holding a small note 9 bearing the number 127. He therefore opens the book to page 127, as designated by reference numeral 10. Since this page contains the recipe for preparing bread, the chef 7 prepares a loaf of bread, designated by reference numeral 12. Pages of the book, such as page 10 in the example shown in FIG. 2A, contain additional information, designated by reference numeral 11 which additional data is further elaborated hereinbelow with reference to FIGS. 3 and 4.

Figure 2B:
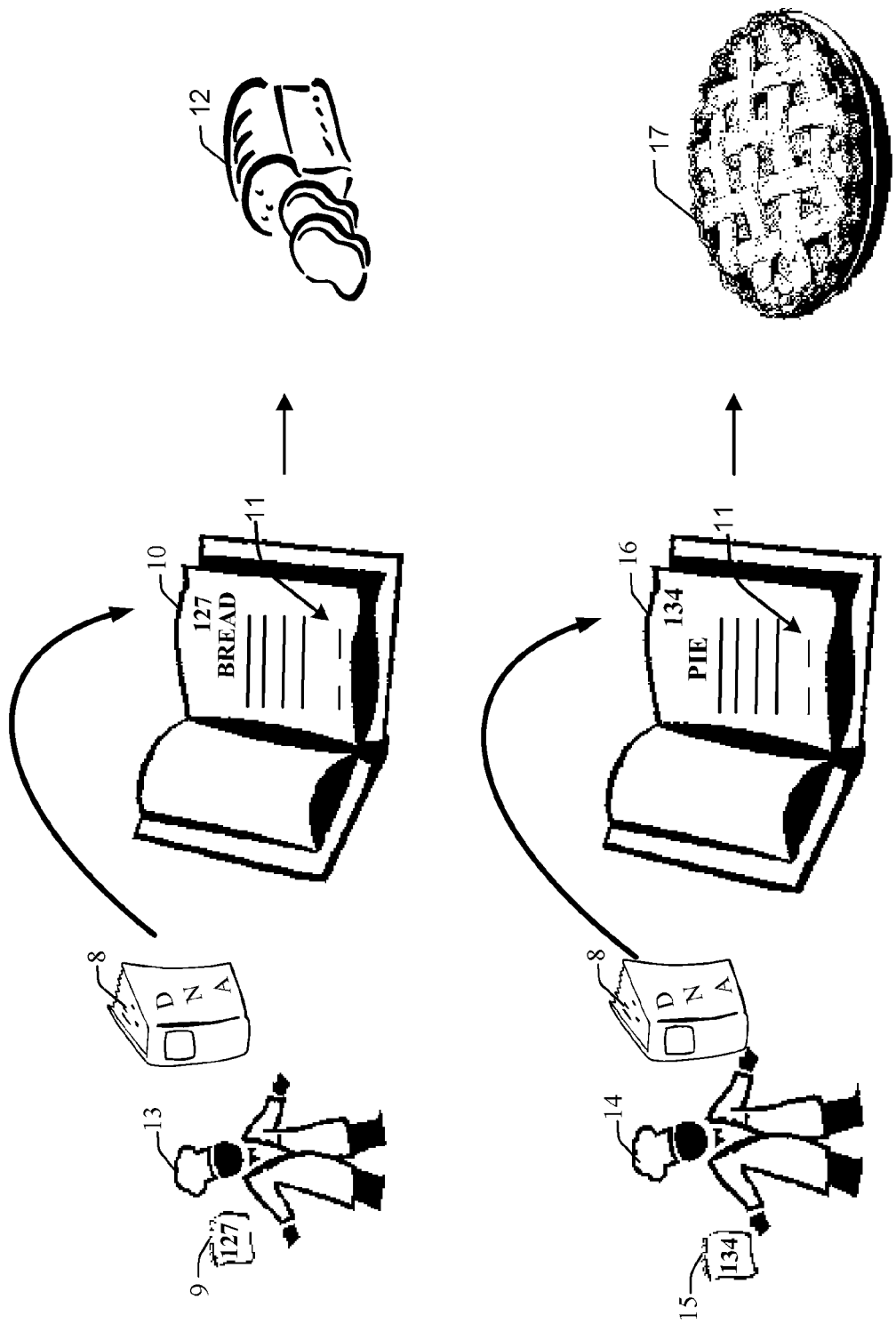
FIGS. 2, 3 and 4 are schematic diagrams which, when taken together, provide an analogy that illustrates a conceptual model of the present invention, addressing the genomic differentiation enigma.

Reference is now made to FIG. 2B, which depicts two identical chefs, a first chef, designated by reference numeral 13, and a second chef, designated by reference numeral 14, both holding an identical recipe book, designated by reference numeral 8. Although the first chef 13 and the second chef 14 are identical, and hold identical recipe books 8, they differ in that they hold different small notes: the first chef 13 holds a small note designated by reference numeral 9, having the number 127 written on it, whereas the second chef 14 holds a small note designated by reference numeral 15, having the number 134 written on it. Accordingly, the first chef 13 opens the book 8 to page 127, as designated by reference numeral 10 and, based on the instructions written on page 127 prepares a loaf of bread, designated by reference numeral 12. The second chef 14 opens the book 8 to page 134, as designated by reference numeral 16 and, based on the instructions written on page 134, prepares a pie, designated by reference numeral 17. Pages in the book, such as pages 10 and 16 in the examples shown in FIG. 2B, contain additional information, designated by reference numeral 11 which additional information is further elaborated hereinbelow with reference to FIGS. 3 and 4.

Figure 3:
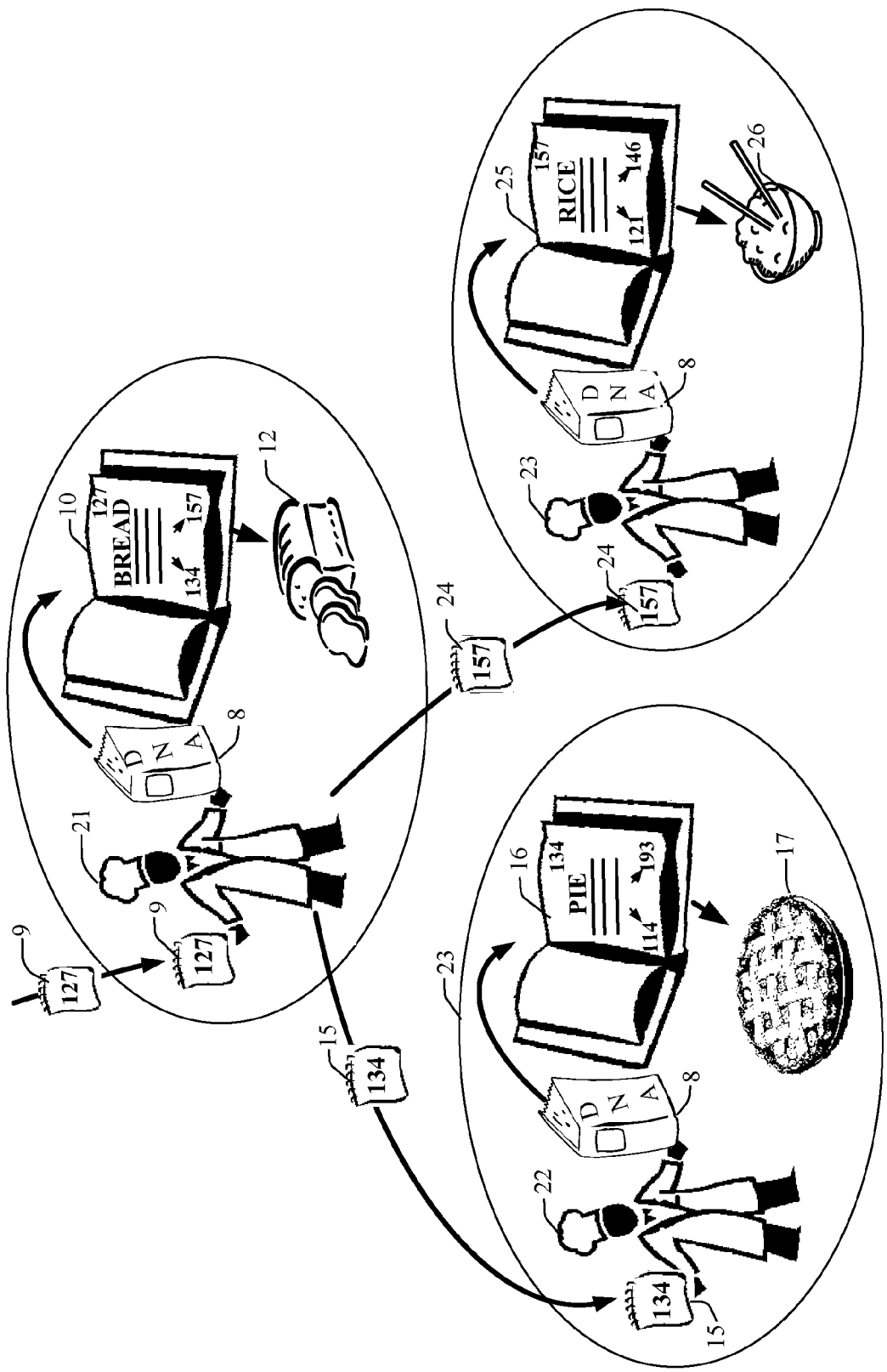

Reference is now made to FIG. 3 which illustrates a mode by which an imaginary chef can duplicate himself yielding two identical chefs, instructing each of the identical duplicate chefs to prepare a different meal. As an example, FIG. 3 shows chef 21 duplicating himself, yielding two duplicate chefs: a first duplicate chef designated by reference numeral 22 and a second duplicate chef designated by reference numeral 23. The duplicate chefs are identical to each other and to chef 21.

Like chefs 7 and 13 (FIGS. 2A and 2B), FIG. 3 shows chef 21 holding a recipe book 8 and receiving a note 9 bearing the number 127. The chef 21 therefore opens the book 8 to page 127, as designated by reference numeral 10, and prepares a loaf of bread 12. However, FIG. 3 also elaborates some of the additional information 11 (FIGS. 2A and 2B) found in page 10: the bottom of page 10, bears two numbers, 134 and 157.

Chef 21 is trained to perform the following three actions when he is finished preparing a meal: (a) Duplicate himself yielding two duplicate chefs, the first duplicate chef 22 and the second duplicate chef 23; (b) Duplicate his recipe book 8, handing an identical copy to each of the duplicate chefs 22 and 23; and (c) Write down the numbers found at the bottom of the page he was instructed to open the book to. In the example of chef 21, since he was instructed to open the book to page 10, he writes the numbers 134 and 157 on two respective notes designated by reference numerals 15 and 24, and hands note 15 bearing the number 134 to the first duplicate chef 22 and note 24 bearing the number 157 to the second duplicate chef 23.

Accordingly, the first duplicate chef 22 receives note 15 bearing the number 134 and therefore opens the recipe book 8 to page 134, as designated by reference numeral 16, and prepares a pie, designated by reference numeral 17. The second duplicate chef 23 receives note 24 bearing the number 157 and therefore opens the recipe book 8 to page 157, as designated by reference numeral 25, and prepares rice, designated by reference numeral 26.

It is appreciated that while chef 21 and duplicate chefs 22 and 23 are identical and hold identical recipe books 8, they each prepare a different meal. It is also appreciated that the meals prepared by the first duplicate chef 22 and the second duplicate chef 23 are determined by chef 21, and are mediated by the differently numbered notes 15 and 24 passed on from chef 21 to duplicate chefs 22 and 23 respectively.

It is further appreciated that the mechanism illustrated by FIG. 3 enables an unlimited lineage of chefs to divide into duplicate, identical chefs and to determine the meals those duplicate chefs would prepare. As an example, since the first duplicate chef 22 is directed to page 134, as designated by reference numeral 16, when he duplicates himself (not shown), he will instruct his two duplicate chefs to prepare meals specified on pages the numbers of which are written at the bottom of page 134, i.e. pages 114 and 193 respectively. Similarly, the second duplicate chef 23 will instruct its duplicate chefs to prepare meals specified on pages 121 and 146 respectively, etc.

Figure 4:
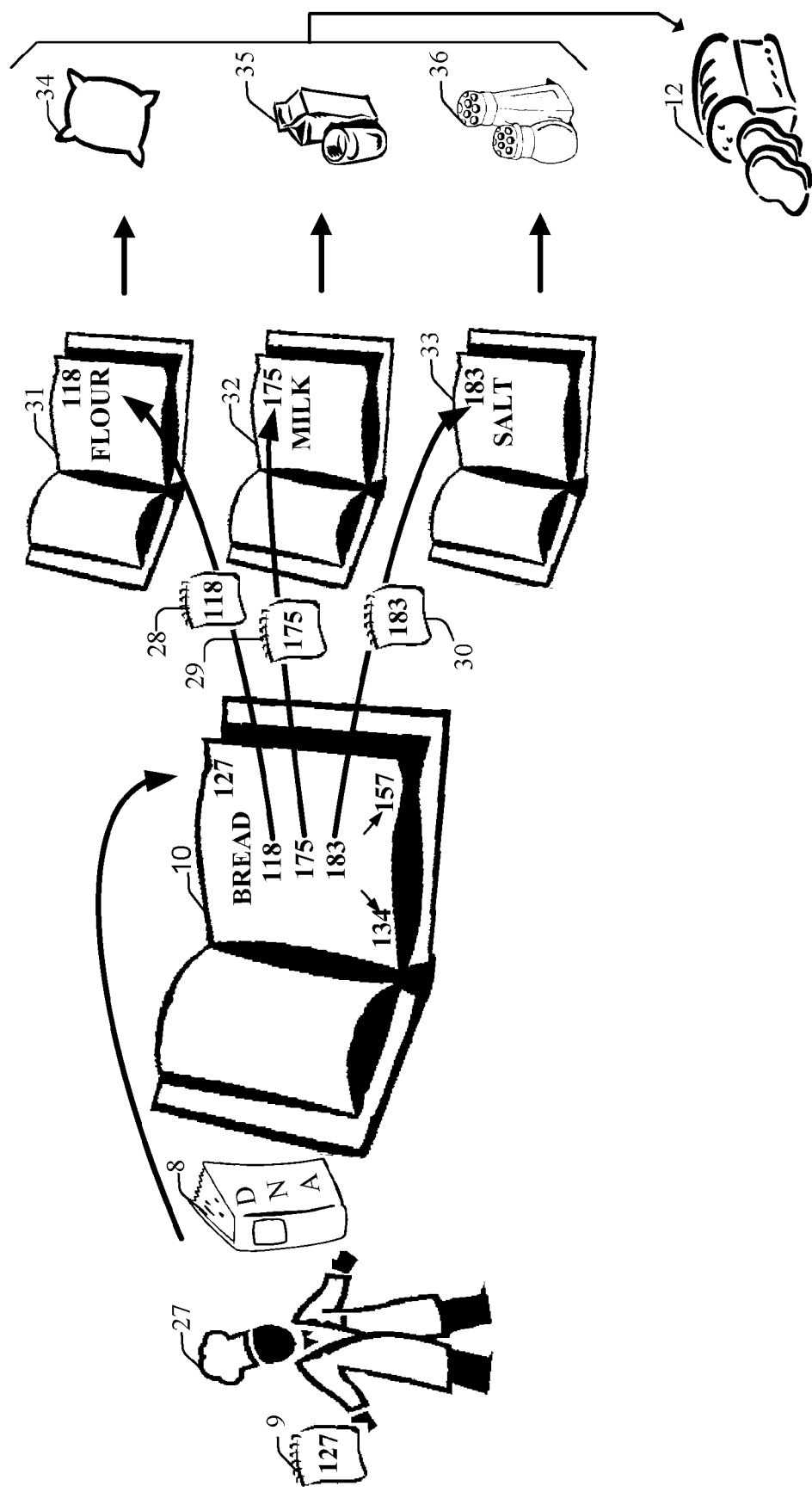

Reference is now made to FIG. 4, which illustrates a mode by which a chef can prepare a meal based on instructions written in a shorthand format: The main meal-page to which a chef is directed by a small note he is given, merely contains a list of numbers which further direct him to other pages, each specifying how to prepare an ingredient of that meal.

To illustrate this shorthand format FIG. 4 shows a chef, designated by reference numeral 27, holding the recipe book 8 and the note 9 which bears the number 127. The chef 27 accordingly opens the recipe book 8 to page 127, as designated by reference numeral 10, and based on instructions on this page prepares bread 12. This is similar to chefs 7, 13 and 21 of FIGS. 2A, 2B and 3 respectively.

However, FIG. 4 also further elaborates some of the additional information 11 (FIGS. 2A and 2B) found in page 10. FIG. 4 shows the cooking "instructions" found on page 10 for making bread 12 written in a shorthand format, comprising only three numbers, 118, 175 and 183. The chef 27 writes these numbers on three respective notes designated by reference numerals 28-30. The notes 28-30 are then used to turn to corresponding pages 31-33 of the book 8, which pages provide instructions for preparation of ingredients required for making bread 12: flour 34, milk 35 and salt 36.

The analogy provided by FIGS. 2A-4 illustrates the conceptual model of the present invention addressing the genomic differentiation enigma, and may be explained as follows: The chefs and duplicate chefs 7, 13, 14, 21-23 and 27 (FIGS. 2A-4) in the given analogy represent cells. The thick recipe book 8 represents the DNA 5 (FIG. 1). Preparing meals such as bread 12, pie 17 or rice 26 (all of FIG. 3) represent the cell manifesting itself as a specific cell-type, such as cartilage cell 1, liver cell 2, fibroblast cell 3, and bone cell 4 (all of FIG. 1). Ingredients of a meal, such as flour 34, milk 35 and salt 36 (all of FIG. 4), represent proteins typically expressed by a cell of a certain cell-type, such as 1-4. Like the different chefs of the analogy, having the same thick recipe book 8 yet preparing different meals, so do different cells in an organism contain the same DNA 5 yet manifest themselves as different cell types, such as 1-4, expressing proteins typical of these respective cell types. Application of analogy of FIGS. 2A-4 to cell-biology is further described hereinbelow with reference to FIGS. 5A-7.

Figure 5A:
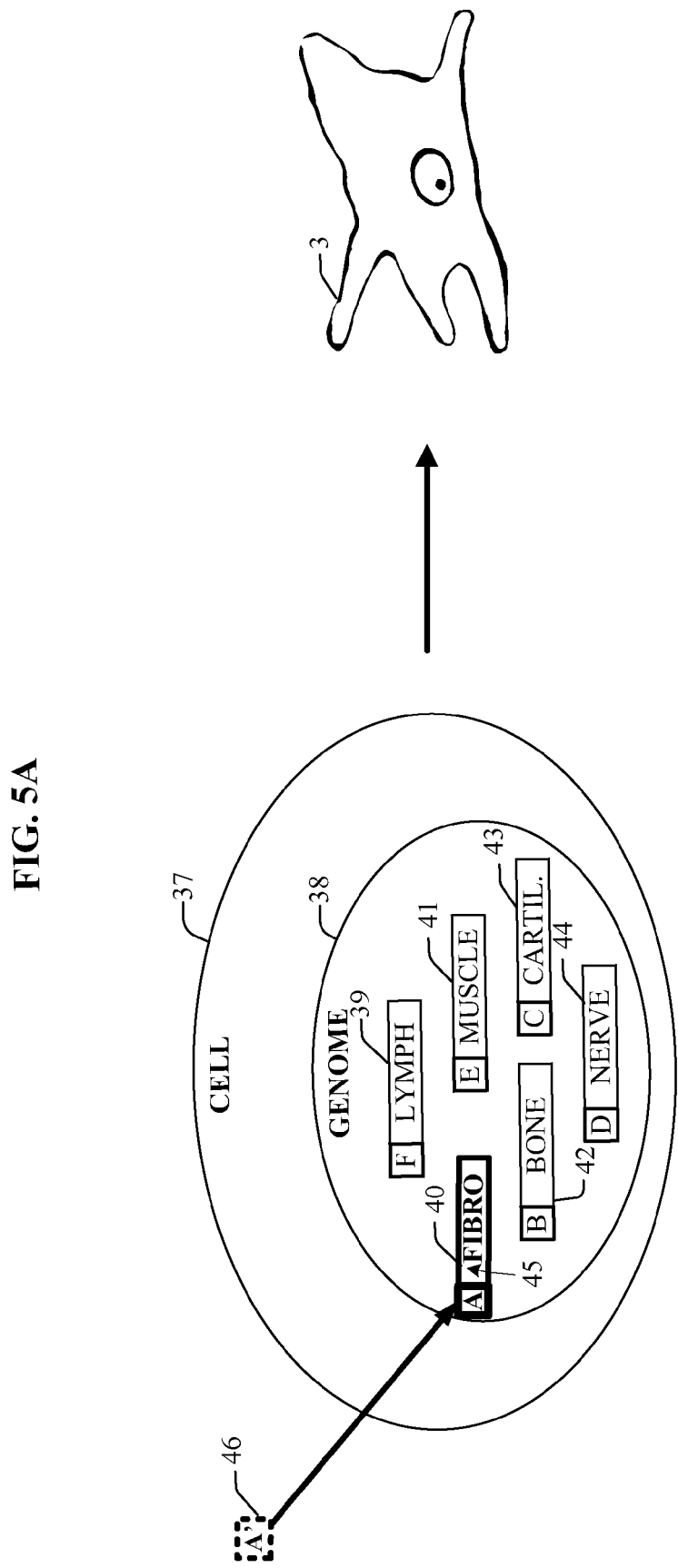

Reference is now made to FIGS. 5A and 5B which are schematic diagrams, which when taken together illustrate a Genomic Records concept of the present invention, addressing the genomic differentiation enigma. FIGS. 5A and 5B correspond to FIGS. 2A and 2B of the chef analogy described hereinabove.

An important aspect of the present invention is the Genomic Records concept. According to a preferred embodiment of the present invention the DNA (the thick recipe book 8 in the illustration) comprises a very large number of Genomic Records (analogous to pages, such as 10, 16 and 25, in the recipe book) containing the instructions for differentiation of a different cell-type, or developmental process. Each Genomic Record comprises a very short genomic sequence which functions as a "Genomic Address" of that Genomic Record (analogous to a page number, such as the numbers 127, 134 and 157 appearing in FIG. 3, in the recipe book). At its inception, in addition to the DNA, each cell also receives a short RNA segment (the scribbled short note, such as 9, 15, 24 of FIG. 3 in the illustration). This short RNA segment binds complementarily to a "Genomic Address" sequence of one of the Genomic Records, thereby modulating expression of that Genomic Record, and accordingly determining the cell's-fate (analogous to opening the recipe book 8 to a page corresponding to a number on the scribbled note, thereby determining the meal to be prepared). A Genomic Record may also comprise multiple short RNA segments each of which binds complementarily to a target protein coding gene, thus modulating expression of this target gene (analogous to the shorthand format whereby a page, such as 10, points to other pages, such as 31-33, encoding various ingredient, such as 34, 35 and 36, all of FIG. 4).

Reference is now made to FIG. 5A. FIG. 5A illustrates a cell 37, having a genome 38. The genome 38 comprises a plurality of Genomic Records, some of which Genomic Records correlate to specific cell-types. As an example, 6 such genomic records are shown, corresponding to 6 cell-types: LYMPH genomic record 39, FIBROBLAST genomic record 40, MUSCLE genomic record 41, BONE genomic record 42, CARTILAGE genomic record 43 and NERVE genomic record 44. Each genomic record comprises genomic instructions on differentiation into a specific cell-type, as further elaborated hereinbelow with reference to FIG. 7. At cell inception, the cell 37 receives a maternal short RNA segment 46, which activates one of the genomic records, causing the cell to differentiate according to the instructions this genomic record comprises. As an example FIG. 5A illustrates reception of a maternal short RNA segment designated 46 having a nucleotide sequence herein symbolically represented by A'.

The FIBROBLAST genomic record 40 contains a binding site having a nucleotide sequence symbolically represented by A, which is complementary to the nucleotide sequence of A', and therefore the short RNA segment 46 binds to the FIBROBLAST genomic record 40. This binding activates the FIBROBLAST genomic record, causing the cell 37 to differentiate into a fibroblast cell-type 3 (FIG. 1). Other genomic records, designated by reference numerals 39 and 41-44, comprise binding sites having nucleotide sequences that are symbolically represented by F, E, B, C and D, which are not complementary of the nucleotide sequence of the short RNA segment 46, and are therefore not activated thereby. Genomic Records, such as the FIBROBLAST genomic record 40 contain additional information, designated by reference numeral 45, which is further elaborated hereinbelow with reference to FIGS. 6 and 7.

Reference is now made to FIG. 5B, which is a simplified schematic diagram, illustrating cellular differentiation mediated by the "Genomic Records" concept. FIG. 5B depicts 2 cells in an organism, CELL A designated by reference numeral 47 and CELL B designated by reference numeral 48, each having a genome 38. It is appreciated that since CELL A 47 and CELL B 48 are cells in the same organism, the genome 38 of cells 47 and 48 is identical. Despite having an identical genome 38, CELL A 47 differentiates differently from CELL B 48, due to activation of different genomic records in these two cells. In CELL A 47 the FIBRO GENOMIC RECORD 40 is activated, causing CELL A 47 to differentiate into a FIBROBLAST CELL 3, whereas in CELL B 48 the BONE GENOMIC RECORD 42 is activated, causing the CELL B 48 to differentiate into a BONE CELL 4 (FIG. 1). The cause for activation of different genomic records in these two cells is the different maternal short RNA which they both received: CELL A 47 received a maternal short RNA segment designated 46 bearing a nucleotide sequence represented by A' activating genomic record FIBRO 40, whereas CELL B 48 received a maternal short RNA segment designated 49 bearing a nucleotide sequence represented by B' activating genomic record BONE 42.

Figure 6:
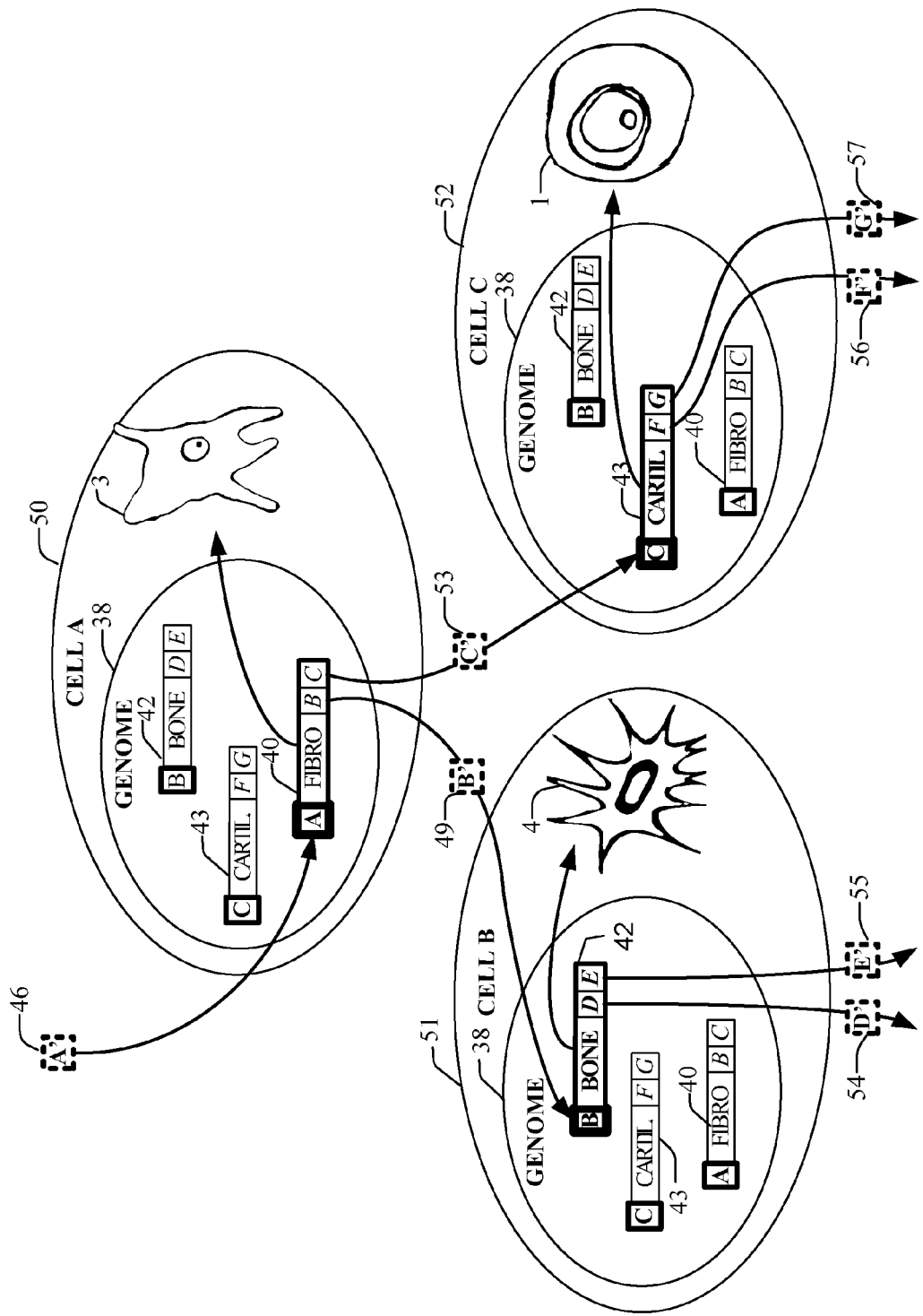
FIG. 6 is a schematic diagram illustrating a 'genomically programmed cell differentiation' concept of the conceptual model of the present invention, addressing the genomic differentiation enigma.

Reference is now made to FIG. 6 which is a schematic diagram illustrating a "genomically programmed cell differentiation" concept of the conceptual model of the present invention, addressing the genomic differentiation enigma.

A cell designated CELL A 50 divides into 2 cells designated CELL B 51 and CELL C 52. CELL A 50, CELL B 51 and CELL C 52, each comprises a GENOME 38. GENOME 38 comprises a plurality of GENOMIC RECORDS, herein exemplified by reference numerals 40, 42 and 43. It is appreciated that since CELL A 50, CELL B 51 and CELL C 52 are cells in the same organism, the GENOME 38 of these cells, and the GENOMIC RECORDS, exemplified by 40, 42 and 43, the genome of these cells comprises, are identical in these cells.

As described above with reference to FIG. 5B, at its inception, CELL A 50 receives a maternal short RNA segment, designated by reference numeral 46, having a nucleotide sequence represented by A' and outlined by a broken line, which activates the FIBRO genomic record 40, thereby causing CELL A 50 to differentiate into a FIBROBLAST CELL 3. However, FIG. 6 elaborates some of the additional information 45 (FIG. 5A) of the genomic records: Genomic record may also comprise two short genomic sequences, referred to here as Daughter Cell Genomic Addresses. Blocks designated B and C are Daughter Cell Genomic Addresses of the FIBRO Genomic Record. At cell division, each parent cell transcribes two short RNA segments, corresponding to the two Daughter Cell Genomic Addresses of the Genomic Record of that parent cell, and transfers one to each of its two daughter cells. CELL A 50 transcribes and transfers to its two daughter cells 51 and 52, two short RNA segments, designated by reference numerals 49 and 53, outlined by a broken line and designated B' and C', corresponding to daughter cell genomic addresses designated B and C comprised in the FIBRO genomic record 40.

CELL B 51 therefore receives the above mentioned maternal short RNA segment designated 49 having a nucleotide sequence represented by B', which binds complementarily to genomic address designated B of the BONE genomic record 42, thereby activating this genomic record, which in turn causes CELL B 51 to differentiate into a BONE CELL 4. Similarly, CELL C 52 receives the above mentioned maternal short RNA segment designated 53 having a nucleotide sequence represented by C', which binds complementarily to genomic address designated C of a CARTILAGE genomic record 43, thereby activating this genomic record, which in turn causes CELL C 52 to differentiate into a CARTILAGE CELL 1 (FIG. 1).

It is appreciated that the mechanism illustrated by FIG. 6 enables an unlimited lineage of cells to divide into daughter cells containing the same DNA 5 (FIG. 1), and to determine the cell-fate of these daughter cells. For example, when CELL B 51 and CELL C 52 divide into their respective daughter cells (not shown), they will transfer short RNA segments designated by reference numerals 54-57, to their respective daughter cells. The cell fate of each of these daughter cells is effected by the identity of the maternal short RNA segments 54-57 they each receive, which in turn determine the genomic record activated.

Figure 7:
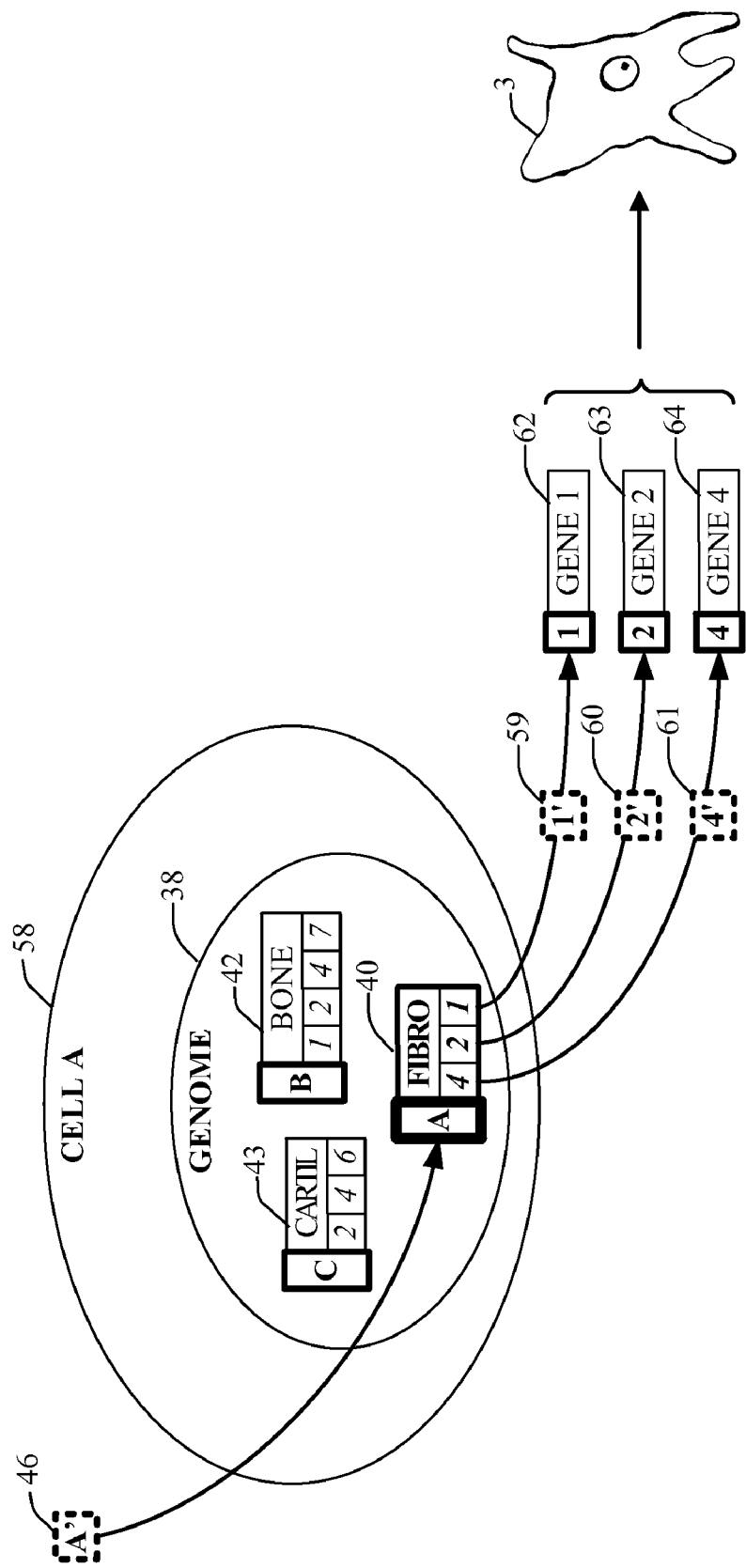
FIG. 7 is a schematic diagram illustrating a 'genomically programmed cell-specific protein expression modulation' concept of the conceptual model of the present invention, addressing the genomic differentiation enigma;>

Reference is now made to FIG. 7 which is a schematic diagram illustrating a "genomically programmed cell-specific protein expression modulation" concept of the conceptual model of the present invention, addressing the genomic differentiation enigma.

Cell A 58 receives a maternal short RNA segment designated 46 having a nucleotide sequence represented by A', which activates the FIBROBLAST genomic record 40, by complementarily binding to a binding site this genomic record comprises, the nucleotide sequence of which binding site is designated A. This is similar to the process shown in FIG. 5A. However, FIG. 7 further elaborates some of the additional information 45 (FIG. 1). The FIBROBLAST genomic record 40 comprises 3 short nucleotide segments, having nucleotide sequences symbolically represented by 1, 2 and 4 respectively, which encode 3 respective short RNA oligonucleotides, designated by reference numerals 59-61. Each of these short RNA oligonucleotides modulates expression of a respective one of the target genes GENE 1, GENE 2 and GENE 4, designated by reference numerals 62-64 respectively, by complementarily binding to a binding site sequence associated with that target gene. In a preferred embodiment of the present invention, the modulation of expression of target genes such as 62-64 comprises translation inhibition of target genes by complementarily binding to binding sites located in untranslated regions of the target genes. Modulation of expression of these genes results in CELL A 58 differentiating into a FIBROBLAST cell-type 3 (FIG. 1).

It is appreciated that the concept of genomic records each comprising a cluster of short RNA segments, which segments modulate expression of target genes thereby modulating differentiation, is compatible with the clusters of miRNA oligonucleotides of the present invention, and their translational inhibition of respective target genes by means of complementarily binding to binding sites located in the untranslated regions of mRNA of these target genes.

Figure 8:
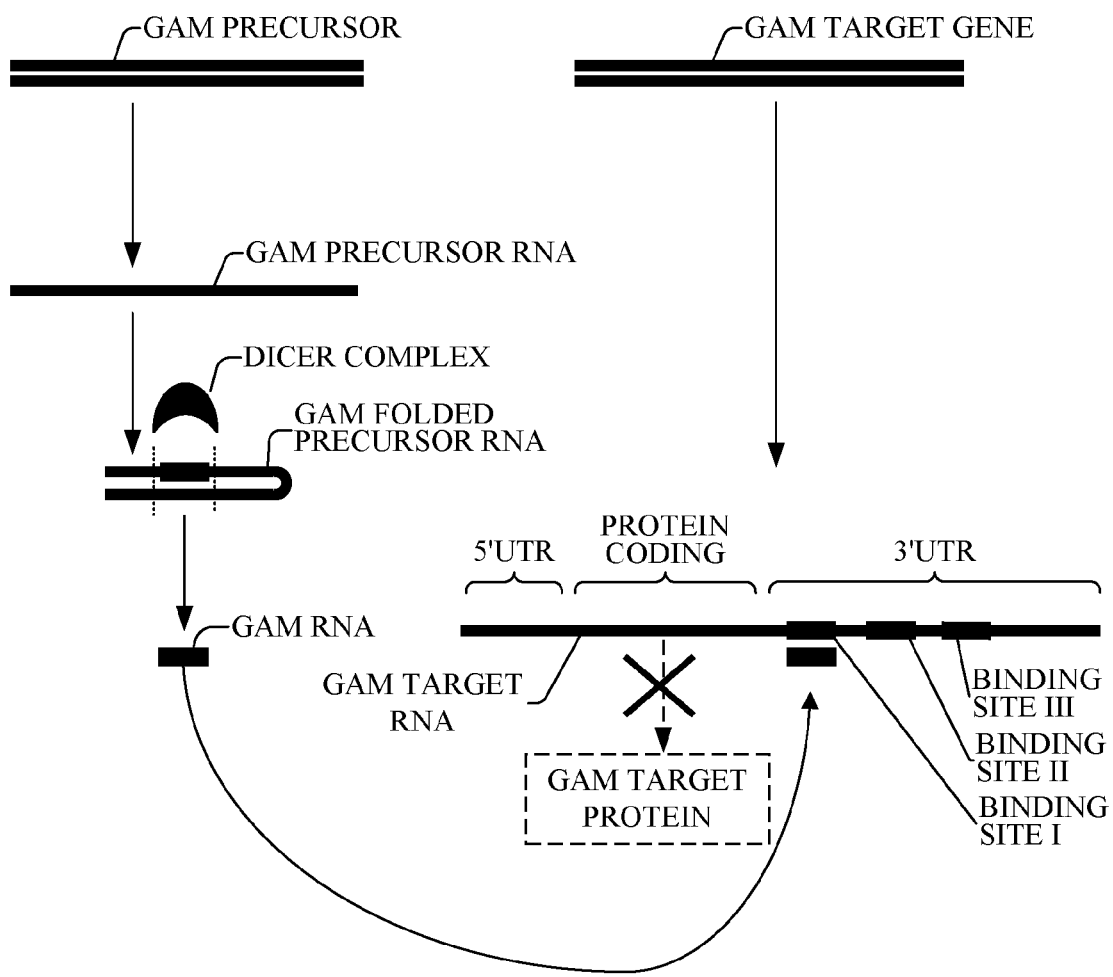
FIG. 8 is a simplified diagram illustrating a mode by which oligonucleotides of a novel group of oligonucleotides of the present invention, modulate expression of known target genes.

Reference is now made to FIG. 8, which is a simplified diagram describing a plurality of novel bioinformatically detected oligonucleotide of the present invention referred to here as Genomic Address Messenger (GAM) oligonucleotide, which modulates expression of respective target genes whose function and utility is known in the art.

GAM is a novel bioinformatically detectable regulatory, non protein coding, microRNA (miRNA)-like oligonucleotide. The method by which GAM is detected is described with additional reference to FIGS. 8-15.

GAM PRECURSOR is encoded by the human genome. GAM TARGET GENE is a gene encoded by the human genome.

GAM PRECURSOR encodes a GAM PRECURSOR RNA. Similar to other miRNA oligonucleotides GAM PRECURSOR RNA does not encode a protein.

GAM PRECURSOR RNA folds onto itself, forming GAM FOLDED PRECURSOR RNA which has a two-dimensional 'hairpin structure'. As is well known in the art, this 'hairpin structure', is typical of RNA encoded by known miRNA oligonucleotides, and is due to the fact that the nucleotide sequence of the first half of the RNA encoded by a miRNA oligonucleotide is a fully or partially complementary sequence of the nucleotide sequence of the second half thereof. By complementary is meant a sequence which is reversed and wherein each nucleotide is replaced by a complementary nucleotide, as is well known in the art (e.g. ATGGC is the complementary sequence of GCCAT). An enzyme complex designated DICER COMPLEX, 'dices' the GAM FOLDED PRECURSOR RNA yielding a GAM RNA in the form of a single stranded ~22 nt long RNA segment. As is known in the art, 'dicing' of a hairpin structured RNA precursor product to yield a short ~22 nt RNA segment is catalyzed by an enzyme complex Dicer RNaseIII together with other necessary proteins.

GAM TARGET GENE encodes a corresponding messenger RNA, GAM TARGET RNA. Each of the GAM TARGET RNAs of the present invention comprises three regions, as is typical of mRNA of a protein coding gene: a 5' untranslated region, a protein coding region and a 3' untranslated region, designated 5'UTR, PROTEIN CODING and 3'UTR respectively.

GAM RNA binds complementarily to one or more target binding sites located in untranslated regions of each of the GAM TARGET RNAs of the present invention. This complementary binding is due to the fact that the nucleotide sequence of GAM RNA is a partial or fully complementary sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is only illustrative and that any suitable number of target binding sites may be present. It is further appreciated that although FIG. 8 shows target binding sites only in the 3'UTR region these target binding sites may be located instead in the 5'UTR region or in both 3'UTR and 5'UTR regions.

The complementary binding of GAM RNA to target binding sites on GAM TARGET RNA, such as BINDING SITE I, BINDING SITE II and BINDING SITE III, inhibits translation of each of the GAM TARGET RNAs of the present invention into GAM TARGET PROTEIN, which is shown surrounded by a broken line.

It is appreciated that GAM TARGET GENE in fact represents a plurality of GAM target genes. The mRNA of each one of this plurality of GAM target genes comprises one or more target binding sites, each having a nucleotide sequence which is at least partly complementary to GAM RNA and which when bound by GAM RNA causes inhibition of translation of the GAM target mRNA into a corresponding GAM target protein.

The mechanism of the translational inhibition exerted by GAM RNA on one or more GAM TARGET GENEs may be similar or identical to the known mechanism of translational inhibition exerted by known miRNA oligonucleotides.

Nucleotide sequences of each of a plurality of GAM oligonucleotides described by FIG. 8 and their respective genomic sources and genomic locations are set forth in Tables 1-3, hereby incorporated herein.

Nucleotide sequences of GAM PRECURSOR RNAs, and a schematic representation of a predicted secondary folding of GAM FOLDED PRECURSOR RNAs, of each of a plurality of GAM oligonucleotides described by FIG. 8 are set forth in Table 4, hereby incorporated herein.

Nucleotide sequences of diced' GAM RNAs of each of a plurality of GAM oligonucleotides described by FIG. 8 are set forth in Table 5, hereby incorporated herein.

Nucleotide sequences of target binding sites, such as BINDING SITE I, BINDING SITE II and BINDING SITE III found on GAM TARGET RNAs of each of a plurality of GAM oligonucleotides described by FIG. 8, and a schematic representation of the complementarity of each of these target binding sites to each of a plurality of GAM RNAs described by FIG. 8 are set forth in Tables 6-7, hereby incorporated herein.

It is appreciated that specific functions and accordingly utilities of each of a plurality of GAM oligonucleotides described by FIG. 8 are correlated with, and may be deduced from the identity of the GAM TARGET GENEs inhibited thereby, and whose functions are set forth in Table 8, hereby incorporated herein.

Studies documenting well known correlations between each of a plurality of GAM TARGET GENEs of the GAM oligonucleotides of FIG. 8, and known functions and diseases are listed in Table 9, hereby incorporated herein.

The present invention discloses a novel group of human oligonucleotides, belonging to the miRNA-like oligonucleotides group, here termed GAM oligonucleotides, for which a specific complementary binding has been determined bioinformatically.

Figure 9:
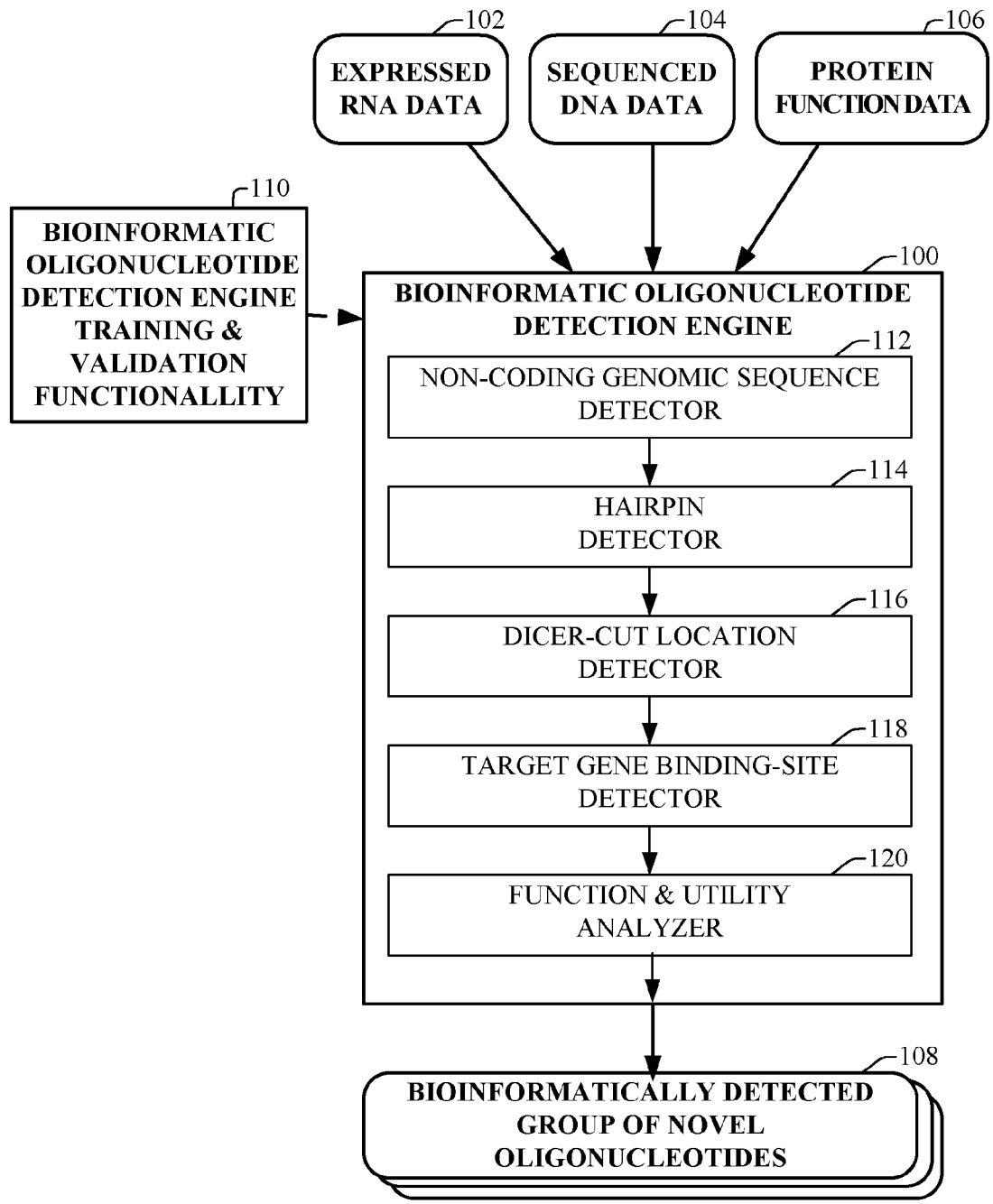
FIG. 9 is a simplified block diagram illustrating a bioinformatic oligonucleotide detection system capable of detecting oligonucleotides of the novel group of oligonucleotides of the present invention, which system is constructed and operative in accordance with a preferred embodiment of the present invention.

Reference is now made to FIG. 9 which is a simplified block diagram illustrating a bioinformatic oligonucleotide detection system and method constructed and operative in accordance with a preferred embodiment of the present invention.

An important feature of the present invention is a BIOINFORMATIC OLIGONUCLEOTIDE DETECTION ENGINE 100, which is capable of bioinformatically detecting oligonucleotides of the present invention.

The functionality of the BIOINFORMATIC OLIGONUCLEOTIDE DETECTION ENGINE 100 includes receiving EXPRESSED RNA DATA 102, SEQUENCED DNA DATA 104, and PROTEIN FUNCTION DATA 106; performing a complex process of analysis of this data as elaborated hereinbelow, and based on this analysis provides information, designated by reference numeral 108, identifying and describing features of novel oligonucleotides.

EXPRESSED RNA DATA 102 comprises published expressed sequence tags (EST) data, published mRNA data, as well as other published RNA data. SEQUENCED DNA DATA 104 comprises alphanumeric data representing genomic sequences and preferably including annotations such as information indicating the location of known protein coding regions relative to the genomic sequences.

PROTEIN FUNCTION DATA 106 comprises information from scientific publications e.g. physiological functions of known proteins and their connection, involvement and possible utility in treatment and diagnosis of various diseases.

EXPRESSED RNA DATA 102 and SEQUENCED DNA DATA 104 may preferably be obtained from data published by the National Center for Biotechnology Information (NCBI) at the National Institute of Health (NIH) (Jenuth, J. P. (2000). Methods Mol. Biol. 132:301-312 (2000), herein incorporated by reference) as well as from various other published data sources. PROTEIN FUNCTION DATA 106 may preferably be obtained from any one of numerous relevant published data sources, such as the Online Mendelian Inherited Disease In Man (OMIM™, Hamosh et al., Nucleic Acids Res. 30: 52-55 (2002)) database developed by John Hopkins University, and also published by NCBI (2000).

Prior to or during actual detection of BIOINFORMATICALLY DETECTED GROUP OF NOVEL OLIGONUCLEOTIDES 108 by the BIOINFORMATIC OLIGONUCLEOTIDE DETECTION ENGINE 100, BIOINFORMATIC OLIGONUCLEOTIDE DETECTION ENGINE TRAINING & VALIDATION FUNCTIONALITY 110 is operative. This functionality uses one or more known miRNA oligonucleotides as a training set to train the BIOINFORMATIC OLIGONUCLEOTIDE DETECTION ENGINE 100 to bioinformatically recognize miRNA-like oligonucleotides, and their respective potential target binding sites. BIOINFORMATIC OLIGONUCLEOTIDE DETECTION ENGINE TRAINING &VALIDATION FUNCTIONALITY 110 is further described hereinbelow with reference to FIG. 10.

The BIOINFORMATIC OLIGONUCLEOTIDE DETECTION ENGINE 100 preferably comprises several modules which are preferably activated sequentially, and are described as follows:

A NON-CODING GENOMIC SEQUENCE DETECTOR 112 operative to bioinformatically detect non-protein coding genomic sequences. The NON-CODING GENOMIC SEQUENCE DETECTOR 112 is further described herein below with reference to FIGS. 11A and 11B.

A HAIRPIN DETECTOR 114 operative to bioinformatically detect genomic 'hairpin-shaped' sequences, similar to GAM FOLDED PRECURSOR RNA (FIG. 8). The HAIRPIN DETECTOR 114 is further described herein below with reference to FIGS. 12A and 12B.

A DICER-CUT LOCATION DETECTOR 116 operative to bioinformatically detect the location on a GAM FOLDED PRECURSOR RNA which is enzymatically cut by DICER COMPLEX (FIG. 8), yielding diced GAM RNA. The DICER-CUT LOCATION DETECTOR 116 is further described herein below with reference to FIGS. 13A-13C.

A TARGET GENE BINDING-SITE DETECTOR 118 operative to bioinformatically detect target genes having binding sites, the nucleotide sequence of which is partially complementary to that of a given genomic sequence, such as a nucleotide sequence cut by DICER COMPLEX. The TARGET GENE BINDING-SITE DETECTOR 118 is further described hereinbelow with reference to FIGS. 14A and 14B.

A FUNCTION & UTILITY ANALYZER 120 operative to analyze the function and utility of target genes in order to identify target genes which have a significant clinical function and utility. The FUNCTION & UTILITY ANALYZER 120 is further described hereinbelow with reference to FIG. 15.

According to a preferred embodiment of the present invention the engine 100 may employ a cluster of 40 PCs (XEON®, 2.8 GHz, with 80 GB storage each), connected by Ethernet to 8 servers (2-CPU, XEON™ 1.2-2.2 GHz, with ~200 GB storage each), combined with an 8-processor server (8-CPU, Xeon 550 Mhz w/8 GB RAM) connected via 2 HBA fiber-channels to an EMC CLARIION™ 100-disks, 3.6 Terabyte storage device. A preferred embodiment of the present invention may also preferably comprise software which utilizes a commercial database software program, such as MICROSOFT™ SQL Server 2000. It is appreciated that the above mentioned hardware configuration is not meant to be limiting, and is given as an illustration only. The present invention may be implemented in a wide variety of hardware and software configurations.

The present invention discloses 15454 novel oligonucleotides of the GAM group of oligonucleotides, which have been detected bioinformatically and 681 novel polynucleotides of the GR group of polynucleotides, which have been detected bioinformatically. Laboratory confirmation of bioinformatically predicted oligonucleotides of the GAM group of oligonucleotides, and several bioinformatically predicted polynucleotides of the GR group of polynucleotides, is described hereinbelow with reference to FIGS. 21-24D.

Figure 10:
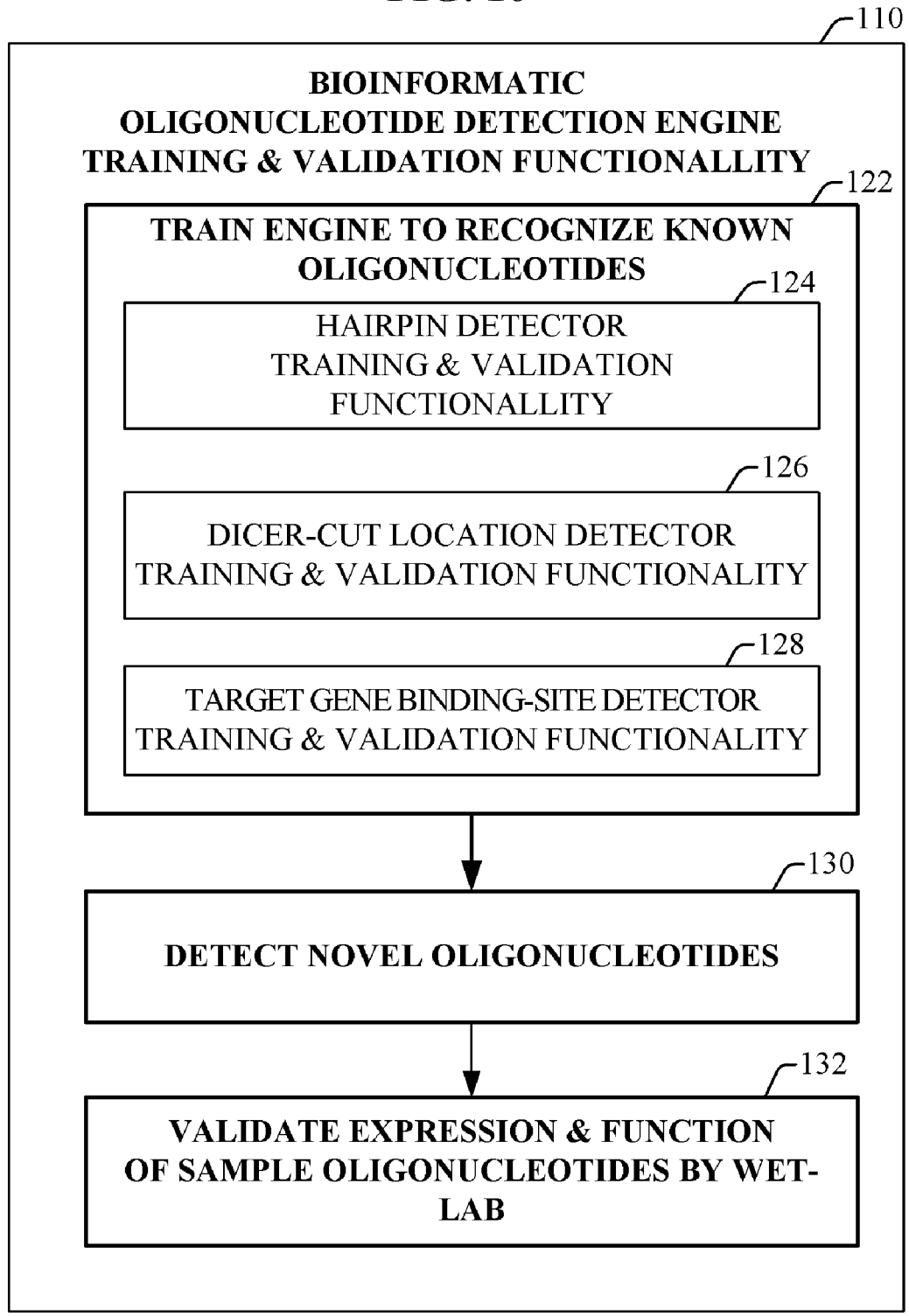
FIG. 10 is a simplified flowchart illustrating operation of a mechanism for training of a computer system to recognize the novel oligonucleotides of the present invention, which mechanism is constructed and operative in accordance with a preferred embodiment of the present invention.

Reference is now made to FIG. 10 which is a simplified flowchart illustrating operation of a preferred embodiment of the BIOINFORMATIC OLIGONUCLEOTIDE DETECTION ENGINE TRAINING & VALIDATION FUNCTIONALITY 110 described hereinabove with reference to FIG. 9.

BIOINFORMATIC OLIGONUCLEOTIDE DETECTION ENGINE TRAINING & VALIDATION FUNCTIONALITY 110 begins by training the BIOINFORMATIC OLIGONUCLEOTIDE DETECTION ENGINE 100 (FIG. 9) to recognize one or more known miRNA oligonucleotides, as designated by reference numeral 122. This training step comprises HAIRPIN DETECTOR TRAINING & VALIDATION FUNCTIONALITY 124, further described hereinbelow with reference to FIG. 12A, DICER-CUT LOCATION DETECTOR TRAINING & VALIDATION FUNCTIONALITY 126, further described hereinbelow with reference to FIGS. 13A and 13B, and TARGET GENE BINDING-SITE DETECTOR TRAINING & VALIDATION FUNCTIONALITY 128, further described hereinbelow with reference to FIG. 14A.

Next, the BIOINFORMATIC OLIGONUCLEOTIDE DETECTION ENGINE TRAINING & VALIDATION FUNCTIONALITY 110 is operative bioinformatically detect novel oligonucleotides, using BIOINFORMATIC OLIGONUCLEOTIDE DETECTION ENGINE 100 (FIG. 9), as designated by reference numeral 130. Wet lab experiments are preferably conducted in order to validate expression and preferably function of some samples of the novel oligonucleotides detected by the BIOINFORMATIC OLIGONUCLEOTIDE DETECTION ENGINE 100, as designated by reference numeral 132. FIGS. 22A-24D illustrate examples of wet-lab validation of sample novel human oligonucleotides bioinformatically detected in accordance with a preferred embodiment of the present invention.

Figure 11A:
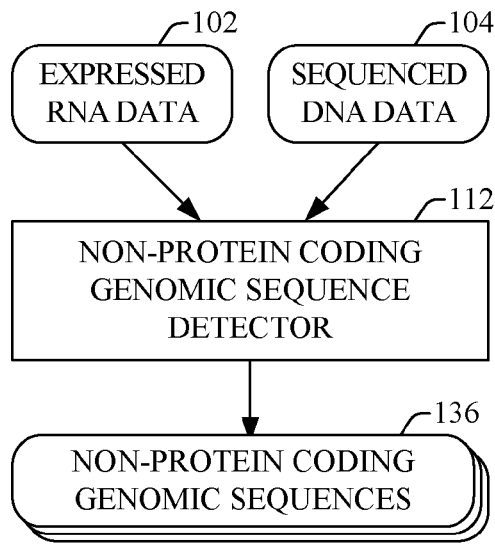
FIG. 11A is a simplified block diagram of a non-coding genomic sequence detector constructed and operative in accordance with a preferred embodiment of the present invention.

Reference is now made to FIG. 11A which is a simplified block diagram of a preferred implementation of the NON-CODING GENOMIC SEQUENCE DETECTOR 112 described hereinabove with reference to FIG. 9. The NON-PROTEIN CODING GENOMIC SEQUENCE DETECTOR 112 preferably receives at least two types of published genomic data: EXPRESSED RNA DATA 102 and SEQUENCED DNA DATA 104. The EXPRESSED RNA DATA 102 may include, inter alia, EST data, EST clusters data, EST genome alignment data and mRNA data. Sources for EXPRESSED RNA DATA 102 include NCBI dbEST, NCBI UniGene clusters and mapping data, and TIGR gene indices (Kirkness F. and Kerlavage, A. R., Methods Mol. Biol. 69:261-268 (1997)). SEQUENCED DNA DATA 104 may include sequence data (FASTA format files), and feature annotations (GenBank file format) mainly from NCBI databases. Based on the above mentioned input data, the NON-PROTEIN CODING GENOMIC SEQUENCE DETECTOR 112 produces a plurality of NON-PROTEIN CODING GENOMIC SEQUENCES 136. Preferred operation of the NON-PROTEIN CODING GENOMIC SEQUENCE DETECTOR 112 is described hereinbelow with reference to FIG. 11B.

Figure 11B:
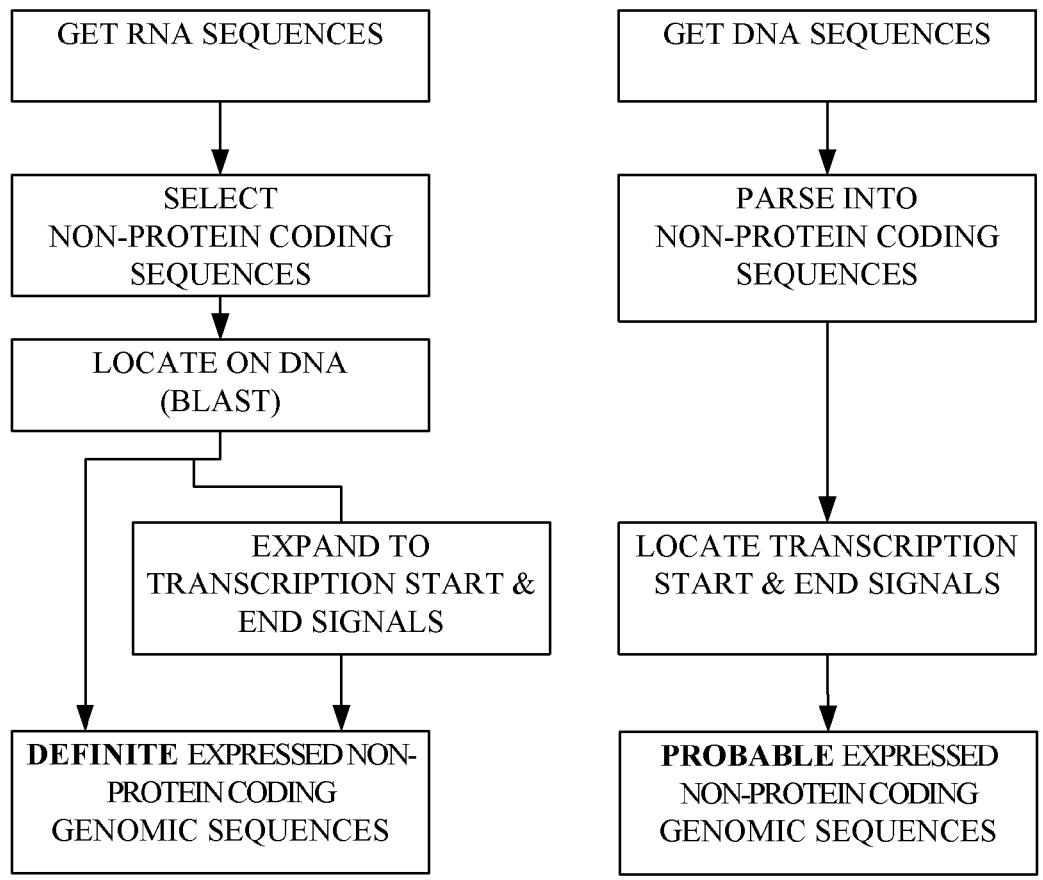
FIG. 11B is a simplified flowchart illustrating operation of a non-coding genomic sequence detector constructed and operative in accordance with a preferred embodiment of the present invention.

Reference is now made to FIG. 11B which is a simplified flowchart illustrating a preferred operation of the NON-CODING GENOMIC SEQUENCE DETECTOR 112 of FIG. 9. Detection of NON-PROTEIN CODING GENOMIC SEQUENCES 136, generally preferably progresses along one of the following two paths:

A first path for detecting NON-PROTEIN CODING GENOMIC SEQUENCES 136 (FIG. 11A) begins with receipt of a plurality of known RNA sequences, such as EST data. Each RNA sequence is first compared with known protein-coding DNA sequences, in order to select only those RNA sequences which are non-protein coding, i.e. intergenic or intronic sequences. This can preferably be performed by using one of many alignment algorithms known in the art, such as BLAST (Altschul et al., J. Mol. Biol. 215:403-410 (1990)). This sequence comparison preferably also provides localization of the RNA sequence on the DNA sequences.

Alternatively, selection of non-protein coding RNA sequences and their localization on the DNA sequences can be performed by using publicly available EST cluster data and genomic mapping databases, such as the UNIGENE database published by NCBI or the TIGR database. Such databases, map expressed RNA sequences to DNA sequences encoding them, find the correct orientation of EST sequences, and indicate mapping of ESTs to protein coding DNA regions, as is well known in the art. Public databases, such as TIGR, may also be used to map an EST to a cluster of ESTs, known in the art as Tentative Human Consensus and assumed to be expressed as one segment. Publicly available genome annotation databases, such as NCBIs GenBank, may also be used to deduce expressed intronic sequences.

Optionally, an attempt may be made to "expand" the non-protein RNA sequences thus found, by searching for transcription start and end signals, respectively upstream and downstream of the location of the RNA on the DNA, as is well known in the art.

A second path for detecting NON-PROTEIN CODING GENOMIC SEQUENCES 136 (FIG. 11A) begins with receipt of DNA sequences. The DNA sequences are parsed into non protein coding sequences, using published DNA annotation data, by extracting those DNA sequences which are between known protein coding sequences. Next, transcription start and end signals are sought. If such signals are found, and depending on their robustness, probable expressed non-protein coding genomic sequences are obtained. Such approach is especially useful for identifying novel GAM oligonucleotides which are found in proximity to other known miRNA oligonucleotides, or other wet-lab validated GAM oligonucleotides. Since, as described hereinbelow with reference to FIG. 16, GAM oligonucleotides are frequently found in clusters; sequences located near known miRNA oligonucleotides are more likely to contain novel GAM oligonucleotides. Optionally, sequence orthology, i.e. sequence conservation in an evolutionary related species, may be used to select genomic sequences having a relatively high probability of containing expressed novel GAM oligonucleotides.

Figure 12A:
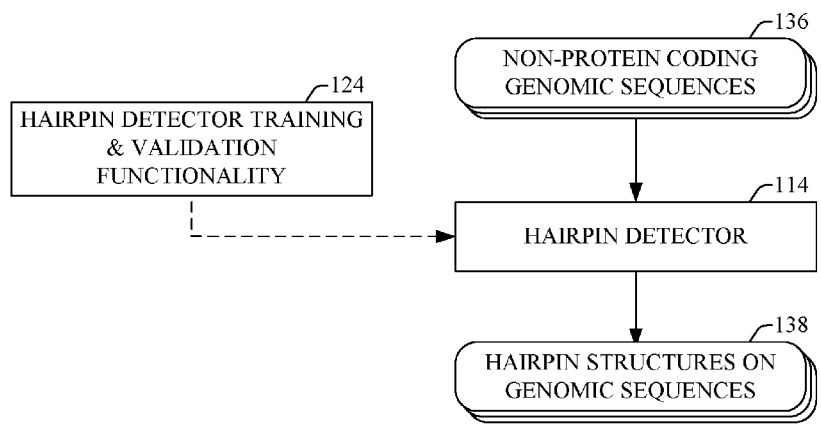
FIG. 12A is a simplified block diagram of a hairpin detector constructed and operative in accordance with a preferred embodiment of the present invention.

Reference is now made to FIG. 12A which is a simplified block diagram of a preferred implementation of the HAIRPIN DETECTOR 114 described hereinabove with reference to FIG. 9.

The goal of the HAIRPIN DETECTOR 114 is to detect hairpin-shaped genomic sequences, similar to those of known miRNA oligonucleotides. A hairpin-shaped genomic sequence is a genomic sequence, having a first half which is at least partially complementary to a second half thereof, which causes the halves to folds onto themselves, thereby forming a hairpin structure, as mentioned hereinabove with reference to FIG. 8.

The HAIRPIN DETECTOR 114 (FIG. 9) receives a plurality of NON-PROTEIN CODING GENOMIC SEQUENCES 136 (FIG. 11A). Following operation of HAIRPIN DETECTOR TRAINING & VALIDATION FUNCTIONALITY 124 (FIG. 10), the HAIRPIN DETECTOR 114 is operative to detect and output hairpin-shaped sequences, which are found in the NON-PROTEIN CODING GENOMIC SEQUENCES 136. The hairpin-shaped sequences detected by the HAIRPIN DETECTOR 114 are designated HAIRPINS STRUCTURES ON GENOMIC SEQUENCES 138. A preferred mode of operation of the HAIRPIN DETECTOR 114 is described hereinbelow with reference to FIG. 12B.

HAIRPIN DETECTOR TRAINING & VALIDATION FUNCTIONALITY 124 includes an iterative process of applying the HAIRPIN DETECTOR 114 to known hairpin shaped miRNA precursor sequences, calibrating the HAIRPIN DETECTOR 114 such that it identifies a training set of known hairpin-shaped miRNA precursor sequences, as well as other similarly hairpin-shaped sequences. In a preferred embodiment of the present invention, the HAIRPIN DETECTOR TRAINING & VALIDATION FUNCTIONALITY 124 trains the HAIRPIN DETECTOR 114 and validates each of the steps of operation thereof described hereinbelow with reference to FIG. 12B The HAIRPIN DETECTOR TRAINING & VALIDATION FUNCTIONALITY 124 preferably uses two sets of data: the aforesaid training set of known hairpin-shaped miRNA precursor sequences, such as hairpin-shaped miRNA precursor sequences of 440 miRNA oligonucleotides of *H. sapiens, M. musculus, C. elegans, C. Brigssae* and *D. Melanogaster*, annotated in the RFAM database (Griffiths-Jones 2003), and a background set of about 1000 hairpin-shaped sequences found in expressed non-protein coding human genomic sequences. The background set is expected to comprise some valid, previously undetected hairpin-shaped miRNA-like precursor sequences, and many hairpin-shaped sequences which are not hairpin-shaped miRNA-like precursors.

In a preferred embodiment of the present invention the efficacy of the HAIRPIN DETECTOR 114 (FIG. 9) is confirmed. For example, when a similarity threshold is chosen such that 87% of the known hairpin-shaped miRNA precursors are successfully predicted, only 21.8% of the 1000 background set of hairpin-shaped sequences are predicted to be hairpin-shaped miRNA-like precursors.

Figure 12B:
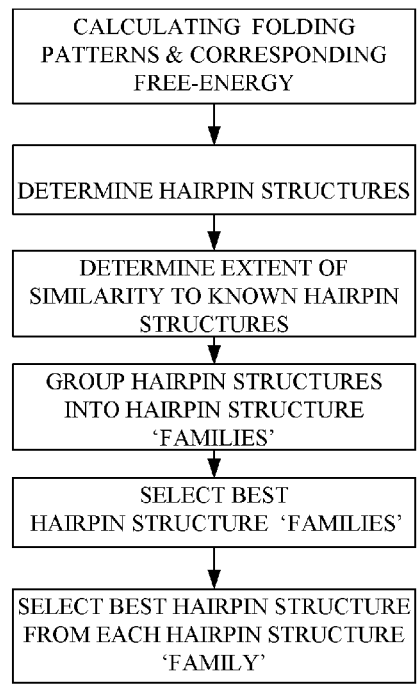
FIG. 12B is a simplified flowchart illustrating operation of a hairpin detector constructed and operative in accordance with a preferred embodiment of the present invention.

Reference is now made to FIG. 12B which is a simplified flowchart illustrating preferred operation of the HAIRPIN DETECTOR 114 of FIG. 9. The HAIRPIN DETECTOR 114 preferably initially uses a secondary structure folding algorithm based on free-energy minimization, such as the MFOLD algorithm, described in Mathews et al. J. Mol. Biol. 288:911-940 (1999) and Zuker, M. Nucleic Acids Res. 31: 3406-3415 (2003), the disclosure of which is hereby incorporated by reference. This algorithm is operative to calculate probable secondary structure folding patterns of the NON-PROTEIN CODING GENOMIC SEQUENCES 136 (FIG. 11A) as well as the free-energy of each of these probable secondary folding patterns. The secondary structure folding algorithm, such as the MFOLD algorithm (Mathews, 1997; Zuker 2003), typically provides a listing of the base-pairing of the folded shape, i.e. a listing of each pair of connected nucleotides in the sequence.

Next, the HAIRPIN DETECTOR 114 analyzes the results of the secondary structure folding patterns, in order to determine the presence and location of hairpin folding structures. The goal of this second step is to assess the base-pairing listing provided by the secondary structure folding algorithm, in order to determine whether the base-pairing listing describes one or more hairpin type bonding pattern. Preferably, sequence segment corresponding to a hairpin structure is then separately analyzed by the secondary structure folding algorithm in order to determine its exact folding pattern and free-energy.

The HAIRPIN DETECTOR 114 then assesses the hairpin structures found by the previous step, comparing them to hairpin structures of known miRNA precursors, using various characteristic hairpin structure features such as its free-energy and its thermodynamic stability, the amount and type of mismatched nucleotides and the existence of sequence repeat-elements, number of mismatched nucleotides in positions 18-22 counting from loop, and Percent of G nucleotide. Only hairpins that bear statistically significant resemblance to the training set of hairpin structures of known miRNA precursors, according to the abovementioned parameters, are accepted.

In a preferred embodiment of the present invention, similarity to the training set of hairpin structures of known miRNA precursors is determined using a "similarity score" which is calculated using a multiplicity of terms, where each term is a function of one of the above-mentioned hairpin structure features. The parameters of each function are found heuristically from the set of hairpin structures of known miRNA precursors, as described hereinabove with reference to HAIRPIN DETECTOR TRAINING & VALIDATION FUNCTIONALITY 124 (FIG. 10). The selection of the features and their function parameters is optimized so as to achieve maximized separation between the distribution of similarity scores validated miRNA-precursor hairpin structures, and the distribution of similarity scores of hairpin structures detected in the background set mentioned hereinabove with reference to FIG. 12B.

In an alternative preferred embodiment of the present invention, the step described in the preceding paragraph may be split into two stages. A first stage implements a simplified scoring method, typically based on thresholding a subset of the hairpin structure features described hereinabove, and may employ a minimum threshold for hairpin structure length and a maximum threshold for free energy. A second stage is preferably more stringent, and preferably employs a full calculation of the weighted sum of terms described hereinabove. The second stage preferably is performed only on the subset of hairpin structures that survived the first stage.

The HAIRPIN DETECTOR 114 also attempts to select hairpin structures whose thermodynamic stability is similar to that of hairpin structures of known miRNA precursors. This may be achieved in various ways. A preferred embodiment of the present invention utilizes the following methodology, preferably comprising three logical steps:

First, the HAIRPIN DETECTOR 114 attempts to group hairpin structures into "families" of closely related hairpin structures. As is known in the art, a secondary structure folding algorithm typically provides multiple alternative folding patterns, for a given genomic sequence and indicates the free energy of each alternative folding pattern. It is a particular feature of the present invention that the HAIRPIN DETECTOR 114 preferably assesses the various hairpin structures appearing in the various alternative folding patterns and groups' hairpin structures which appear at identical or similar sequence locations in various alternative folding patterns into common sequence location based "families" of hairpins. For example, all hairpin structures whose center is within 7 nucleotides of each other may be grouped into a family". Hairpin structures may also be grouped into a family" if their nucleotide sequences are identical or overlap to a predetermined degree.

It is also a particular feature of the present invention that the hairpin structure "families" are assessed in order to select only those families which represent hairpin structures that are as thermodynamically stable as those of hairpin structures of known miRNA precursors. Preferably only families which are represented in at least a selected majority of the alternative secondary structure folding patterns, typically 65%, 80% or 100% are considered to be sufficiently stable. Our tests suggest that only about 50% of the hairpin structures, predicted by the MFOLD algorithm with default parameters, are members of sufficiently stable families, comparing to about 90% of the hairpin structures that contain known miRNAs. This percent depends on the size of the fraction that was fold. In an alternative embodiment of the present invention we use fractions of size 1000 nts as preferable size. Different embodiment uses other sizes of genomics sequences, more or less strict demand for representation in the alternative secondary structure folding patterns.

It is an additional particular feature of the present invention that the most suitable hairpin structure is selected from each selected family. For example, a hairpin structure which has the greatest similarity to the hairpin structures appearing in alternative folding patterns of the family may be preferred. Alternatively or additionally, the hairpin structures having relatively low free energy may be preferred.

Alternatively or additionally considerations of homology to hairpin structures of other organisms and the existence of clusters of thermodynamically stable hairpin structures located adjacent to each other along a sequence may be important in selection of hairpin structures. The tightness of the clusters in terms of their location and the occurrence of both homology and clusters may be of significance.

Figure 13A:
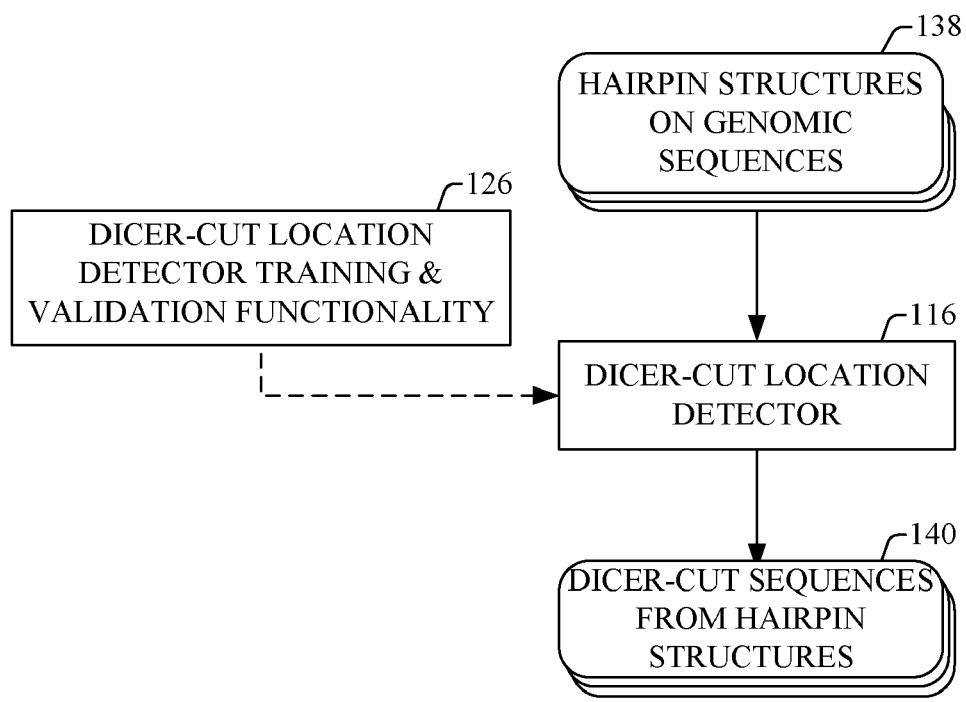
FIG. 13A is a simplified block diagram of a dicer-cut location detector constructed and operative in accordance with a preferred embodiment of the present invention.
Figure 13B:
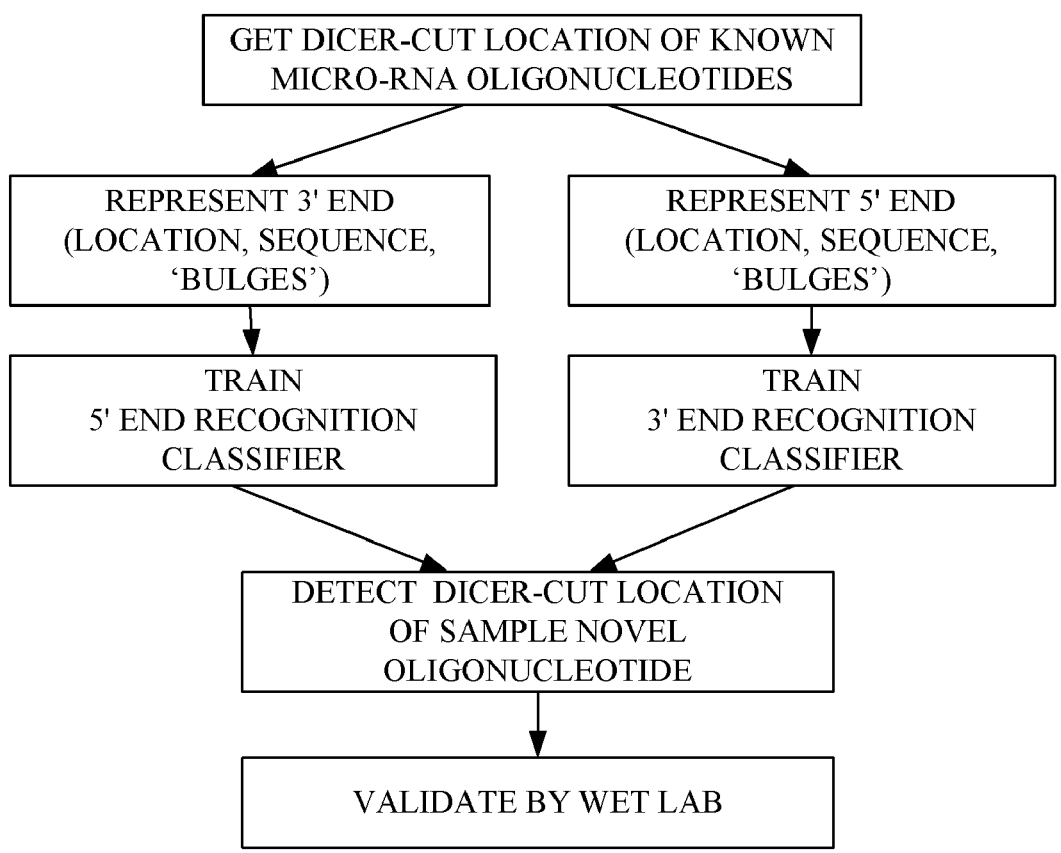
FIG. 13B is a simplified flowchart illustrating training of a dicer-cut location detector constructed and operative in accordance with a preferred embodiment of the present invention.
Figure 13C:
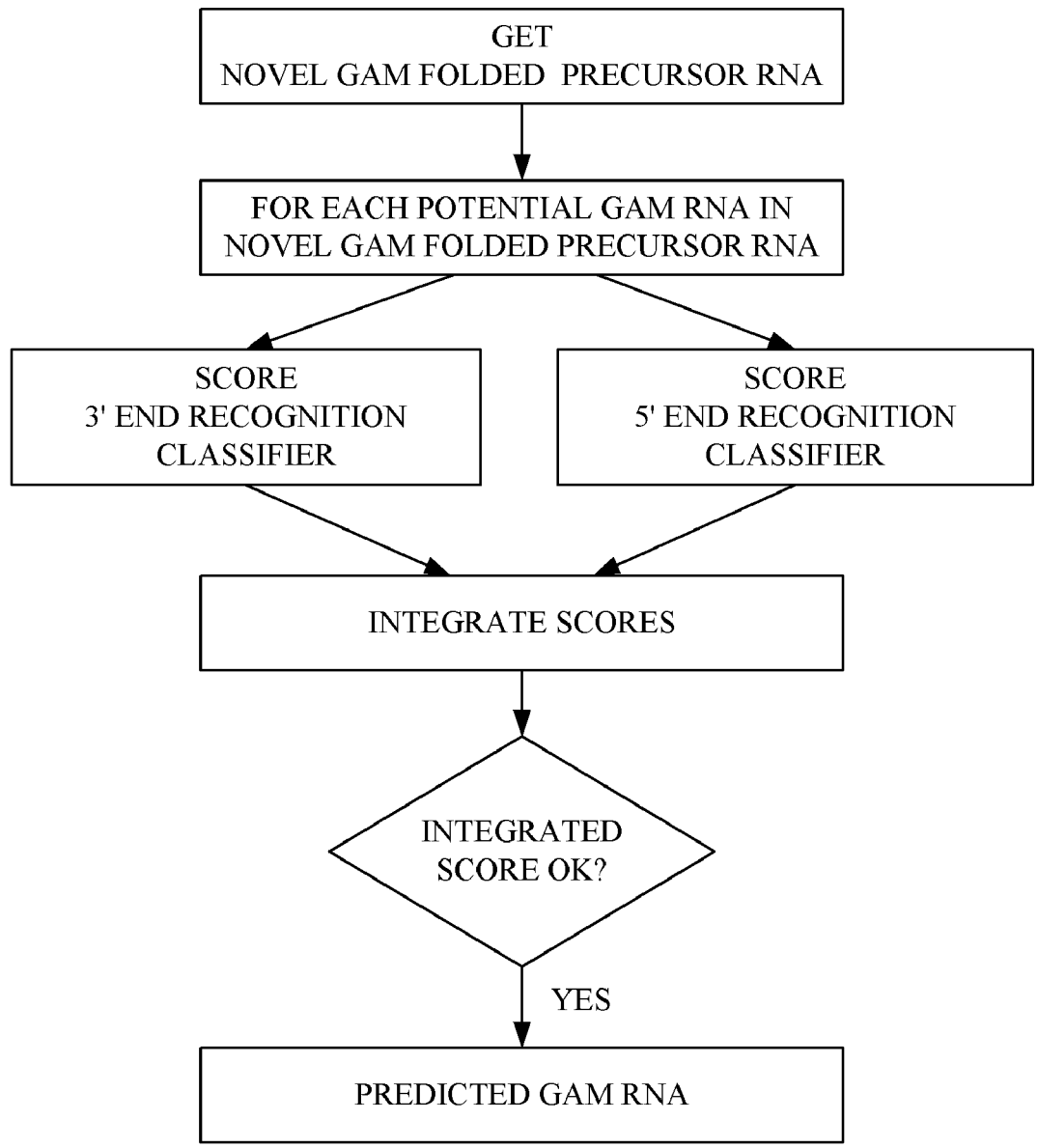
FIG. 13C is a simplified flowchart illustrating operation of a dicer-cut location detector constructed and operative in accordance with a preferred embodiment of the present invention.

Reference is now made to FIGS. 13A-13C which together describe the structure and operation of the DICER-CUT LOCATION DETECTOR 116, described hereinabove with FIG. 9.

FIG. 13A is a simplified block diagram of a preferred implementation of the DICER-CUT LOCATION DETECTOR 116. The goal of the DICER-CUT LOCATION DETECTOR 116 is to detect the location in which the DICER COMPLEX, described hereinabove with reference to FIG. 8, dices GAM FOLDED PRECURSOR RNA, yielding GAM RNA.

The DICER-CUT LOCATION DETECTOR 116 therefore receives a plurality of HAIRPIN STRUCTURES ON GENOMIC SEQUENCES 138 (FIG. 12A), and following operation of DICER-CUT LOCATION DETECTOR TRAINING & VALIDATION FUNCTIONALITY 126 (FIG. 10), is operative to detect a plurality of DICER-CUT SEQUENCES FROM HAIRPIN STRUCTURES 140.

Reference is now made to FIG. 13B which is a simplified flowchart illustrating a preferred implementation of DICER-CUT LOCATION DETECTOR TRAINING & VALIDATION FUNCTIONALITY 126.

A general goal of the DICER-CUT LOCATION DETECTOR TRAINING & VALIDATION FUNCTIONALITY 126 is to analyze the dicer-cut locations of known diced miRNA on respective hairpin shaped miRNA precursors in order to determine a common pattern in these locations, which can be used to predict dicer cut locations on GAM folded precursor RNAs.

The dicer-cut locations of known miRNA precursors are obtained and studied. Locations of the 5' and/or 3' ends of the known diced miRNAs are preferably represented by their respective distances from the 5' end of the corresponding hairpin shaped miRNA precursor. Additionally or alternatively, the 5' and/or 3' ends of the known diced miRNAs are preferably represented by the relationship between their locations and the locations of one or more nucleotides along the hairpin shaped miRNA precursor. Additionally or alternatively, the 5' and/or 3' ends of the known diced miRNAs are preferably represented by the relationship between their locations and the locations of one or more bound nucleotide pairs along the hairpin shaped miRNA precursor. Additionally or alternatively, the 5' and/or 3' ends of the known diced miRNAs are preferably represented by the relationship between their locations and the locations of one or more mismatched nucleotide pairs along the hairpin shaped miRNA precursor. Additionally or alternatively, the 5' and/or 3' ends of the known diced miRNAs are preferably represented by the relationship between their locations and the locations of one or more unmatched nucleotides along the hairpin shaped miRNA precursor. Additionally or alternatively, locations of the 5' and/or 3' ends of the known diced miRNAs are preferably represented by their respective distances from the loop located at the center of the corresponding hairpin shaped miRNA precursor.

One or more of the foregoing location metrics may be employed in the training and validation functionality. Additionally, metrics related to the nucleotide content of the diced miRNA and/or of the hairpin shaped miRNA precursor may be employed.

In a preferred embodiment of the present invention, DICER-CUT LOCATION DETECTOR TRAINING & VALIDATION FUNCTIONALITY 126 preferably employs standard machine learning techniques known in the art of machine learning for analysis of existing patterns in a given "training set" of examples. These techniques are capable, to a certain degree, of detecting similar patterns in other, previously unseen examples. Such machine learning techniques include, but are not limited to neural networks, Bayesian networks, Support Vector Machines (SVM), Genetic Algorithms, Markovian modeling, Maximum Likelihood modeling, Nearest Neighbor algorithms, Decision trees and other techniques, as is well known in the art.

In accordance with one embodiment of the present invention, machine learning predictors, such as a Support Vector Machine (SVM) predictor, are applied to the aforementioned training set and are operative, for example to test every possible nucleotide on a hairpin as a candidate for being the 5' end or the 3' end of a diced GAM RNA. More preferred machine learning predictors include predictors based on Nearest Neighbor, Bayesian modeling, and K-nearest-neighbor algorithms. A training set of the known miRNA precursor sequences is preferably used for training multiple separate classifiers or predictors, each of which produces a model for the 5' and/or 3' end locations of a diced miRNA with respect to its hairpin precursor. The models take into account one or more of the various miRNA location metrics described above.

Performance of the resulting predictors, evaluated on the abovementioned validation set of 440 published miRNAs using k-fold cross validation (Mitchell, 1997) with k=3, is found to be as follows: in 70% of known miRNAs 5'-end location is correctly determined by an SVM predictor within up to 2 nucleotides; a Nearest Neighbor (EDIT DISTANCE) predictor achieves 56% accuracy (247/440); a Two-Phased predictor that uses Bayesian modeling (TWO PHASED) achieves 80% accuracy (352/440), when only the first phase is used. When the second phase (strand choice) is implemented by a nave Bayesian model the accuracy is 55% (244/440), and when the K-nearest-neighbor modeling is used for the second phase, 374/440 decision are made and the accuracy is 65% (242/374). A K-nearest-neighbor predictor (FIRST-K) achieves 61% accuracy (268/440). The accuracies of all predictors are considerably higher on top scoring subsets of published miRNA.

Finally, in order to validate the efficacy and accuracy of the DICER-CUT LOCATION DETECTOR 116, a sample of novel oligonucleotides detected thereby is preferably selected, and validated by wet lab. Laboratory results validating the efficacy of the DICER-CUT LOCATION DETECTOR 116 are described hereinbelow with reference to FIGS. 21-24D.

Reference is now made to FIG. 13C which is a simplified flowchart illustrating operation of DICER-CUT LOCATION DETECTOR 116 (FIG. 9), constructed and operative in accordance with a preferred embodiment of the present invention. The DICER CUT LOCATION DETECTOR 116 preferably comprises a machine learning computer program module, which is trained to recognize dicer-cut locations on known hairpin-shaped miRNA precursors, and based on this training, is operable to detect dicer-cut locations of novel GAM RNAs (FIG. 8) on GAM FOLDED PRECURSOR RNAs (FIG. 8). In a preferred embodiment of the present invention, the dicer-cut location module preferably utilizes machine learning algorithms, such as known Support Vector Machine (SVM) and more preferably: known Bayesian modeling, Nearest Neighbors, and K-nearest-neighbor algorithms.

When initially assessing a novel GAM FOLDED PRECURSOR RNA, all 19-24 nucleotide long segments thereof are initially considered as "potential GAM RNAs", since the dicer-cut location is initially unknown.

For each such potential GAM RNA, the location of its 5' end or the locations of its 5' and 3' ends are scored by at least one recognition classifier or predictor.

In a preferred embodiment of the present invention, the DICER-CUT LOCATION DETECTOR 116 (FIG. 9) may use a Support Vector Machine predictor trained on and operating on features such as the following:

Locations of the 5' and/or 3' ends of the known diced miRNAs, which are preferably represented by their respective distances from the 5 end of the corresponding hairpin shaped miRNA precursor. Additionally or alternatively, the 5' and/or 3' ends of the known diced miRNAs are preferably represented by the relationship between their locations and the locations of one or more nucleotides along the hairpin shaped miRNA precursor. Additionally or alternatively, the 5' and/or 3' ends of the known diced miRNAs are preferably represented by the relationship between their locations and the locations of one or more bound nucleotide pairs along the hairpin shaped miRNA precursor. Additionally or alternatively, the 5' and/or 3' ends of the known diced miRNAs are preferably represented by the relationship between their locations and the locations of one or more mismatched nucleotide pairs along the hairpin shaped miRNA precursor. Additionally or alternatively, the 5' and/or 3' ends of the known diced miRNAs are preferably represented by the relationship between their locations and the locations of one or more unmatched nucleotides along the hairpin shaped miRNA precursor. Additionally or alternatively, locations of the 5' and/or 3' ends of the known diced miRNAs are preferably represented by their respective distances from the loop located at the center of the corresponding hairpin shaped miRNA precursor; and secondarily Metrics related to the nucleotide content of the diced miRNA and/or of the hairpin shaped miRNA precursor.

In another preferred embodiment of the present invention, the DICER-CUT LOCATION DETECTOR 116 (FIG. 9) preferably employs an "EDIT DISTANCE" predictor, which seeks sequences that are similar to those of known miRNAs, utilizing a Nearest Neighbor algorithm, where a similarity metric between two sequences is a variant of the Edit Distance algorithm (Gusfield, 1997). The EDIT DISTANCE predictor is based on an observation that miRNA oligonucleotides tend to form clusters, the members of which show marked sequence similarity.

In yet another preferred embodiment of the present invention, the DICER-CUT LOCATION DETECTOR 116 (FIG. 9) preferably uses a "TWO PHASE" predictor, which predicts the dicer-cut location in two distinct phases: (a) selecting a double-stranded segment of the GAM FOLDED PRECURSOR RNA (FIG. 8) comprising the GAM RNA by nave Bayesian modeling and (b) detecting which strand of the double-stranded segment contains GAM RNA (FIG. 8) by employing either nave or by K-nearest-neighbor modeling. K-nearest-neighbor modeling is a variant of the 'FIRST-K' predictor described hereinbelow, with parameters optimized for this specific task. The 'TWO PHASE' predictor may be operated in two modes: either utilizing only the first phase and thereby producing two alternative dicer-cut location predictions, or utilizing both phases and thereby producing only one final dicer-cut location.

In still another preferred embodiment of the present invention, the DICER-CUT LOCATION DETECTOR 116 preferably uses a "FIRST-K" predictor, which utilizes a K-nearestneighbor algorithm. The similarity metric between any two sequences is 1-E/L, where L is a parameter, preferably 8-10 and E is the edit distance between the two sequences, taking into account only the first L nucleotides of each sequence. If the K-nearest-neighbor scores of two or more locations on the GAM FOLDED PRECURSOR RNA (FIG. 8) are not significantly different, these locations are further ranked by a Bayesian model, similar to the one described hereinabove.

The TWO PHASE and FIRST-K predictors preferably are trained on and operate on features such as the following:

Locations of the 5' and/or 3' ends of the known diced miRNAs, which are preferably represented by their respective distances from the 5' end of the corresponding hairpin shaped miRNA precursor. Additionally or alternatively, the 5' and/or 3' ends of the known diced miRNAs are preferably represented by the relationship between their locations and the locations of one or more nucleotides along the hairpin shaped miRNA precursor. Additionally or alternatively, the 5' and/or 3' ends of the known diced miRNAs are preferably represented by the relationship between their locations and the locations of one or more bound nucleotide pairs along the hairpin shaped miRNA precursor. Additionally or alternatively, the 5' and/or 3' ends of the known diced miRNAs are preferably represented by the relationship between their locations and the locations of one or more mismatched nucleotide pairs along the hairpin shaped miRNA precursor. Additionally or alternatively, the 5' and/or 3' ends of the known diced miRNAs are preferably represented by the relationship between their locations and the locations of one or more unmatched nucleotides along the hairpin shaped miRNA precursor. Additionally or alternatively, locations of the 5' and/or 3' ends of the known diced miRNAs are preferably represented by their respective distances from the loop located at the center of the corresponding hairpin shaped miRNA precursor; and secondarily Metrics related to the nucleotide content of the diced miRNA and/or of the hairpin shaped miRNA precursor.

In accordance with an embodiment of the present invention scores of two or more of the abovementioned classifiers or predictors are integrated, yielding an integrated score for each "potential GAM RNA". As an example, FIG. 13C illustrates integration of scores from two classifiers, a 3' end recognition classifier and a 5' end recognition classifier, the scores of which are integrated to yield an integrated score. Most preferably, the INTEGRATED SCORE of FIG. 13C preferably implements a "best-of-breed" approach employing a pair of classifiers and accepting only "potential GAM RNAs" that score highly on one of the above mentioned "EDIT DISTANCE", or "TWO-PHASE" predictors. In this context, "high scores" means scores which have been demonstrated to have low false positive value when scoring known miRNA oligonucleotides. Alternatively, the INTEGRATED SCORE may be derived from operation of more or less than two classifiers.

The INTEGRATED SCORE is evaluated as follows: (a) the "potential GAM RNA" having the highest score is preferably taken to be the most probable GAM RNA, and (b) if the integrated score of this most probable GAM RNA is higher than a pre-defined threshold, then the most probable GAM RNA is accepted as a PREDICTED GAM RNA. Preferably, this evaluation technique is not limited to the highest scoring potential GAM RNA.

As a final optional stage we may filter PREDICTED GAM RNAs with low complexity, which have high probability to be part of repeated element in the DNA (for example ATATATA sequences). For each PREDICTED GAM RNA sequence we count the number of occurrences of each 2 nucleotides combination (AA, AT, AC), we filter out sequences where the sum of the most 2 probable combination is higher then 9. Using this criteria we filter 2% of the known miRNA and around 30% of the PREDICTED GAM RNAs.

Figure 14A:
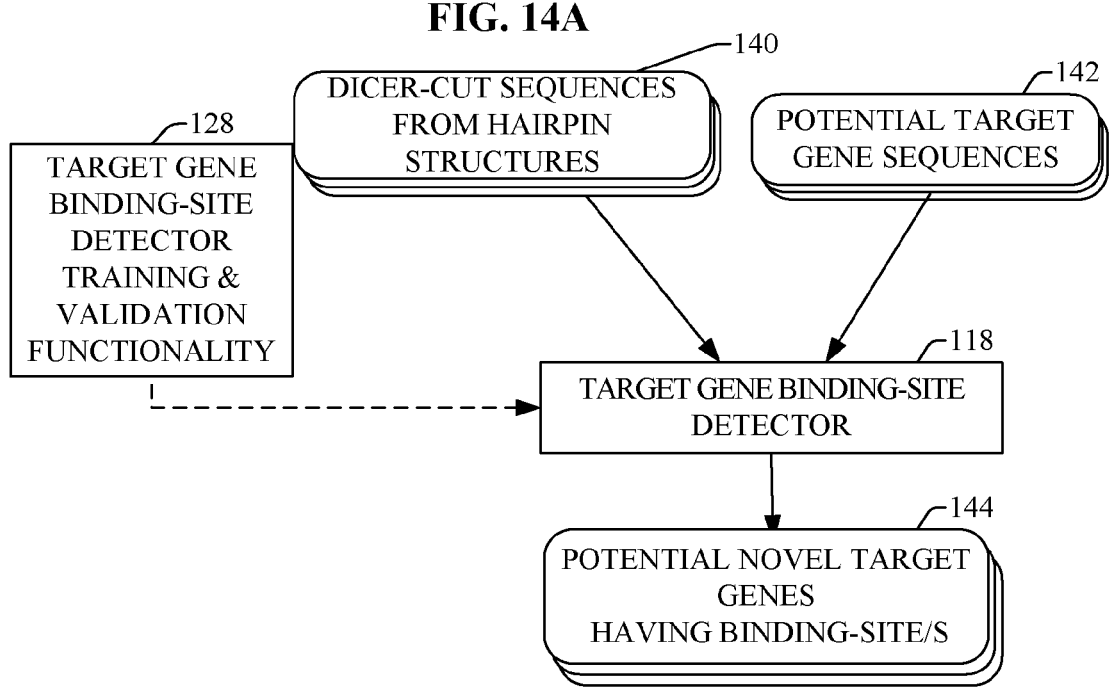
FIG. 14A is a simplified block diagram of a target gene binding-site detector constructed and operative in accordance with a preferred embodiment of the present invention.

Reference is now made to FIG. 14A which is a simplified block diagram of a preferred implementation of the TARGET GENE BINDING-SITE DETECTOR 118 described hereinabove with reference to FIG. 9. The goal of the TARGET GENE BINDING-SITE DETECTOR 118 is to detect one or more binding sites such as BINDING SITE I, BINDING SITE II and BINDING SITE III (FIG. 8) located in 3' untranslated regions of the mRNA of a known gene, the nucleotide sequence of which binding sites is partially or fully complementary to a GAM RNA, thereby determining that the above mentioned known gene is a target gene thereof.

The TARGET GENE BINDING-SITE DETECTOR 118 (FIG. 9) receives a plurality of DICER-CUT SEQUENCES FROM HAIRPIN STRUCTURES 140 (FIG. 13A), and a plurality of POTENTIAL TARGET GENE SEQUENCES 142 which are derived from SEQUENCED DNA DATA 104 (FIG. 9).

TARGET GENE BINDING-SITE DETECTOR TRAINING & VALIDATION FUNCTIONALITY 128 (FIG. 10) is operative to train the TARGET GENE BINDING-SITE DETECTOR 118 on known miRNAs and their respective target genes and to build a background model for evaluation of a P value for the TARGET GENE BINDING-SITE DETECTOR 118 results It Construct the model by analyzing both heuristically and computationally the results of the TARGET GENE BINDING-SITE DETECTOR 118.

Following operation of TARGET GENE BINDING-SITE DETECTOR TRAINING & VALIDATION FUNCTIONALITY 128 (FIG. 10), the TARGET GENE BINDING-SITE DETECTOR 118 is operative to detect a plurality of POTENTIAL NOVEL TARGET GENES HAVING BINDING-SITE/S 144 the nucleotide sequence of which is partially or fully complementary to that of each of the plurality of DICER-CUT SEQUENCES FROM HAIRPIN STRUCTURES 140. Preferred operation of the TARGET GENE BINDING-SITE DETECTOR 118 is further described hereinbelow with reference to FIG. 14B.

Figure 14B:
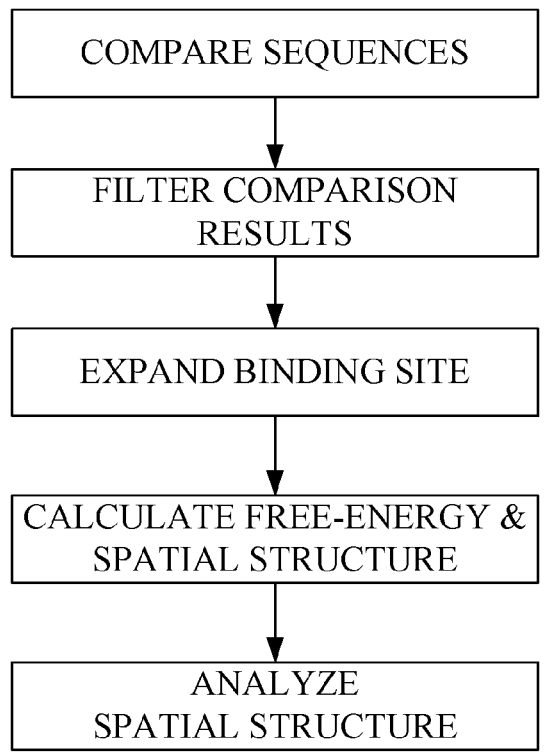
FIG. 14B is a simplified flowchart illustrating operation of a target gene binding-site detector constructed and operative in accordance with a preferred embodiment of the present invention.

Reference is now made to FIG. 14B which is a simplified flowchart illustrating a preferred operation of the TARGET GENE BINDING-SITE DETECTOR 118 of FIG. 9. In a preferred embodiment of the present invention, the TARGET GENE BINDING-SITE DETECTOR 118 employs a match search tool, described hereinbelow, in order to compare the nucleotide sequence of each of the plurality of DICER-CUT SEQUENCES FROM HAIRPIN STRUCTURES 140 (FIG. 13A), to the POTENTIAL TARGET GENE SEQUENCES 142 (FIG. 14A), such as 3 untranslated regions of known mRNAs, in order to find crude potential matches. Alternatively, a sequence comparison algorithm such as BLAST can be used.

The match search tool compare the DICER-CUT SEQUENCES FROM HAIRPIN STRUCTURES 140 (FIG. 14A) to POTENTIAL TARGET GENE SEQUENCES 142 (FIG. 14A). the methodology of the match search tool is to match Nucleotides 1:8 of DICER-CUT SEQUENCES FROM HAIRPIN STRUCTURES 140 (FIG. 14A) to POTENTIAL TARGET GENE SEQUENCES 142 (FIG. 14A). The results are preferably filtered to allow at most 1 edit distance between the DICER-CUT SEQUENCES FROM HAIRPIN STRUCTURES 140 (FIG. 14A) complementary sequence and POTENTIAL TARGET GENE SEQUENCES 142 (FIG. 14A).

In a preferred implementation of the match search tool, it first calculates two preprocess data structures: the first, store for every 9 nts sequences all its appearances in the POTENTIAL TARGET GENE SEQUENCES 142 (FIG. 14A).

The second is a map of all the 8 nts sequence to 9 nts sequences that can be accepted by adding one nucleotide and performing one or less editing actions to the 8 nts complementary sequence. This two data structures help to improve performance and to perform the binding site filtering stage as an integral part of the search. The match search tool in this implementation returns for every DICER-CUT SEQUENCES FROM HAIRPIN STRUCTURES 140 (FIG. 14A all the appearances of the 9 nts sequence in the POTENTIAL TARGET GENE SEQUENCES 142 (FIG. 14A) that are calculated using the second, describe hereinabove, data structure from its first 8 nts. The 9 nts sequences appearances are the potentially 3 of the POTENTIAL TARGET GENE SEQUENCES 142 (FIG. 14A) binding site of each DICER-CUT SEQUENCES FROM HAIRPIN STRUCTURES 140 (FIG. 14A Next the binding sites are expanded, and determinations are made whether if nucleotide sequences immediately upstream to the binding sites 3 part matches with the 3' end of the DICER-CUT SEQUENCES FROM HAIRPIN STRUCTURES. The alignment of the binding site 5 part is made by the alignment algorithm with specific weighting parameters describes hereinbelow with reference to FIG. 12). Alternatively the alignment can include also the 3 part of the binding site.

The alignment algorithm (implemented here) with specific weighting parameters. The weighting parameters are based on analyze of known miRNA binding sites (references: Wightman et al. Cell 1993, Moss Cell 1997, Reinhart Nature 2000, Abrahante Developmental Cell 2003 and Lin Developmental Cell 2003, Brennecke Cell 2003, Stark PLOS 2003, lewis et al. Cell 2003). It was heuristically found to best distinguish between known miRNA binding sites and sequences which are known not to be miRNA binding sites.

According to a preferred embodiment of the present invention a good matching at 5' end of the miRNA (nucleotides 1-8), and at 3' end of the miRNA, (the last 9 nucleotides) is required. The matching at 5' end is crucial for the binding while the 3' end binding is less important but can compensate on few mismatches at the 5'. The nucleotides at the middle of the miRNA have no punishment for any editing operation (reference: Doench et al. Gene and Development 2004). In this preferred embodiment the alignment of the 5 end of the miRNA (3 of the binding site) is a result of the match search tool, while the middle and 3 miRNA (5 of the binding site) is done by the alignment algorithm. The alignment is a combination of both. Alternatively, the alignment is done for all the miRNA and all the binding site sequence. The alignment algorithm finds the lowest free-energy spatial structure and heuristic constrain that were found to distinct the known binding sites in the best way. The alignment yields 2 scores for 5' end and 3' end. Each score represents the inverse of its probability to obtain such or higher score by running random sequences, with 22 nucleotides length and same base composition as known miRNA, with randomly chosen 3 un translated region sequences. The final score is the multiplicity of the two scores.

The binding site detector, then analyze the spatial structure of the miRNA with all its potential target gene 3 un translated region. It assesses the list of binding sites of each miRNA-Target gene pair with their positions and respective scores. The TARGET GENE BINDING-SITE DETECTOR 118 (FIG. 14A) then uses the fact that Many of the known binding sites are clustered, to evaluate the P value of obtaining cluster of few binding sites on the same target gene 3 un translated region in the following way: It scans different scores threshold, and calculate for each threshold the number and positions of possible binding sites with score above the threshold. It then gets from a preprocess calculated background matrixes, describe hereinbelow, a P value for each threshold and number and positions of binding sites combination. The output score for each miRNA and target gene pair is the minimal P value, normalized with the number of thresholds trying using Bernoulli distribution. A preference of low P value pairs is made.

As mentioned hereinabove, for each target gene a preprocess calculated background matrixes were build. The matrixes includes rows for each number of miRNA binding site (In the preferred embodiment the matrix include 7 rows for 0 to 6 binding site.), and columns for each different score threshold (In the preferred embodiment the matrix include 5 columns for 5 different threshold). Each matrix cell, corresponding to specific number of binding site and threshold, was set to be the probability to get equal or more binding sites with equal or more score by random sequences with 22 nucleotides length with the same letter distribution as known miRNAs (29.5% T, 24.5% A, 25% G and 21% C). Those probabilities are calculated by running the above procedure for 10000 random sequences. The P value can be estimated as the number of random sequences obeys the matrix cell requirement divided by the total number of random sequences (10000). In the preferred embodiment 2 matrixes are calculated. The P values are of the second matrix are calculated under constrain that at least two of the binding site position are under a heuristically determine constant value. The second matrix values are calculated without this constrain. The TARGET GENE BINDING-SITE DETECTOR uses the second matrix if the binding sites position agree with the constrain, else it uses the first. In an alternative embodiment only one matrix is calculated without any constrain on the binding sites positions.

Test preformed using the TARGET GENE BINDING-SITE DETECTOR showed that all of the known miRNA target genes are found using this algorithm with a P value of less than 0.5%. Running known miRNA against 3400 potential 3'UTR of target genes sequences yield on average 32 target genes for each miRNA with P value less than 0.5%, while background sequences, as well as inverse or complement sequence of known miRNA (which preserve their high order sequence statistics) found, as excepted, on average 17 target genes. This reflects the algorithm performance to detect real target genes with 47% accuracy.

Scoring of all potential binding sites are calculated and P value for obtaining such binding sites list for DICER-CUT SEQUENCE FROM HAIRPIN STRUCTURE and POTENTIAL TARGET GENE SEQUENCE pair is evaluate using the background matrix. In accordance with another preferred embodiment of the present invention, binding sites are searched by a reversed process. Sequences of K (preferably 22) nucleotides of a untranslated regions of a target gene are assessed as potential binding sites. A sequence comparison algorithm, such as BLAST or EDIT DISTANCE variant, is then used to search elsewhere in the genome for partially or fully complementary sequences which are found in known miRNA oligonucleotides or computationally predicted GAM oligonucleotides. Only complementary sequences, which meet predetermined spatial structure and free energy criteria as described hereinabove, are accepted. Clustered binding sites are strongly preferred and potential binding sites and potential GAM oligonucleotides which occur in evolutionarily conserved genomic sequences are also preferred. Scoring of candidate binding sites takes into account free energy and spatial structure of the binding site complexes, as well as the aforesaid preferences.

Figure 15:
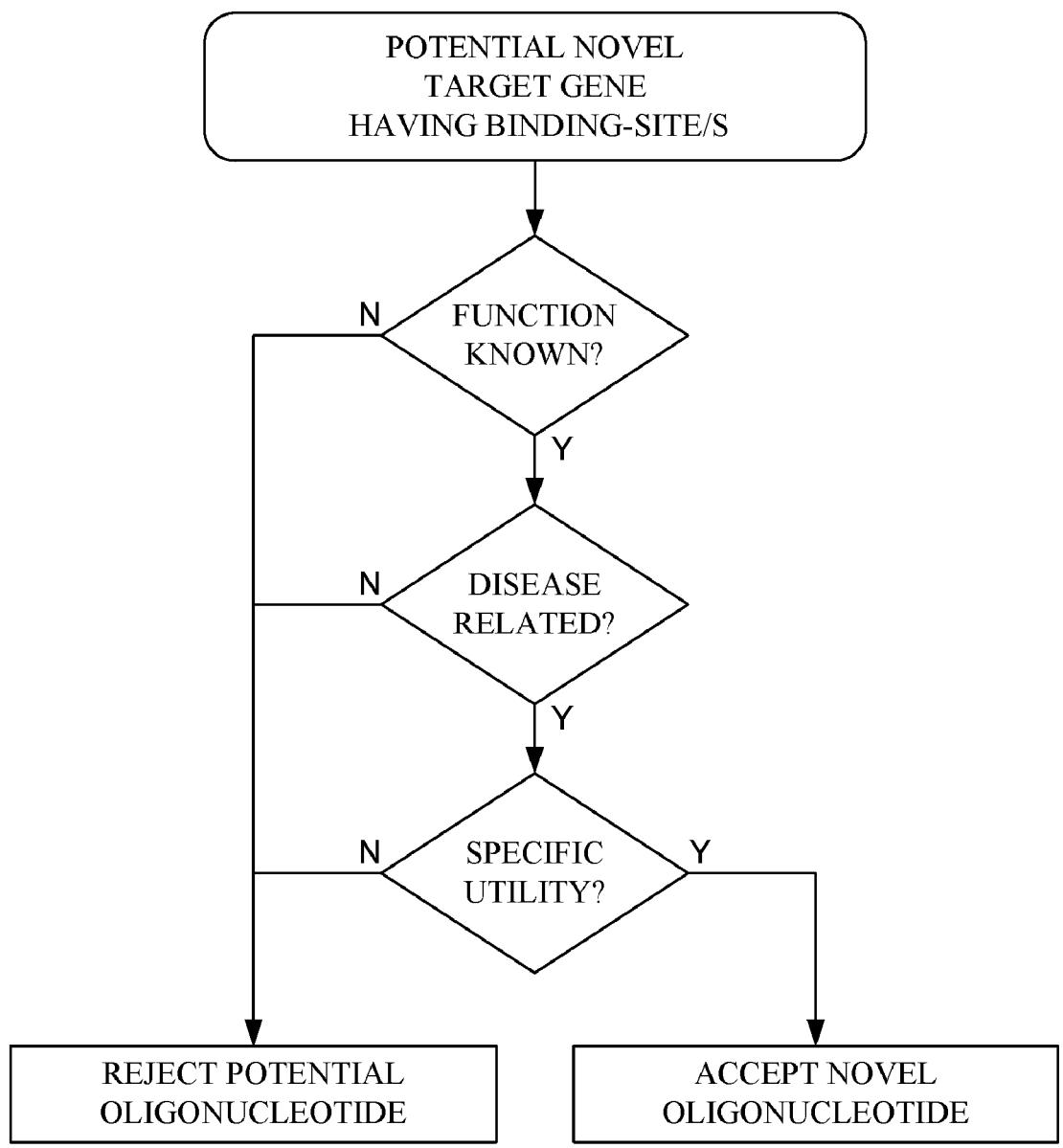
FIG. 15 is a simplified flowchart illustrating operation of a function & utility analyzer constructed and operative in accordance with a preferred embodiment of the present invention.

Reference is now made to FIG. 15 which is a simplified flowchart illustrating a preferred operation of the FUNCTION & UTILITY ANALYZER 120 described hereinabove with reference to FIG. 9. The goal of the FUNCTION & UTILITY ANALYZER 120 is to determine if a potential target gene is in fact a valid clinically useful target gene. Since a potential novel GAM oligonucleotide binding a binding site in the UTR of a target gene is understood to inhibit expression of that target gene, and if that target gene is shown to have a valid clinical utility, then in such a case it follows that the potential novel oligonucleotide itself also has a valid useful function which is the opposite of that of the target gene.

The FUNCTION & UTILITY ANALYZER 120 preferably receives as input a plurality of POTENTIAL NOVEL TARGET GENES HAVING BINDING-SITE/S 144 (FIG. 14A), generated by the TARGET GENE BINDING-SITE DETECTOR 118 (FIG. 9). Each potential oligonucleotide is evaluated as follows: First, the system checks to see if the function of the potential target gene is scientifically well established. Preferably, this can be achieved bioinformatically by searching various published data sources presenting information on known function of proteins. Many such data sources exist and are published as is well known in the art. Next, for those target genes the function of which is scientifically known and is well documented, the system then checks if scientific research data exists which links them to known diseases. For example, a preferred embodiment of the present invention utilizes the OMIM™ (Hamosh et al, 2002) database published by NCBI, which summarizes research publications relating to genes which have been shown to be associated with diseases. Finally, the specific possible utility of the target gene is evaluated. While this process too may be facilitated by bioinformatic means, it might require manual evaluation of published scientific research regarding the target gene, in order to determine the utility of the target gene to the diagnosis and or treatment of specific disease. Only potential novel oligonucleotides, the target genes of which have passed all three examinations, are accepted as novel oligonucleotide.

Figure 16:
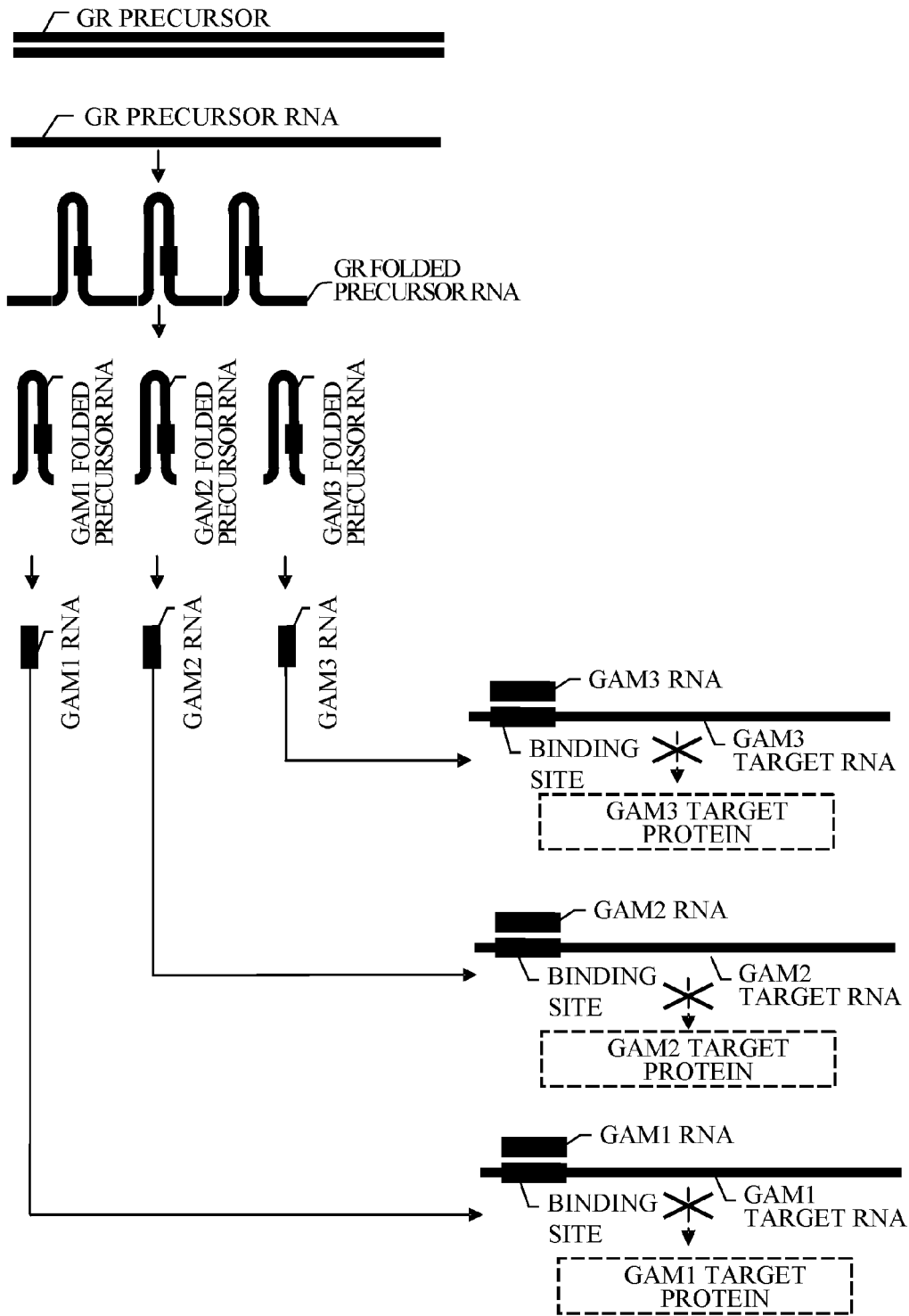
FIG. 16 is a simplified diagram describing a novel bioinformatically detected group of regulatory polynucleotides, referred to here as Genomic Record (GR) polynucleotides, each of which encodes an 'operon-like' cluster of novel miRNA-like oligonucleotides, which in turn modulate expression of one or more target genes.

Reference is now made to FIG. 16, which is a simplified diagram describing each of a plurality of novel bioinformatically detected regulatory polynucleotide referred to here as Genomic Record (GR) polynucleotide, which encodes an 'operon-like' cluster of novel microRNA-like oligonucleotides, each of which in turn modulates expression of at least one target gene; the function and utility of which at least one target gene is known in the art.

GR PRECURSOR is a novel bioinformatically detected regulatory, non protein coding polynucleotide. The method by which GR PRECURSOR is detected is described hereinabove with additional reference to FIGS. 9-18.

GR PRECURSOR encodes GR PRECURSOR RNA, an RNA molecule, typically several hundred to several thousand nucleotides long. GR PRECURSOR RNA folds spatially, forming GR FOLDED PRECURSOR RNA. It is appreciated that GR FOLDED PRECURSOR RNA comprises a plurality of what is known in the art as 'hairpin' structures. These 'hairpin' structures are due to the fact that the nucleotide sequence of GR PRECURSOR RNA comprises a plurality of segments, the first half of each such segment having a nucleotide sequence which is at least a partial or accurate reverse-complement sequence of the second half thereof, as is well known in the art.

GR FOLDED PRECURSOR RNA is naturally processed by cellular enzymatic activity into a plurality of separate GAM precursor RNAs, herein schematically represented by GAM1 FOLDED PRECURSOR RNA through GAM3 FOLDED PRECURSOR RNA, each of which GAM folded precursor RNAs being a hairpin shaped RNA segment, corresponding to GAM FOLDED PRECURSOR RNA of FIG. 8.

The above mentioned GAM folded precursor RNAs are diced by DICER COMPLEX of FIG. 8, yielding respective short RNA segments of about 22 nucleotides in length, schematically represented by GAM1 RNA through GAM3 RNA, each of which GAM RNAs corresponding to GAM RNA of FIG. 8. GAM1 RNA, GAM2 RNA and GAM3 RNA, each bind complementarily to binding sites located in untranslated regions of respective target genes, designated GAM1 TARGET RNA, GAM2 TARGET RNA and GAM3 TARGET RNA, respectively, which target binding site corresponds to a target binding site such as BINDING SITE I, BINDING SITE II or BINDING SITE III of FIG. 8. This binding inhibits translation of the respective target proteins designated GAM1 TARGET PROTEIN, GAM2 TARGET PROTEIN and GAM3 TARGET PROTEIN respectively.

It is appreciated that specific functions, and accordingly utilities of GR polynucleotide are correlated with and may be deduced from the identity of the target genes, which are inhibited by GAM RNAs comprised in the 'operon-like' cluster of GR polynucleotide, schematically represented by GAM1 TARGET PROTEIN through GAM3 TARGET PROTEIN. The function of these target genes is elaborated in Table 8, hereby incorporated herein.

Figure 17:
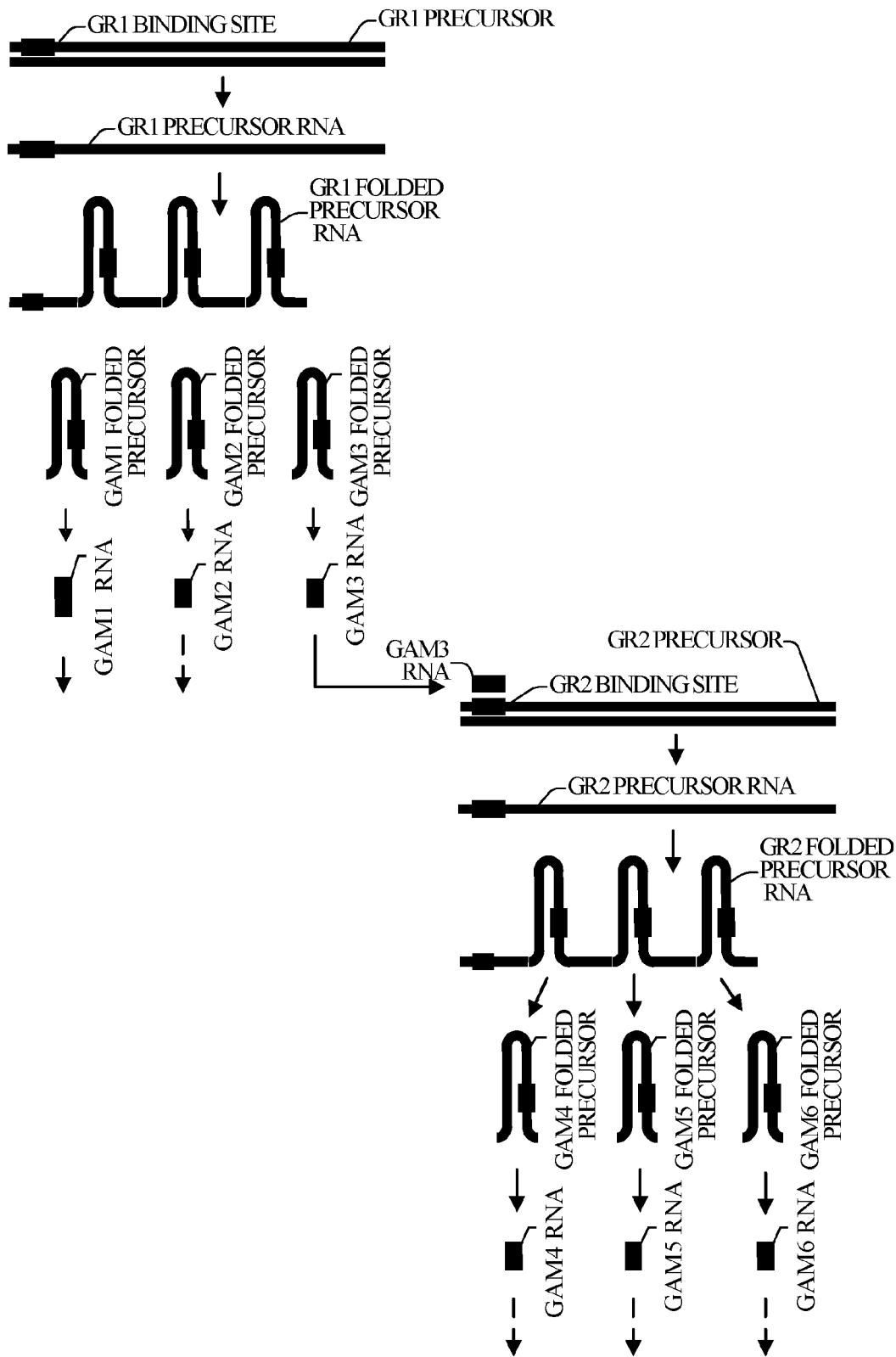
FIG. 17 is a simplified diagram illustrating a mode by which human oligonucleotides of a novel group of operon-like polynucleotides of the present invention, modulate expression of other such polynucleotides, in a cascading manner.

Reference is now made to FIG. 17 which is a simplified diagram illustrating a mode by which oligonucleotides of a novel group of operon-like polynucleotide described hereinabove with reference to FIG. 16 of the present invention, modulate expression of other such polynucleotide, in a cascading manner. GR1 PRECURSOR and GR2 PRECURSOR are two polynucleotides of the novel group of operon-like polynucleotides designated GR PRECURSOR (FIG. 16). As is typical of polynucleotides of the GR group of polynucleotides GR1 PRECURSOR and GR2 PRECURSOR, each encode a long RNA precursor, which in turn folds into a folded RNA precursor comprising multiple hairpin shapes, and is cut into respective separate hairpin shaped RNA segments, each of which RNA segments being diced to yield an oligonucleotide of a group of oligonucleotides designated GAM RNA. In this manner GR1 yields GAM1 RNA, GAM2 RNA and GAM3 RNA, and GR2 yields GAM4 RNA, GAM5 RNA and GAM6 RNA. As FIG. 17 shows, GAM3 RNA, which derives from GR1, binds a binding site located adjacent to GR2 GPRECURSOR thus modulating expression of GR2, thereby invoking expression of GAM4 RNA, GAM5 RNA and GAM6 RNA which derive from GR2. It is appreciated that the mode of modulation of expression presented by FIG. 17 enables an unlimited 'cascading effect' in which a GR polynucleotide comprises multiple GAM oligonucleotides each of which may modulate expression of other GR polynucleotides each such GR polynucleotides comprising additional GAM oligonucleotide etc., whereby eventually certain GAM oligonucleotides modulate expression of target proteins.

This mechanism is in accord with the conceptual model of the present invention addressing the differentiation enigma, described hereinabove with specific reference to FIGS. 6-7.

Figure 18:
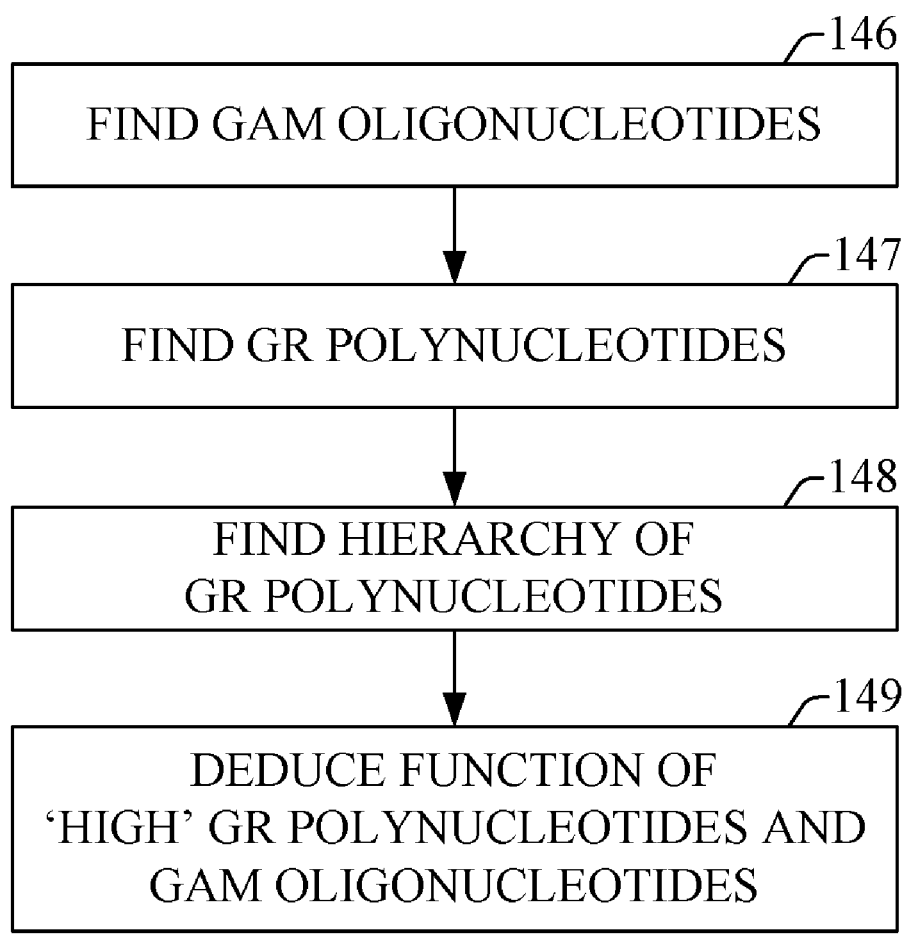
FIG. 18 is a block diagram illustrating an overview of a methodology for finding novel human oligonucleotides and novel operon-like human polynucleotides of the present invention, and their respective functions.

Reference is now made to FIG. 18 which is a block diagram illustrating an overview of a methodology for finding novel oligonucleotides and operon-like polynucleotides of the present invention, and their respective functions. According to a preferred embodiment of the present invention, the methodology to finding novel oligonucleotides of the present invention and their function comprises of the following major steps: First, FIND GAM OLIGONUCLEOTIDES 146 is used to detect, oligonucleotide of the novel group of oligonucleotide of the present invention, referred to here as GAM oligonucleotide. GAM oligonucleotides are located and their function elicited by detecting target proteins they bind and the function of those target proteins, as described hereinabove with reference to FIGS. 9-15. Next, FIND GR POLYNUCLEOTIDES 147 is used to detect polynucleotide of a novel group of operon-like polynucleotide of the present invention, referred to here as GR polynucleotide. GR polynucleotides are located, by locating clusters of proximally located GAM oligonucleotide, based on the previous step. Consequently, FIND HIERARCHY OF GR POLYNUCLEOTIDES 148 elicits the hierarchy of GR and GAM: binding sites for non-protein-binding GAM oligonucleotide comprised in each GR polynucleotide found are sought adjacent to other GR polynucleotides. When found, such a binding site indicates that the connection between the GAM and the GR the expression of which it modulates, and thus the hierarchy of the GR polynucleotides and the GAM oligonucleotides they comprise.

Lastly, DEDUCE FUNCTION OF HIGH GR POLYNUCLEOTIDES AND GAM OLIGONUCLEOTIDES 149 is used to deduce the function of GR polynucleotides and GAM oligonucleotides which are 'high' in the hierarchy, i.e. GAM oligonucleotides which modulate expression of other GR polynucleotides rather than directly modulating expression of target proteins. A preferred approach is as follows: The function of protein-modulating GAM oligonucleotides is deducible from the proteins which they modulate, provided that the function of these target proteins is known. The function of 'higher' GAM oligonucleotides may be deduced by comparing the function of protein-modulating GAM oligonucleotides with the hierarchical relationships by which the 'higher' GAM oligonucleotides are connected to the protein-modulating GAM oligonucleotides. For example, given a group of several protein-modulating GAM oligonucleotides which collectively cause a protein expression pattern typical of a certain cell-type, then a 'higher' GAM oligonucleotide is sought which modulates expression of GR polynucleotides which perhaps modulate expression of other GR polynucleotides which eventually modulate expression of the given group of protein-modulating GAM oligonucleotide. The 'higher' GAM oligonucleotide found in this manner is taken to be responsible for differentiation of that cell-type, as per the conceptual model of the invention described hereinabove with reference to FIG. 6.

Figure 19:
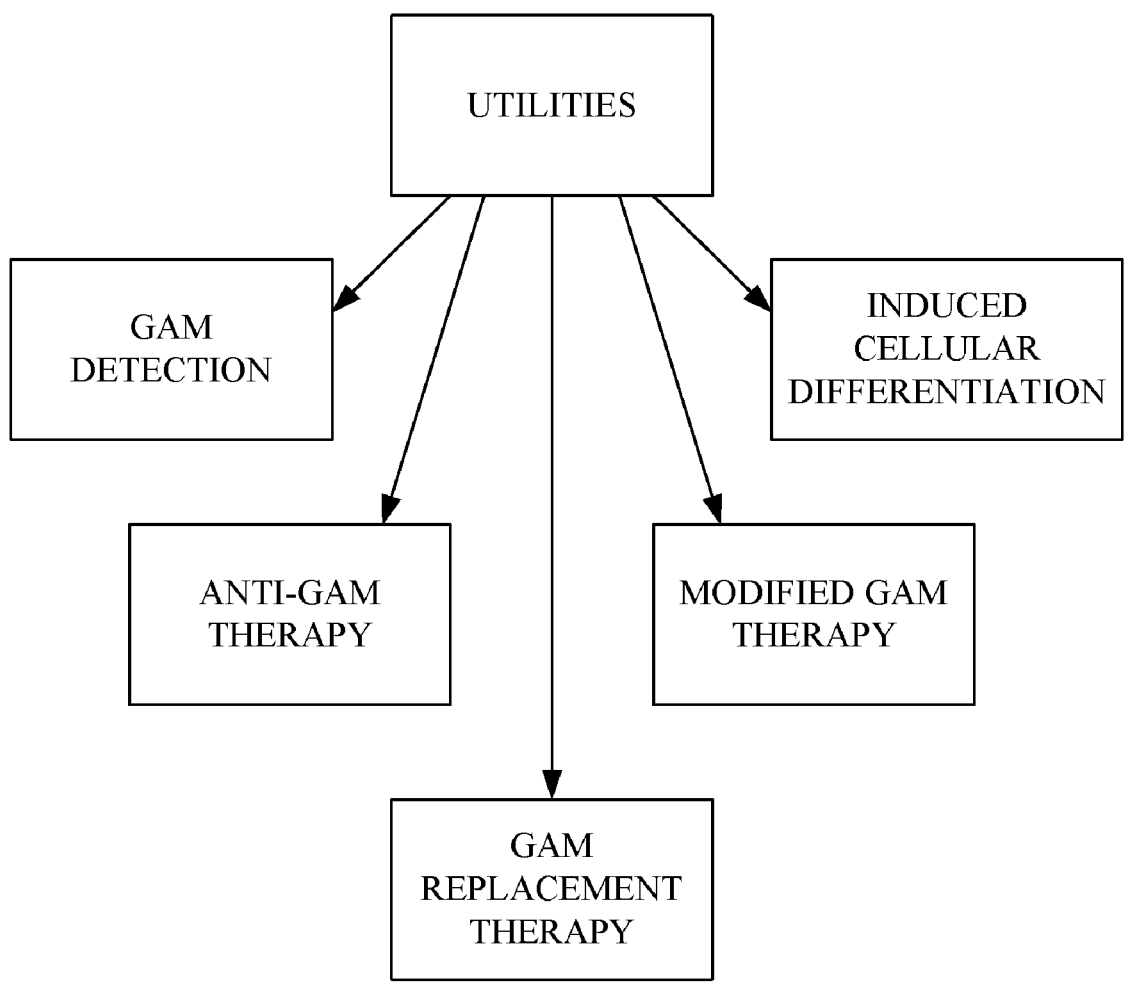
FIG. 19 is a block diagram illustrating different utilities of novel oligonucleotides and novel operon-like polynucleotides, both of the present invention.

Reference is now made to FIG. 19 which is a block diagram illustrating different utilities of oligonucleotide of the novel group of oligonucleotides of the present invention referred to here as GAM oligonucleotides and GR polynucleotides. The present invention discloses a first plurality of novel oligonucleotides referred to here as GAM oligonucleotides and a second plurality of operon-like polynucleotides referred to here as GR polynucleotides, each of the GR polynucleotide encoding a plurality of GAM oligonucleotides. The present invention further discloses a very large number of known target genes, which are bound by, and the expression of which is modulated by each of the novel oligonucleotides of the present invention. Published scientific data referenced by the present invention provides specific, substantial, and credible evidence that the above mentioned target genes modulated by novel oligonucleotides of the present invention, are associated with various diseases. Specific novel oligonucleotides of the present invention, target genes thereof and diseases associated therewith, are described hereinbelow with reference to Tables 1 through 11. It is therefore appreciated that a function of GAM oligonucleotides and GR polynucleotides of the present invention is modulation of expression of target genes related to known diseases, and that therefore utilities of novel oligonucleotides of the present invention include diagnosis and treatment of the above mentioned diseases.

FIG. 19 describes various types of diagnostic and therapeutic utilities of novel oligonucleotides of the present invention. A utility of novel oligonucleotide of the present invention is detection of GAM oligonucleotides and of GR polynucleotides. It is appreciated that since GAM oligonucleotides and GR polynucleotides modulate expression of disease related target genes, that detection of expression of GAM oligonucleotides in clinical scenarios associated with said diseases is a specific, substantial and credible utility. Diagnosis of novel oligonucleotides of the present invention may preferably be implemented by RNA expression detection techniques, including but not limited to biochips, as is well known in the art. Diagnosis of expression of oligonucleotides of the present invention may be useful for research purposes, in order to further understand the connection between the novel oligonucleotides of the present invention and the above mentioned related diseases, for disease diagnosis and prevention purposes, and for monitoring disease progress.

Another utility of novel oligonucleotides of the present invention is anti-GAM therapy, a mode of therapy which allows up regulation of a disease-related target gene of a novel GAM oligonucleotide of the present invention, by lowering levels of the novel GAM oligonucleotide which naturally inhibits expression of that target gene. This mode of therapy is particularly useful with respect to target genes which have been shown to be under-expressed in association with a specific disease. Anti-GAM therapy is further discussed hereinbelow with reference to FIGS. 20A and 20B.

A further utility of novel oligonucleotides of the present invention is GAM replacement therapy, a mode of therapy which achieves down regulation of a disease related target gene of a novel GAM oligonucleotide of the present invention, by raising levels of the GAM which naturally inhibits expression of that target gene. This mode of therapy is particularly useful with respect to target genes which have been shown to be over-expressed in association with a specific disease. GAM replacement therapy involves introduction of supplementary GAM products into a cell, or stimulation of a cell to produce excess GAM products. GAM replacement therapy may preferably be achieved by transfecting cells with an artificial DNA molecule encoding a GAM which causes the cells to produce the GAM product, as is well known in the art.

Yet a further utility of novel oligonucleotides of the present invention is modified GAM therapy. Disease conditions are likely to exist, in which a mutation in a binding site of a GAM RNA prevents natural GAM RNA to effectively bind inhibit a disease related target gene, causing up regulation of that target gene, and thereby contributing to the disease pathology. In such conditions, a modified GAM oligonucleotides is designed which effectively binds the mutated GAM binding site, i.e. is an effective anti-sense of the mutated GAM binding site, and is introduced in disease effected cells. Modified GAM therapy is preferably achieved by transfecting cells with an artificial DNA molecule encoding the modified GAM which causes the cells to produce the modified GAM product, as is well known in the art.

An additional utility of novel GAM of the present invention is induced cellular differentiation therapy. An aspect of the present invention is finding oligonucleotides which determine cellular differentiation, as described hereinabove with reference to FIG. 18. Induced cellular differentiation therapy comprises transfection of cell with such GAM oligonucleotides thereby determining their differentiation as desired. It is appreciated that this approach may be widely applicable, inter alia as a means for auto trans-plantation harvesting cells of one cell-type from a patient, modifying their differentiation as desired, and then trans-planting them back into the patient. It is further appreciated that this approach may also be utilized to modify cell differentiation in vivo, by transfecting cells in a genetically diseased tissue with a cell-differentiation determining GAM thus stimulating these cells to differentiate appropriately.

Reference is now made to FIGS. 20A and 20B, simplified diagrams which when taken together illustrate anti-GAM therapy mentioned hereinabove with reference to FIG. 19. A utility of novel GAMs of the present invention is anti-GAM therapy, a mode of therapy which allows up regulation of a disease-related target gene of a novel GAM of the present invention, by lowering levels of the novel GAM which naturally inhibits expression of that target gene. FIG. 20A shows a normal GAM inhibiting translation of a target gene by binding of GAM RNA to a BINDING SITE found in an untranslated region of GAM TARGET RNA, as described hereinabove with reference to FIG. 8.

FIG. 20B shows an example of anti-GAM therapy. ANTI-GAM RNA is short artificial RNA molecule the sequence of which is an anti-sense of GAM RNA. Anti-GAM treatment comprises transfecting diseased cells with ANTI-GAM RNA, or with a DNA encoding thereof. The ANTI-GAM RNA binds the natural GAM RNA, thereby preventing binding of natural GAM RNA to its BINDING SITE. This prevents natural translation inhibition of GAM TARGET RNA by GAM RNA, thereby up regulating expression of GAM TARGET PROTEIN.

It is appreciated that anti-GAM therapy is particularly useful with respect to target genes which have been shown to be under-expressed in association with a specific disease.

Furthermore, anti-GAM therapy is particularly useful, since it may be used in situations in which technologies known in the art as RNAi and siRNA can not be utilized. As in known in the art, RNAi and siRNA are technologies which offer means for artificially inhibiting expression of a target protein, by artificially designed short RNA segments which bind complementarily to mRNA of said target protein. However, RNAi and siRNA can not be used to directly up regulate translation of target proteins.

Figure 21A:
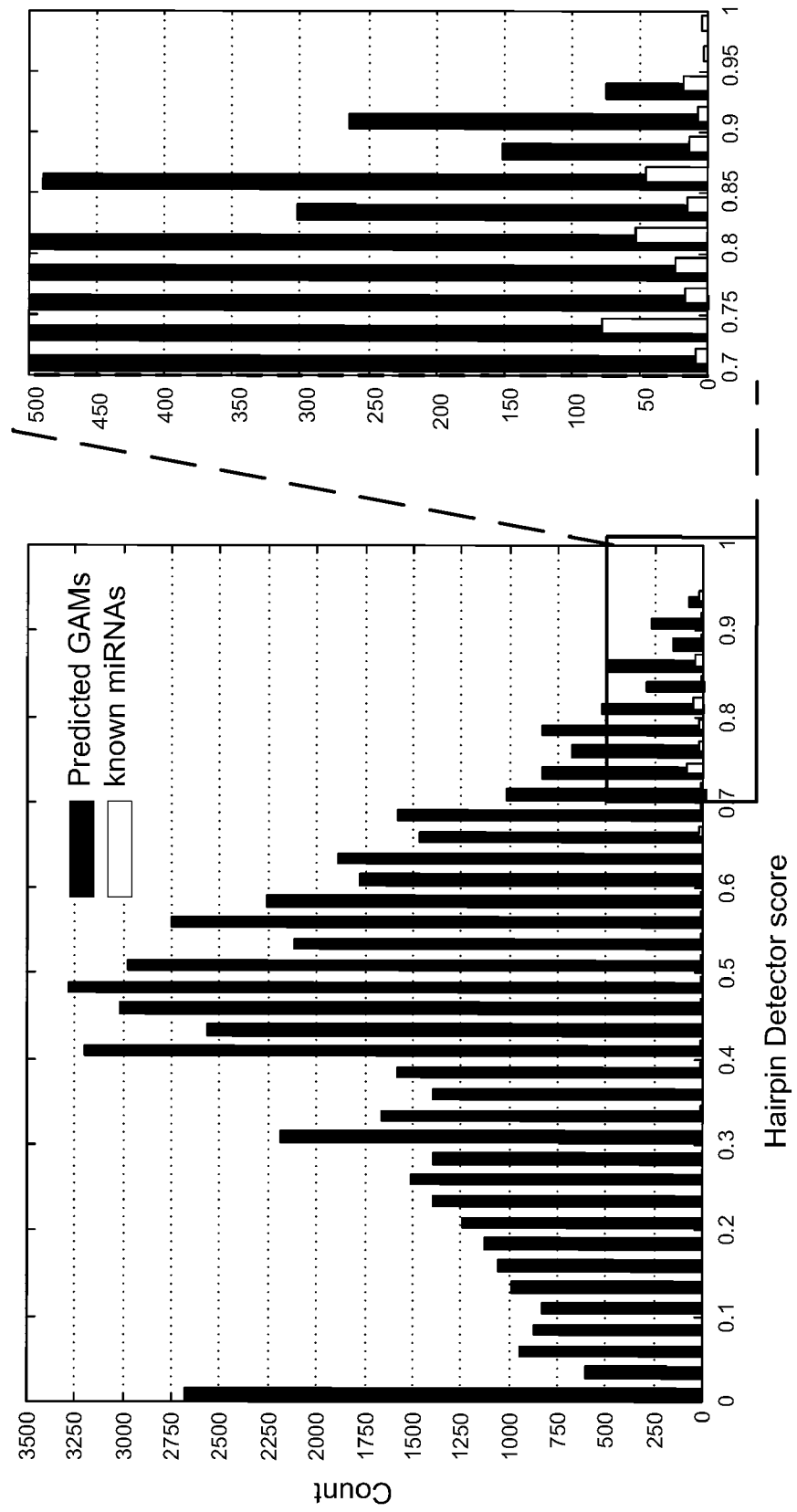
FIG. 21A is a histogram representing the distribution of known miRNA oligonucleotides and that of predicted miRNA-like hairpin structures extracted from expressed genome sequences with respect to their hairpin detector score.

Reference is now made to FIG. 21A, which is a histogram representing the distribution of known miRNA oligonucleotides and that of hairpin structures extracted from expressed human genome sequences with respect to their HAIRPIN DETECTOR score (this analysis preferably uses the previous version of the Hairpin Detector program). The known miRNA oligonucleotides set is taken from RFAM database, Release 2.1 and includes 440 miRNA oligonucleotides from *H. sapienas, M. musculus, C. elegans, C. brigassae* and *D. melanogaster*. Folding of expressed genome sequences taken from public databases of ESTs (Unigene-NCBI and TIGR) identified 342,882 hairpin structures. ~154,000 out of the 342,882 hairpin structures did not pass the filter of being identified as hairpins in several secondary structure folding versions of the given genomic sequence, as described hereinabove with reference to FIG. 12B, and hence did not receive a Hairpin detector score. Furthermore, ~133,000 hairpin structures did not pass the filter of minimum score of the DICER-CUT LOCATION DETECTOR 116 (FIG. 9) (those ~287,000 hairpin structures are not represented in the histogram).

Hairpin structures are considered as miRNA-like precursor oligonucleotides here referred to as GAM precursor, if their Hairpin detector score is above 0.3. Thus, the GAM precursor set is comprised of ~40,000 hairpin structures, of those ~5100 received a high Hairpin detector score (>=0.7). These are much higher numbers than those of the known miRNA oligonucleotides and of the upper bound of ~255 human miRNA oligonucleotides, estimated by Bartel et al. (Science, 299, 1540, March 2003). Of the reference set that pass the above filter (408/440), 284 (69%) received a high Hairpin detector score (>=0.7).

Reference is now made to FIG. 21B, which is a table summarizing laboratory validation results that validate efficacy of the BIOINFORMATIC OLIGONUCLEOTIDE DETECTION ENGINE 100 (FIG. 9). In order to assess efficacy of the BIOINFORMATIC OLIGONUCLEOTIDE DETECTION ENGINE 100, novel oligonucleotides predicted thereby are preferably filtered using the scores of HAIRPIN DETECTOR 114 (FIG. 9) and DICER-CUT LOCATION DETECTOR 116 (FIG. 9) as follows: covering 85% (second column) of published hairpin our algorithm enable to filter 95% of background (third column), leaving only dozens of predicted hairpins with relatively high probability of being a real hairpin carrying a 'diced' miRNA for lab validation.

Group A (selected for the present invention, first column): The score of the HAIRPIN-DETECTOR is above 0, the overall score of the two-phased predictor is above 0.55, and the score of the second phase of the two-phased predictor is above 0.75, or the score of the EDIT-DISTANCE predictor is equal or above 17. In this group, one Dicer cut location is predicted for each hairpin.

Sample of novel bioinformatically predicted human GAMs are sent to the laboratory for validation (fourth column), and the number (fifth column) and percent (sixth column) of successful validation of predicted human GAM is noted for each of the groups, as well as overall (bottom line). The information about the above lab validation is based on previous patents group selections, there is a high correlation between the old group A predicted hairpin and the present one indicate that the update results should be approximately the same or better, due to improvement in the predictions.

It is appreciated that the present invention comprises 15454 novel GAM oligonucleotides, which fall into group A, and that the BIOINFORMATIC OLIGONUCLEOTIDE DETECTION ENGINE 100 (FIG. 9) is substantiated by a group of 37 novel human GAM oligonucleotides validated by laboratory means, out of 101 human GAM oligonucleotides which were tested in the lab, resulting in validation of an overall 31% accuracy. The selected group demonstrated 37% accuracy. Pictures of test-results of specific human GAM oligonucleotides as well as the methodology used for validating the expression of predicted oligonucleotides are elaborated hereinbelow with reference to FIG. 22.

It is further appreciated that failure to detect a predicted oligonucleotide in the lab does not necessarily indicate a mistaken bioinformatic prediction. Rather, it may be due to technical sensitivity limitation of the lab test, or because the predicted oligonucleotides are not expressed in the tissue examined, or at the development phase tested.

It is still further appreciated that in general these findings are in agreement with the expected bioinformatic accuracy, as describe hereinabove with reference to FIG. 13B: assuming 80% accuracy of the HAIRPIN DETECTOR 114 and 80% accuracy of the DICER-CUT LOCATION DETECTOR 116 and 80% accuracy of the lab validation, this would result in 50% overall accuracy of the predicted oligonucleotide validated in the lab.

Figure 22A:
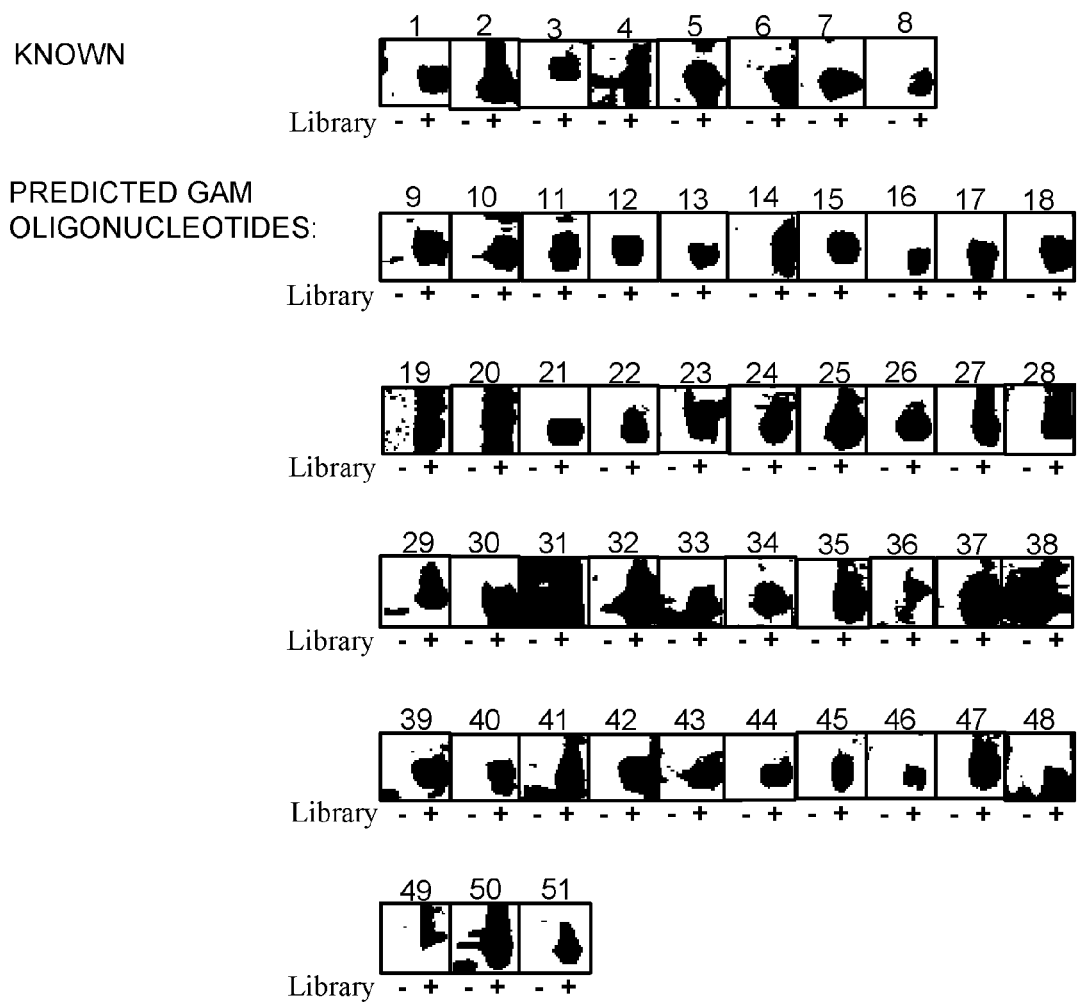

Reference is now made to FIG. 22A which is a picture of laboratory results validating the expression of 43 novel human GAM oligonucleotides detected by the BIOINFORMATIC OLIGONUCLEOTIDE DETECTION ENGINE 100 (FIG. 9).

Reference is now made to FIG. 22A and FIG. 22B which are pictures and a summary table of laboratory results validating the expression of 43 novel human GAM oligonucleotides detected by the BIOINFORMATIC OLIGONUCLEOTIDE DETECTION ENGINE 100. In each row in FIG. 22A, pictures of several oligonucleotides validated by hybridization of Polymerase Chain Reaction (PCR)-product southern-blots, are provided, each corresponding to a specific GAM oligonucleotide, as elaborated hereinbelow. To test our validation method, we used a reference set of 8 known human miRNA oligonucleotides, as a blind test to our laboratory. These PCR-product hybridization pictures are designated 1 through 8 for the reference set known miRNA oligonucleotides; and 9 through 51 for predicted GAM oligonucleotides.

In each PCR hybridization picture, 2 lanes are seen: the test lane, designated "+" and the control lane, designated "−". The control reaction contained all the components of the test reaction except library template. For convenience of viewing the results, all PCR-product hybridization pictures of FIG. 22A have been shrunk ×4 vertically. It is appreciated that for each of the tested GAM oligonucleotides a clear hybridization band appears in the test ("+") lane, but not in the control ("−") lane.

Specifically, FIG. 22A shows pictures of PCR-product hybridization validation by southern-blot, the methodology of which is described hereinbelow, to the following novel human GAM oligonucleotides (RosettaGenomics Ltd. Nomenclature, 'A' and 'B' referred to the Dicer Cut Location as described hereinbelow with reference to the description of large tables:

(1) hsa-MIR-21; (2) hsa-MIR-27b; (3) hsa-MIR-186; (4) hsa-MIR-93; (5) hsa-MIR-26a; (6) hsa-MIR-191; (7) hsa-MIR-31; (8) hsa-MIR-92; (9) GAM3418-A (later published by other researchers as hsa-MIR23); (10) GAM4426-A; (11) GAM281-A; (12) GAM7553-A; (13) GAM5385-A; (14) GAM2608-A; (15) GAM1032-A; (16) GAM3431-A; (17) GAM7933-A; (18) GAM3298-A.; (19) GAM7080-A; (20) GAM895-A.; (21) GAM3770.1; (22) GAM337162-A; (23) GAM 8678-A; (24) GAM2033-A; (25) GAM7776-A; (26) GAM8145-A; (27) GAM25-A; (28) GAM7352.1; (29) GAM337624-A; (30) GAM1479-A; (31) GAM2270-A; (32) GAM7591-A; (33) GAM8285-A; (34) GAM6773-A; (35) GAM336818-A; (36) GAM336487-A; (37) GAM337620-A; (38) GAM336809-A; (39) GAM5346-A; (40) GAM8554-A; (41) GAM2071-A; (42) GAM7957-A; (43) GAM391-A; (44) GAM6633-A; (45) GAM19; (46) GAM8358-A; (47) GAM3229-A; an)GAM 7052-A; (49) GAM3027-A; (50) GAM21 and (51) GAM oligonucleotide similar to mmu-MIR-30e.

The next validated GAM oligonucleotides are highly similar or identical to known mouse-miRNA oligonucleotides: GAM3027-A, similar to mmu-MIR-29c; GAM21, similar to mmu-MIR-130b; and GAM oligonucleotide which is highly similar to mmu-MIR-30e (picture number 51). In addition to the PCR—product hybridization detection, the following GAMs were also cloned and sequenced: GAM3418-A, GAM5385-A, GAM1032-A, GAM3298-A, GAM7080-A, GAM1338-A, GAM7776-A, GAM25-A, GAM337624-A, GAM1479-A, GAM6773-A, GAM336818-A, GAM336487-A, GAM337620-A, GAM336809-A, GAM3027-A, GAM21, and GAM oligonucleotide similar to mmu-MIR-30e (picture number 51). Furthermore, the following GAM oligonucleotides were sequenced directly from the ligation reaction by the method described hereinbelow under LIGATION-PCR DIAGNOSTIC METHOD: GAM4426-A, GAM7553-A, GAM2270-A, and GAM7591-A.

In order to validate the expression of predicted novel GAMs and assuming that these novel GAM oligonucleotides are probably expressed at low concentrations, a PCR product cloning approach was set up through the following strategy: two types of cDNA libraries designated "One tailed" and "Ligation" were prepared from frozen HeLa S100 extract (4c Biotech, Belgium) size fractionated RNA. Essentially, Total S100 RNA was prepared through an SDS-Proteinase K incubation followed by an acid Phenol-Chloroform purification and Isopropanol precipitation. Alternatively, total HeLa RNA was also used as starting material for these libraries.

Fractionation was done by loading up to 500 g per YM100 Amicon Microcon column (Millipore) followed by a 500 g centrifugation for 40 minutes at 4 C. Flow through "YM100"RNA consisting of about of the total RNA was used for library preparation or fractionated further by loading onto a YM30 Amicon Microcon column (Millipore) followed by a 13,500 g centrifugation for 25 minutes at 4 C. Flowthrough "YM30" was used for library preparation as is and consists of less than 0.5% of total RNA. For the both the "ligation" and the "One-tailed" libraries, RNA was dephosphorilated and ligated to an RNA (lowercase)-DNA (UPPERCASE) hybrid 5-phosphorilated, 3 idT blocked 3-adapter (5-P-uuuAACCG-CATCCTTCTC-idT-3 Dharmacon #P-002045-01-05) (SEQ ID NO: 2254574) (as elaborated in Elbashir et al., Genes Dev. 15:188-200 (2001)) resulting in ligation only of RNase III type cleavage products. 3-Ligated RNA was excised and purified from a half 6%, half 13% polyacrylamide gel to remove excess adapter with a Nanosep 0.2M centrifugal device (Pall) according to instructions, and precipitated with glycogenand 3 volumes of Ethanol. Pellet was resuspended in a minimal volume of water.

For the "ligation" library a DNA (JPPERCASE)-RNA Oowercase) hybrid 5-adapter (5-TACTAATACGACTCAC-Taaa-3 Dharmacon #P-002046-01-05) (SEQ ID NO: 2254575) was ligated to the 3-adapted RNA, reverse transcribed with "EcoRI-RT": (5-GACTAGCTGGAATTCAAG-GATGCGGTTAAA-3) (SEQ ID NO: 2254576), PCR amplified with two external primers essentially as in Elbashir et al 2001 except that primers were "EcoRI-RT" and "PstI Fwd" (5-CAGCCAACGCTGCAGATACGACTCACTAAA-3) (SEQ ID NO: 2254577). This PCR product was used as a template for a second round of PCR with one hemispecific and one external primer or with two hemispecific primers.

For the "One tailed" library the 3-Adapted RNA was annealed to 20 pmol primer "EcoRI RT" by heating to 70 C and cooling 0.1 C/sec to 30 C and then reverse transcribed with Superscript II RT (According to instructions, Invitrogen) in a 201 volume for 10 alternating 5 minute cycles of 37 C and 45 C. Subsequently, RNA was digested with 1 1 2M NaOH, 2 mM EDTA at 65 C for 10 minutes. cDNA was loaded on a polyacrylamide gel, excised and gelpurified from excess primer as above (invisible, judged by primer run alongside) and resuspended in 13 1 of water. Purified cDNA was then oligo-dC tailed with 400 U of recombinant terminal transferase (Roche molecular biochemicals), 1 1 100M dCTP, 1 1 15 mM CoCl2, and 41 reaction buffer, to a final volume of 20 l for 15 minutes at 37 C. Reaction was stopped with 210.2M EDTA and 15 1 3M NaOAc pH 5.2. Volume was adjusted to 150 1 with water, Phenol: Bromochloropropane 10:1 extracted and subsequently precipitated with glycogen and 3 volumes of Ethanol. C-tailed cDNA was used as a template for PCR with the external primers "T3-PstBsg(G/I) 18"(5- AATTAACCCTCACTAAAGGCTGCAGGTGC AGGIGGGIIGGGIIGGGIIGN-3 (SEQ ID NO: 2254578) where I stands for Inosine and N for any of the 4 possible. deoxynucleotides), and with "EcoRI Nested" (5-GGAAT-TCAAGGATGCGGTTA-3) (SEQ ID NO:2254579). This PCR product was used as a template for a second round of PCR with one hemispecific and one external primer or with two hemispecific primers.

Hemispecific primers were constructed for each predicted GAM RNA oligonucleotide by an in-house program designed to choose about half of the 5 or 3 sequence of the GAM RNA corresponding to a TM of about 30-34 C constrained by an optimized 3 clamp, appended to the cloning adapter sequence (for "One-tailed" libraries 5-GGN-NGGGNNG (SEQ ID NO: 2254580) on the 5 end of the GAM RNA, or TTTAACCGCATC-3 (SEQ ID NO: 2254581) on the 3 end of the GAM RNA. For "Ligation" libraries the same 3 adapter and 5-CGACTCACTAAA (SEQ ID NO: 2254582) on the 5 end). Consequently, a fully complementary primer of a TM higher than 60 C was created covering only one half of the GAM RNA sequence permitting the unbiased elucidation by sequencing of the other half.

Confirmation of GAM Oligonucleotide Sequence Authenticity of PCR Products:

SOUTHERN BLOT: PCR-product sequences were confirmed by southern blot (Southern E. M., Biotechnology, 1992, 24:122-39 (1975)) and hybridization with DNA oligonucleotide probes synthesized as complimentary (antisense) to predicted GAM RNA oligonucleotides. Gels were transferred onto a Biodyne PLUS 0.45 m, (Pall) positively charged nylon membrane and UV cross-linked. Hybridization was performed overnight with DIG-labeled probes at 420 C in DIG Easy-Hyb buffer (Roche). Membranes were washed twice with 2×SSC and 0.1% SDS for 10 minutes at 420 C and then washed twice with 0.5×SSC and 0.1% SDS for 5 min at 420 C. The membrane was then developed by using a DIG luminescent detection kit (Roche) using anti-DIG and CSPD reaction, according to the manufacturer's protocol. All probes were prepared according to the manufacturers (Roche Molecular Biochemicals) protocols: Digoxigenin (DIG) labeled antisense transcripts was prepared from purified PCR products using a DIG RNA labeling kit with T3 RNA polymerase. DIG labeled PCR was prepared by using a DIG PCR labeling kit. 3-DIG-tailed oligo ssDNA antisense probes, containing DIG-dUTP and dATP at an average tail length of 50 nucleotides were prepared from 100 pmole oligonucleotides with the DIG Oligonucleotide Labeling Kit.

CLONE-SEQUENCING: PCR products were inserted into pGEM-T (Promega) or pTZ57/T (MBI Fermentas), heat-shock transformed into competent JM109 E. coli (Promega) and sown on LB-Ampiccilin plates with IPTG and Xgal. White and light-blue colonies were transferred to duplicate gridded plates, one of which was blotted onto a membrane (Biodyne Plus, Pall) for hybridization with DIG tailed oligo probes (according to instructions, Roche) complimentary to the expected GAM. Plasmid DNA from positive colonies was sequenced.

LIGATION-PCR DIAGNOSTIC METHOD: To further validate predicted GAM PCR product sequence derived from hemi-primers, a PCR based diagnostic technique was devised to amplify only those products containing also at least two additional nucleotides of the non hemi-primer defined part of the predicted GAM RNA oligonucleotide. In essence, a diagnostic primer was designed so that its 3 end, which is the specificity determining side, was identical to the desired GAM RNA oligonucleotide, 2-10 nucleotides (typically 4-7, chosen for maximum specificity) further into its 3 end than the nucleotide stretch primed by the hemi-primer. The hemi-primer PCR product was first ligated into a T-cloning vector (pTZ57/T or pGEM-T) as described hereinabove. The ligation reaction mixture was used as template for the diagnostic PCR under strict annealing conditions with the new diagnostic primer in conjunction with a general plasmid-homologous primer, resulting in a distinct ~200 base-pair product. This PCR product can be directly sequenced, permitting the elucidation of the remaining nucleotides up to the 3 of the mature GAM RNA oligonucleotide adjacent to the 3 adapter. Alternatively, following analysis of the diagnostic PCR reaction on an agarose gel, positive ligation reactions (containing a band of the expected size) were transformed into E. coli. Using this same diagnostic technique and as an alternative to screening by Southern-blot colony-hybridization, transformed bacterial colonies were screened by colony-PCR (Gussow, D. and Clackson, T, Nucleic Acids Res. 17: 4000 (1989)) prior to plasmid purification and sequencing.

Reference is now made to FIG. 22B which is a table summarizing laboratory results which validate the expression of 8 known human miRNA oligonucleotides and 43 novel GAM oligonucleotides detected by the BIOINFORMATIC OLIGONUCLEOTIDE DETECTION ENGINE 100. The table gives additional information on the above GAM oligonucleotides and contains the following fields: NUMBER: refers to the hybridization picture number of FIG. 22A; NAME: indicates the known MIR name for the reference set, or the GAM's name as given by RosettaGenomics nomenclature method; SEQUENCE: 5' to 3' sequence of the mature, 'diced' oligonucleotide; SEQUENCED: '+' indicates the additional validation of the GAM RNA sequence by sequencing procedure as described hereinabove with reference to FIG. 22A.

Figures 23A, 23B, 23C:
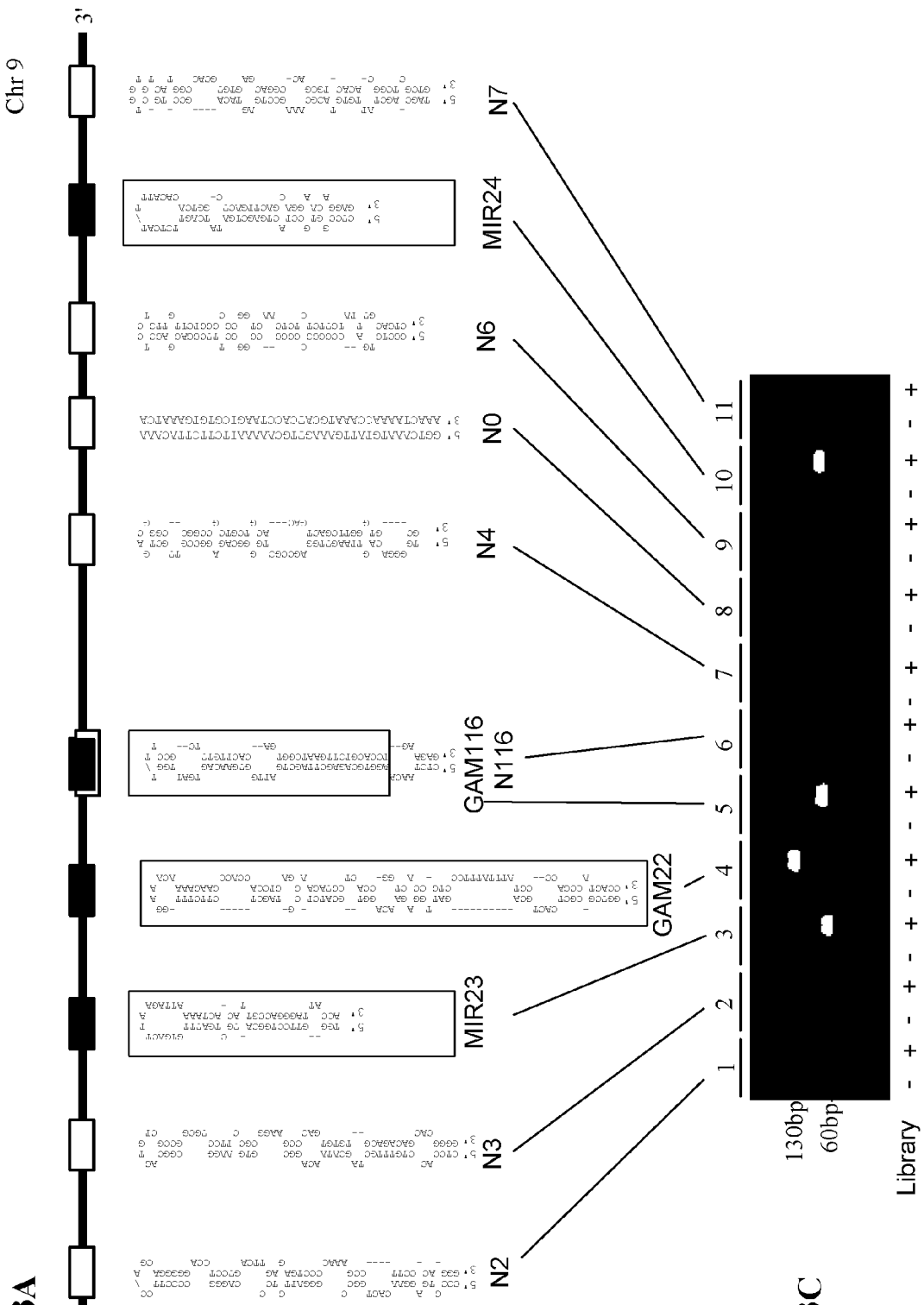
FIG. 23A is a schematic representation of an "operon-like" cluster of novel human hairpin sequences detected bioinformatically by a bioinformatic oligonucleotide detection engine constructed and operative in accordance with a preferred embodiment of the present invention, and non-GAM hairpin useful as negative controls thereto.
FIG. 23B is a schematic representation of secondary folding of hairpins of the operon-like cluster of FIG. 23A. The hairpins are associated with the following SEQ ID NOs: N2 (SEQ ID NO: 2254563); N3 (SEQ ID NO: 2254564); MIR23 (SEQ ID NO: 2254565); GAM22 (SEQ ID NO: 2254566); GAM116 (SEQ ID NOs: 2254567 and 2254568); N4 (SEQ ID NO: 2254569; N0 (SEQ ID NO: 2254570): N6 (SEQ ID NO: 2254571); MIR24 (SEQ ID NO: 2254572); N7 (SEQ ID NO: 2254573)
FIG. 23C is a picture of laboratory results demonstrating expression of novel oligonucleotides of FIGS. 23A and 23B, and lack of expression of the negative controls, thereby validating efficacy of bioinformatic detection of GAM oligonucleotides and GR polynucleotides detected by a bioinformatic oligonucleotide detection engine, constructed and operative in accordance with a preferred embodiment of the present invention.

Reference is now made to FIG. 23A, which is a schematic representation of a novel human GR polynucleotide herein designated GR12731 (RosettaGenomics Ltd. nomenclature), located on chromosome 9, comprising 2 known human MIR oligonucleotides—MIR24 and MIR23, and 2 novel GAM oligonucleotides, herein designated GAM22 and GAM116, all marked by solid black boxes. FIG. 23A also schematically illustrates 6 non-GAM hairpin sequences, and one non-hairpin sequence, all marked by white boxes, and serving as negative controls. By "non-GAM hairpin sequences" is meant sequences of a similar length to known MIR PRECURSOR sequences, which form hairpin secondary folding pattern similar to MIR PRECURSOR hairpins, and yet which are assessed by the BIOINFORMATIC OLIGONUCLEOTIDE DETECTION ENGINE 100 not to be valid GAM PRECURSOR hairpins. It is appreciated that FIG. 23A is a simplified schematic representation, reflecting only the order in which the segments of interest appear relative to one another, and not a proportional distance between the segments.

Reference is now made to FIG. 23B, which is a schematic representation of secondary folding of each of the MIRs and GAMs of GR GR12731 MIR24, MIR23, GAM22 and GAM116, and of the negative control non-GAM hairpins, herein designated N2, N3, N116, N4, N6 and N7. N0 is a non-hairpin control, of a similar length to that of known MIR PRECURSOR hairpins. It is appreciated that the negative controls are situated adjacent to and in between real MIR oligonucleotides and GAM predicted oligonucleotides and demonstrates similar secondary folding patterns to that of known MIRs and GAMs.

Reference is now made to FIG. 23C, which is a picture of laboratory results of a PCR test upon a YM100 size-fractionated "ligation"-library, utilizing a set of specific primer pairs located directly inside the boundaries of the hairpins. Due to the nature of the library the only PCR amplifiable products can result from RNaseIII type enzyme cleaved RNA, as expected for legitimate hairpin precursors presumed to be produced by DROSHA (Lee et al, Nature 425 415-419, 2003). FIG. 23C demonstrates expression of hairpin precursors of known MIR oligonucleotides—MIRhsa-23 and MIRhsa-24, and of novel bioinformatically detected GAM22 and GAM116 hairpins predicted bioinformatically by a system constructed and operative in accordance with a preferred embodiment of the present invention. FIG. 23C also shows that none of the 7 controls (6 hairpins designated N2, N3, N23, N4, N6 and N7 and 1 non-hairpin sequence designated N0) were expressed. N116 is a negative control sequence partially overlapping GAM116.

In the picture, test lanes including template are designated "+" and the control lane is designated "−". The control reaction contained all the components of the test reaction except library template. It is appreciated that for each of the tested hairpins, a clear PCR band appears in the test ("+") lane, but not in the control ("−") lane.

FIGS. 23A through 23C, when taken together validate the efficacy of the bioinformatic oligonucleotide detection engine in: (a) detecting known MIR oligonucleotides; (b) detecting novel GAM PRECURSOR hairpins which are found adjacent to these MIR oligonucleotides, and which despite exhaustive prior biological efforts and bioinformatic detection efforts, went undetected; (c) discerning between GAM (or MIR) PRECURSOR hairpins, and non-GAM hairpins.

It is appreciated that the ability to discern GAM-hairpins from non-GAM-hairpins is very significant in detecting GAM oligonucleotides since hairpins are highly abundant in the genome. Other MIR prediction programs have not been able to address this challenge successfully.

Reference is now made to FIG. 24A which is an annotated sequence of an EST comprising a novel GAM oligonucleotides detected by the oligonucleotide detection system of the present invention. FIG. 24A shows the nucleotide sequence of a known human non-protein coding EST (Expressed Sequence Tag), identified as EST72223. The EST72223 clone obtained from TIGR database (Kirkness and Kerlavage, 1997) was sequenced to yield the above 705 bp transcript with a polyadenyl tail. It is appreciated that the sequence of this EST comprises sequences of one known miRNA oligonucleotide, identified as hsa-MIR98, and of one novel GAM oligonucleotide referred to here as GAM25, detected by the BIOINFORMATIC OLIGONUCLEOTIDE DETECTION ENGINE 100 (FIG. 9) of the present invention.

The sequences of the precursors of the known MIR98 and of the predicted GAM25 precursors are marked in bold, the sequences of the established miRNA 98 and of the predicted miRNA-like oligonucleotide GAM25 are underlined.

Reference is now made to FIGS. 24B, 24C and 24D that are pictures of laboratory results, which when taken together demonstrate laboratory confirmation of expression of the bioinformatically detected novel oligonucleotide of FIG. 24A. In two parallel experiments, an enzymatically synthesized capped, EST72223 RNA transcript, was incubated with Hela S100 lysate for 0 minutes, 4 hours and 24 hours. RNA was subsequently harvested, run on a denaturing polyacrylamide gel, and reacted with either a 102 nt antisense MIR98 probe or a 145 nt antisenseGAM25 precursor transcript probe respectively. The Northern blot results of these experiments demonstrated processing of EST72223 RNA by Hela lysate (lanes 2-4, in 24B and 24C), into ~80 bp and ~22 bp segments, which reacted with the MIR98 precursor probe (24B), and into ~100 bp and ~24 bp segments, which reacted with the GAM25 precursor probe (24C). These results demonstrate the processing of EST72223 by Hela lysate into MIR98 precursor and GAM25 precursor. It is also appreciated from FIG. 24C (lane 1) that Hela lysate itself reacted with the GAM25 precursor probe, in a number of bands, including a ~100 bp band, indicating that GAM25-precursor is endogenously expressed in Hela cells. The presence of additional bands, higher than 100 bp in lanes 5-9 probably corresponds to the presence of nucleotide sequences in Hela lysate, which contain the GAM25 sequence.

In addition, in order to demonstrate the kinetics and specificity of the processing of MIR98 and GAM25 precursors into their respective mature, 'diced' segments, transcripts of MIR98 and of the bioinformatically predicted GAM25 precursors were similarly incubated with Hela S100 lysate, for 0 minutes, 30 minutes, 1 hour and 24 hours, and for 24 hours with the addition of EDTA, added to inhibit Dicer activity, following which RNA was harvested, run on a polyacrylamide gel and reacted with MIR98 and GAM25 precursor probes. Capped transcripts were prepared for in-vitro RNA cleavage assays with T7 RNA polymerase, including a m7G (5')ppp(5')G-capping reaction using the T7-mMessage mMachine kit (Ambion). Purified PCR products were used as template for the reaction. These were amplified for each assay with specific primers containing a T7 promoter at the 5 end and a T3 RNA polymerase promoter at the 3end. Capped RNA transcripts were incubated at 30 C in supplemented, dialysis concentrated, Hela S100 cytoplasmic extract (4C Biotech, Seneffe, Belgium). The Hela S100 was supplemented by dialysis to a final concentration of 20 mM Hepes, 100 mM KCl, 2.5 mM MgCl2, 0.5 mM DTT, 20% glycerol and protease inhibitor cocktail tablets (Complete mini Roche Molecular Biochemicals). After addition of all components, final concentrations were 100 mM capped target RNA, 2 mM ATP, 0.2 mM GTP, 500 U/ml RNasin, 25 g/ml creatine kinase, 25 mM creatine phosphate, 2.5 mM DTT and 50% S100 extract. Proteinase K, used to enhance Dicer activity (Zhang et al., EMBO J. 21, 5875-5885 (2002)) was dissolved in 50 mM Tris-HCl pH 8, 5 mM CaCl2, and 50% glycerol, was added to a final concentration of 0.6 mg/ml. Cleavage reactions were stopped by the addition of 8 volumes of proteinase K buffer (200 Mm Tris-Hcl, pH 7.5, 25 m M EDTA, 300 mM NaCl, and 2% SDS) and incubated at 65 C for 15 min at different time points (0, 0.5, 1, 4, 24 h) and subjected to phenol/chloroform extraction. Pellets were dissolved in water and kept frozen. Samples were analyzed on a segmented half 6%, half 13% polyacrylamide 1XTBE-7M Urea gel.

The Northern blot results of these experiments demonstrated an accumulation of a ~22 bp segment which reacted with the MIR98 precursor probe, and of a ~24 bp segment which reacted with the GAM25 precursor probe, over time (lanes 5-8). Absence of these segments when incubated with EDTA (lane 9), which is known to inhibit Dicer enzyme (Zhang et al., 2002), supports the notion that the processing of MIR98 and GAM25 precursors into their 'diced' segments is mediated by Dicer enzyme, found in Hela lysate. Other RNases do not utilize divalent cations and are thus not inhibited by EDTA. The molecular sizes of EST72223, MIR-98 and GAM25 and their corresponding precursors are indicated by arrows.

FIG. 24D present Northern blot results of same above experiments with GAM25 probe (24 nt). The results clearly demonstrated the accumulation of mature GAM25 oligonucleotide after 24 h.

To validate the identity of the band shown by the lower arrow in FIGS. 24C and 24D, a RNA band parallel to a marker of 24 base was excised from the gel and cloned as in Elbashir et al (2001) and sequenced. 90 clones corresponded to the sequence of mature GAM25 oligonucleotide, three corresponded to GAM25*(the opposite arm of the hairpin with a 1-3 nucleotide 3 overhang) and two to the hairpin-loop.

GAM25 was also validated endogenously by sequencing from both sides from a HeLa YM100 total-RNA "ligation" libraries, utilizing hemispecific primers as described in FIG. 22.

Taken together, these results validate the presence and processing of a novel MIR-like oligonucleotide, GAM25, which was predicted bioinformatically. The processing of this novel GAM oligonucleotide product, by Hela lysate from EST72223, through its precursor, to its final form was similar to that observed for known miRNA oligonucleotide, MIR98.

Transcript products were 705 nt (EST72223), 102 nt (MIR98 precursor), 125 nt (GAM25 precursor) long. EST72223 was PCR amplified with T7-EST 72223 forward primer: 5-TAATACGACTCACTATAGGCCCTTATFA-GAGGATTCTGCT-3 (SEQ ID NO: 2254583) and T3-EST72223 reverse primer: "-AATTAACCCTCAC-TAAAGGTTTTTTTTTCCTGAGACAGAG T-3 (SEQ ID NO: 2254584). MIR98 was PCR amplified using EST72223 as a template with T7MIR98 forward primer: 5-TAATAC-GACTCACTATAGGGTGAGGTAGTAAGTTGTATT GTT-3 (SEQ ID NO: 2254585) and T3MIR98 reverse primer: 5-AATTAACCCTCACTAAAGGGAAAGTAG-TAAGTTGTATAGT T-3. (SEQ ID NO: 2254586) GAM25 was PCR amplified using EST72223 as a template with GAM25 forward primer: 5-GAGGCAGGAGAATTGCT-TGA-3 (SEQ ID NO: 2254587) and T3-EST72223 reverse primer: 5-AATTAACCCTCACTAAAGGC CTGAGACA-GAGTCTTGCTC-3 (SEQ ID NO: 2254588).

It is appreciated that the data presented in FIGS. 24A, 24B, 24C and 24D when taken together validate the function of the bioinformatic oligonucleotide detection engine 100 of FIG. 9. FIG. 24A shows a novel GAM oligonucleotide bioinformatically detected by the BIOINFORMATIC OLIGONUCLE-OTIDE DETECTION ENGINE 100, and FIGS. 24C and 24D show laboratory confirmation of the expression of this novel oligonucleotide. This is in accord with the engine training and validation methodology described hereinabove with reference to FIG. 10.

DETAILED DESCRIPTION OF LARGE TABLES

Table 1 comprises data relating the SEQ ID NO of oligonucleotides of the present invention to their corresponding GAM NAME, and contains the following fields: GAM SEQ-ID: GAM SEQ ID NO, as in the Sequence Listing; GAM NAME: Rosetta Genomics Ltd. nomenclature (see below); GAM RNA SEQUENCE: Sequence (5' to 3') of the mature, 'diced' GAM RNA; GAM ORGANISM: identity of the organism encoding the GAM oligonucleotide; GAM POS: Dicer cut location (see below); and Table 2 comprises detailed textual description according to the description of FIG. 8 of each of a plurality of novel GAM oligonucleotides of the present invention, and contains the following fields: GAM NAME: Rosetta Genomics Ltd. nomenclature (see below); GAM ORGANISM: identity of the organism encoding the GAM oligonucleotide; PRECUR SEQ-ID:GAM precursor Seq-ID, as in the Sequence Listing; PRECURSOR SEQUENCE: Sequence (5' to 3) of the GAM precursor; GAM DESCRIPTION: Detailed description of GAM oligonucleotide with reference to FIG. 8; and Table 3 comprises data relating to the source and location of novel GAM oligonucleotides of the present invention, and contains the following fields: GAM NAME: Rosetta Genomics Ltd. nomenclature (see below); PRECUR SEQ-ID: GAM precursor SEQ ID NO, as in the Sequence Listing; GAM ORGANISM: identity of the organism encodes the GAM oligonucleotide; SOURCE: Chromosome encoding a human GAM oligonucleotide; STRAND: Orientation of the strand, '+' for the plus strand, '−' for the minus strand; SRC-START OFFSET: Start offset of GAM precursor sequence relative to the SOURCE; SRC-END OFFSET: End offset of GAM precursor sequence relative to the SOURCE; and Table 4 comprises data relating to GAM precursors of novel GAM oligonucleotides of the present invention, and contains the following fields: GAM NAME: Rosetta Genomics Ltd. nomenclature (see below); PRECUR SEQ-ID: GAM precursor Seq-ID, as in the Sequence Listing; GAM ORGANISM: identity of the organism encoding the GAM oligonucleotide; PRECURSOR-SEQUENCE: GAM precursor nucleotide sequence (5' to 3'); GAM FOLDED PRECUR-SOR RNA: Schematic representation of the GAM folded precursor, beginning 5' end (beginning of upper row) to 3' end (beginning of lower row), where the hairpin loop is positioned at the right part of the draw; and Table 5 comprises data relating to GAM oligonucleotides of the present invention, and contains the following fields: GAM NAME: Rosetta Genomics Ltd. nomenclature (see below); GAM ORGAN-ISM: identity of the organism encoding the GAM oligonucleotide; GAM RNA SEQUENCE: Sequence (5' to 3') of the mature, 'diced' GAM RNA; PRECUR SEQ-ID: GAM precursor Seq-ID, as in the Sequence Listing; GAM POS: Dicer cut location (see below); and Table 6 comprises data relating SEQ ID NO of the GAM target gene binding site sequence to TARGET gene name and target binding site sequence, and contains the following fields: TARGET BINDING SITE SEQ-ID: Target binding site SEQ ID NO, as in the Sequence Listing; TARGET ORGANISM: identity of organism encode the TARGET gene; TARGET: GAM target gene name; TARGET BIND-ING SITE SEQUENCE: Nucleotide sequence (5' to 3') of the target binding site; and Table 7 comprises data relating to target-genes and binding sites of GAM oligonucleotides of the present invention, and contains the following fields: GAM NAME: Rosetta Genomics Ltd. nomenclature (see below); GAM ORGANISM: identity of the organism encoding the GAM oligonucleotide; GAM RNA SEQUENCE: Sequence (5' to 3') of the mature, 'diced' GAM RNA; TARGET: GAM target gene name; TAR-GET REF-ID: Target accession number (GenBank); TAR-GET ORGANISM: identity of organism encode the TAR-GET gene; UTR: Untranslated region of binding site/s (3" or 5"); TARGET BS-SEQ: Nucleotide sequence (5' to 3') of the target binding site; BINDING-SITE-DRAW: Schematic representation of the binding site, upper row represent 5 to 3 sequence of the GAM, Lower row represent 3' to 5N Sequence of the target; GAM POS: Dicer cut location (see below); and Table 8 comprises data relating to functions and utilities of novel GAM oligonucleotides of the present invention, and contains the following fields: GAM NAME: Rosetta Genomics Ltd. nomenclature (see below); GAM RNA SEQUENCE: Sequence (5' to 3') of the mature, 'diced' GAM RNA; GAM ORGANISM: identity of the organism encoding the GAM oligonucleotide; TARGET:GAM target gene name; TAR-GET ORGANISM: identity of organism encode the TAR-GET gene; GAM FUNCTION: Description of the GAM functions and utilities; GAM POS: Dicer cut location (see below); and Table 9 comprises data of gene function references—Bibliography and contains the following fields: GAM NAME: Rosetta Genomics Ltd. nomenclature (see below); GAM RNA SEQUENCE: Sequence (5 to 3) of the mature, 'diced' GAM RNA gene; GAM ORGANISM: identity of the organism encoding the GAM oligonucleotide; TARGET: GAM target gene name; TARGET ORGANISM: identity of organism encode the TARGET gene; REFERENCES: list of references relating to the target gene; GAM POS: Dicer cut location (see below); and Table 10 comprises data relating to novel GR (Genomic Record) polynucleotides of the present invention, and contains the following fields: GR NAME: Rosetta Genomics Ltd.nomenclature (see below); GR ORGANISM: identity of the organism encoding the GR polynucleotide; GR DESCRIPTION: Detailed description of a GR gene cluster, with reference to FIG. 16; and Table 11 comprises data relating to diseases that GAM oligonucleotides are predicted to regulate the disease-associated genes. Each row is referred to a specific disease, and lists the GAM target genes related to the disease. The first row is a summary of ALL diseases containing in the present invention, thus listing ALL GAM target genes relating to theses diseases. The table contains the following fields: ROW #: index of the row number; DISEASE NAME: name of the disease; TARGET-GENES ASSOCIATED WITH DISEASE: list of GAM target genes that are associated with the specified disease; and The following conventions and abbreviations are used in the tables: The nucleotide 'U' is represented as 'T' in the tables, and GAM NAME or GR NAME are names for nucleotide sequences of the present invention given by RosettaGenomics Ltd. nomenclature method. All GAMs/GRs are designated by GAMx/GRx where x is a unique ID.

GAM POS is a position of the GAM RNA on the GAM PRECURSOR RNA sequence. This position is the Dicer cut location: A indicates a probable Dicer cut location; B indicates an alternative Dicer cut location.

All human nucleotide sequences of the present invention as well as their chromosomal location and strand orientation are derived from sequence records of UCSC-hg16 version, which is based on NCBI, Build34 database (April, 2003).

SEQUENCE LISTING (2254592 sequences)

SEQ ID NO: 1 - RNA, 22 nt, Homo sapiens
aauugcuugaacccaggaagug

SEQ ID NO: 2 - RNA, 22 nt, Homo sapiens
acugcacuccagccugggcaac

SEQ ID NO: 3 - RNA, 22 nt, Homo sapiens
cacugcaaccuccaccuccugg

SEQ ID NO: 4 - RNA, 22 nt, Homo sapiens
cacugcacuccagccugggcaa

SEQ ID NO: 5 - RNA, 22 nt, Homo sapiens
cauugcacuccagccugggcaa

SEQ ID NO: 6 - RNA, 22 nt, Homo sapiens
cuagacugaagcuccuugagga

SEQ ID NO: 7 - RNA, 22 nt, Homo sapiens
gaaguuugaagccuguuguuca

SEQ ID NO: 8 - RNA, 22 nt, Homo sapiens
gcacucaagccuggguuacaga

SEQ ID NO: 9 - RNA, 22 nt, Homo sapiens
ucuaagagaaaggaaguucaga

SEQ ID NO: 10 - RNA, 22 nt, Homo sapiens
uuauggcucuuggggaaguaga

SEQ ID NO: 11 - RNA, 22 nt, Homo sapiens
guauggaagucaguuuguuggc

SEQ ID NO: 12 - RNA, 22 nt, Homo sapiens
uugguauguguuucauacucaa

SEQ ID NO: 13 - RNA, 22 nt, Homo sapiens
aaucccugagcuagacacaaag

SEQ ID NO: 14 - RNA, 17 nt, Homo sapiens
uuagacagacauccugc

SEQ ID NO: 15 - RNA, 22 nt, Homo sapiens
gugggcucguucguguuagaca

SEQ ID NO: 16 - RNA, 22 nt, Homo sapiens
ugagagcuuuuuugccugguga

SEQ ID NO: 17 - RNA, 22 nt, Homo sapiens
aauggcuuucagcuuuucccca

SEQ ID NO: 18 - RNA, 22 nt, Homo sapiens
cucauuggcuacugaggcuugu

SEQ ID NO: 19 - RNA, 22 nt, Homo sapiens
uuccugcacuugcuugccuaug

SEQ ID NO: 20 - RNA, 22 nt, Homo sapiens
gcccagcguucagggaggggcu

SEQ ID NO: 21 - RNA, 22 nt, Homo sapiens
aaguuguuggaguuccauuguu

SEQ ID NO: 22 - RNA, 22 nt, Homo sapiens
ugcuaugucuucucucacagag

SEQ ID NO: 23 - RNA, 22 nt, Homo sapiens
aaggcuauuugagaaugugugu

SEQ ID NO: 24 - RNA, 22 nt, Homo sapiens
agugguauaauauuauuuugaa

SEQ ID NO: 25 - RNA, 23 nt, Homo sapiens
acagucuaguuugaagucaggua

SEQ ID NO: 26 - RNA, 22 nt, Homo sapiens
uauuguacauguuauagauuuu

SEQ ID NO: 27 - RNA, 22 nt, Homo sapiens
ucacagucuccucuagggaggg

SEQ ID NO: 28 - RNA, 21 nt, Homo sapiens
uuggccuggaggccugaaugu

SEQ ID NO: 29 - RNA, 22 nt, Homo sapiens
cacauagucccugcuaaucuuc

SEQ ID NO: 30 - RNA, 22 nt, Homo sapiens
auagugcugcaaaaaacauacg

SEQ ID NO: 31 - RNA, 22 nt, Homo sapiens
ugucaaguugugguucaauuuu

SEQ ID NO: 32 - RNA, 21 nt, Homo sapiens
gacauggcgauacuccgucuc

SEQ ID NO: 33 - RNA, 22 nt, Homo sapiens
aguguuuuuaucaugaaagggu

SEQ ID NO: 34 - RNA, 22 nt, Homo sapiens
gggcaagaagucuuguaguuuu

SEQ ID NO: 35 - RNA, 22 nt, Homo sapiens
ugagauuacguucggcccacuu

SEQ ID NO: 36 - RNA, 22 nt, Homo sapiens
uagcagucaagauagucauuau

SEQ ID NO: 37 - RNA, 22 nt, Homo sapiens
ucucaguggcuuccucacuuuu

SEQ ID NO: 38 - RNA, 22 nt, Homo sapiens
agcugauggucuuguaugaugu

SEQ ID NO: 39 - RNA, 22 nt, Homo sapiens
uucccugugggcuggugcucca

SEQ ID NO: 40 - RNA, 22 nt, Homo sapiens
uacugcacuccaaccugagaga

SEQ ID NO: 41 - RNA, 22 nt, Homo sapiens
guauuuguugcagcagcacuau

SEQ ID NO: 42 - RNA, 22 nt, Homo sapiens
uugcacagugguuuagagccug

SEQ ID NO: 43 - RNA, 20 nt, Homo sapiens
cucagauuauucugaagcaa

SEQ ID NO: 44 - RNA, 20 nt, Homo sapiens
gugacacucguuaaccucug

SEQ ID NO: 45 - RNA, 22 nt, Homo sapiens
augaagucguuacuaccaauug

SEQ ID NO: 46 - RNA, 22 nt, Homo sapiens
cuggcaauaaauuuuuguguug

SEQ ID NO: 47 - RNA, 22 nt, Homo sapiens
aagagguaauaacaaagcuucu

SEQ ID NO: 48 - RNA, 22 nt, Homo sapiens
guggaagcacaggccuccugga

SEQ ID NO: 49 - RNA, 23 nt, Homo sapiens
uuaaggugaugucuuugugccuc

SEQ ID NO: 50 - RNA, 22 nt, Homo sapiens
ugucuuggacuugaaucucauu

SEQ ID NO: 51 - RNA, 22 nt, Homo sapiens
uuuuuauggccaauccucagaa

SEQ ID NO: 52 - RNA, 22 nt, Homo sapiens
guauugcuugagcccaggaguu

SEQ ID NO: 53 - RNA, 22 nt, Homo sapiens
uucccuuugaaacuaaacuugc

SEQ ID NO: 54 - RNA, 22 nt, Homo sapiens
aucaggcacacauuggaguuug

SEQ ID NO: 55 - RNA, 22 nt, Homo sapiens
aauggcacaagacaugaagaag

SEQ ID NO: 56 - RNA, 19 nt, Homo sapiens
gugguauuaccuuuugauu

SEQ ID NO: 57 - RNA, 22 nt, Homo sapiens
auagcacuuaccacaggcugca

SEQ ID NO: 58 - RNA, 22 nt, Homo sapiens
guguuauggagccaaacuacua

SEQ ID NO: 59 - RNA, 22 nt, Homo sapiens
uaugccuuugaccauuuuguga

SEQ ID NO: 60 - RNA, 22 nt, Homo sapiens
gagugcauaugggccuguguca

SEQ ID NO: 61 - RNA, 22 nt, Homo sapiens
ucucacaccccucucauauacc

SEQ ID NO: 62 - RNA, 22 nt, Homo sapiens
gugucacagcuuccaucucggu

SEQ ID NO: 63 - RNA, 18 nt, Homo sapiens
aaugggacuacaaagcca

SEQ ID NO: 64 - RNA, 22 nt, Homo sapiens
ucugacacuucugcagaauuga

SEQ ID NO: 65 - RNA, 22 nt, Homo sapiens
ucaaaugauucacccaccuuug

SEQ ID NO: 66 - RNA, 22 nt, Homo sapiens
ugguacuucaugcucacagaua

SEQ ID NO: 67 - RNA, 22 nt, Homo sapiens
cauggguuuucucaaguaguca

SEQ ID NO: 68 - RNA, 22 nt, Homo sapiens
auggcggugugaucuuggcuca

SEQ ID NO: 69 - RNA, 22 nt, Homo sapiens
uguugcacugguaauguacuga

SEQ ID NO: 70 - RNA, 22 nt, Homo sapiens
ucuauuugggguaccuguggua

SEQ ID NO: 71 - RNA, 22 nt, Homo sapiens
ugugauuggccuggcguggguc

SEQ ID NO: 72 - RNA, 16 nt, Homo sapiens
gugagagaugacaaac

SEQ ID NO: 73 - RNA, 22 nt, Homo sapiens
gagaacagagauaauuuuacuu

SEQ ID NO: 74 - RNA, 22 nt, Homo sapiens
uugacuagaccaucuuucuaga

SEQ ID NO: 75 - RNA, 22 nt, Homo sapiens
uggcgggaaaguugggagaaga

SEQ ID NO: 76 - RNA, 22 nt, Homo sapiens
ccacugggcaguuuauuaucag

SEQ ID NO: 77 - RNA, 22 nt, Homo sapiens
acaguauaaugcuguagggaga

SEQ ID NO: 78 - RNA, 22 nt, Homo sapiens
auugucacugugcuccaccagu

SEQ ID NO: 79 - RNA, 19 nt, Homo sapiens
gcagagaugugguagcuug

SEQ ID NO: 80 - RNA, 22 nt, Homo sapiens
guacccuauggauauagaugaa

SEQ ID NO: 81 - RNA, 22 nt, Homo sapiens
gauuuuuggggaagccucuuau

SEQ ID NO: 82 - RNA, 17 nt, Homo sapiens
augugaauguucaaaua

SEQ ID NO: 83 - RNA, 22 nt, Homo sapiens
aacuaugucaaauaaaaugagg

SEQ ID NO: 84 - RNA, 22 nt, Homo sapiens
gcccgugagacuggaagcaaga

SEQ ID NO: 85 - RNA, 22 nt, Homo sapiens
gagcaccagucccugucagugc

SEQ ID NO: 86 - RNA, 22 nt, Homo sapiens
uugaauggaauguuggaacuau

SEQ ID NO: 87 - RNA, 22 nt, Homo sapiens
ugagaucuuggaggcuuuguga

SEQ ID NO: 88 - RNA, 22 nt, Homo sapiens
uacuagaggaauugcuauaacu

SEQ ID NO: 89 - RNA, 22 nt, Homo sapiens
cugucacuggggcacauguccc

SEQ ID NO: 90 - RNA, 21 nt, Homo sapiens
uaugagucugcaagaaccaca

SEQ ID NO: 91 - RNA, 19 nt, Homo sapiens
uccaccgcgugcaccucua

SEQ ID NO: 92 - RNA, 22 nt, Homo sapiens
ugagaugcaaaaugagaauugu

SEQ ID NO: 93 - RNA, 22 nt, Homo sapiens
ugaauaggcaguuaaguuuaug

SEQ ID NO: 94 - RNA, 22 nt, Homo sapiens
uaacaguguauuuacuacuucc

SEQ ID NO: 95 - RNA, 22 nt, Homo sapiens
auacgugcaggucacaggggau

SEQ ID NO: 96 - RNA, 22 nt, Homo sapiens
guagaccauuuaucuggggagu

SEQ ID NO: 97 - RNA, 22 nt, Homo sapiens
auaaagacacuuggcaugauuu

SEQ ID NO: 98 - RNA, 22 nt, Homo sapiens
ucagugaauauauaacagcgau

SEQ ID NO: 99 - RNA, 22 nt, Homo sapiens
acugcacuucagccuuggcuac

SEQ ID NO: 100 - RNA, 22 nt, Homo sapiens
auggacagaaaaaaauagaugu

SEQ ID NO: 101 - RNA, 22 nt, Homo sapiens
acugcacuccagccuuggccac

SEQ ID NO: 102 - RNA, 21 nt, Homo sapiens
uuauccagcacuguuucggac

SEQ ID NO: 103 - RNA, 22 nt, Homo sapiens
gucuuuguuuugauuuaccaga

SEQ ID NO: 104 - RNA, 20 nt, Homo sapiens
gagcucaucuucuuuaccac

SEQ ID NO: 105 - RNA, 22 nt, Homo sapiens
agugcaguggcacaaucuuggc

SEQ ID NO: 106 - RNA, 19 nt, Homo sapiens
ugccauguagcacaugguc

SEQ ID NO: 107 - RNA, 22 nt, Homo sapiens
ccuggcacugagcaguguucua

SEQ ID NO: 108 - RNA, 22 nt, Homo sapiens
cugaggugggagaaucacauaa

SEQ ID NO: 109 - RNA, 22 nt, Homo sapiens
uuucacuagccagcccuuuauu

SEQ ID NO: 110 - RNA, 19 nt, Homo sapiens
ggucagcaaagucuagcug

SEQ ID NO: 111 - RNA, 22 nt, Homo sapiens
gagagugcuuggcaucugcuga

SEQ ID NO: 112 - RNA, 22 nt, Homo sapiens
auguggauaucuauaucuggau

SEQ ID NO: 113 - RNA, 22 nt, Homo sapiens
auacuguauaggauuguagccu

SEQ ID NO: 114 - RNA, 22 nt, Homo sapiens
gucugguugacagcauguggcc

SEQ ID NO: 115 - RNA, 22 nt, Homo sapiens
gugcacgucuuaggaggucacg

SEQ ID NO: 116 - RNA, 21 nt, Homo sapiens
ucauugguuggcugcccugua

SEQ ID NO: 117 - RNA, 22 nt, Homo sapiens
cucaguagaaaauacauggacu

SEQ ID NO: 118 - RNA, 22 nt, Homo sapiens
uugaggacugcuaagcauuuga

SEQ ID NO: 119 - RNA, 22 nt, Homo sapiens
cauugcacuccagccugaccaa

SEQ ID NO: 120 - RNA, 22 nt, Homo sapiens
cucacugucaacauguauuugg

SEQ ID NO: 121 - RNA, 22 nt, Homo sapiens
acaccaucuccuuauuucucuu

SEQ ID NO: 122 - RNA, 18 nt, Homo sapiens
uaagugcuuuaaacacau

SEQ ID NO: 123 - RNA, 22 nt, Homo sapiens
ucauauugguuaaaauaguggg

SEQ ID NO: 124 - RNA, 22 nt, Homo sapiens
gaucucaguggauacugugaug

SEQ ID NO: 125 - RNA, 22 nt, Homo sapiens
augcagugugcaacagauuaag

SEQ ID NO: 126 - RNA, 22 nt, Homo sapiens
augugucaaaucuaggccaaag

SEQ ID NO: 127 - RNA, 22 nt, Homo sapiens
gcugcuguuuaguuucuccugg

SEQ ID NO: 128 - RNA, 22 nt, Homo sapiens
ggcacuguugccggccugaauu

SEQ ID NO: 129 - RNA, 20 nt, Homo sapiens
cuuuuugcugugcugggagc

SEQ ID NO: 130 - RNA, 20 nt, Homo sapiens
gagaacugagaugcguuuga

SEQ ID NO: 131 - RNA, 22 nt, Homo sapiens
uuaccuuuuuaagacagguuag

SEQ ID NO: 132 - RNA, 21 nt, Homo sapiens
uucuauggucagaauucaaua

SEQ ID NO: 133 - RNA, 22 nt, Homo sapiens
accauugcacuucagccuaggc

SEQ ID NO: 134 - RNA, 22 nt, Homo sapiens
ugcauagcaaaauaggauuaga

SEQ ID NO: 135 - RNA, 22 nt, Homo sapiens
guuggcaagaggugcuguacac

SEQ ID NO: 136 - RNA, 22 nt, Homo sapiens
cuguuugguaaggaugccucag

SEQ ID NO: 137 - RNA, 22 nt, Homo sapiens
ccuaaguaauggcaguuuuugc

SEQ ID NO: 138 - RNA, 22 nt, Homo sapiens
gagguaguuuaguuuuggggaa

SEQ ID NO: 139 - RNA, 22 nt, Homo sapiens
ucacgugcucuuguguguucug

SEQ ID NO: 140 - RNA, 22 nt, Homo sapiens
gagaugucuauuucagagaugu

SEQ ID NO: 141 - RNA, 22 nt, Homo sapiens
auguaguugcucugccuguuuu

SEQ ID NO: 142 - RNA, 22 nt, Homo sapiens
augaaaacaugauuugccuguu

SEQ ID NO: 143 - RNA, 22 nt, Homo sapiens
ugacauggaagauguucaugau

SEQ ID NO: 144 - RNA, 20 nt, Homo sapiens
gcaugagucuuuauaguaga

SEQ ID NO: 145 - RNA, 22 nt, Homo sapiens
gaaagugcugcuugacugggau

SEQ ID NO: 146 - RNA, 22 nt, Homo sapiens
ucccauguagcuaggauuacag

SEQ ID NO: 147 - RNA, 22 nt, Homo sapiens
augugcuaguaucaaacgagac

SEQ ID NO: 148 - RNA, 21 nt, Homo sapiens
agcuccacucguucccaaagc

SEQ ID NO: 149 - RNA, 22 nt, Homo sapiens
uauugcuggauguauuacaugu

SEQ ID NO: 150 - RNA, 22 nt, Homo sapiens
ugaagcuaggauuaauuuucau

SEQ ID NO: 151 - RNA, 22 nt, Homo sapiens
cugagcuaugccuggaaaggca

SEQ ID NO: 152 - RNA, 22 nt, Homo sapiens
acaugcauccaugugaagagac

SEQ ID NO: 153 - RNA, 19 nt, Homo sapiens
ucucugguguuggagggga

SEQ ID NO: 154 - RNA, 22 nt, Homo sapiens
uaucacagcaaggacccauuau

SEQ ID NO: 155 - RNA, 22 nt, Homo sapiens
uuaugguuuuucugugagaugg

SEQ ID NO: 156 - RNA, 21 nt, Homo sapiens
gucauaugucucugauuagug

SEQ ID NO: 157 - RNA, 22 nt, Homo sapiens
gggaugaagcccuaggguuggu

SEQ ID NO: 158 - RNA, 22 nt, Homo sapiens
uccccgucacacgcaggcuuac

SEQ ID NO: 159 - RNA, 21 nt, Homo sapiens
acaucagaguugugaagguag

SEQ ID NO: 160 - RNA, 22 nt, Homo sapiens
cugguuuguaaaguuccugaga

SEQ ID NO: 161 - RNA, 22 nt, Homo sapiens
uuacaucaucacauuaguuugc

SEQ ID NO: 162 - RNA, 22 nt, Homo sapiens
uauuugguagcuauuuugcagu

SEQ ID NO: 163 - RNA, 22 nt, Homo sapiens
uauugaacuggaucagaaggcc

SEQ ID NO: 164 - RNA, 22 nt, Homo sapiens
agaugauguuucuggcacauga

SEQ ID NO: 165 - RNA, 22 nt, Homo sapiens
auaaucacacccagguuaaaug

SEQ ID NO: 166 - RNA, 22 nt, Homo sapiens
ucuauguuuuugcuaguagugu

SEQ ID NO: 167 - RNA, 22 nt, Homo sapiens
ugugagcuauggaguuguagag

SEQ ID NO: 168 - RNA, 22 nt, Homo sapiens
cugccuaaagaaaaagacguug

SEQ ID NO: 169 - RNA, 22 nt, Homo sapiens
cuaugguuucucaaacuccuga

SEQ ID NO: 170 - RNA, 22 nt, Homo sapiens
ucauauguaugugcaauuuugu

SEQ ID NO: 171 - RNA, 22 nt, Homo sapiens
uuggucaggcuaaucucgaacg

SEQ ID NO: 172 - RNA, 22 nt, Homo sapiens
gcacaguaggugguaggacuuu

SEQ ID NO: 173 - RNA, 22 nt, Homo sapiens
gagacuaaagagcuugcccugg

SEQ ID NO: 174 - RNA, 22 nt, Homo sapiens
uucucagcccccugacagucag

SEQ ID NO: 175 - RNA, 22 nt, Homo sapiens
auggaauguauagucauguagg

SEQ ID NO: 176 - RNA, 22 nt, Homo sapiens
aaaugggacugggguccuuuga

SEQ ID NO: 177 - RNA, 22 nt, Homo sapiens
ugaaacugcagugggcuuggca

SEQ ID NO: 178 - RNA, 22 nt, Homo sapiens
uaagguccuuaaauguguaacc

SEQ ID NO: 179 - RNA, 22 nt, Homo sapiens
auguaacugggacacaagccuc

SEQ ID NO: 180 - RNA, 22 nt, Homo sapiens
uccaugaggcuacaguaaucuc

SEQ ID NO: 181 - RNA, 22 nt, Homo sapiens
uacuagaguagugcagagggga

SEQ ID NO: 182 - RNA, 22 nt, Homo sapiens
aauucacuucuuuuaggcaggg

SEQ ID NO: 183 - RNA, 22 nt, Homo sapiens
auagugcugcaacaaauauacg

SEQ ID NO: 184 - RNA, 22 nt, Homo sapiens
acuauacugaagcaaauuaaca

SEQ ID NO: 185 - RNA, 22 nt, Homo sapiens
auauccaugccauagguuuuga

SEQ ID NO: 186 - RNA, 22 nt, Homo sapiens
gucgguguuuccugagaacgaa

SEQ ID NO: 187 - RNA, 22 nt, Homo sapiens
ccaaggcacugauucuguacuc

SEQ ID NO: 188 - RNA, 22 nt, Homo sapiens
cuuugguguauuuucagagacc

SEQ ID NO: 189 - RNA, 22 nt, Homo sapiens
gaggaaguaauuuuaggccugu

SEQ ID NO: 190 - RNA, 22 nt, Homo sapiens
ugcaguacuuugaaauauacug

SEQ ID NO: 191 - RNA, 22 nt, Homo sapiens
uuggucaggagccucccucuuu

SEQ ID NO: 192 - RNA, 22 nt, Homo sapiens
auguuugguaagaauauuguua

SEQ ID NO: 193 - RNA, 22 nt, Homo sapiens
uuucauggcaguuuggggccug

SEQ ID NO: 194 - RNA, 22 nt, Homo sapiens
guaaucucagcuacucaggagg

SEQ ID NO: 195 - RNA, 22 nt, Homo sapiens
cauggccuuuggaaugugucua

SEQ ID NO: 196 - RNA, 22 nt, Homo sapiens
auagaaucaucugugcacuagu

SEQ ID NO: 197 - RNA, 22 nt, Homo sapiens
augucuagagugauacugaagc

SEQ ID NO: 198 - RNA, 22 nt, Homo sapiens
agguauguauguaugggagaaa

SEQ ID NO: 199 - RNA, 22 nt, Homo sapiens
agagaucaacugaauuacugga

SEQ ID NO: 200 - RNA, 22 nt, Homo sapiens
augcagguguuuugcacugagu

SEQ ID NO: 201 - RNA, 22 nt, Homo sapiens
auaucaacaucgugucauuagu

SEQ ID NO: 202 - RNA, 22 nt, Homo sapiens
augugggaggacuuggcuguug

SEQ ID NO: 203 - RNA, 22 nt, Homo sapiens
acauagaguagcuaccuguaga

SEQ ID NO: 204 - RNA, 22 nt, Homo sapiens
aauauagcuauguacaugucca

SEQ ID NO: 205 - RNA, 22 nt, Homo sapiens
uuuugugacuauuguaaauggg

SEQ ID NO: 206 - RNA, 21 nt, Homo sapiens
gugcagacacacauauaggcu

SEQ ID NO: 207 - RNA, 22 nt, Homo sapiens
guaagucucaugagaucugaug

SEQ ID NO: 208 - RNA, 22 nt, Homo sapiens
ugcauggaggagcuccccgcag

SEQ ID NO: 209 - RNA, 22 nt, Homo sapiens
uugcaggugguuuaugcaagac

SEQ ID NO: 210 - RNA, 19 nt, Homo sapiens
auugcacuccaaccugggu

SEQ ID NO: 211 - RNA, 22 nt, Homo sapiens
uauugcuggcacauaguagguc

SEQ ID NO: 212 - RNA, 22 nt, Homo sapiens
caaugugcuuggggcacaugag

SEQ ID NO: 213 - RNA, 22 nt, Homo sapiens
ugaagaucauacugguggaggg

SEQ ID NO: 214 - RNA, 22 nt, Homo sapiens
uuugguaauguuucauugcaga

SEQ ID NO: 215 - RNA, 22 nt, Homo sapiens
aucugcaaagcugggcugagac

SEQ ID NO: 216 - RNA, 22 nt, Homo sapiens
uagcauggaggcggccauagug

SEQ ID NO: 217 - RNA, 23 nt, Homo sapiens
uagaauguuuuuccauguuucuu

SEQ ID NO: 218 - RNA, 22 nt, Homo sapiens
uucugauggaguaguccacaga

SEQ ID NO: 219 - RNA, 22 nt, Homo sapiens
aguuuuugcugauagcaugcuu

SEQ ID NO: 220 - RNA, 22 nt, Homo sapiens
agcaacauggaguuugugcgca

SEQ ID NO: 221 - RNA, 22 nt, Homo sapiens
guugguuuccuguaacuggaca

SEQ ID NO: 222 - RNA, 22 nt, Homo sapiens
aaccugaagaaaauauuugcug

SEQ ID NO: 223 - RNA, 22 nt, Homo sapiens
guccaguguuggagguuuuacc

SEQ ID NO: 224 - RNA, 22 nt, Homo sapiens
uggaaugggauuggaaauuuug

SEQ ID NO: 225 - RNA, 22 nt, Homo sapiens
gaggcaauaugagggaggcuuc

SEQ ID NO: 226 - RNA, 22 nt, Homo sapiens
cuaaagugcugagauuauaggu

SEQ ID NO: 227 - RNA, 22 nt, Homo sapiens
gugcaaguguaauacagcuagg

SEQ ID NO: 228 - RNA, 22 nt, Homo sapiens
acuggaguuuguucaagaaaua

SEQ ID NO: 229 - RNA, 22 nt, Homo sapiens
aagcuggcuuucauugagugcu

SEQ ID NO: 230 - RNA, 23 nt, Homo sapiens
ugacaaccucaugcuuugucaug

SEQ ID NO: 231 - RNA, 22 nt, Homo sapiens
guguucaaauucugacagagag

SEQ ID NO: 232 - RNA, 22 nt, Homo sapiens
augagugugaccugccaagaga

SEQ ID NO: 233 - RNA, 22 nt, Homo sapiens
gauggaguaauguaaucuugag

SEQ ID NO: 234 - RNA, 22 nt, Homo sapiens
uauaucuagagcggaccaggcu

SEQ ID NO: 235 - RNA, 22 nt, Homo sapiens
guggaggagaaagaagcauuuc

SEQ ID NO: 236 - RNA, 22 nt, Homo sapiens
uagucccuuucuauuaaugaga

SEQ ID NO: 237 - RNA, 22 nt, Homo sapiens
augagauuguuuguacuccaca

SEQ ID NO: 238 - RNA, 22 nt, Homo sapiens
uugcacauuuuuucuggcagaa

SEQ ID NO: 239 - RNA, 22 nt, Homo sapiens
aggugaauggauaaacuguggg

SEQ ID NO: 240 - RNA, 22 nt, Homo sapiens
ugagacugguaauguguagggc

SEQ ID NO: 241 - RNA, 20 nt, Homo sapiens
gacaugacuaggagauagcc

SEQ ID NO: 242 - RNA, 22 nt, Homo sapiens
cuagaggcacagccuaggcacu

SEQ ID NO: 243 - RNA, 22 nt, Homo sapiens
auguccaugagcacauguauca

SEQ ID NO: 244 - RNA, 22 nt, Homo sapiens
uuagcaguggauggguggagaa

SEQ ID NO: 245 - RNA, 22 nt, Homo sapiens
aucaggaaccuuuuuggugugu

SEQ ID NO: 246 - RNA, 22 nt, Homo sapiens
aauugcacuggaaguaacugag

SEQ ID NO: 247 - RNA, 22 nt, Homo sapiens
gcccugauacauucuucugccu

SEQ ID NO: 248 - RNA, 22 nt, Homo sapiens
ugugaugaaggcauagggaugu

SEQ ID NO: 249 - RNA, 22 nt, Homo sapiens
ugacagugugagacuuugucuc

SEQ ID NO: 250 - RNA, 19 nt, Homo sapiens
ugucaucaucuuuucuugc

SEQ ID NO: 251 - RNA, 19 nt, Homo sapiens
acagugucucuauaaugau

SEQ ID NO: 252 - RNA, 22 nt, Homo sapiens
cuaaucugugcauagaagaggc

SEQ ID NO: 253 - RNA, 19 nt, Homo sapiens
gaaguguuuguucuccaug

SEQ ID NO: 254 - RNA, 22 nt, Homo sapiens
caucacagcaaguagggagugg

SEQ ID NO: 255 - RNA, 22 nt, Homo sapiens
agcuuguguuugucugccuggg

SEQ ID NO: 256 - RNA, 22 nt, Homo sapiens
uucaaguagguaggaccacagg

SEQ ID NO: 257 - RNA, 22 nt, Homo sapiens
uuuggcaguuauuuacucagug

SEQ ID NO: 258 - RNA, 22 nt, Homo sapiens
uaggacuuuuugguaggcggga

SEQ ID NO: 259 - RNA, 22 nt, Homo sapiens
cugagugcaagugauccuccca

SEQ ID NO: 260 - RNA, 22 nt, Homo sapiens
auugcucagucagggagcucgg

SEQ ID NO: 261 - RNA, 19 nt, Homo sapiens
gguucaguuuauaaagaug

SEQ ID NO: 262 - RNA, 22 nt, Homo sapiens
aagcaacacaucugccccgguu

SEQ ID NO: 263 - RNA, 22 nt, Homo sapiens
acuggauguuagggauuuuauu

SEQ ID NO: 264 - RNA, 22 nt, Homo sapiens
uuugugaaugucauaagcucca

SEQ ID NO: 265 - RNA, 22 nt, Homo sapiens
gucuuagguuuaaucacuucua

SEQ ID NO: 266 - RNA, 22 nt, Homo sapiens
uguagucauuuggaguccagcu

SEQ ID NO: 267 - RNA, 22 nt, Homo sapiens
uugcacuccggccuggguaaca

SEQ ID NO: 268 - RNA, 22 nt, Homo sapiens
uuguucccuucuggcuuuuaug

SEQ ID NO: 269 - RNA, 21 nt, Homo sapiens
auugcgcuccagccuccuggg

SEQ ID NO: 270 - RNA, 22 nt, Homo sapiens
uguuauuuuguguuagggcaca

SEQ ID NO: 271 - RNA, 22 nt, Homo sapiens
ugaacucagcauccagggccaa

SEQ ID NO: 272 - RNA, 22 nt, Homo sapiens
cuuuuugcuagagucuaggguc

SEQ ID NO: 273 - RNA, 22 nt, Homo sapiens
uagagagcuguuugaaagcagg

SEQ ID NO: 274 - RNA, 22 nt, Homo sapiens
ucacagaugcuugacccauuuc

SEQ ID NO: 275 - RNA, 22 nt, Homo sapiens
augcaauucuagauugauagua

SEQ ID NO: 276 - RNA, 22 nt, Homo sapiens
uggcuuuucauccugggacauu

SEQ ID NO: 277 - RNA, 22 nt, Homo sapiens
gaauaaacuagagaggacugag

SEQ ID NO: 278 - RNA, 22 nt, Homo sapiens
gugugguaggauugguuacuca

SEQ ID NO: 279 - RNA, 22 nt, Homo sapiens
uacauaguuacuuccauuucca

SEQ ID NO: 280 - RNA, 22 nt, Homo sapiens
gugugauguaaagaacugggga

SEQ ID NO: 281 - RNA, 22 nt, Homo sapiens
ucagggacgcuugacacaagcc

SEQ ID NO: 282 - RNA, 22 nt, Homo sapiens
ugagguaauagauaauauuuuu

SEQ ID NO: 283 - RNA, 22 nt, Homo sapiens
uguaaagaaagcuguuguugua

SEQ ID NO: 284 - RNA, 22 nt, Homo sapiens
uggcucauuucuaaacccagcu

SEQ ID NO: 285 - RNA, 22 nt, Homo sapiens
uuaagucacacuagacaacuga

SEQ ID NO: 286 - RNA, 22 nt, Homo sapiens
agcaacaucagcagcaggaaaa

SEQ ID NO: 287 - RNA, 22 nt, Homo sapiens
uugcagcaaauaggaaugagga

SEQ ID NO: 288 - RNA, 22 nt, Homo sapiens
uucugugcuuguggaugaagug

SEQ ID NO: 289 - RNA, 22 nt, Homo sapiens
cuuguucuccuaagaugaaugc

SEQ ID NO: 290 - RNA, 22 nt, Homo sapiens
uucacugcaugaaaaggacagc

SEQ ID NO: 291 - RNA, 22 nt, Homo sapiens
guuggucucguauaaaucaagg

SEQ ID NO: 292 - RNA, 22 nt, Homo sapiens
agguaaguauguuauuacuuuu

SEQ ID NO: 293 - RNA, 22 nt, Homo sapiens
ucagugacugcugcuuguauac

SEQ ID NO: 294 - RNA, 22 nt, Homo sapiens
auuuggccuuuguaugcaguau

SEQ ID NO: 295 - RNA, 22 nt, Homo sapiens
uguaauuuaaaugauccuugga

SEQ ID NO: 296 - RNA, 22 nt, Homo sapiens
uaugccuuuuggcucaagaaac

SEQ ID NO: 297 - RNA, 22 nt, Homo sapiens
uaaggcucuuguuauuuugagg

SEQ ID NO: 298 - RNA, 22 nt, Homo sapiens
acuuugguuaucauacuuucag

SEQ ID NO: 299 - RNA, 22 nt, Homo sapiens
ugcuggugucaucaaggcuuug

SEQ ID NO: 300 - RNA, 22 nt, Homo sapiens
uaugucuuuugcuugcaaauag

SEQ ID NO: 301 - RNA, 16 nt, Homo sapiens
uuucaucaguuuuaau

SEQ ID NO: 302 - RNA, 23 nt, Homo sapiens
ucuugguuauagaaaaauaguug

SEQ ID NO: 303 - RNA, 22 nt, Homo sapiens
gcugauggugcaguucuagccu

SEQ ID NO: 304 - RNA, 18 nt, Homo sapiens
uggauaguuguuggcaga

SEQ ID NO: 305 - RNA, 22 nt, Homo sapiens
ccucuguaguccugcaagagga

SEQ ID NO: 306 - RNA, 22 nt, Homo sapiens
gcacagucaacacuuauucacc

SEQ ID NO: 307 - RNA, 22 nt, Homo sapiens
auaccuuguagugcuauuugau

SEQ ID NO: 308 - RNA, 21 nt, Homo sapiens
gugaggaguuacuggcuuuga

SEQ ID NO: 309 - RNA, 22 nt, Homo sapiens
ucacauuguauauguaccuauc

SEQ ID NO: 310 - RNA, 22 nt, Homo sapiens
cugcuaagagaaugagacuuag

SEQ ID NO: 311 - RNA, 22 nt, Homo sapiens
uguuaguuguucauguuaagag

SEQ ID NO: 312 - RNA, 23 nt, Homo sapiens
ccuguagaaugucugugauacuu

SEQ ID NO: 313 - RNA, 22 nt, Homo sapiens
ugacacagugggggauccuuuu

SEQ ID NO: 314 - RNA, 17 nt, Homo sapiens
cuucaaauaauuucccc

SEQ ID NO: 315 - RNA, 22 nt, Homo sapiens
uggggcaaugaacauuuuugca

SEQ ID NO: 316 - RNA, 22 nt, Homo sapiens
auacagcuaaaauauuaaguua

SEQ ID NO: 317 - RNA, 18 nt, Homo sapiens
ugauaucaaugauagcca

SEQ ID NO: 318 - RNA, 22 nt, Homo sapiens
acagaauucucagaacugggag

SEQ ID NO: 319 - RNA, 15 nt, Homo sapiens
augaguuuuauggag

SEQ ID NO: 320 - RNA, 22 nt, Homo sapiens
cuuugauuauaaaaggguguuu

SEQ ID NO: 321 - RNA, 22 nt, Homo sapiens
ugacauggagagagaagccuuu

SEQ ID NO: 322 - RNA, 22 nt, Homo sapiens
ugaaaucuuugaugguggcauu

SEQ ID NO: 323 - RNA, 22 nt, Homo sapiens
cucaaagucaagggaaagcagg

SEQ ID NO: 324 - RNA, 20 nt, Homo sapiens
uaucuacuugcaaaugccau

SEQ ID NO: 325 - RNA, 23 nt, Homo sapiens
gaguggagacucauugauuuccu

SEQ ID NO: 326 - RNA, 22 nt, Homo sapiens
uccaguuuggaggcuugaugug

SEQ ID NO: 327 - RNA, 19 nt, Homo sapiens
uggcaugaaugugaacuaa

SEQ ID NO: 328 - RNA, 22 nt, Homo sapiens
acacauuggcaauucuggagca

SEQ ID NO: 329 - RNA, 21 nt, Homo sapiens
acccucuaguuuucaacaggc

SEQ ID NO: 330 - RNA, 22 nt, Homo sapiens
cuguucaaauuguuugugaagu

SEQ ID NO: 331 - RNA, 22 nt, Homo sapiens
aaugcuguucuuugcuuaaguu

SEQ ID NO: 332 - RNA, 18 nt, Homo sapiens
ugcuccccugggugagca

SEQ ID NO: 333 - RNA, 22 nt, Homo sapiens
cucaguacuugcacagaagaac

SEQ ID NO: 334 - RNA, 22 nt, Homo sapiens
aucgcgccauuguacuccagcc

SEQ ID NO: 335 - RNA, 22 nt, Homo sapiens
auacaugugugagcgaagaugu

SEQ ID NO: 336 - RNA, 22 nt, Homo sapiens
uucagaguggacagaaauuaag

SEQ ID NO: 337 - RNA, 22 nt, Homo sapiens
ucgcugggaaccagagguaaag

SEQ ID NO: 338 - RNA, 22 nt, Homo sapiens
gaggcagucugacccuuagcag

SEQ ID NO: 339 - RNA, 22 nt, Homo sapiens
uauugcauguugagcaguaccu

SEQ ID NO: 340 - RNA, 18 nt, Homo sapiens
ugauaugguuuggcucug

SEQ ID NO: 341 - RNA, 22 nt, Homo sapiens
ugcuacccuucgucucucuggu

SEQ ID NO: 342 - RNA, 22 nt, Homo sapiens
aaguuguaguuagagaguugcu

SEQ ID NO: 343 - RNA, 21 nt, Homo sapiens
uaucucaguuuuccuuugugg

SEQ ID NO: 344 - RNA, 22 nt, Homo sapiens
ugaggagugagaaauugguuuc

SEQ ID NO: 345 - RNA, 23 nt, Homo sapiens
uuagaucuuuaaggaaucuccac

SEQ ID NO: 346 - RNA, 22 nt, Homo sapiens
aagugguguuugggagcuggac

SEQ ID NO: 347 - RNA, 22 nt, Homo sapiens
cugauugucaucaauauuauua

SEQ ID NO: 348 - RNA, 20 nt, Homo sapiens
ucucccaaacagcaggcccu

SEQ ID NO: 349 - RNA, 22 nt, Homo sapiens
uauagcuugauuauggugaugg

SEQ ID NO: 350 - RNA, 23 nt, Homo sapiens
cuugagacaaaugcgugugugca

SEQ ID NO: 351 - RNA, 22 nt, Homo sapiens
aaauugcuuuugaagacuuagu

SEQ ID NO: 352 - RNA, 22 nt, Homo sapiens
augaucauggaagugcacccau

SEQ ID NO: 353 - RNA, 22 nt, Homo sapiens
uugagggagcacagauucuuau

SEQ ID NO: 354 - RNA, 22 nt, Homo sapiens
ugauucccucaagugccuuaug

SEQ ID NO: 355 - RNA, 19 nt, Homo sapiens
uugcaguauccuauauguu

SEQ ID NO: 356 - RNA, 22 nt, Homo sapiens
uaguucauuuuucuugcuuaga

SEQ ID NO: 357 - RNA, 22 nt, Homo sapiens
ggaguguaauggcgccaucuca

SEQ ID NO: 358 - RNA, 22 nt, Homo sapiens
ucaguuuagguguaacggccac

SEQ ID NO: 359 - RNA, 22 nt, Homo sapiens
guggcuauuguucccugguugc

SEQ ID NO: 360 - RNA, 22 nt, Homo sapiens
gcuggugacuuuaaguugaagc

SEQ ID NO: 361 - RNA, 22 nt, Homo sapiens
aaagugauguccaggcuuucag

SEQ ID NO: 362 - RNA, 22 nt, Homo sapiens
uuauaugcuaaacaaggggugg

SEQ ID NO: 363 - RNA, 22 nt, Homo sapiens
agccccauuuguugaaaagacg

SEQ ID NO: 364 - RNA, 22 nt, Homo sapiens
ggcaaggauguuuuucuggcaa

SEQ ID NO: 365 - RNA, 22 nt, Homo sapiens
cuggaaucuauggauaacaucg

SEQ ID NO: 366 - RNA, 22 nt, Homo sapiens
gucaagagaacuuucuaucacu

SEQ ID NO: 367 - RNA, 22 nt, Homo sapiens
uccaccgugggcugcggggcuc

SEQ ID NO: 368 - RNA, 22 nt, Homo sapiens
uuccuacugcccauuaaaaugg

SEQ ID NO: 369 - RNA, 22 nt, Homo sapiens
gaguagaacugguuaucuaaua

SEQ ID NO: 370 - RNA, 18 nt, Homo sapiens
gugagaaugacuguucug

SEQ ID NO: 371 - RNA, 22 nt, Homo sapiens
uaauagcucggauaaacaugau

SEQ ID NO: 372 - RNA, 22 nt, Homo sapiens
uagguagaaucuugaagccauu

SEQ ID NO: 373 - RNA, 22 nt, Homo sapiens
gagugguaguuucuagaggugu

SEQ ID NO: 374 - RNA, 22 nt, Homo sapiens
uugauaacauucugcauccuau

SEQ ID NO: 375 - RNA, 22 nt, Homo sapiens
caaagucuauucuacccuuacc

SEQ ID NO: 376 - RNA, 22 nt, Homo sapiens
agcuguuguucucagaggcuuu

SEQ ID NO: 377 - RNA, 22 nt, Homo sapiens
aguagcauuggggggcauccuc

SEQ ID NO: 378 - RNA, 22 nt, Homo sapiens
uugagguaauaaacagccauuc

SEQ ID NO: 379 - RNA, 22 nt, Homo sapiens
auagugcugcaauaaacauaca

SEQ ID NO: 380 - RNA, 22 nt, Homo sapiens
ugauaugaaagggaaauaagug

SEQ ID NO: 381 - RNA, 22 nt, Homo sapiens
uacaaagcuacucgagggcagg

SEQ ID NO: 382 - RNA, 22 nt, Homo sapiens
gccaacauggcgcuccauucuu

SEQ ID NO: 383 - RNA, 22 nt, Homo sapiens
cauugcacugcauucugggcaa

SEQ ID NO: 384 - RNA, 22 nt, Homo sapiens
uauuugguuacuugaauagcua

SEQ ID NO: 385 - RNA, 22 nt, Homo sapiens
uaauugcaguucuguguuauau

SEQ ID NO: 386 - RNA, 22 nt, Homo sapiens
gugaacagaaccugggaucgaa

SEQ ID NO: 387 - RNA, 22 nt, Homo sapiens
uuugcauaauaagauuagggug

SEQ ID NO: 388 - RNA, 19 nt, Homo sapiens
agacuggcccaggcgggug

SEQ ID NO: 389 - RNA, 22 nt, Homo sapiens
aaagugaauguaucccguaagu

SEQ ID NO: 390 - RNA, 22 nt, Homo sapiens
uuuauggcaugcucccucucaa

SEQ ID NO: 391 - RNA, 22 nt, Homo sapiens
ccaguguucuggaaggcugagu

SEQ ID NO: 392 - RNA, 22 nt, Homo sapiens
acuauacuguaacuguauucag

SEQ ID NO: 393 - RNA, 22 nt, Homo sapiens
ugagcucaugcauucuugagga

SEQ ID NO: 394 - RNA, 22 nt, Homo sapiens
ugcaagacaucguauuuugguc

SEQ ID NO: 395 - RNA, 22 nt, Homo sapiens
aggcuuuuggagaacacugcac

SEQ ID NO: 396 - RNA, 22 nt, Homo sapiens
aaauuguccuauugguuuaagc

SEQ ID NO: 397 - RNA, 22 nt, Homo sapiens
agaguacugacguuugcaaauu

SEQ ID NO: 398 - RNA, 22 nt, Homo sapiens
auacuggcuuuccaauugugau

SEQ ID NO: 399 - RNA, 22 nt, Homo sapiens
auccaucagacggcaggcguug

SEQ ID NO: 400 - RNA, 22 nt, Homo sapiens
gcuaaaucuguaaaaugaggag

SEQ ID NO: 401 - RNA, 20 nt, Homo sapiens
gugaauacauuugguuucau

SEQ ID NO: 402 - RNA, 22 nt, Homo sapiens
cacugcacuccaguuuggauga

SEQ ID NO: 403 - RNA, 22 nt, Homo sapiens
aggguuuuuauuuauguggcau

SEQ ID NO: 404 - RNA, 22 nt, Homo sapiens
uugaccucaucacuucccaaag

SEQ ID NO: 405 - RNA, 22 nt, Homo sapiens
uugacaaggagccauugcaucu

SEQ ID NO: 406 - RNA, 22 nt, Homo sapiens
aaucauauugucugccaagagg

SEQ ID NO: 407 - RNA, 22 nt, Homo sapiens
gaaagguaggaacagggugcag

SEQ ID NO: 408 - RNA, 22 nt, Homo sapiens
ucccugagguccuggauuauug

SEQ ID NO: 409 - RNA, 22 nt, Homo sapiens
uggcuuuuccaggcauuacgau

SEQ ID NO: 410 - RNA, 20 nt, Homo sapiens
uacacguaugagcacaugug

SEQ ID NO: 411 - RNA, 22 nt, Homo sapiens
agguauuuucaacuuagaaugg

SEQ ID NO: 412 - RNA, 22 nt, Homo sapiens
cugaaauggaaugugugcacag

SEQ ID NO: 413 - RNA, 22 nt, Homo sapiens
aagugcucuugaaacugccuua

SEQ ID NO: 414 - RNA, 22 nt, Homo sapiens
acugcacuucagccuugugaca

SEQ ID NO: 415 - RNA, 22 nt, Homo sapiens
acugcacuccagccugcuggau

SEQ ID NO: 416 - RNA, 22 nt, Homo sapiens
gugacauuuuuacugaugagag

SEQ ID NO: 417 - RNA, 19 nt, Homo sapiens
ggucacagggguuacaagg

SEQ ID NO: 418 - RNA, 22 nt, Homo sapiens
uucagugagacgaaaacaacaa

SEQ ID NO: 419 - RNA, 22 nt, Homo sapiens
gguaaguuuggggcuaauuugu

SEQ ID NO: 420 - RNA, 22 nt, Homo sapiens
augccacugcacuucagccugg

SEQ ID NO: 421 - RNA, 15 nt, Homo sapiens
aaacccugucucaag

SEQ ID NO: 422 - RNA, 22 nt, Homo sapiens
augacuagaggagggauggcca

SEQ ID NO: 423 - RNA, 22 nt, Homo sapiens
ugucaaauucuggguuaaaaca

SEQ ID NO: 424 - RNA, 22 nt, Homo sapiens
aaguggcauugaggaaaaaaau

SEQ ID NO: 425 - RNA, 22 nt, Homo sapiens
uguucuugagccuuuagaccua

SEQ ID NO: 426 - RNA, 22 nt, Homo sapiens
uagcaccugugcacaccaggca

SEQ ID NO: 427 - RNA, 22 nt, Homo sapiens
ucccaguggucuugaaacaggg

SEQ ID NO: 428 - RNA, 21 nt, Homo sapiens
uucacuggucuauuucccuuu

SEQ ID NO: 429 - RNA, 22 nt, Homo sapiens
agcucacagccuagcacuguga

SEQ ID NO: 430 - RNA, 22 nt, Homo sapiens
agugccuacuauguagaugcug

SEQ ID NO: 431 - RNA, 22 nt, Homo sapiens
ggugagauguucagacgaacug

SEQ ID NO: 432 - RNA, 21 nt, Homo sapiens
augugcacuaugucauuuaau

SEQ ID NO: 433 - RNA, 22 nt, Homo sapiens
acacuguacuuauguuuugcag

SEQ ID NO: 434 - RNA, 22 nt, Homo sapiens
auggcacugccuggcuucaugg

SEQ ID NO: 435 - RNA, 22 nt, Homo sapiens
uuugaagcaauugugaauggga

SEQ ID NO: 436 - RNA, 22 nt, Homo sapiens
auaguagcaugaaacagccauu

SEQ ID NO: 437 - RNA, 22 nt, Homo sapiens
cagacagugucccgagucccug

SEQ ID NO: 438 - RNA, 22 nt, Homo sapiens
uuguguccccacccaaauuuca

SEQ ID NO: 439 - RNA, 22 nt, Homo sapiens
agcugcacaaauggaugugagg

SEQ ID NO: 440 - RNA, 22 nt, Homo sapiens
uuuucacggugucccagagagu

SEQ ID NO: 441 - RNA, 22 nt, Homo sapiens
aagucaaggagagaagcuucag

SEQ ID NO: 442 - RNA, 22 nt, Homo sapiens
gugagauggagucuugcuuugu

SEQ ID NO: 443 - RNA, 22 nt, Homo sapiens
gggcuagaauccgcgucucuug

SEQ ID NO: 444 - RNA, 22 nt, Homo sapiens
ugaucucagcucacugguugaa

SEQ ID NO: 445 - RNA, 22 nt, Homo sapiens
uggaccccugcucgggagcccu

SEQ ID NO: 446 - RNA, 22 nt, Homo sapiens
uauggauauuacuccacaaaga

SEQ ID NO: 447 - RNA, 22 nt, Homo sapiens
uuugagcauuagggcaaaggca

SEQ ID NO: 448 - RNA, 22 nt, Homo sapiens
uaucucauccuccuugauccca

SEQ ID NO: 449 - RNA, 17 nt, Homo sapiens
ggcaagaaguggaacuc

SEQ ID NO: 450 - RNA, 22 nt, Homo sapiens
ucuuuaguuaagggacauuuua

SEQ ID NO: 451 - RNA, 22 nt, Homo sapiens
cuaugucuuucauauuuugggg

SEQ ID NO: 452 - RNA, 22 nt, Homo sapiens
acagucuggagaaugggugcuc

SEQ ID NO: 453 - RNA, 22 nt, Homo sapiens
ugaauaguaauguguuuggucu

SEQ ID NO: 454 - RNA, 22 nt, Homo sapiens
uaacugcaaccucugccugcug

SEQ ID NO: 455 - RNA, 22 nt, Homo sapiens
uucaucagcuguagaugucaug

SEQ ID NO: 456 - RNA, 22 nt, Homo sapiens
agucugguguucucacacuagu

SEQ ID NO: 457 - RNA, 22 nt, Homo sapiens
agcugcacgugguaaauguaaa

SEQ ID NO: 458 - RNA, 22 nt, Homo sapiens
cuggcaagaggauaaaguccua

SEQ ID NO: 459 - RNA, 21 nt, Homo sapiens
uuugaucauuaaaagugaauc

SEQ ID NO: 460 - RNA, 22 nt, Homo sapiens
ggaagguaauuggguaaugaga

SEQ ID NO: 461 - RNA, 19 nt, Homo sapiens
auaauuagcagugaggaca

SEQ ID NO: 462 - RNA, 22 nt, Homo sapiens
cacuggacauguugaagcuuuu

SEQ ID NO: 463 - RNA, 22 nt, Homo sapiens
auuugucacuauguggcuaaua

SEQ ID NO: 464 - RNA, 22 nt, Homo sapiens
uucuacagugacugcagccaua

SEQ ID NO: 465 - RNA, 23 nt, Homo sapiens
uaugccuguuucaaacaaacuuu

SEQ ID NO: 466 - RNA, 22 nt, Homo sapiens
cauuugcacugagacucagcuu

SEQ ID NO: 467 - RNA, 22 nt, Homo sapiens
aacucugucuccuucaaguuca

SEQ ID NO: 468 - RNA, 22 nt, Homo sapiens
uuauugcuaaaucaugaccaca

SEQ ID NO: 469 - RNA, 22 nt, Homo sapiens
cucuuggguagauuuugcagag

SEQ ID NO: 470 - RNA, 22 nt, Homo sapiens
ugucaaacauuaugaugcucua

SEQ ID NO: 471 - RNA, 20 nt, Homo sapiens
guguaagagcaagcuuccua

SEQ ID NO: 472 - RNA, 22 nt, Homo sapiens
ugucaggaguuuuagaaucuua

SEQ ID NO: 473 - RNA, 22 nt, Homo sapiens
uggaguguaauuagccaucagu

SEQ ID NO: 474 - RNA, 22 nt, Homo sapiens
ucuauugguaggggcugaggca

SEQ ID NO: 475 - RNA, 22 nt, Homo sapiens
auaugacugccagggcccaguc

SEQ ID NO: 476 - RNA, 22 nt, Homo sapiens
ugugguuuuuuucuccaauagg

SEQ ID NO: 477 - RNA, 22 nt, Homo sapiens
ugggauccaugugguuuaagca

SEQ ID NO: 478 - RNA, 22 nt, Homo sapiens
uugagcuauguacagaugcugu

SEQ ID NO: 479 - RNA, 22 nt, Homo sapiens
uucaccagggaagucucaacuc

SEQ ID NO: 480 - RNA, 22 nt, Homo sapiens
ggucugguguugaaauucuuca

SEQ ID NO: 481 - RNA, 22 nt, Homo sapiens
uguggccuuuguuucaguuggg

SEQ ID NO: 482 - RNA, 22 nt, Homo sapiens
ccacugggcuagguguuuugga

SEQ ID NO: 483 - RNA, 22 nt, Homo sapiens
agagguuuugcccucgagauaa

SEQ ID NO: 484 - RNA, 22 nt, Homo sapiens
ugcuuguguucagguaaccuuu

SEQ ID NO: 485 - RNA, 22 nt, Homo sapiens
cccuggacacacacuuuuauuc

SEQ ID NO: 486 - RNA, 18 nt, Homo sapiens
cacugagcccuucacucu

SEQ ID NO: 487 - RNA, 22 nt, Homo sapiens
gaguuacauuguaauugccgag

SEQ ID NO: 488 - RNA, 22 nt, Homo sapiens
ucuuuugguuucuagaggccgc

SEQ ID NO: 489 - RNA, 22 nt, Homo sapiens
uguaacaggaggaaaaugugaa

SEQ ID NO: 490 - RNA, 22 nt, Homo sapiens
uaacuagaaaggagacaguugc

SEQ ID NO: 491 - RNA, 22 nt, Homo sapiens
uuaggcuuuuuaaccaguuguu

SEQ ID NO: 492 - RNA, 23 nt, Homo sapiens
uuguacacuaagaaucgcagaug

SEQ ID NO: 493 - RNA, 22 nt, Homo sapiens
uaaguucauucaugaaacuuag

SEQ ID NO: 494 - RNA, 22 nt, Homo sapiens
uugacauauguguguccacaua

SEQ ID NO: 495 - RNA, 22 nt, Homo sapiens
ugacuaagaugaggucuggaua

SEQ ID NO: 496 - RNA, 22 nt, Homo sapiens
uggaaugguaucuuguuggggu

SEQ ID NO: 497 - RNA, 23 nt, Homo sapiens
uucccuuagaagaaggggagaaa

SEQ ID NO: 498 - RNA, 22 nt, Homo sapiens
uaaguaguccugauuuaaccuu

SEQ ID NO: 499 - RNA, 18 nt, Homo sapiens
auaaccuggugcuuucaa

SEQ ID NO: 500 - RNA, 22 nt, Homo sapiens
cauggcccugggcugggcgaac

SEQ ID NO: 501 - RNA, 22 nt, Homo sapiens
ucugugaaugugaccuuauuug

SEQ ID NO: 502 - RNA, 22 nt, Homo sapiens
auucaaggagucuucgucccaa

SEQ ID NO: 503 - RNA, 22 nt, Homo sapiens
auugaacuuaaaagacuugcca

SEQ ID NO: 504 - RNA, 22 nt, Homo sapiens
uggcaugcauuguggguaauua

SEQ ID NO: 505 - RNA, 22 nt, Homo sapiens
uuaccuguguuuugggcccaga

SEQ ID NO: 506 - RNA, 20 nt, Homo sapiens
acugcacuccaggcugccca

SEQ ID NO: 507 - RNA, 22 nt, Homo sapiens
uaccuguagcucuucuaggcug

SEQ ID NO: 508 - RNA, 22 nt, Homo sapiens
uuugcuuaaaucuuaaucagau

SEQ ID NO: 509 - RNA, 22 nt, Homo sapiens
guggugucuuguuuaauauaua

SEQ ID NO: 510 - RNA, 22 nt, Homo sapiens
uagcugaucuuuuaaagaauga

SEQ ID NO: 511 - RNA, 21 nt, Homo sapiens
augggacuaacugaugggucu

SEQ ID NO: 512 - RNA, 22 nt, Homo sapiens
auggaucauauucuugaggagg

SEQ ID NO: 513 - RNA, 22 nt, Homo sapiens
gugacuaagauucuuugauaug

SEQ ID NO: 514 - RNA, 20 nt, Homo sapiens
ucacagucacacauaauccu

SEQ ID NO: 515 - RNA, 22 nt, Homo sapiens
uggagucuugcucuguugccca

SEQ ID NO: 516 - RNA, 22 nt, Homo sapiens
agguccauuauuuucauucaug

SEQ ID NO: 517 - RNA, 22 nt, Homo sapiens
uaugcccauuuaaauugaacaa

SEQ ID NO: 518 - RNA, 17 nt, Homo sapiens
aguacugucccauccuu

SEQ ID NO: 519 - RNA, 23 nt, Homo sapiens
cuuuguccccacccaaaucucau

SEQ ID NO: 520 - RNA, 22 nt, Homo sapiens
ucauugcaaucucugccucccg

SEQ ID NO: 521 - RNA, 22 nt, Homo sapiens
aucaaagcagcauggcccaguc

SEQ ID NO: 522 - RNA, 20 nt, Homo sapiens
ggaagagugacacaagguau

SEQ ID NO: 523 - RNA, 21 nt, Homo sapiens
agcugguuucuucuuacuccu

SEQ ID NO: 524 - RNA, 22 nt, Homo sapiens
agcugcacugguauaggagaaa

SEQ ID NO: 525 - RNA, 22 nt, Homo sapiens
cugcacugagacccucuuugcu

SEQ ID NO: 526 - RNA, 22 nt, Homo sapiens
auggcucaauucuuucccugaa

SEQ ID NO: 527 - RNA, 22 nt, Homo sapiens
uagugaauguuggcuauuaaua

SEQ ID NO: 528 - RNA, 22 nt, Homo sapiens
uggugagaaaagaugucuuugu

SEQ ID NO: 529 - RNA, 22 nt, Homo sapiens
augcagaucacauuuuucuguc

SEQ ID NO: 530 - RNA, 22 nt, Homo sapiens
uuccuugagucuuuuuccugag

SEQ ID NO: 531 - RNA, 22 nt, Homo sapiens
augggucuccugaauacagcac

SEQ ID NO: 532 - RNA, 22 nt, Homo sapiens
cuggcaagagugaaccagcugu

SEQ ID NO: 533 - RNA, 18 nt, Homo sapiens
uggcaagugccauacggu

SEQ ID NO: 534 - RNA, 22 nt, Homo sapiens
uagcagcaaagcaggaucugcu

SEQ ID NO: 535 - RNA, 22 nt, Homo sapiens
cuuggguaagucauuaaaauua

SEQ ID NO: 536 - RNA, 22 nt, Homo sapiens
uucaucacagucuccgaugccc

SEQ ID NO: 537 - RNA, 22 nt, Homo sapiens
auagcuguccuuacuagcuagg

SEQ ID NO: 538 - RNA, 22 nt, Homo sapiens
gacauguuuucaagauuuauaa

SEQ ID NO: 539 - RNA, 22 nt, Homo sapiens
gcaaaucuuauguccucacauu

SEQ ID NO: 540 - RNA, 23 nt, Homo sapiens
ucaagugaugguggccacaaggg

SEQ ID NO: 541 - RNA, 22 nt, Homo sapiens
uucucagugcuaucuuuuaugc

SEQ ID NO: 542 - RNA, 22 nt, Homo sapiens
ggcaaagaugaccauuacuuuu

SEQ ID NO: 543 - RNA, 22 nt, Homo sapiens
uauuugauuaacaagagccuaa

SEQ ID NO: 544 - RNA, 22 nt, Homo sapiens
ccugucuugaagagauccuccu

SEQ ID NO: 545 - RNA, 22 nt, Homo sapiens
ucacuagaucaagggagagaaa

SEQ ID NO: 546 - RNA, 22 nt, Homo sapiens
uauaugauugguagacccugca

SEQ ID NO: 547 - RNA, 22 nt, Homo sapiens
cuccaugagauuguugaaguag

SEQ ID NO: 548 - RNA, 20 nt, Homo sapiens
auagcagcaugauuuauaau

SEQ ID NO: 549 - RNA, 20 nt, Homo sapiens
uagcagcagacagagggagg

SEQ ID NO: 550 - RNA, 22 nt, Homo sapiens
uguggaaauuguuguauuuaau

SEQ ID NO: 551 - RNA, 22 nt, Homo sapiens
ucagggacuuacaaaccagaag

SEQ ID NO: 552 - RNA, 22 nt, Homo sapiens
ucagaauguaacuuuaguugga

SEQ ID NO: 553 - RNA, 22 nt, Homo sapiens
guguuaaucucaaguacucuca

SEQ ID NO: 554 - RNA, 19 nt, Homo sapiens
ccuugguuagguauauucc

SEQ ID NO: 555 - RNA, 22 nt, Homo sapiens
gcagugcaguggcgcgaucucg

SEQ ID NO: 556 - RNA, 22 nt, Homo sapiens
uguagcuuuugagauuuauauu

SEQ ID NO: 557 - RNA, 22 nt, Homo sapiens
augacuggauaauggacacaca

SEQ ID NO: 558 - RNA, 22 nt, Homo sapiens
uggcagaugggugagcuggaga

SEQ ID NO: 559 - RNA, 22 nt, Homo sapiens
gcauggagcauacauuucuguu

SEQ ID NO: 560 - RNA, 22 nt, Homo sapiens
uguuugcuguguggaguagcag

SEQ ID NO: 561 - RNA, 22 nt, Homo sapiens
auggaguuugaacaauuuccug

SEQ ID NO: 562 - RNA, 19 nt, Homo sapiens
aucaccauuauuuggaaca

SEQ ID NO: 563 - RNA, 22 nt, Homo sapiens
augauguaggccauggguuucu

SEQ ID NO: 564 - RNA, 22 nt, Homo sapiens
aucacaggcaaaauuccuucuc

SEQ ID NO: 565 - RNA, 22 nt, Homo sapiens
uaggcaaguugcccaaucucuc

SEQ ID NO: 566 - RNA, 22 nt, Homo sapiens
ucucaaccucccaaguagcugg

SEQ ID NO: 567 - RNA, 18 nt, Homo sapiens
uuugacugguguccuuau

SEQ ID NO: 568 - RNA, 20 nt, Homo sapiens
agcuugguuuggaugaucac

SEQ ID NO: 569 - RNA, 22 nt, Homo sapiens
cugauuguucuugcugggccuu

SEQ ID NO: 570 - RNA, 20 nt, Homo sapiens
agcugcagauauaaauccgc

SEQ ID NO: 571 - RNA, 22 nt, Homo sapiens
uuguugcacugcuuuccuggcc

SEQ ID NO: 572 - RNA, 22 nt, Homo sapiens
aauggagcuguuuggaugacuu

SEQ ID NO: 573 - RNA, 22 nt, Homo sapiens
ugggaugauguuaaacguacuc

SEQ ID NO: 574 - RNA, 22 nt, Homo sapiens
cuguuugauuaagugguggaaa

SEQ ID NO: 575 - RNA, 22 nt, Homo sapiens
ugugauggaguuucauggacug

SEQ ID NO: 576 - RNA, 22 nt, Homo sapiens
gagacugagucuugcucugucg

SEQ ID NO: 577 - RNA, 22 nt, Homo sapiens
uuaauucugucugcccucaucc

SEQ ID NO: 578 - RNA, 15 nt, Homo sapiens
ucuuuaguuuuucuu

SEQ ID NO: 579 - RNA, 22 nt, Homo sapiens
uacaugcaugggcaugugugca

SEQ ID NO: 580 - RNA, 22 nt, Homo sapiens
ucuccauugaaauggacauaau

SEQ ID NO: 581 - RNA, 22 nt, Homo sapiens
cucccugagccagggcuuugac

SEQ ID NO: 582 - RNA, 23 nt, Homo sapiens
ucacuagaguccuggaguuugag

SEQ ID NO: 583 - RNA, 22 nt, Homo sapiens
uagagcuacagcccucacuguc

SEQ ID NO: 584 - RNA, 22 nt, Homo sapiens
augcuaugugugacuucuuaug

SEQ ID NO: 585 - RNA, 22 nt, Homo sapiens
aagcuaguguuccagugaacag

SEQ ID NO: 586 - RNA, 22 nt, Homo sapiens
uucuugcuguauccucacaugg

SEQ ID NO: 587 - RNA, 22 nt, Homo sapiens
gaggcuagauggggaugugucc

SEQ ID NO: 588 - RNA, 22 nt, Homo sapiens
uagagguagagugacuucccca

SEQ ID NO: 589 - RNA, 22 nt, Homo sapiens
cucagggugguggacucuaaua

SEQ ID NO: 590 - RNA, 22 nt, Homo sapiens
ugucauuggacuucuuucaugg

SEQ ID NO: 591 - RNA, 22 nt, Homo sapiens
cuagacacugacguuccuccga

SEQ ID NO: 592 - RNA, 22 nt, Homo sapiens
guggguaaaucucuguuugagg

SEQ ID NO: 593 - RNA, 21 nt, Homo sapiens
ugacauguugguguucugcac

SEQ ID NO: 594 - RNA, 22 nt, Homo sapiens
uucauuggacuuguguucuuga

SEQ ID NO: 595 - RNA, 22 nt, Homo sapiens
cuugcagaggcccuggggagag

SEQ ID NO: 596 - RNA, 22 nt, Homo sapiens
uuggagugugagagcagccugg

SEQ ID NO: 597 - RNA, 22 nt, Homo sapiens
ucucugguuuguggaaucuuag

SEQ ID NO: 598 - RNA, 22 nt, Homo sapiens
uucacagaaaaaggcgaugagg

SEQ ID NO: 599 - RNA, 22 nt, Homo sapiens
uuguccuugagauaguuugcug

SEQ ID NO: 600 - RNA, 22 nt, Homo sapiens
auacacgugccauguugguaug

SEQ ID NO: 601 - RNA, 22 nt, Homo sapiens
agugauauguuugccuugaggg

SEQ ID NO: 602 - RNA, 22 nt, Homo sapiens
uacaccugcacucuagccuggg

SEQ ID NO: 603 - RNA, 22 nt, Homo sapiens
augagaacauaucaagugauug

SEQ ID NO: 604 - RNA, 22 nt, Homo sapiens
guuugugcuccuaugagaaucu

SEQ ID NO: 605 - RNA, 22 nt, Homo sapiens
ugucaauauguaauaacugaau

SEQ ID NO: 606 - RNA, 22 nt, Homo sapiens
ggggucauuaaauuccgcuggu

SEQ ID NO: 607 - RNA, 19 nt, Homo sapiens
ucaguagugcacauaagcc

SEQ ID NO: 608 - RNA, 22 nt, Homo sapiens
uuggguagugaguuccuccagg

SEQ ID NO: 609 - RNA, 22 nt, Homo sapiens
ucagugucugcauucuuauugu

SEQ ID NO: 610 - RNA, 22 nt, Homo sapiens
uuggcaagaauguaugccgauc

SEQ ID NO: 611 - RNA, 22 nt, Homo sapiens
aucccgagacuuugcugaaguu

SEQ ID NO: 612 - RNA, 22 nt, Homo sapiens
ugacaguguccucauucccaac

SEQ ID NO: 613 - RNA, 18 nt, Homo sapiens
ugucagaguggauuguaa

SEQ ID NO: 614 - RNA, 22 nt, Homo sapiens
gugauugcauuaugaauauuau

SEQ ID NO: 615 - RNA, 22 nt, Homo sapiens
agcaagacauggcuuccaaaug

SEQ ID NO: 616 - RNA, 22 nt, Homo sapiens
aacugcucuaauguggugggag

SEQ ID NO: 617 - RNA, 22 nt, Homo sapiens
uggcauguaaugcagaaguugc

SEQ ID NO: 618 - RNA, 22 nt, Homo sapiens
acugcacuccagccucggugac

SEQ ID NO: 619 - RNA, 22 nt, Homo sapiens
cuaguaaugucugucuuaugga

SEQ ID NO: 620 - RNA, 22 nt, Homo sapiens
uagcagugugaaaacggacuaa

SEQ ID NO: 621 - RNA, 22 nt, Homo sapiens
uauacaguaggcacucaguggc

SEQ ID NO: 622 - RNA, 22 nt, Homo sapiens
uugacacuaauuauuauaggug

SEQ ID NO: 623 - RNA, 22 nt, Homo sapiens
uauugucacuaaaggaagcugg

SEQ ID NO: 624 - RNA, 22 nt, Homo sapiens
uaaggcuuuuguucagcguggg

SEQ ID NO: 625 - RNA, 22 nt, Homo sapiens
ggugucuuguuuaauacucauu

SEQ ID NO: 626 - RNA, 22 nt, Homo sapiens
ucuggccccucucaaaucucau

SEQ ID NO: 627 - RNA, 22 nt, Homo sapiens
uucacaguacucccuggaauua

SEQ ID NO: 628 - RNA, 22 nt, Homo sapiens
uugaagacuauaugauucuuca

SEQ ID NO: 629 - RNA, 22 nt, Homo sapiens
uugugguugaugaagacugucu

SEQ ID NO: 630 - RNA, 22 nt, Homo sapiens
uuuguccccgcccagaucucau

SEQ ID NO: 631 - RNA, 22 nt, Homo sapiens
gugguaaaauggcauagagcua

SEQ ID NO: 632 - RNA, 22 nt, Homo sapiens
ugacuugaaguuaccauaugca

SEQ ID NO: 633 - RNA, 22 nt, Homo sapiens
ugaguucuuuuagggauauugc

SEQ ID NO: 634 - RNA, 22 nt, Homo sapiens
ugaaggacauaaggcagaguga

SEQ ID NO: 635 - RNA, 22 nt, Homo sapiens
ugagguuguccacuauaaucca

SEQ ID NO: 636 - RNA, 22 nt, Homo sapiens
gucguggagcucacagugugcc

SEQ ID NO: 637 - RNA, 22 nt, Homo sapiens
uaucucacauauucaguagguu

SEQ ID NO: 638 - RNA, 22 nt, Homo sapiens
agcuugugauuuagagugagag

SEQ ID NO: 639 - RNA, 22 nt, Homo sapiens
aaucccuuuguccagucucuuu

SEQ ID NO: 640 - RNA, 22 nt, Homo sapiens
agaguaguuucuauauucuuca

SEQ ID NO: 641 - RNA, 22 nt, Homo sapiens
caucacuuugccuccgucucua

SEQ ID NO: 642 - RNA, 22 nt, Homo sapiens
uugagaagugucuguucauguc

SEQ ID NO: 643 - RNA, 22 nt, Homo sapiens
acuguacuccagccugggcaac

SEQ ID NO: 644 - RNA, 22 nt, Homo sapiens
agcuggucuacguguguaugag

SEQ ID NO: 645 - RNA, 22 nt, Homo sapiens
ucgcaccauugcacuccagcca

SEQ ID NO: 646 - RNA, 23 nt, Homo sapiens
ucgguccccuuggcugcccucgg

SEQ ID NO: 647 - RNA, 22 nt, Homo sapiens
uaagcuagcauagggguaaauu

SEQ ID NO: 648 - RNA, 22 nt, Homo sapiens
guaauaccuuccccugcuggag

SEQ ID NO: 649 - RNA, 21 nt, Homo sapiens
ugaacacuggacugagugucc

SEQ ID NO: 650 - RNA, 22 nt, Homo sapiens
aagguuguauuuaauauacugu

SEQ ID NO: 651 - RNA, 23 nt, Homo sapiens
auaaugcaaguggugguaaucug

SEQ ID NO: 652 - RNA, 22 nt, Homo sapiens
gaugagguaggccugcuuugaa

SEQ ID NO: 653 - RNA, 22 nt, Homo sapiens
gcagcaguggcaguuaauauuu

SEQ ID NO: 654 - RNA, 22 nt, Homo sapiens
uugugauggugcauacugagcu

SEQ ID NO: 655 - RNA, 22 nt, Homo sapiens
aaaugucauggaguguuucccc

SEQ ID NO: 656 - RNA, 22 nt, Homo sapiens
agcugcaaagggagagaugauu

SEQ ID NO: 657 - RNA, 22 nt, Homo sapiens
uggaauuaauccuccugguuuc

SEQ ID NO: 658 - RNA, 22 nt, Homo sapiens
acugcacuccagccucgcaaca

SEQ ID NO: 659 - RNA, 22 nt, Homo sapiens
ugaugguccauaguucauggua

SEQ ID NO: 660 - RNA, 22 nt, Homo sapiens
ugagauaggaucuugcucuguu

SEQ ID NO: 661 - RNA, 22 nt, Homo sapiens
guguuugguugauagagccacu

SEQ ID NO: 662 - RNA, 22 nt, Homo sapiens
cagauacuggccuggagcugug

SEQ ID NO: 663 - RNA, 22 nt, Homo sapiens
ugagagacauuuguuguagagu

SEQ ID NO: 664 - RNA, 22 nt, Homo sapiens
auagcauagucagcuucgcuga

SEQ ID NO: 665 - RNA, 19 nt, Homo sapiens
caugccacugcacuugagu

SEQ ID NO: 666 - RNA, 22 nt, Homo sapiens
aucagucacugcguuuuuggga

SEQ ID NO: 667 - RNA, 23 nt, Homo sapiens
agucuguguuuacaggcucucug

SEQ ID NO: 668 - RNA, 22 nt, Homo sapiens
gcacacguagaagcaugcauca

SEQ ID NO: 669 - RNA, 22 nt, Homo sapiens
ugagucuguucucacauugcua

SEQ ID NO: 670 - RNA, 22 nt, Homo sapiens
accaguagaaucaguggauucu

SEQ ID NO: 671 - RNA, 22 nt, Homo sapiens
ugcaaauguuaguaacaccacu

SEQ ID NO: 672 - RNA, 22 nt, Homo sapiens
aucuagagacauaguaaagaau

SEQ ID NO: 673 - RNA, 22 nt, Homo sapiens
aggugcaauggugguuuugugg

SEQ ID NO: 674 - RNA, 22 nt, Homo sapiens
auugaacuguuggagagguuuu

SEQ ID NO: 675 - RNA, 22 nt, Homo sapiens
ccggcugugugacugugggcag

SEQ ID NO: 676 - RNA, 20 nt, Homo sapiens
agaagcauugcucucuucag

SEQ ID NO: 677 - RNA, 22 nt, Homo sapiens
accccauuugcacugagcccuu

SEQ ID NO: 678 - RNA, 22 nt, Homo sapiens
uacauaguaagcaucuccugug

SEQ ID NO: 679 - RNA, 22 nt, Homo sapiens
cacugcauccucugccuggcgg

SEQ ID NO: 680 - RNA, 22 nt, Homo sapiens
auggcuuuuuaaaucauguugu

SEQ ID NO: 681 - RNA, 22 nt, Homo sapiens
uuauagcacuaagaagguaaua

SEQ ID NO: 682 - RNA, 22 nt, Homo sapiens
agcuuguguuuuucuaaguauc

SEQ ID NO: 683 - RNA, 22 nt, Homo sapiens
uugagauggaguuucacucucg

SEQ ID NO: 684 - RNA, 22 nt, Homo sapiens
uugagauggagucucacucuug

SEQ ID NO: 685 - RNA, 22 nt, Homo sapiens
uuaucagcagcaugaaacugga

SEQ ID NO: 686 - RNA, 22 nt, Homo sapiens
uuaguucccucauucuugacuu

SEQ ID NO: 687 - RNA, 22 nt, Homo sapiens
cacagagugagacccugucucu

SEQ ID NO: 688 - RNA, 19 nt, Homo sapiens
ugggaauguaaauuaguuc

SEQ ID NO: 689 - RNA, 22 nt, Homo sapiens
auggcucuggauagaaugcagg

SEQ ID NO: 690 - RNA, 22 nt, Homo sapiens
ugaguuccuuucccaguccagu

SEQ ID NO: 691 - RNA, 21 nt, Homo sapiens
ugucaagaugacugcugcggc

SEQ ID NO: 692 - RNA, 22 nt, Homo sapiens
uauugaacgugggauauugaag

SEQ ID NO: 693 - RNA, 22 nt, Homo sapiens
gugcucauuuagagagaagcac

SEQ ID NO: 694 - RNA, 22 nt, Homo sapiens
ugaagugcugugggccaggcgu

SEQ ID NO: 695 - RNA, 22 nt, Homo sapiens
uugcuacuuggauguacaugug

SEQ ID NO: 696 - RNA, 22 nt, Homo sapiens
cuugugccugaucuuagggggc

SEQ ID NO: 697 - RNA, 22 nt, Homo sapiens
ugagauggaucuuggauuugaa

SEQ ID NO: 698 - RNA, 22 nt, Homo sapiens
auggcuuuuauuguguugaggu

SEQ ID NO: 699 - RNA, 21 nt, Homo sapiens
gugaggucauugggcuuucug

SEQ ID NO: 700 - RNA, 22 nt, Homo sapiens
auuccacaguuaacacagaccg

SEQ ID NO: 701 - RNA, 22 nt, Homo sapiens
auugcacuccagccuggcagca

SEQ ID NO: 702 - RNA, 22 nt, Homo sapiens
gacuagauauuguucuauguca

SEQ ID NO: 703 - RNA, 21 nt, Homo sapiens
ugugaaaucuaggcagagguu

SEQ ID NO: 704 - RNA, 20 nt, Homo sapiens
ugcugcacuuaagcaugggc

SEQ ID NO: 705 - RNA, 22 nt, Homo sapiens
ugagucuguuccaaagaaauaa

SEQ ID NO: 706 - RNA, 22 nt, Homo sapiens
uucaagcugggcaaauaagggg

SEQ ID NO: 707 - RNA, 22 nt, Homo sapiens
ccagaguuucugauucagcagg

SEQ ID NO: 708 - RNA, 22 nt, Homo sapiens
uuagguauuaggaaauaugcuu

SEQ ID NO: 709 - RNA, 22 nt, Homo sapiens
auauggcuuuuauuauguugag

SEQ ID NO: 710 - RNA, 22 nt, Homo sapiens
cugaguauaacugaccuuauga

SEQ ID NO: 711 - RNA, 22 nt, Homo sapiens
uaaggcaaguuuuuaguggaca

SEQ ID NO: 712 - RNA, 22 nt, Homo sapiens
cuauggccugcuuagaacauac

SEQ ID NO: 713 - RNA, 22 nt, Homo sapiens
ucacaauucucaauuugugaaa

SEQ ID NO: 714 - RNA, 22 nt, Homo sapiens
ucaaguaagaagugggcauaaa

SEQ ID NO: 715 - RNA, 22 nt, Homo sapiens
gagaaugaugauuuccaauuuc

SEQ ID NO: 716 - RNA, 22 nt, Homo sapiens
auaucacaggaaaggaagauac

SEQ ID NO: 717 - RNA, 22 nt, Homo sapiens
ugucaagaugguuugauguugu

SEQ ID NO: 718 - RNA, 22 nt, Homo sapiens
gcugagaucucuugccugaacu

SEQ ID NO: 719 - RNA, 22 nt, Homo sapiens
uaacaacauucuaacugacggc

SEQ ID NO: 720 - RNA, 22 nt, Homo sapiens
aacauugaacuuggcacaccca

SEQ ID NO: 721 - RNA, 22 nt, Homo sapiens
gauuggcauugcugcaccugag

SEQ ID NO: 722 - RNA, 22 nt, Homo sapiens
auuugguugggugcgguggcuu

SEQ ID NO: 723 - RNA, 22 nt, Homo sapiens
ucacagauaaauaaagaugauu

SEQ ID NO: 724 - RNA, 21 nt, Homo sapiens
uuacaauggcuccuugaaggu

SEQ ID NO: 725 - RNA, 22 nt, Homo sapiens
uagagcuaguugcucacugcuu

SEQ ID NO: 726 - RNA, 22 nt, Homo sapiens
cacccgugcucccuccagcugc

SEQ ID NO: 727 - RNA, 22 nt, Homo sapiens
uugacgagaguaguagucuacc

SEQ ID NO: 728 - RNA, 22 nt, Homo sapiens
uuuaguucauuaaggaaucucc

SEQ ID NO: 729 - RNA, 22 nt, Homo sapiens
ugugccaaaucccauaauaaau

SEQ ID NO: 730 - RNA, 22 nt, Homo sapiens
ugagacggagucucgcucuguu

SEQ ID NO: 731 - RNA, 22 nt, Homo sapiens
ugagacggagucuugcucuguc

SEQ ID NO: 732 - RNA, 22 nt, Homo sapiens
aagcacccuuugucuggacaug

SEQ ID NO: 733 - RNA, 16 nt, Homo sapiens
agcuggaauuacaggc

SEQ ID NO: 734 - RNA, 22 nt, Homo sapiens
auagguagcauagcaggaauau

SEQ ID NO: 735 - RNA, 22 nt, Homo sapiens
ugauguugaauuguucagcguc

SEQ ID NO: 736 - RNA, 22 nt, Homo sapiens
uuggucacugacauguuugaaa

SEQ ID NO: 737 - RNA, 22 nt, Homo sapiens
cggugcaauucuccugucucag

SEQ ID NO: 738 - RNA, 22 nt, Homo sapiens
uucugugguugaaaggagagau

SEQ ID NO: 739 - RNA, 22 nt, Homo sapiens
acacuggaguuaaaggugauuu

SEQ ID NO: 740 - RNA, 22 nt, Homo sapiens
uuggcauuuuuagucaugggaa

SEQ ID NO: 741 - RNA, 22 nt, Homo sapiens
ugcagagucuguccugccugcc

SEQ ID NO: 742 - RNA, 22 nt, Homo sapiens
cugagauuuuuagauccuggcg

SEQ ID NO: 743 - RNA, 22 nt, Homo sapiens
uucagggacuuuagacaagaga

SEQ ID NO: 744 - RNA, 22 nt, Homo sapiens
agcaucacacacuacagggaaa

SEQ ID NO: 745 - RNA, 22 nt, Homo sapiens
gucuaguuuuaauacauuaaga

SEQ ID NO: 746 - RNA, 18 nt, Homo sapiens
auugcacuccugccuggg

SEQ ID NO: 747 - RNA, 18 nt, Homo sapiens
ugauugacuuauuuaggu

SEQ ID NO: 748 - RNA, 22 nt, Homo sapiens
acacauacacauaugguguaua

SEQ ID NO: 749 - RNA, 22 nt, Homo sapiens
ugagugccuggagggcagggac

SEQ ID NO: 750 - RNA, 22 nt, Homo sapiens
auaugcuuauuagcaagaaaua

SEQ ID NO: 751 - RNA, 22 nt, Homo sapiens
aagucacugagacuuguggcug

SEQ ID NO: 752 - RNA, 22 nt, Homo sapiens
ugagauuguuagaucaaauggu

SEQ ID NO: 753 - RNA, 22 nt, Homo sapiens
guuggcaaguggcugagcuggg

SEQ ID NO: 754 - RNA, 22 nt, Homo sapiens
ugcuuaguuguauguuccacau

SEQ ID NO: 755 - RNA, 18 nt, Homo sapiens
cccgggugggcuguuccc

SEQ ID NO: 756 - RNA, 22 nt, Homo sapiens
augcacaugcgaaaacuugugu

SEQ ID NO: 757 - RNA, 22 nt, Homo sapiens
uucaaguaguucucaugccuca

SEQ ID NO: 758 - RNA, 22 nt, Homo sapiens
uggcaugggguaguagcgcugg

SEQ ID NO: 759 - RNA, 22 nt, Homo sapiens
gaacuguuucuggugaaagagu

SEQ ID NO: 760 - RNA, 22 nt, Homo sapiens
accuggguguauguucaguuug

SEQ ID NO: 761 - RNA, 22 nt, Homo sapiens
uacaguguuuugguauuccaca

SEQ ID NO: 762 - RNA, 22 nt, Homo sapiens
cugaauagagcacacugauggg

SEQ ID NO: 763 - RNA, 22 nt, Homo sapiens
gucauggagggacauaacuaac

SEQ ID NO: 764 - RNA, 22 nt, Homo sapiens
cugucuggaguccuucgugugc

SEQ ID NO: 765 - RNA, 22 nt, Homo sapiens
ugauaauguuaggcuuuauuca

SEQ ID NO: 766 - RNA, 22 nt, Homo sapiens
auucaacuaauuauugaagaug

SEQ ID NO: 767 - RNA, 22 nt, Homo sapiens
acugcacuucagccuuggggac

SEQ ID NO: 768 - RNA, 22 nt, Homo sapiens
cuuugcacaucucugcuuuccc

SEQ ID NO: 769 - RNA, 22 nt, Homo sapiens
ucuagaugaaguauaaaguagu

SEQ ID NO: 770 - RNA, 22 nt, Homo sapiens
uggugcaaauguaauugugguu

SEQ ID NO: 771 - RNA, 22 nt, Homo sapiens
ugaguuagguguuuuaaauaua

SEQ ID NO: 772 - RNA, 22 nt, Homo sapiens
uugaaugucuauuaaguuguuu

SEQ ID NO: 773 - RNA, 22 nt, Homo sapiens
ggucauagagaauucaccagga

SEQ ID NO: 774 - RNA, 21 nt, Homo sapiens
accugauguuucaguuggagu

SEQ ID NO: 775 - RNA, 22 nt, Homo sapiens
aaagaagucagccuguccuuug

SEQ ID NO: 776 - RNA, 22 nt, Homo sapiens
acugcacuccagccugaugaaa

SEQ ID NO: 777 - RNA, 18 nt, Homo sapiens
aaacagugucucuuucug

SEQ ID NO: 778 - RNA, 22 nt, Homo sapiens
cugugccaagcuugcgaugugc

SEQ ID NO: 779 - RNA, 22 nt, Homo sapiens
aucugguauuacugcaacugua

SEQ ID NO: 780 - RNA, 19 nt, Homo sapiens
ucacuggacagcacacuca

SEQ ID NO: 781 - RNA, 22 nt, Homo sapiens
uugauaugcuugucaguccauu

SEQ ID NO: 782 - RNA, 22 nt, Homo sapiens
uguaugcuuuugagagauauuu

SEQ ID NO: 783 - RNA, 22 nt, Homo sapiens
gcaggaaucuugagaaggauuc

SEQ ID NO: 784 - RNA, 22 nt, Homo sapiens
ugucaucauuccaucagggcuu

SEQ ID NO: 785 - RNA, 22 nt, Homo sapiens
augugaccaucucuccacuaau

SEQ ID NO: 786 - RNA, 22 nt, Homo sapiens
gccuagagaguuaucaggcugu

SEQ ID NO: 787 - RNA, 22 nt, Homo sapiens
gcugucuggagucuguucaaug

SEQ ID NO: 788 - RNA, 22 nt, Homo sapiens
gaggucauucugugguacccag

SEQ ID NO: 789 - RNA, 22 nt, Homo sapiens
gaccccuagagauaggaggaac

SEQ ID NO: 790 - RNA, 22 nt, Homo sapiens
ggcaaggugaugaaugucuaca

SEQ ID NO: 791 - RNA, 22 nt, Homo sapiens
ugggaucagcugggcucucugu

SEQ ID NO: 792 - RNA, 22 nt, Homo sapiens
uugccuauucacucugaugaua

SEQ ID NO: 793 - RNA, 22 nt, Homo sapiens
ugagauuaaucuuuaaguaaga

SEQ ID NO: 794 - RNA, 22 nt, Homo sapiens
cuggagcaaaggugacucuugu

SEQ ID NO: 795 - RNA, 22 nt, Homo sapiens
gggaagugugcagaguucucuu

SEQ ID NO: 796 - RNA, 22 nt, Homo sapiens
ggacuagaucucccggcuucua

SEQ ID NO: 797 - RNA, 22 nt, Homo sapiens
auuugguuauggucauggacac

SEQ ID NO: 798 - RNA, 22 nt, Homo sapiens
augugaaugugaucggauaguc

SEQ ID NO: 799 - RNA, 16 nt, Homo sapiens
uguccaaauaaauaca

SEQ ID NO: 800 - RNA, 22 nt, Homo sapiens
guguguaaauggcagugagcuc

SEQ ID NO: 801 - RNA, 21 nt, Homo sapiens
uaaaggcuccaauuauacccc

SEQ ID NO: 802 - RNA, 22 nt, Homo sapiens
uuaugucacuguucagucuccc

SEQ ID NO: 803 - RNA, 20 nt, Homo sapiens
ugagaucaggauuaaggcua

SEQ ID NO: 804 - RNA, 22 nt, Homo sapiens
uccauggagacacauuuuauau

SEQ ID NO: 805 - RNA, 22 nt, Homo sapiens
uuagcccaucuugaggaaagua

SEQ ID NO: 806 - RNA, 22 nt, Homo sapiens
ucauugguugcguaauuugauu

SEQ ID NO: 807 - RNA, 22 nt, Homo sapiens
gcgguuuuaagugaguuucuua

SEQ ID NO: 808 - RNA, 22 nt, Homo sapiens
uauggauucuagcucaguaggu

SEQ ID NO: 809 - RNA, 19 nt, Homo sapiens
gaugcaaugcacugagguc

SEQ ID NO: 810 - RNA, 22 nt, Homo sapiens
uccugcauucugaaauacaagu

SEQ ID NO: 811 - RNA, 22 nt, Homo sapiens
gagaucuuuaagaacuacugcu

SEQ ID NO: 812 - RNA, 22 nt, Homo sapiens
uuggaauacuuguuaaagucca

SEQ ID NO: 813 - RNA, 22 nt, Homo sapiens
uucuggcucaggucaacacuuc

SEQ ID NO: 814 - RNA, 22 nt, Homo sapiens
auugcacuccggccugggugac

SEQ ID NO: 815 - RNA, 22 nt, Homo sapiens
ucaugugagcaaguugggcuca

SEQ ID NO: 816 - RNA, 22 nt, Homo sapiens
auagaggacugaggugaucuuu

SEQ ID NO: 817 - RNA, 22 nt, Homo sapiens
ugcaaacuuccuugggcagcau

SEQ ID NO: 818 - RNA, 22 nt, Homo sapiens
cacagugaacaauauccucugu

SEQ ID NO: 819 - RNA, 22 nt, Homo sapiens
ugugaauguaagaaaauccaac

SEQ ID NO: 820 - RNA, 22 nt, Homo sapiens
ugagaugguaaauuuuuguugu

SEQ ID NO: 821 - RNA, 22 nt, Homo sapiens
guucaaguuuucucuugugggu

SEQ ID NO: 822 - RNA, 18 nt, Homo sapiens
uauuaagcuagauauuau

SEQ ID NO: 823 - RNA, 22 nt, Homo sapiens
ucaagaccucacauagaggaga

SEQ ID NO: 824 - RNA, 22 nt, Homo sapiens
gucauggacaaggugugagcca

SEQ ID NO: 825 - RNA, 22 nt, Homo sapiens
ggcgguguccuccaagugcuuc

SEQ ID NO: 826 - RNA, 23 nt, Homo sapiens
ucagguaguuucagaggaccuug

SEQ ID NO: 827 - RNA, 21 nt, Homo sapiens
ugacuagauuccagauuggcc

SEQ ID NO: 828 - RNA, 23 nt, Homo sapiens
agccuguugccuaggcagcucau

SEQ ID NO: 829 - RNA, 17 nt, Homo sapiens
gacgaucaucaggaggc

SEQ ID NO: 830 - RNA, 18 nt, Homo sapiens
aaaugcucuucuggaaua

SEQ ID NO: 831 - RNA, 22 nt, Homo sapiens
uccccgagcccaggcugugacu

SEQ ID NO: 832 - RNA, 22 nt, Homo sapiens
ugugcuaaaaugggacuucuaa

SEQ ID NO: 833 - RNA, 22 nt, Homo sapiens
uggacuagagggugggcgaggu

SEQ ID NO: 834 - RNA, 22 nt, Homo sapiens
gcaagaauggaacaggagagcc

SEQ ID NO: 835 - RNA, 22 nt, Homo sapiens
uucucaguucgguggcagugcu

SEQ ID NO: 836 - RNA, 22 nt, Homo sapiens
auagcagugugaggacagacua

SEQ ID NO: 837 - RNA, 17 nt, Homo sapiens
cucacugagaacagcua

SEQ ID NO: 838 - RNA, 22 nt, Homo sapiens
ugaaaucuaaaauguuccaaga

SEQ ID NO: 839 - RNA, 22 nt, Homo sapiens
ugugcacaaccugcagguuugu

SEQ ID NO: 840 - RNA, 22 nt, Homo sapiens
uugcagugugacgacuauauuu

SEQ ID NO: 841 - RNA, 23 nt, Homo sapiens
uauaacuuuuaauuuacuggccu

SEQ ID NO: 842 - RNA, 21 nt, Homo sapiens
uggaaguguacaauuauaccc

SEQ ID NO: 843 - RNA, 22 nt, Homo sapiens
uggcuguuuauuucaccugggc

SEQ ID NO: 844 - RNA, 22 nt, Homo sapiens
auagacugaguggcuuaaacca

SEQ ID NO: 845 - RNA, 18 nt, Homo sapiens
cucaaccucaugcagggc

SEQ ID NO: 846 - RNA, 22 nt, Homo sapiens
guauuagaugguauuugaagau

SEQ ID NO: 847 - RNA, 22 nt, Homo sapiens
gagguaggaggauugcuuaagg

SEQ ID NO: 848 - RNA, 22 nt, Homo sapiens
uaugcacaugugccugggugug

SEQ ID NO: 849 - RNA, 22 nt, Homo sapiens
uugugucaaauggcaauuagca

SEQ ID NO: 850 - RNA, 22 nt, Homo sapiens
ggcuagaauagggauagaccuu

SEQ ID NO: 851 - RNA, 17 nt, Homo sapiens
uagcuucacauuaggaa

SEQ ID NO: 852 - RNA, 22 nt, Homo sapiens
uuguaaacaucuguacauugcu

SEQ ID NO: 853 - RNA, 22 nt, Homo sapiens
gucacggagauauggauucgga

SEQ ID NO: 854 - RNA, 22 nt, Homo sapiens
aaaugcacgcuacccagcuaga

SEQ ID NO: 855 - RNA, 22 nt, Homo sapiens
gagauuaacauuugaggagcug

SEQ ID NO: 856 - RNA, 22 nt, Homo sapiens
auugcaauuaguccauagaguu

SEQ ID NO: 857 - RNA, 21 nt, Homo sapiens
uggcaacauggauggauucug

SEQ ID NO: 858 - RNA, 22 nt, Homo sapiens
acauccauuugcuuuauuugcu

SEQ ID NO: 859 - RNA, 22 nt, Homo sapiens
ggaaugugugucaugcuuuugc

SEQ ID NO: 860 - RNA, 17 nt, Homo sapiens
guacacuucuucuguga

SEQ ID NO: 861 - RNA, 22 nt, Homo sapiens
uuccacagggauuugcauugau

SEQ ID NO: 862 - RNA, 22 nt, Homo sapiens
uguucuggagccgguucaaaug

SEQ ID NO: 863 - RNA, 22 nt, Homo sapiens
uauugcugaaaaugcuaaugau

SEQ ID NO: 864 - RNA, 22 nt, Homo sapiens
cagagaaugucuuuuuuaacca

SEQ ID NO: 865 - RNA, 22 nt, Homo sapiens
ggaguuuaagucuugugcaucu

SEQ ID NO: 866 - RNA, 22 nt, Homo sapiens
aauuacuucuacaccaaccuaa

SEQ ID NO: 867 - RNA, 22 nt, Homo sapiens
uaucaccuugagagaccuuauc

SEQ ID NO: 868 - RNA, 22 nt, Homo sapiens
cacucaguuugugguacuuugu

SEQ ID NO: 869 - RNA, 22 nt, Homo sapiens
cagcccguaaucccagcacuuu

SEQ ID NO: 870 - RNA, 21 nt, Homo sapiens
ugaaugucuaggcagaaguuu

SEQ ID NO: 871 - RNA, 22 nt, Homo sapiens
uuuggucagcugcgggucagcu

SEQ ID NO: 872 - RNA, 22 nt, Homo sapiens
ccccggguggauguacauguga

SEQ ID NO: 873 - RNA, 22 nt, Homo sapiens
auugaguaaaugaaaauugccu

SEQ ID NO: 874 - RNA, 22 nt, Homo sapiens
ucacaauucacuacaggcuuga

SEQ ID NO: 875 - RNA, 23 nt, Homo sapiens
ucacggagaccugcaagaccaau

SEQ ID NO: 876 - RNA, 20 nt, Homo sapiens
ugguccccugagucuggcuu

SEQ ID NO: 877 - RNA, 22 nt, Homo sapiens
ucuugcaccuacaugcuuuguc

SEQ ID NO: 878 - RNA, 22 nt, Homo sapiens
aagcacaauuucaccuucuugu

SEQ ID NO: 879 - RNA, 22 nt, Homo sapiens
auggagaugaauaucaucuguu

SEQ ID NO: 880 - RNA, 22 nt, Homo sapiens
cuggaaugcagcuuuaggggcu

SEQ ID NO: 881 - RNA, 22 nt, Homo sapiens
auagcagugugaaaauguacua

SEQ ID NO: 882 - RNA, 20 nt, Homo sapiens
ucaggcuccgcauuaacuua

SEQ ID NO: 883 - RNA, 22 nt, Homo sapiens
ggcaacaauuccuacuucuuuu

SEQ ID NO: 884 - RNA, 22 nt, Homo sapiens
auucuugcuugaacuuggugca

SEQ ID NO: 885 - RNA, 22 nt, Homo sapiens
uaucaccacccugggaaacaua

SEQ ID NO: 886 - RNA, 22 nt, Homo sapiens
gugguuuuacaaagagaaagau

SEQ ID NO: 887 - RNA, 20 nt, Homo sapiens
uggugguuuuaugugguuua

SEQ ID NO: 888 - RNA, 19 nt, Homo sapiens
ccugcuguucuuuugcacc

SEQ ID NO: 889 - RNA, 21 nt, Homo sapiens
ugcauggagaacacugagggu

SEQ ID NO: 890 - RNA, 22 nt, Homo sapiens
ugagacggaguuucacucuugu

SEQ ID NO: 891 - RNA, 22 nt, Homo sapiens
acugcacuccagccuucgugac

SEQ ID NO: 892 - RNA, 22 nt, Homo sapiens
cuucaaguguggccaccugacc

SEQ ID NO: 893 - RNA, 22 nt, Homo sapiens
cuuaaagcgaauauugguggua

SEQ ID NO: 894 - RNA, 22 nt, Homo sapiens
guggaaaauuauugcuguuuuu

SEQ ID NO: 895 - RNA, 22 nt, Homo sapiens
aucuuugauugaagggacccug

SEQ ID NO: 896 - RNA, 22 nt, Homo sapiens
guuggcuguuucccccaaguga

SEQ ID NO: 897 - RNA, 22 nt, Homo sapiens
augauacguuacuucacugggg

SEQ ID NO: 898 - RNA, 18 nt, Homo sapiens
uacagaacuggaguagaa

SEQ ID NO: 899 - RNA, 22 nt, Homo sapiens
ucuuuggucaucaugggaagca

SEQ ID NO: 900 - RNA, 22 nt, Homo sapiens
ugagauaucauuucacacccag

SEQ ID NO: 901 - RNA, 23 nt, Homo sapiens
accuucauucauucagcugaagu

SEQ ID NO: 902 - RNA, 22 nt, Homo sapiens
ugaagugaaugguaaguaugcc

SEQ ID NO: 903 - RNA, 22 nt, Homo sapiens
ugaugguaguucagucaaugua

SEQ ID NO: 904 - RNA, 22 nt, Homo sapiens
uugcauaauaagagggauacgu

SEQ ID NO: 905 - RNA, 22 nt, Homo sapiens
uggaucuguucuauuuaucuga

SEQ ID NO: 906 - RNA, 22 nt, Homo sapiens
uggaaaguaguucuaaucuaag

SEQ ID NO: 907 - RNA, 22 nt, Homo sapiens
uucaccggggaccccuggcugu

SEQ ID NO: 908 - RNA, 22 nt, Homo sapiens
ugcauccauucuagacucaucu

SEQ ID NO: 909 - RNA, 22 nt, Homo sapiens
uagggcuuuuccaagcugccac

SEQ ID NO: 910 - RNA, 22 nt, Homo sapiens
ugaucugucucggguuaucagu

SEQ ID NO: 911 - RNA, 20 nt, Homo sapiens
aaggcuuucgaguuccaggg

SEQ ID NO: 912 - RNA, 22 nt, Homo sapiens
ugacuacaccacacgguuaagg

SEQ ID NO: 913 - RNA, 22 nt, Homo sapiens
ugaaauuuuuuauucguuggcu

SEQ ID NO: 914 - RNA, 22 nt, Homo sapiens
aaagugcugagacagacuggga

SEQ ID NO: 915 - RNA, 22 nt, Homo sapiens
uuacaguggugaccuuguauug

SEQ ID NO: 916 - RNA, 20 nt, Homo sapiens
ucauacuguggaguaccagg

SEQ ID NO: 917 - RNA, 22 nt, Homo sapiens
uuguccucuccaaaucucaugu

SEQ ID NO: 918 - RNA, 22 nt, Homo sapiens
cagauacuccuggucucaggag

SEQ ID NO: 919 - RNA, 23 nt, Homo sapiens
agcuagagaggcuggggauacag

SEQ ID NO: 920 - RNA, 22 nt, Homo sapiens
agacccuguauguguuuaguuu

SEQ ID NO: 921 - RNA, 22 nt, Homo sapiens
aggugacugguuuaucuggcag

SEQ ID NO: 922 - RNA, 22 nt, Homo sapiens
auagcaauuugggaaucagacu

SEQ ID NO: 923 - RNA, 22 nt, Homo sapiens
ucagauguuucuuuaacgcaug

SEQ ID NO: 924 - RNA, 22 nt, Homo sapiens
aucccuagaaaaaucagcacau

SEQ ID NO: 925 - RNA, 22 nt, Homo sapiens
gacaagagaacacugcuauauu

SEQ ID NO: 926 - RNA, 22 nt, Homo sapiens
gcagugaugugaucauagcuca

SEQ ID NO: 927 - RNA, 22 nt, Homo sapiens
cuggauauguugcaacauuucc

SEQ ID NO: 928 - RNA, 19 nt, Homo sapiens
gcuucuugaggacgaugac

SEQ ID NO: 929 - RNA, 22 nt, Homo sapiens
gaagacauuuacaugggagacc

SEQ ID NO: 930 - RNA, 22 nt, Homo sapiens
gugcaauguuaauuacuugacu

SEQ ID NO: 931 - RNA, 22 nt, Homo sapiens
agacuguaaugcauaauuuacu

SEQ ID NO: 932 - RNA, 19 nt, Homo sapiens
acugcacuccuccuugggu

SEQ ID NO: 933 - RNA, 22 nt, Homo sapiens
uaagacuguuggcaauuuuugc

SEQ ID NO: 934 - RNA, 22 nt, Homo sapiens
caccacagccauuauugucccc

SEQ ID NO: 935 - RNA, 22 nt, Homo sapiens
ucugucuuguccucacccuaga

SEQ ID NO: 936 - RNA, 22 nt, Homo sapiens
gagguugggaugagggauacag

SEQ ID NO: 937 - RNA, 20 nt, Homo sapiens
uagaaaguagaguggugguu

SEQ ID NO: 938 - RNA, 22 nt, Homo sapiens
uauggcucuguaauuuuagaug

SEQ ID NO: 939 - RNA, 22 nt, Homo sapiens
uuggccaauggugauucccggc

SEQ ID NO: 940 - RNA, 22 nt, Homo sapiens
gagucagugucuugcucuguca

SEQ ID NO: 941 - RNA, 22 nt, Homo sapiens
ugacacauguagacaucuggug

SEQ ID NO: 942 - RNA, 22 nt, Homo sapiens
augacauagaagcaauccccua

SEQ ID NO: 943 - RNA, 22 nt, Homo sapiens
auggcaauaauagcuaccauuu

SEQ ID NO: 944 - RNA, 22 nt, Homo sapiens
gucacggaauguaaguggaagu

SEQ ID NO: 945 - RNA, 22 nt, Homo sapiens
guguuauugagaaauagggugu

SEQ ID NO: 946 - RNA, 23 nt, Homo sapiens
aagcaugcacagcuguuuguggu

SEQ ID NO: 947 - RNA, 22 nt, Homo sapiens
ugcugcuguuguuguuacuagc

SEQ ID NO: 948 - RNA, 22 nt, Homo sapiens
ggggucaucagagaaucuaccc

SEQ ID NO: 949 - RNA, 22 nt, Homo sapiens
guccauuuguuuccagagcacu

SEQ ID NO: 950 - RNA, 22 nt, Homo sapiens
auguuguaguaugagucaaaau

SEQ ID NO: 951 - RNA, 22 nt, Homo sapiens
ugucccugagccuggauuccug

SEQ ID NO: 952 - RNA, 22 nt, Homo sapiens
ugagaucaugucauuugcacuc

SEQ ID NO: 953 - RNA, 22 nt, Homo sapiens
ugaagacucauacuugaaucag

SEQ ID NO: 954 - RNA, 21 nt, Homo sapiens
uuuuugggcuuucauaguguu

SEQ ID NO: 955 - RNA, 22 nt, Homo sapiens
auaugguacuuaugcucaaacu

SEQ ID NO: 956 - RNA, 22 nt, Homo sapiens
uacacagucaaaaauuuccagg

SEQ ID NO: 957 - RNA, 22 nt, Homo sapiens
ggcuuggaggaaugugagggcu

SEQ ID NO: 958 - RNA, 22 nt, Homo sapiens
gaaacugcauuucuaacaagcu

SEQ ID NO: 959 - RNA, 22 nt, Homo sapiens
uacugcacuccaggcucaccug

SEQ ID NO: 960 - RNA, 22 nt, Homo sapiens
gucugagcauggggccggcagg

SEQ ID NO: 961 - RNA, 18 nt, Homo sapiens
guggagugucuuccugga

SEQ ID NO: 962 - RNA, 22 nt, Homo sapiens
uguuacagcagaauugauugca

SEQ ID NO: 963 - RNA, 22 nt, Homo sapiens
uaaggcuugcuucagucuugaa

SEQ ID NO: 964 - RNA, 22 nt, Homo sapiens
uugaggaguacugauuagguau

SEQ ID NO: 965 - RNA, 22 nt, Homo sapiens
acauauaaggagacuagggcau

SEQ ID NO: 966 - RNA, 22 nt, Homo sapiens
agucagugucuguaaggagaac

SEQ ID NO: 967 - RNA, 22 nt, Homo sapiens
gugagggaugugaaaaagguca

SEQ ID NO: 968 - RNA, 21 nt, Homo sapiens
gaccccuagaucuuuuuccag

SEQ ID NO: 969 - RNA, 22 nt, Homo sapiens
uuaggaucacagaaaauccucu

SEQ ID NO: 970 - RNA, 22 nt, Homo sapiens
uaggcaguuuuccuuucacagu

SEQ ID NO: 971 - RNA, 17 nt, Homo sapiens
uauagcacuucucacau

SEQ ID NO: 972 - RNA, 22 nt, Homo sapiens
aguccagguuuuguaauggcaa

SEQ ID NO: 973 - RNA, 22 nt, Homo sapiens
aaggcaagguggauaaugaagc

SEQ ID NO: 974 - RNA, 23 nt, Homo sapiens
aucacuguuaacaauuucuuccu

SEQ ID NO: 975 - RNA, 22 nt, Homo sapiens
uggcaugucguuuuucauagga

SEQ ID NO: 976 - RNA, 22 nt, Homo sapiens
aagaugguauuucauuaguuuu

SEQ ID NO: 977 - RNA, 22 nt, Homo sapiens
ugagagcuuugaugcacuguuu

SEQ ID NO: 978 - RNA, 22 nt, Homo sapiens
ugcaccacuacacuccaggcug

SEQ ID NO: 979 - RNA, 22 nt, Homo sapiens
uuggcuucuggacuauugugca

SEQ ID NO: 980 - RNA, 22 nt, Homo sapiens
ugguuagucuguguguauauau

SEQ ID NO: 981 - RNA, 23 nt, Homo sapiens
uggcaagauuuguauugccugga

SEQ ID NO: 982 - RNA, 21 nt, Homo sapiens
auagcacaucagauuuuauua

SEQ ID NO: 983 - RNA, 23 nt, Homo sapiens
aagucauggaaucaaaugaggug

SEQ ID NO: 984 - RNA, 22 nt, Homo sapiens
guauggcaugcaugagaauuuc

SEQ ID NO: 985 - RNA, 21 nt, Homo sapiens
uuguagcagcauaaucccaga

SEQ ID NO: 986 - RNA, 22 nt, Homo sapiens
gccauugcacucuagccuaggu

SEQ ID NO: 987 - RNA, 22 nt, Homo sapiens
uuuggcauuaagaugcuguauc

SEQ ID NO: 988 - RNA, 22 nt, Homo sapiens
auccauugucuaaugcuaagau

SEQ ID NO: 989 - RNA, 22 nt, Homo sapiens
uagauuaucuuaaggagcauca

SEQ ID NO: 990 - RNA, 22 nt, Homo sapiens
acugcacuccagccuggcggac

SEQ ID NO: 991 - RNA, 22 nt, Homo sapiens
ugagagcugguuguuuaaagga

SEQ ID NO: 992 - RNA, 22 nt, Homo sapiens
cuagaacuagaacugcuggggu

SEQ ID NO: 993 - RNA, 22 nt, Homo sapiens
uuugcacuucugagugugacau

SEQ ID NO: 994 - RNA, 22 nt, Homo sapiens
ugugacacugaauggcagaacu

SEQ ID NO: 995 - RNA, 22 nt, Homo sapiens
ugagauguguccagaucuaguu

SEQ ID NO: 996 - RNA, 22 nt, Homo sapiens
ugcaaaguccucauucuuaccc

SEQ ID NO: 997 - RNA, 22 nt, Homo sapiens
gaugcaaauuaagcuugggaca

SEQ ID NO: 998 - RNA, 23 nt, Homo sapiens
ugcauaguacccaauacuuuauc

SEQ ID NO: 999 - RNA, 22 nt, Homo sapiens
cucaccuugugauccaccggcc

SEQ ID NO: 1000 - RNA, 22 nt, Homo sapiens
cuuggcuuguuguccccugcuc

SEQ ID NO: 1001 - RNA, 22 nt, Homo sapiens
uccaguguuauaauaugcgucu

SEQ ID NO: 1002 - RNA, 23 nt, Homo sapiens
uguauacacccugugcaucuggg

SEQ ID NO: 1003 - RNA, 22 nt, Homo sapiens
uguagucauuugaaggaugucc

SEQ ID NO: 1004 - RNA, 22 nt, Homo sapiens
gcucguuuuugccucugguugc

SEQ ID NO: 1005 - RNA, 22 nt, Homo sapiens
cugucagugggaguucaggcuu

SEQ ID NO: 1006 - RNA, 22 nt, Homo sapiens
uguagauauucuuucaguuuuu

SEQ ID NO: 1007 - RNA, 22 nt, Homo sapiens
agcuggucuuggggaagaguag

SEQ ID NO: 1008 - RNA, 22 nt, Homo sapiens
uguugcauuugucaaggucaag

SEQ ID NO: 1009 - RNA, 22 nt, Homo sapiens
gcuuuuggaggaacuuaagauu

SEQ ID NO: 1010 - RNA, 22 nt, Homo sapiens
gaaagacuuucugcuguggaua

SEQ ID NO: 1011 - RNA, 22 nt, Homo sapiens
cuggaauauuagcuggucuuaa

SEQ ID NO: 1012 - RNA, 20 nt, Homo sapiens
ucaucaguuggugcucgcug

SEQ ID NO: 1013 - RNA, 22 nt, Homo sapiens
auacaguauggagggcccagcu

SEQ ID NO: 1014 - RNA, 21 nt, Homo sapiens
uucuaaguaaauguuggacau

SEQ ID NO: 1015 - RNA, 22 nt, Homo sapiens
uugaggucuuugagcaaacgca

SEQ ID NO: 1016 - RNA, 22 nt, Homo sapiens
uuccauguugauacgugaaguu

SEQ ID NO: 1017 - RNA, 22 nt, Homo sapiens
ucucacaggguuauugaggggg

SEQ ID NO: 1018 - RNA, 22 nt, Homo sapiens
ggcaguuuguuugugaggucca

SEQ ID NO: 1019 - RNA, 21 nt, Homo sapiens
uguagcagcauaauuuauaau

SEQ ID NO: 1020 - RNA, 22 nt, Homo sapiens
uaggacacaggacauauguaga

SEQ ID NO: 1021 - RNA, 21 nt, Homo sapiens
uuuguccaccuguguucacca

SEQ ID NO: 1022 - RNA, 19 nt, Homo sapiens
uuuguccugcccuuucuca

SEQ ID NO: 1023 - RNA, 22 nt, Homo sapiens
uugagcacauguguuaaggggu

SEQ ID NO: 1024 - RNA, 22 nt, Homo sapiens
agcacauauauuucccaaaaca

SEQ ID NO: 1025 - RNA, 22 nt, Homo sapiens
uucccgggguggaaugcaguga

SEQ ID NO: 1026 - RNA, 22 nt, Homo sapiens
cugauuuguccccagccucaug

SEQ ID NO: 1027 - RNA, 22 nt, Homo sapiens
uugguccucccaugcucaagag

SEQ ID NO: 1028 - RNA, 22 nt, Homo sapiens
uaggcacugagaauaugaggau

SEQ ID NO: 1029 - RNA, 22 nt, Homo sapiens
uugaaccauucuuuugauagag

SEQ ID NO: 1030 - RNA, 22 nt, Homo sapiens
agcaucacaugggcugcuuggg

SEQ ID NO: 1031 - RNA, 22 nt, Homo sapiens
ugacuggaacuuuagugagucu

SEQ ID NO: 1032 - RNA, 18 nt, Homo sapiens
ucaagcaauugucaugcc

SEQ ID NO: 1033 - RNA, 22 nt, Homo sapiens
gaucacaguuccucacgggcau

SEQ ID NO: 1034 - RNA, 22 nt, Homo sapiens
uuugguguauauguaaacuaug

SEQ ID NO: 1035 - RNA, 22 nt, Homo sapiens
ugugcuugaauuuaguagcuua

SEQ ID NO: 1036 - RNA, 21 nt, Homo sapiens
ugcucaugaguaaugcaguga

SEQ ID NO: 1037 - RNA, 22 nt, Homo sapiens
gucagggagucucuaucagugg

SEQ ID NO: 1038 - RNA, 22 nt, Homo sapiens
uauuccacacuguuggugggau

SEQ ID NO: 1039 - RNA, 19 nt, Homo sapiens
uccccaguuuuccguucag

SEQ ID NO: 1040 - RNA, 22 nt, Homo sapiens
ugagcaauaaaguuacacaguu

SEQ ID NO: 1041 - RNA, 22 nt, Homo sapiens
gauuuguuggccugugagcuag

SEQ ID NO: 1042 - RNA, 22 nt, Homo sapiens
agucacaugcauuuucuucaau

SEQ ID NO: 1043 - RNA, 22 nt, Homo sapiens
auuggcaaucgucuccauuuuu

SEQ ID NO: 1044 - RNA, 18 nt, Homo sapiens
augacucuggguguuccu

SEQ ID NO: 1045 - RNA, 20 nt, Homo sapiens
guucacagagguuaugauua

SEQ ID NO: 1046 - RNA, 22 nt, Homo sapiens
ggcagacuguggaguucuuucu

SEQ ID NO: 1047 - RNA, 22 nt, Homo sapiens
agccaagacucuguuccccuug

SEQ ID NO: 1048 - RNA, 22 nt, Homo sapiens
guuaugcagcuuagaaaaugaa

SEQ ID NO: 1049 - RNA, 22 nt, Homo sapiens
uguauguugggucaaaguacau

SEQ ID NO: 1050 - RNA, 22 nt, Homo sapiens
uguuuuguuagcacucugggaa

SEQ ID NO: 1051 - RNA, 22 nt, Homo sapiens
aggagcacuggccuuggaguca

SEQ ID NO: 1052 - RNA, 22 nt, Homo sapiens
cagugucugcauuuggaacuca

SEQ ID NO: 1053 - RNA, 20 nt, Homo sapiens
aagugaguguuaaacugaac

SEQ ID NO: 1054 - RNA, 22 nt, Homo sapiens
cccaguaaucuugccaguuuuc

SEQ ID NO: 1055 - RNA, 22 nt, Homo sapiens
aguacaauguugaguagaagug

SEQ ID NO: 1056 - RNA, 22 nt, Homo sapiens
gcaucacagcuccugugcuggc

SEQ ID NO: 1057 - RNA, 22 nt, Homo sapiens
ugucauuguggugcagauauaa

SEQ ID NO: 1058 - RNA, 22 nt, Homo sapiens
cauguauagauuccauaguggu

SEQ ID NO: 1059 - RNA, 22 nt, Homo sapiens
auggcaccauguuaugauaaua

SEQ ID NO: 1060 - RNA, 20 nt, Homo sapiens
uugcagagcccaacccugga

SEQ ID NO: 1061 - RNA, 22 nt, Homo sapiens
uaugacucagaaggcacacaca

SEQ ID NO: 1062 - RNA, 21 nt, Homo sapiens
ugaucacaugaaaaccaugca

SEQ ID NO: 1063 - RNA, 16 nt, Homo sapiens
uaacacaguucccacc

SEQ ID NO: 1064 - RNA, 22 nt, Homo sapiens
auuagguagugagaugcugcug

SEQ ID NO: 1065 - RNA, 22 nt, Homo sapiens
agaguauacaugugagugagau

SEQ ID NO: 1066 - RNA, 22 nt, Homo sapiens
aagaguaguaguggcacucucu

SEQ ID NO: 1067 - RNA, 22 nt, Homo sapiens
acugcacuccaguuccgggcaa

SEQ ID NO: 1068 - RNA, 22 nt, Homo sapiens
uccacugagcuagaccacuugg

SEQ ID NO: 1069 - RNA, 21 nt, Homo sapiens
uugaaugguuuuccuugggag

SEQ ID NO: 1070 - RNA, 22 nt, Homo sapiens
uauaugucugagacugggggau

SEQ ID NO: 1071 - RNA, 22 nt, Homo sapiens
gcaguacuuuauguccuaauua

SEQ ID NO: 1072 - RNA, 19 nt, Homo sapiens
cuaaaugggucccuagugg

SEQ ID NO: 1073 - RNA, 22 nt, Homo sapiens
cagauguaguauuuuagugaaa

SEQ ID NO: 1074 - RNA, 22 nt, Homo sapiens
aaagcuaccagauucuguugga

SEQ ID NO: 1075 - RNA, 22 nt, Homo sapiens
gugagacugaguuucgcucuug

SEQ ID NO: 1076 - RNA, 22 nt, Homo sapiens
uguaaacuuuugagauugacuu

SEQ ID NO: 1077 - RNA, 22 nt, Homo sapiens
uuugacuguggagucgaugcuu

SEQ ID NO: 1078 - RNA, 22 nt, Homo sapiens
ucuggauuuuugaggcaauaua

SEQ ID NO: 1079 - RNA, 22 nt, Homo sapiens
auugcaguuagaacagaagucu

SEQ ID NO: 1080 - RNA, 22 nt, Homo sapiens
gugagauuagcugagauccuug

SEQ ID NO: 1081 - RNA, 22 nt, Homo sapiens
gguacagcuaguuaaacauuug

SEQ ID NO: 1082 - RNA, 21 nt, Homo sapiens
ugaggucaugaugcugcuucc

SEQ ID NO: 1083 - RNA, 22 nt, Homo sapiens
cuuuguaugucaugacaacugu

SEQ ID NO: 1084 - RNA, 22 nt, Homo sapiens
uagcaagaugaauuugugcaaa

SEQ ID NO: 1085 - RNA, 22 nt, Homo sapiens
uugcaugcuccuuaugagaauc

SEQ ID NO: 1086 - RNA, 22 nt, Homo sapiens
gugagcuauguccugguuuggg

SEQ ID NO: 1087 - RNA, 22 nt, Homo sapiens
auauucacuauaugcagaacca

SEQ ID NO: 1088 - RNA, 21 nt, Homo sapiens
uuagugcucaguuugacaaaa

SEQ ID NO: 1089 - RNA, 22 nt, Homo sapiens
uagcagaauauaccucuuacuu

SEQ ID NO: 1090 - RNA, 22 nt, Homo sapiens
gagauguuuguuucacugucac

SEQ ID NO: 1091 - RNA, 22 nt, Homo sapiens
aucacaguuauaacauccuuuu

SEQ ID NO: 1092 - RNA, 22 nt, Homo sapiens
acccaguagucauucaggagca

SEQ ID NO: 1093 - RNA, 22 nt, Homo sapiens
cagugcauguggcacucuccag

SEQ ID NO: 1094 - RNA, 22 nt, Homo sapiens
cauauaguaguacuguuagguu

SEQ ID NO: 1095 - RNA, 22 nt, Homo sapiens
gucauugcacuccagccuggac

SEQ ID NO: 1096 - RNA, 22 nt, Homo sapiens
uugauguguuuccaggauuugu

SEQ ID NO: 1097 - RNA, 20 nt, Homo sapiens
cagcacgcacaugagacugu

SEQ ID NO: 1098 - RNA, 22 nt, Homo sapiens
uagcacaucccuaaaaugcugu

SEQ ID NO: 1099 - RNA, 22 nt, Homo sapiens
auaaugcuggaacuagagggca

SEQ ID NO: 1100 - RNA, 22 nt, Homo sapiens
agcaagaugaaguugagcuagg

SEQ ID NO: 1101 - RNA, 21 nt, Homo sapiens
cuuuaugcuguguuagaaaag

SEQ ID NO: 1102 - RNA, 22 nt, Homo sapiens
acaucccaugccuggguacucc

SEQ ID NO: 1103 - RNA, 19 nt, Homo sapiens
aggacuaaagacuagaagu

SEQ ID NO: 1104 - RNA, 22 nt, Homo sapiens
uaugacguuuuauuggcgcagu

SEQ ID NO: 1105 - RNA, 22 nt, Homo sapiens
uagacccauuacguaguuucca

SEQ ID NO: 1106 - RNA, 22 nt, Homo sapiens
ugagcaagaaauagaaacagau

SEQ ID NO: 1107 - RNA, 22 nt, Homo sapiens
uggaaggcuucauauguaaaga

SEQ ID NO: 1108 - RNA, 22 nt, Homo sapiens
gaugagaugagcauuugaauug

SEQ ID NO: 1109 - RNA, 22 nt, Homo sapiens
guacaugugcacagugugcagg

SEQ ID NO: 1110 - RNA, 23 nt, Homo sapiens
auugcacuccagccuaccugggc

SEQ ID NO: 1111 - RNA, 22 nt, Homo sapiens
guguauucaucuggcugaggua

SEQ ID NO: 1112 - RNA, 21 nt, Homo sapiens
gaguggcuuuuguuucaccag

SEQ ID NO: 1113 - RNA, 22 nt, Homo sapiens
uagagcaaugacucuggaaacc

SEQ ID NO: 1114 - RNA, 22 nt, Homo sapiens
ucagucauugauggaguagguc

SEQ ID NO: 1115 - RNA, 22 nt, Homo sapiens
gugugcacaaucuggcaugugc

SEQ ID NO: 1116 - RNA, 20 nt, Homo sapiens
uugacaguggguuguuaaag

SEQ ID NO: 1117 - RNA, 22 nt, Homo sapiens
uacucacauucuguuucuugcu

SEQ ID NO: 1118 - RNA, 22 nt, Homo sapiens
uuggagucaucucuguacugua

SEQ ID NO: 1119 - RNA, 22 nt, Homo sapiens
gauauguaaaaauuauaucuga

SEQ ID NO: 1120 - RNA, 22 nt, Homo sapiens
uuugugucccucuaaaauuuau

SEQ ID NO: 1121 - RNA, 22 nt, Homo sapiens
uuuacccugaggaaucuauuuu

SEQ ID NO: 1122 - RNA, 20 nt, Homo sapiens
ucuggguuuuggccacgccc

SEQ ID NO: 1123 - RNA, 22 nt, Homo sapiens
gccaaaaugcugggauuacagg

SEQ ID NO: 1124 - RNA, 22 nt, Homo sapiens
uuguacuuuuaguagagacggg

SEQ ID NO: 1125 - RNA, 21 nt, Homo sapiens
ucagaagcucccagggaggac

SEQ ID NO: 1126 - RNA, 22 nt, Homo sapiens
gugggaugcaaguaaaauuguc

SEQ ID NO: 1127 - RNA, 22 nt, Homo sapiens
auagagcuaccauagaauccag

SEQ ID NO: 1128 - RNA, 18 nt, Homo sapiens
ucauagaucaugacagug

SEQ ID NO: 1129 - RNA, 22 nt, Homo sapiens
guuuggcucuuguuucugucaa

SEQ ID NO: 1130 - RNA, 22 nt, Homo sapiens
uucuauggucacagaugcuuga

SEQ ID NO: 1131 - RNA, 22 nt, Homo sapiens
acaguagcgcaaucucggcuca

SEQ ID NO: 1132 - RNA, 22 nt, Homo sapiens
acacucuaguguucuuaaucag

SEQ ID NO: 1133 - RNA, 22 nt, Homo sapiens
aggcaugugugcagacugucug

SEQ ID NO: 1134 - RNA, 22 nt, Homo sapiens
uagauuaucuaugaggcuucca

SEQ ID NO: 1135 - RNA, 22 nt, Homo sapiens
gacuacaacuucuauuauucag

SEQ ID NO: 1136 - RNA, 22 nt, Homo sapiens
ugaaacauacacucugaugggg

SEQ ID NO: 1137 - RNA, 22 nt, Homo sapiens
uugcuaguguuugguugauggu

SEQ ID NO: 1138 - RNA, 22 nt, Homo sapiens
auuacaugucuauccaugaaca

SEQ ID NO: 1139 - RNA, 22 nt, Homo sapiens
ggagcaaugccucauucucacu

SEQ ID NO: 1140 - RNA, 22 nt, Homo sapiens
uaauaugugguugcuugggcac

SEQ ID NO: 1141 - RNA, 20 nt, Homo sapiens
ugucuauggggguucucugc

SEQ ID NO: 1142 - RNA, 22 nt, Homo sapiens
uaucagcacaguggguucaugg

SEQ ID NO: 1143 - RNA, 22 nt, Homo sapiens
uauagcacaucuguguguacau

SEQ ID NO: 1144 - RNA, 22 nt, Homo sapiens
cucaaagugcugggauuggcca

SEQ ID NO: 1145 - RNA, 22 nt, Homo sapiens
cugucaucauuucuaugugcca

SEQ ID NO: 1146 - RNA, 22 nt, Homo sapiens
agucaugguaguaaauuuggac

SEQ ID NO: 1147 - RNA, 22 nt, Homo sapiens
uugugauugagugauccuuguu

SEQ ID NO: 1148 - RNA, 22 nt, Homo sapiens
gauuagucccauuuuacaggug

SEQ ID NO: 1149 - RNA, 22 nt, Homo sapiens
caguaguagccccuuagaugga

SEQ ID NO: 1150 - RNA, 20 nt, Homo sapiens
cuugcuccccuuguucuaga

SEQ ID NO: 1151 - RNA, 22 nt, Homo sapiens
aaagugucuguuccuagcauga

SEQ ID NO: 1152 - RNA, 20 nt, Homo sapiens
gcaguguucacuguauuccu

SEQ ID NO: 1153 - RNA, 22 nt, Homo sapiens
cuaauucuggccaaagggauaa

SEQ ID NO: 1154 - RNA, 22 nt, Homo sapiens
uuguauguaaccauuuggcaaa

SEQ ID NO: 1155 - RNA, 23 nt, Homo sapiens
ucacaguuacuuuugcaucaacc

SEQ ID NO: 1156 - RNA, 19 nt, Homo sapiens
acccuguccccaccuuuac

SEQ ID NO: 1157 - RNA, 22 nt, Homo sapiens
aagcauccagcauggaacugaa

SEQ ID NO: 1158 - RNA, 17 nt, Homo sapiens
ucagugcauuuaagaga

SEQ ID NO: 1159 - RNA, 22 nt, Homo sapiens
ggcccugagacaggaaaaagcu

SEQ ID NO: 1160 - RNA, 22 nt, Homo sapiens
aagugaccuaacaaugaaggcc

SEQ ID NO: 1161 - RNA, 22 nt, Homo sapiens
gagaaccauuuggagaaaaagu

SEQ ID NO: 1162 - RNA, 22 nt, Homo sapiens
aagugcaaauucccaggcucug

SEQ ID NO: 1163 - RNA, 22 nt, Homo sapiens
uauggcugcuuucacacuacaa

SEQ ID NO: 1164 - RNA, 22 nt, Homo sapiens
accugagauuacaggugcuggc

SEQ ID NO: 1165 - RNA, 22 nt, Homo sapiens
acugcacuucagccuguugaca

SEQ ID NO: 1166 - RNA, 22 nt, Homo sapiens
acugcacuccagccugcugaca

SEQ ID NO: 1167 - RNA, 22 nt, Homo sapiens
ucuggccuagaacaauuaauua

SEQ ID NO: 1168 - RNA, 20 nt, Homo sapiens
aagcagacauuuggaugaaa

SEQ ID NO: 1169 - RNA, 22 nt, Homo sapiens
guggcaaacucagcaugcccca

SEQ ID NO: 1170 - RNA, 22 nt, Homo sapiens
uuuagguaauauuaaguagcug

SEQ ID NO: 1171 - RNA, 21 nt, Homo sapiens
aggagcauuguugugguggag

SEQ ID NO: 1172 - RNA, 22 nt, Homo sapiens
augcauggucugaagucaaccu

SEQ ID NO: 1173 - RNA, 22 nt, Homo sapiens
auggccgggugcgguggcucac

SEQ ID NO: 1174 - RNA, 23 nt, Homo sapiens
uucaacagguagacccucccugc

SEQ ID NO: 1175 - RNA, 22 nt, Homo sapiens
gugagauuuucuccagguucag

SEQ ID NO: 1176 - RNA, 21 nt, Homo sapiens
gugguucuagagaaacagaau

SEQ ID NO: 1177 - RNA, 17 nt, Homo sapiens
agcaccacacucucuug

SEQ ID NO: 1178 - RNA, 22 nt, Homo sapiens
agcuacuguuagucuaguuagg

SEQ ID NO: 1179 - RNA, 19 nt, Homo sapiens
cugucacugaggaagacug

SEQ ID NO: 1180 - RNA, 22 nt, Homo sapiens
uucugcacaucgaucacaagau

SEQ ID NO: 1181 - RNA, 21 nt, Homo sapiens
uguccagcuuuuggaauauaa

SEQ ID NO: 1182 - RNA, 22 nt, Homo sapiens
acccauacacacauauuuaugu

SEQ ID NO: 1183 - RNA, 22 nt, Homo sapiens
uggccagugucggaggccagga

SEQ ID NO: 1184 - RNA, 22 nt, Homo sapiens
uuaugucauuuuuggauguuaa

SEQ ID NO: 1185 - RNA, 22 nt, Homo sapiens
ucaggugcaguggcucaugcuu

SEQ ID NO: 1186 - RNA, 22 nt, Homo sapiens
uuaaucuguucucuguauucua

SEQ ID NO: 1187 - RNA, 19 nt, Homo sapiens
ucaccuugcccugcacaca

SEQ ID NO: 1188 - RNA, 21 nt, Homo sapiens
cuucuuggggcagggcagggu

SEQ ID NO: 1189 - RNA, 19 nt, Homo sapiens
gugugcauaucacagagca

SEQ ID NO: 1190 - RNA, 22 nt, Homo sapiens
uugacauaguuucugaaauaga

SEQ ID NO: 1191 - RNA, 22 nt, Homo sapiens
cauugcauuuucuuuguaccuu

SEQ ID NO: 1192 - RNA, 22 nt, Homo sapiens
uauaacacccacauauagucuu

SEQ ID NO: 1193 - RNA, 22 nt, Homo sapiens
gugagcauuacucaugggauca

SEQ ID NO: 1194 - RNA, 22 nt, Homo sapiens
gcuguguguuaucagaaauugc

SEQ ID NO: 1195 - RNA, 22 nt, Homo sapiens
ucgcagcacgagcaugcaaggu

SEQ ID NO: 1196 - RNA, 22 nt, Homo sapiens
cauggcauuucaagauuuacca

SEQ ID NO: 1197 - RNA, 22 nt, Homo sapiens
guaaauguccugcuacagagug

SEQ ID NO: 1198 - RNA, 22 nt, Homo sapiens
gccaagauuuaauucaucaguu

SEQ ID NO: 1199 - RNA, 22 nt, Homo sapiens
ugaggcaagauacugauuucau

SEQ ID NO: 1200 - RNA, 22 nt, Homo sapiens
ucagauacuggugacaugaaug

SEQ ID NO: 1201 - RNA, 22 nt, Homo sapiens
agagcacuguggguccaaauau

SEQ ID NO: 1202 - RNA, 22 nt, Homo sapiens
cugagaucaagucuugcucugu

SEQ ID NO: 1203 - RNA, 22 nt, Homo sapiens
ugcuaucauugauuagugaugu

SEQ ID NO: 1204 - RNA, 22 nt, Homo sapiens
ucuugcacaaauuauuuuaacu

SEQ ID NO: 1205 - RNA, 22 nt, Homo sapiens
ugugauugauauauuuacagaa

SEQ ID NO: 1206 - RNA, 22 nt, Homo sapiens
agugcaaugauccggugcuggg

SEQ ID NO: 1207 - RNA, 22 nt, Homo sapiens
cucacagucagaagggacuugc

SEQ ID NO: 1208 - RNA, 22 nt, Homo sapiens
acugcacuccagcuuuggguga

SEQ ID NO: 1209 - RNA, 22 nt, Homo sapiens
aauuaggcuagaauguuauuaa

SEQ ID NO: 1210 - RNA, 22 nt, Homo sapiens
ugagcauuguuuggacuuggau

SEQ ID NO: 1211 - RNA, 22 nt, Homo sapiens
uuuggucuuuuguaaguuaucu

SEQ ID NO: 1212 - RNA, 19 nt, Homo sapiens
ugugagcauuagcauuuag

SEQ ID NO: 1213 - RNA, 22 nt, Homo sapiens
aacaccauucucuguaacaaga

SEQ ID NO: 1214 - RNA, 22 nt, Homo sapiens
agcuuuuugggaggccuuagga

SEQ ID NO: 1215 - RNA, 22 nt, Homo sapiens
aucagcagcaugaaaacaggcu

SEQ ID NO: 1216 - RNA, 22 nt, Homo sapiens
aaagggcacugugcuuuggcaa

SEQ ID NO: 1217 - RNA, 22 nt, Homo sapiens
ugcauaugucuuuauaguagca

SEQ ID NO: 1218 - RNA, 22 nt, Homo sapiens
aaggaauacuggugguugcuau

SEQ ID NO: 1219 - RNA, 22 nt, Homo sapiens
acacaugugaaaaaaauguuac

SEQ ID NO: 1220 - RNA, 22 nt, Homo sapiens
cuuuggcacuuccuaagugcca

SEQ ID NO: 1221 - RNA, 22 nt, Homo sapiens
guaucacggugucugcguugcu

SEQ ID NO: 1222 - RNA, 22 nt, Homo sapiens
guuagugcuuauuaaauaguau

SEQ ID NO: 1223 - RNA, 22 nt, Homo sapiens
ugcuuaggcuuccuuacaguau

SEQ ID NO: 1224 - RNA, 22 nt, Homo sapiens
cucagguaguuccuuauagcaa

SEQ ID NO: 1225 - RNA, 22 nt, Homo sapiens
aagugacuagacuaugaaaccu

SEQ ID NO: 1226 - RNA, 19 nt, Homo sapiens
gggucaguuugaaugauua

SEQ ID NO: 1227 - RNA, 22 nt, Homo sapiens
uuaaugcuuuugggauauuucu

SEQ ID NO: 1228 - RNA, 22 nt, Homo sapiens
uugcacucuagccugggugaca

SEQ ID NO: 1229 - RNA, 22 nt, Homo sapiens
uuuagcucauucaauuucaguc

SEQ ID NO: 1230 - RNA, 22 nt, Homo sapiens
uugugguuuuaucuaccuuugg

SEQ ID NO: 1231 - RNA, 20 nt, Homo sapiens
uaagugcuugaugaaugaac

SEQ ID NO: 1232 - RNA, 22 nt, Homo sapiens
cugagagugguauguuuaagug

SEQ ID NO: 1233 - RNA, 22 nt, Homo sapiens
acaugagacuggguuuguaggg

SEQ ID NO: 1234 - RNA, 22 nt, Homo sapiens
ugcaauuuaaugugucccaauu

SEQ ID NO: 1235 - RNA, 22 nt, Homo sapiens
uuguacucucaccguaucccag

SEQ ID NO: 1236 - RNA, 22 nt, Homo sapiens
augagcagaugcuccugccucu

SEQ ID NO: 1237 - RNA, 22 nt, Homo sapiens
ugugucuugagagucucgagaa

SEQ ID NO: 1238 - RNA, 22 nt, Homo sapiens
uccccggaugacggccgcuuca

SEQ ID NO: 1239 - RNA, 22 nt, Homo sapiens
caucacacuuggauguaagaca

SEQ ID NO: 1240 - RNA, 22 nt, Homo sapiens
uacagucuagaggagaaucagg

SEQ ID NO: 1241 - RNA, 22 nt, Homo sapiens
auggagaugaacuuggguaaag

SEQ ID NO: 1242 - RNA, 22 nt, Homo sapiens
uagacacuagauaugugacuga

SEQ ID NO: 1243 - RNA, 21 nt, Homo sapiens
cugaucacaggugagcugccu

SEQ ID NO: 1244 - RNA, 22 nt, Homo sapiens
uugagggaaacauucacaucau

SEQ ID NO: 1245 - RNA, 22 nt, Homo sapiens
aucucagagaaaauuacuaaga

SEQ ID NO: 1246 - RNA, 22 nt, Homo sapiens
ucucagcggacaggccggccag

SEQ ID NO: 1247 - RNA, 22 nt, Homo sapiens
auguguaaagcuuuucuuuguu

SEQ ID NO: 1248 - RNA, 22 nt, Homo sapiens
ucagguccuuacugugcucccu

SEQ ID NO: 1249 - RNA, 22 nt, Homo sapiens
uuauccugucaguaaauauuuu

SEQ ID NO: 1250 - RNA, 22 nt, Homo sapiens
ugaaggcaggagggagaaaagu

SEQ ID NO: 1251 - RNA, 22 nt, Homo sapiens
uugauaugguauaagauuucau

SEQ ID NO: 1252 - RNA, 22 nt, Homo sapiens
gugauaucuuacaauucucuuu

SEQ ID NO: 1253 - RNA, 18 nt, Homo sapiens
ucacauggccgagagaga

SEQ ID NO: 1254 - RNA, 22 nt, Homo sapiens
augccaagaugagcacgcgucu

SEQ ID NO: 1255 - RNA, 22 nt, Homo sapiens
uauugcuuaugaugcugaauua

SEQ ID NO: 1256 - RNA, 22 nt, Homo sapiens
uggccaagagcacagauauugg

SEQ ID NO: 1257 - RNA, 23 nt, Homo sapiens
cuuuugcaaugugaucuugccac

SEQ ID NO: 1258 - RNA, 22 nt, Homo sapiens
agagcaccauuuagcaagguga

SEQ ID NO: 1259 - RNA, 22 nt, Homo sapiens
uucucagugaaguuuagaacau

SEQ ID NO: 1260 - RNA, 22 nt, Homo sapiens
acucacagcaaccuccgccucc

SEQ ID NO: 1261 - RNA, 22 nt, Homo sapiens
gaagagacagguucccacaaaa

SEQ ID NO: 1262 - RNA, 22 nt, Homo sapiens
auaaacagcuuauccucuauuc

SEQ ID NO: 1263 - RNA, 22 nt, Homo sapiens
acccugugagagaguuaauauu

SEQ ID NO: 1264 - RNA, 17 nt, Homo sapiens
augaacucaucguucuu

SEQ ID NO: 1265 - RNA, 22 nt, Homo sapiens
uggguagagaaucaggaucuua

SEQ ID NO: 1266 - RNA, 22 nt, Homo sapiens
ugugcaugaaauuuaccuuuaa

SEQ ID NO: 1267 - RNA, 20 nt, Homo sapiens
uaguggcaugcaccuguagc

SEQ ID NO: 1268 - RNA, 22 nt, Homo sapiens
ggagauccucugcgggcaaaga

SEQ ID NO: 1269 - RNA, 22 nt, Homo sapiens
gcacauauguaaauagcugccu

SEQ ID NO: 1270 - RNA, 22 nt, Homo sapiens
aaaguaguagcaguuucugcca

SEQ ID NO: 1271 - RNA, 22 nt, Homo sapiens
ugggaauaugauacaggucuuu

SEQ ID NO: 1272 - RNA, 22 nt, Homo sapiens
guacaguauaguaauaggauuu

SEQ ID NO: 1273 - RNA, 22 nt, Homo sapiens
uuuaaugcaucccaaaauguag

SEQ ID NO: 1274 - RNA, 22 nt, Homo sapiens
ugagaagacaucagcuuucgga

SEQ ID NO: 1275 - RNA, 17 nt, Homo sapiens
uuagagguagacucauu

SEQ ID NO: 1276 - RNA, 22 nt, Homo sapiens
cucaggguacuucuccuuugcu

SEQ ID NO: 1277 - RNA, 22 nt, Homo sapiens
ucuuauuuggggaaaggguccu

SEQ ID NO: 1278 - RNA, 22 nt, Homo sapiens
ucacaugugaagauugggagua

SEQ ID NO: 1279 - RNA, 22 nt, Homo sapiens
uuagauuauugagcauccacug

SEQ ID NO: 1280 - RNA, 22 nt, Homo sapiens
ucacacugcaucuguuggaauu

SEQ ID NO: 1281 - RNA, 22 nt, Homo sapiens
augauauuauucuagcccagag

SEQ ID NO: 1282 - RNA, 22 nt, Homo sapiens
uugucaugguuaauuuuaugua

SEQ ID NO: 1283 - RNA, 22 nt, Homo sapiens
ugucaagaaaucaaggugugag

SEQ ID NO: 1284 - RNA, 22 nt, Homo sapiens
gugcacaucuguguuccagcua

SEQ ID NO: 1285 - RNA, 22 nt, Homo sapiens
gggcaacauugaguacccugaa

SEQ ID NO: 1286 - RNA, 19 nt, Homo sapiens
ugcuuauccagagaaacuu

SEQ ID NO: 1287 - RNA, 22 nt, Homo sapiens
uggcaagaacaacaauuacuuu

SEQ ID NO: 1288 - RNA, 22 nt, Homo sapiens
aaugugccuacagugggcuguu

SEQ ID NO: 1289 - RNA, 22 nt, Homo sapiens
ugaaauggaaagaguguagacu

SEQ ID NO: 1290 - RNA, 22 nt, Homo sapiens
auuuggcagugaagggaucaca

SEQ ID NO: 1291 - RNA, 22 nt, Homo sapiens
cauggcacauauauaucuaggu

SEQ ID NO: 1292 - RNA, 22 nt, Homo sapiens
uuugagaucuuuagaaucaggc

SEQ ID NO: 1293 - RNA, 22 nt, Homo sapiens
uagaaugcauuagguugcccag

SEQ ID NO: 1294 - RNA, 22 nt, Homo sapiens
uggcuguuuauuucaccugggu

SEQ ID NO: 1295 - RNA, 22 nt, Homo sapiens
auccaguguuuucuuuugucac

SEQ ID NO: 1296 - RNA, 22 nt, Homo sapiens
uuggcacugggaaaaugaccac

SEQ ID NO: 1297 - RNA, 22 nt, Homo sapiens
ugugacagguauccuguguucu

SEQ ID NO: 1298 - RNA, 22 nt, Homo sapiens
guguuugauugcaaauaaucua

SEQ ID NO: 1299 - RNA, 22 nt, Homo sapiens
caagugcuuucuuggggauuua

SEQ ID NO: 1300 - RNA, 20 nt, Homo sapiens
uauuugguuauuuccauggu

SEQ ID NO: 1301 - RNA, 22 nt, Homo sapiens
gacaucauuaugagauuuaaac

SEQ ID NO: 1302 - RNA, 22 nt, Homo sapiens
auagcagugugagaaugaacua

SEQ ID NO: 1303 - RNA, 22 nt, Homo sapiens
uucauaguauuuuucuccaaau

SEQ ID NO: 1304 - RNA, 18 nt, Homo sapiens
ucaaauacuuugggcagu

SEQ ID NO: 1305 - RNA, 22 nt, Homo sapiens
uugaaagcuaucagagauucca

SEQ ID NO: 1306 - RNA, 22 nt, Homo sapiens
aucaugucuucccagugauucu

SEQ ID NO: 1307 - RNA, 22 nt, Homo sapiens
cacugaaugugagguuggggag

SEQ ID NO: 1308 - RNA, 18 nt, Homo sapiens
agaguaucauuuccccca

SEQ ID NO: 1309 - RNA, 22 nt, Homo sapiens
gcugauguuggccucugggcuu

SEQ ID NO: 1310 - RNA, 22 nt, Homo sapiens
uauuaguuuucuguggauuaca

SEQ ID NO: 1311 - RNA, 17 nt, Homo sapiens
ugauaagugugagguga

SEQ ID NO: 1312 - RNA, 18 nt, Homo sapiens
auugcccucauggggcuu

SEQ ID NO: 1313 - RNA, 22 nt, Homo sapiens
aggcuaagaugacuccaccccc

SEQ ID NO: 1314 - RNA, 22 nt, Homo sapiens
ugaaggaguauggauaagucgu

SEQ ID NO: 1315 - RNA, 22 nt, Homo sapiens
uggcuagauauccagaguucug

SEQ ID NO: 1316 - RNA, 23 nt, Homo sapiens
ucucauuccuugaaaauaaugac

SEQ ID NO: 1317 - RNA, 22 nt, Homo sapiens
aucacauggccagguaguaauc

SEQ ID NO: 1318 - RNA, 22 nt, Homo sapiens
uaggacuuuucuugagagugac

SEQ ID NO: 1319 - RNA, 22 nt, Homo sapiens
uuucuugguuguauuuagacuu

SEQ ID NO: 1320 - RNA, 19 nt, Homo sapiens
aucuggaguuccuggggcu

SEQ ID NO: 1321 - RNA, 22 nt, Homo sapiens
ucagugaauguuggccacuacu

SEQ ID NO: 1322 - RNA, 17 nt, Homo sapiens
auaugucugcuggggga

SEQ ID NO: 1323 - RNA, 22 nt, Homo sapiens
ucccuuaaugaugaacaaugag

SEQ ID NO: 1324 - RNA, 22 nt, Homo sapiens
guaaaguaaagcacaucaaggu

SEQ ID NO: 1325 - RNA, 22 nt, Homo sapiens
uuccaguuauuauaccucuuaa

SEQ ID NO: 1326 - RNA, 22 nt, Homo sapiens
aucacugugauuucuacugugc

SEQ ID NO: 1327 - RNA, 22 nt, Homo sapiens
cucaguguucccauucuaccuu

SEQ ID NO: 1328 - RNA, 22 nt, Homo sapiens
agaagacuauucuggguugggc

SEQ ID NO: 1329 - RNA, 22 nt, Homo sapiens
gucaagugaagaccugacucuu

SEQ ID NO: 1330 - RNA, 22 nt, Homo sapiens
ugauaagaaauuguucauguag

SEQ ID NO: 1331 - RNA, 22 nt, Homo sapiens
augcaacugcacuccagccugg

SEQ ID NO: 1332 - RNA, 22 nt, Homo sapiens
ugaccacugucuaagauaggug

SEQ ID NO: 1333 - RNA, 22 nt, Homo sapiens
ugguuaucacuuuccuuccauc

SEQ ID NO: 1334 - RNA, 21 nt, Homo sapiens
gauaucuuuauucccaagagc

SEQ ID NO: 1335 - RNA, 22 nt, Homo sapiens
gcaagcuugcugggccugacuc

SEQ ID NO: 1336 - RNA, 22 nt, Homo sapiens
aaggcaagaaaauggauucucc

SEQ ID NO: 1337 - RNA, 22 nt, Homo sapiens
ucccaguauucauuuacagaag

SEQ ID NO: 1338 - RNA, 22 nt, Homo sapiens
auguggcacuugacuuucucgc

SEQ ID NO: 1339 - RNA, 16 nt, Homo sapiens
auaccacagugacaca

SEQ ID NO: 1340 - RNA, 22 nt, Homo sapiens
gugguucuagaauugaguaucc

SEQ ID NO: 1341 - RNA, 21 nt, Homo sapiens
uauaugacuuacuauugccuc

SEQ ID NO: 1342 - RNA, 22 nt, Homo sapiens
gaaagcugguauagauacauua

SEQ ID NO: 1343 - RNA, 22 nt, Homo sapiens
ggacaucauuaccauggaccca

SEQ ID NO: 1344 - RNA, 22 nt, Homo sapiens
acccuuuagguuggaugaggau

SEQ ID NO: 1345 - RNA, 22 nt, Homo sapiens
gugcagugugauccuuccguau

SEQ ID NO: 1346 - RNA, 22 nt, Homo sapiens
ugauugacauacauaggugugg

SEQ ID NO: 1347 - RNA, 22 nt, Homo sapiens
agcuauauugaggaugccauuc

SEQ ID NO: 1348 - RNA, 22 nt, Homo sapiens
gucccaguggaaccuccaagcu

SEQ ID NO: 1349 - RNA, 19 nt, Homo sapiens
gccaccuggugcguguucu

SEQ ID NO: 1350 - RNA, 22 nt, Homo sapiens
gguauuuaaaguaccugucugc

SEQ ID NO: 1351 - RNA, 22 nt, Homo sapiens
ugugauaguugcuguucugggc

SEQ ID NO: 1352 - RNA, 22 nt, Homo sapiens
uugugaguggugccgcaauaaa

SEQ ID NO: 1353 - RNA, 22 nt, Homo sapiens
uugugaauggugccacaauaaa

SEQ ID NO: 1354 - RNA, 22 nt, Homo sapiens
auucaucagggauauuggucug

SEQ ID NO: 1355 - RNA, 22 nt, Homo sapiens
ucaguaaauguuaggacauuuc

SEQ ID NO: 1356 - RNA, 22 nt, Homo sapiens
uccaugaguccauuagaaaaaa

SEQ ID NO: 1357 - RNA, 22 nt, Homo sapiens
uggucaaaugccaaucuguagu

SEQ ID NO: 1358 - RNA, 22 nt, Homo sapiens
uguccguuuuggcuuucucccu

SEQ ID NO: 1359 - RNA, 22 nt, Homo sapiens
gcagugugaucacagcuuacug

SEQ ID NO: 1360 - RNA, 22 nt, Homo sapiens
uaaauggauaaaugaauaccua

SEQ ID NO: 1361 - RNA, 22 nt, Homo sapiens
ugcaagacacuguccugggcau

SEQ ID NO: 1362 - RNA, 22 nt, Homo sapiens
ugcaccauugucaccuggguga

SEQ ID NO: 1363 - RNA, 21 nt, Homo sapiens
ugcauuggagaauguuucuca

SEQ ID NO: 1364 - RNA, 22 nt, Homo sapiens
caaagugguuuauacaugauug

SEQ ID NO: 1365 - RNA, 22 nt, Homo sapiens
ggucaagcuagauuuuaaugau

SEQ ID NO: 1366 - RNA, 22 nt, Homo sapiens
ucugagcaugcaucuugccugg

SEQ ID NO: 1367 - RNA, 22 nt, Homo sapiens
gauggcauuucuggaucugccc

SEQ ID NO: 1368 - RNA, 21 nt, Homo sapiens
ugcugcacuucuuuugcugug

SEQ ID NO: 1369 - RNA, 22 nt, Homo sapiens
uuugcgacuucugaguuaaugu

SEQ ID NO: 1370 - RNA, 22 nt, Homo sapiens
ugaaguguuuuuucaggcaugu

SEQ ID NO: 1371 - RNA, 22 nt, Homo sapiens
uuauguguuuaauguuucugaa

SEQ ID NO: 1372 - RNA, 22 nt, Homo sapiens
gugggguagcaggcuccuaucu

SEQ ID NO: 1373 - RNA, 19 nt, Homo sapiens
ggacugucauggaguaguu

SEQ ID NO: 1374 - RNA, 20 nt, Homo sapiens
uguaaaggagauugcagcug

SEQ ID NO: 1375 - RNA, 22 nt, Homo sapiens
aagcagacauguucauuuugaa

SEQ ID NO: 1376 - RNA, 22 nt, Homo sapiens
auggucuuuauuguguugagug

SEQ ID NO: 1377 - RNA, 22 nt, Homo sapiens
uguuaagaugucaauuuuccac

SEQ ID NO: 1378 - RNA, 17 nt, Homo sapiens
uuacaggugcugagagu

SEQ ID NO: 1379 - RNA, 22 nt, Homo sapiens
agcaucagugauuuuguugaag

SEQ ID NO: 1380 - RNA, 22 nt, Homo sapiens
uacugcacuggaggccucagau

SEQ ID NO: 1381 - RNA, 22 nt, Homo sapiens
uuggcaaucaauucugacgucu

SEQ ID NO: 1382 - RNA, 22 nt, Homo sapiens
gucauggugcuagcgggaaugu

SEQ ID NO: 1383 - RNA, 20 nt, Homo sapiens
auagaccauugguagguagg

SEQ ID NO: 1384 - RNA, 22 nt, Homo sapiens
gagcacugaauacugugguggu

SEQ ID NO: 1385 - RNA, 22 nt, Homo sapiens
uuuugcuuuuccucggucccac

SEQ ID NO: 1386 - RNA, 22 nt, Homo sapiens
uaucaccauguccguuuuaaaa

SEQ ID NO: 1387 - RNA, 22 nt, Homo sapiens
uggguagugucagcugauccau

SEQ ID NO: 1388 - RNA, 22 nt, Homo sapiens
cucccauugcaaacaacagaag

SEQ ID NO: 1389 - RNA, 19 nt, Homo sapiens
uuagguacuggauaugccc

SEQ ID NO: 1390 - RNA, 22 nt, Homo sapiens
ugugcgcaucggggccugcuuc

SEQ ID NO: 1391 - RNA, 22 nt, Homo sapiens
uuguuguggauuaaauuugcau

SEQ ID NO: 1392 - RNA, 22 nt, Homo sapiens
aacauguuuagcagauaccugu

SEQ ID NO: 1393 - RNA, 22 nt, Homo sapiens
uuccuugaaacagucaagagaa

SEQ ID NO: 1394 - RNA, 22 nt, Homo sapiens
auccuugagaaaauaaaugacc

SEQ ID NO: 1395 - RNA, 22 nt, Homo sapiens
uuugugcaugaagagggggugc

SEQ ID NO: 1396 - RNA, 22 nt, Homo sapiens
aagucaugaagaggaaaggaca

SEQ ID NO: 1397 - RNA, 22 nt, Homo sapiens
gaguucauuuugaaaccuugau

SEQ ID NO: 1398 - RNA, 22 nt, Homo sapiens
aguuccuacuggcuguaaagaa

SEQ ID NO: 1399 - RNA, 22 nt, Homo sapiens
auggcaagaagagcaauuauuu

SEQ ID NO: 1400 - RNA, 22 nt, Homo sapiens
gugauaucacuguaucacucca

SEQ ID NO: 1401 - RNA, 18 nt, Homo sapiens
ucuagacacugugucuau

SEQ ID NO: 1402 - RNA, 22 nt, Homo sapiens
aaccuguggauuuugguaucug

SEQ ID NO: 1403 - RNA, 22 nt, Homo sapiens
aaagugauuguaguuuuugcca

SEQ ID NO: 1404 - RNA, 22 nt, Homo sapiens
uuacaguaugaguaagaguucu

SEQ ID NO: 1405 - RNA, 22 nt, Homo sapiens
caguugcacuagccccguuuca

SEQ ID NO: 1406 - RNA, 22 nt, Homo sapiens
guaaguauuaggugugagauuc

SEQ ID NO: 1407 - RNA, 22 nt, Homo sapiens
cucauggaauacuucacagcca

SEQ ID NO: 1408 - RNA, 22 nt, Homo sapiens
cuucagcaauauauccccuggg

SEQ ID NO: 1409 - RNA, 22 nt, Homo sapiens
uagauuguaauaugcagaaugg

SEQ ID NO: 1410 - RNA, 22 nt, Homo sapiens
uccauaguacuagaaacugacc

SEQ ID NO: 1411 - RNA, 20 nt, Homo sapiens
uacauaguaaacugagagca

SEQ ID NO: 1412 - RNA, 18 nt, Homo sapiens
uccaguuuucccagcauc

SEQ ID NO: 1413 - RNA, 22 nt, Homo sapiens
uugguaggcuggccucucucag

SEQ ID NO: 1414 - RNA, 21 nt, Homo sapiens
uggaaugaauggccaacaugg

SEQ ID NO: 1415 - RNA, 20 nt, Homo sapiens
uuagcagcaugauuuauaau

SEQ ID NO: 1416 - RNA, 22 nt, Homo sapiens
uaucacaguaaaucugggugca

SEQ ID NO: 1417 - RNA, 22 nt, Homo sapiens
ggcaaggaggggcacuuucacu

SEQ ID NO: 1418 - RNA, 22 nt, Homo sapiens
uuauauguuuguacuuaggccu

SEQ ID NO: 1419 - RNA, 23 nt, Homo sapiens
ugauaacagcauaugaagauucu

SEQ ID NO: 1420 - RNA, 22 nt, Homo sapiens
ugugcacaacaugcagguuugu

SEQ ID NO: 1421 - RNA, 22 nt, Homo sapiens
gugagacugguucugaacccag

SEQ ID NO: 1422 - RNA, 22 nt, Homo sapiens
caaagcacuuggcuuggaagau

SEQ ID NO: 1423 - RNA, 22 nt, Homo sapiens
gagagcuaggccacuggggcuu

SEQ ID NO: 1424 - RNA, 22 nt, Homo sapiens
aucuaaaucucauaugggcaca

SEQ ID NO: 1425 - RNA, 22 nt, Homo sapiens
uucucuaguuacuuuaauggag

SEQ ID NO: 1426 - RNA, 22 nt, Homo sapiens
gaggaaguagcuacugucuuuc

SEQ ID NO: 1427 - RNA, 22 nt, Homo sapiens
uacuacuuucucuucugggaaa

SEQ ID NO: 1428 - RNA, 22 nt, Homo sapiens
uugaagguaggaugugcuauca

SEQ ID NO: 1429 - RNA, 22 nt, Homo sapiens
aucugguguggcugugauccuc

SEQ ID NO: 1430 - RNA, 16 nt, Homo sapiens
uuccacagucgaggug

SEQ ID NO: 1431 - RNA, 22 nt, Homo sapiens
uuccauguaguugagcaguuuu

SEQ ID NO: 1432 - RNA, 22 nt, Homo sapiens
cacaggaagaggcacggucccu

SEQ ID NO: 1433 - RNA, 22 nt, Homo sapiens
ucagacacuguggccuuuggac

SEQ ID NO: 1434 - RNA, 22 nt, Homo sapiens
augugcuugagggaaaucaguu

SEQ ID NO: 1435 - RNA, 22 nt, Homo sapiens
ugagaugagagaaugcuugccu

SEQ ID NO: 1436 - RNA, 22 nt, Homo sapiens
cugagcuagaccauuuggcucc

SEQ ID NO: 1437 - RNA, 22 nt, Homo sapiens
uugacauguaaguacucuauag

SEQ ID NO: 1438 - RNA, 22 nt, Homo sapiens
uauugcacuuuuccauaggagu

SEQ ID NO: 1439 - RNA, 16 nt, Homo sapiens
agccaccauuuacuug

SEQ ID NO: 1440 - RNA, 22 nt, Homo sapiens
uucagugucauuaacacaguag

SEQ ID NO: 1441 - RNA, 22 nt, Homo sapiens
ugagacaucugagauuuuaagc

SEQ ID NO: 1442 - RNA, 22 nt, Homo sapiens
augauagucuugagaagcauuu

SEQ ID NO: 1443 - RNA, 22 nt, Homo sapiens
auauuggacucugugcuaggaa

SEQ ID NO: 1444 - RNA, 22 nt, Homo sapiens
aucagaguugucagggagcuuu

SEQ ID NO: 1445 - RNA, 22 nt, Homo sapiens
cuucaugagacuuuuggaaggc

SEQ ID NO: 1446 - RNA, 20 nt, Homo sapiens
augaccuauggugguauaag

SEQ ID NO: 1447 - RNA, 22 nt, Homo sapiens
uucucaguaauuccagauuuuu

SEQ ID NO: 1448 - RNA, 22 nt, Homo sapiens
auuguacugccccccuguugcu

SEQ ID NO: 1449 - RNA, 22 nt, Homo sapiens
gggcaaauuauguaucucucag

SEQ ID NO: 1450 - RNA, 22 nt, Homo sapiens
auguggaaagcagcaugauaug

SEQ ID NO: 1451 - RNA, 20 nt, Homo sapiens
auagcauugauggacucaaa

SEQ ID NO: 1452 - RNA, 22 nt, Homo sapiens
ucauaucauuagaucuacugua

SEQ ID NO: 1453 - RNA, 22 nt, Homo sapiens
ugcaguacauucagcauccucu

SEQ ID NO: 1454 - RNA, 22 nt, Homo sapiens
augagcuaauauggguaaguug

SEQ ID NO: 1455 - RNA, 20 nt, Homo sapiens
ucaugccacugcgcuccagc

SEQ ID NO: 1456 - RNA, 20 nt, Homo sapiens
ucgcaccacuauacuccagc

SEQ ID NO: 1457 - RNA, 22 nt, Homo sapiens
aagauagcuaagcuucuucuaa

SEQ ID NO: 1458 - RNA, 22 nt, Homo sapiens
agagguauacauuugagagcca

SEQ ID NO: 1459 - RNA, 22 nt, Homo sapiens
gugguagaaaguaccaaacuag

SEQ ID NO: 1460 - RNA, 22 nt, Homo sapiens
cugguuguuacaaagagccugg

SEQ ID NO: 1461 - RNA, 22 nt, Homo sapiens
uaugcuuauaaacauuugucag

SEQ ID NO: 1462 - RNA, 20 nt, Homo sapiens
uggaggucaucugucacuac

SEQ ID NO: 1463 - RNA, 22 nt, Homo sapiens
ucacuggaggagaggaagugga

SEQ ID NO: 1464 - RNA, 22 nt, Homo sapiens
aacuugcacuugauugagagcu

SEQ ID NO: 1465 - RNA, 22 nt, Homo sapiens
agcuguaguuuauucauguuaa

SEQ ID NO: 1466 - RNA, 20 nt, Homo sapiens
uucacaggcagcuucuuucu

SEQ ID NO: 1467 - RNA, 22 nt, Homo sapiens
aauaaagccugucucuuuagag

SEQ ID NO: 1468 - RNA, 22 nt, Homo sapiens
cuguugguguuuaaucacugca

SEQ ID NO: 1469 - RNA, 22 nt, Homo sapiens
ucuggguuuuguaccgugcucg

SEQ ID NO: 1470 - RNA, 22 nt, Homo sapiens
uucaccuggaguucaggauaag

SEQ ID NO: 1471 - RNA, 22 nt, Homo sapiens
uuucugugguccucuugaaggu

SEQ ID NO: 1472 - RNA, 22 nt, Homo sapiens
cccucauucauucauccuaugu

SEQ ID NO: 1473 - RNA, 21 nt, Homo sapiens
uguauauguuuauacacacac

SEQ ID NO: 1474 - RNA, 22 nt, Homo sapiens
uugacaaugcacugugcuaagu

SEQ ID NO: 1475 - RNA, 22 nt, Homo sapiens
aaaugcaccacucuggugcagg

SEQ ID NO: 1476 - RNA, 22 nt, Homo sapiens
gucuuugagauaggguuauuuu

SEQ ID NO: 1477 - RNA, 22 nt, Homo sapiens
uacaagguaucagugaccguaa

SEQ ID NO: 1478 - RNA, 22 nt, Homo sapiens
uagugcugugauuaacauaaug

SEQ ID NO: 1479 - RNA, 22 nt, Homo sapiens
acaucccuuucccacccuucac

SEQ ID NO: 1480 - RNA, 22 nt, Homo sapiens
uugauaguccuguaucuauuuu

SEQ ID NO: 1481 - RNA, 17 nt, Homo sapiens
ugguagguuuuucuggc

SEQ ID NO: 1482 - RNA, 22 nt, Homo sapiens
cacugcacuccagucuggcgac

SEQ ID NO: 1483 - RNA, 22 nt, Homo sapiens
guaaacuuccccucaugaauga

SEQ ID NO: 1484 - RNA, 22 nt, Homo sapiens
guggaaguguaaaagcucuugg

SEQ ID NO: 1485 - RNA, 22 nt, Homo sapiens
gaucaguuucuggagauacgua

SEQ ID NO: 1486 - RNA, 22 nt, Homo sapiens
gucaguuugguuaaucauucca

SEQ ID NO: 1487 - RNA, 22 nt, Homo sapiens
uguuaagauguguuuuguggcu

SEQ ID NO: 1488 - RNA, 22 nt, Homo sapiens
agcagguguccacaauguuugc

SEQ ID NO: 1489 - RNA, 22 nt, Homo sapiens
uuggaccacuugauuucugguc

SEQ ID NO: 1490 - RNA, 22 nt, Homo sapiens
ccaugaacuagaauagaacaug

SEQ ID NO: 1491 - RNA, 22 nt, Homo sapiens
gugcacuguagaacccuuuguu

SEQ ID NO: 1492 - RNA, 22 nt, Homo sapiens
uccuugguugauccugugcaga

SEQ ID NO: 1493 - RNA, 20 nt, Homo sapiens
ugauguccaggcagagguuu

SEQ ID NO: 1494 - RNA, 22 nt, Homo sapiens
cuuaaggccagauaauuucuau

SEQ ID NO: 1495 - RNA, 22 nt, Homo sapiens
acauagaguaguggugaggaug

SEQ ID NO: 1496 - RNA, 18 nt, Homo sapiens
uggauuggaaaaguuccu

SEQ ID NO: 1497 - RNA, 22 nt, Homo sapiens
uugagcauugguauagguuuua

SEQ ID NO: 1498 - RNA, 22 nt, Homo sapiens
auguaauguuaaauugcuaauu

SEQ ID NO: 1499 - RNA, 22 nt, Homo sapiens
uugagguaggaggagcuuggau

SEQ ID NO: 1500 - RNA, 22 nt, Homo sapiens
cccugagaugugaauuucagag

SEQ ID NO: 1501 - RNA, 22 nt, Homo sapiens
uagguuauucauucaucauuua

SEQ ID NO: 1502 - RNA, 22 nt, Homo sapiens
guggaagaaaucagguuauuug

SEQ ID NO: 1503 - RNA, 22 nt, Homo sapiens
aauuaguuggcugggugcggug

SEQ ID NO: 1504 - RNA, 22 nt, Homo sapiens
uaaugcuccauggguuauuaaa

SEQ ID NO: 1505 - RNA, 22 nt, Homo sapiens
ugauuggagaacaaacugcaua

SEQ ID NO: 1506 - RNA, 22 nt, Homo sapiens
agaguacaggcaaguuagucau

SEQ ID NO: 1507 - RNA, 22 nt, Homo sapiens
ugauaugaaguucaaaccaggu

SEQ ID NO: 1508 - RNA, 22 nt, Homo sapiens
ucacgguggaaucccagauccc

SEQ ID NO: 1509 - RNA, 22 nt, Homo sapiens
uaugucacuggacauaaguucu

SEQ ID NO: 1510 - RNA, 22 nt, Homo sapiens
agcaccacaauuuccugccuaa

SEQ ID NO: 1511 - RNA, 23 nt, Homo sapiens
ugugacacuuccgucaguucauu

SEQ ID NO: 1512 - RNA, 19 nt, Homo sapiens
uuuuccccuuucuuaagac

SEQ ID NO: 1513 - RNA, 22 nt, Homo sapiens
ugaggcacucuagacuuauuca

SEQ ID NO: 1514 - RNA, 22 nt, Homo sapiens
uauuguccaauaggauguuccu

SEQ ID NO: 1515 - RNA, 22 nt, Homo sapiens
uugauauguuguuggauucacu

SEQ ID NO: 1516 - RNA, 21 nt, Homo sapiens
uggagugcaacacuagguaua

SEQ ID NO: 1517 - RNA, 22 nt, Homo sapiens
auugaguaaaaaauagugaugu

SEQ ID NO: 1518 - RNA, 22 nt, Homo sapiens
ugucacugugaguuugacugcu

SEQ ID NO: 1519 - RNA, 22 nt, Homo sapiens
auaaagcuauuccucucuuuuu

SEQ ID NO: 1520 - RNA, 22 nt, Homo sapiens
uuuaaacugucuuggguuugga

SEQ ID NO: 1521 - RNA, 22 nt, Homo sapiens
uucagagugaggcucucggaac

SEQ ID NO: 1522 - RNA, 22 nt, Homo sapiens
uagcuggaauuacuugcaccug

SEQ ID NO: 1523 - RNA, 22 nt, Homo sapiens
aaauccauuuguucagcuaugc

SEQ ID NO: 1524 - RNA, 22 nt, Homo sapiens
uuccauaggcuagaucaaccag

SEQ ID NO: 1525 - RNA, 22 nt, Homo sapiens
ugugccacugcacuucagccug

SEQ ID NO: 1526 - RNA, 22 nt, Homo sapiens
cugaugaaguauuuguucugga

SEQ ID NO: 1527 - RNA, 19 nt, Homo sapiens
uucucugguuguacuaccc

SEQ ID NO: 1528 - RNA, 22 nt, Homo sapiens
uacaggcagguguucccugguu

SEQ ID NO: 1529 - RNA, 22 nt, Homo sapiens
ucagcgggaguggaaagucaga

SEQ ID NO: 1530 - RNA, 22 nt, Homo sapiens
cagagucaagcucuuguuccau

SEQ ID NO: 1531 - RNA, 22 nt, Homo sapiens
cuuguaccccugagucccauaa

SEQ ID NO: 1532 - RNA, 22 nt, Homo sapiens
gugcuauguuguuuuggccgaa

SEQ ID NO: 1533 - RNA, 22 nt, Homo sapiens
auaaaccuacauuuucacuucu

SEQ ID NO: 1534 - RNA, 22 nt, Homo sapiens
gcacauuacaaguauuagcuca

SEQ ID NO: 1535 - RNA, 22 nt, Homo sapiens
ugacuagucauaggcauggggg

SEQ ID NO: 1536 - RNA, 18 nt, Homo sapiens
ugcuaugagauuauuuua

SEQ ID NO: 1537 - RNA, 21 nt, Homo sapiens
aucucacuugaauguaaaagc

SEQ ID NO: 1538 - RNA, 22 nt, Homo sapiens
gcagguguuaugcaaacaacug

SEQ ID NO: 1539 - RNA, 22 nt, Homo sapiens
uuaguaguagcugcaugucagu

SEQ ID NO: 1540 - RNA, 22 nt, Homo sapiens
acugcacuccggccuggcaaca

SEQ ID NO: 1541 - RNA, 22 nt, Homo sapiens
auugcacuccagccuggugaca

SEQ ID NO: 1542 - RNA, 23 nt, Homo sapiens
ugacauguaauucaguccagcag

SEQ ID NO: 1543 - RNA, 22 nt, Homo sapiens
ucacugcacuucaggcuuucuc

SEQ ID NO: 1544 - RNA, 22 nt, Homo sapiens
ugugucuuguuuauagcuuucu

SEQ ID NO: 1545 - RNA, 22 nt, Homo sapiens
cacugcauggccacccauguua

SEQ ID NO: 1546 - RNA, 22 nt, Homo sapiens
uaaaugcucuuuaaaagugcuu

SEQ ID NO: 1547 - RNA, 22 nt, Homo sapiens
uaagugcuguguuguuaccuaa

SEQ ID NO: 1548 - RNA, 22 nt, Homo sapiens
gacuggccauugauacagaggu

SEQ ID NO: 1549 - RNA, 22 nt, Homo sapiens
ucugucacugaaucccugucac

SEQ ID NO: 1550 - RNA, 22 nt, Homo sapiens
ucacugaaaccuccgccuucug

SEQ ID NO: 1551 - RNA, 22 nt, Homo sapiens
uuaaagccauaccugagagagu

SEQ ID NO: 1552 - RNA, 22 nt, Homo sapiens
agcuggcuguagcugcaagucu

SEQ ID NO: 1553 - RNA, 22 nt, Homo sapiens
guacauguaugcaugcaugcau

SEQ ID NO: 1554 - RNA, 22 nt, Homo sapiens
uccuugagccugggaguuauag

SEQ ID NO: 1555 - RNA, 22 nt, Homo sapiens
gucauugcuuaaggguucaugc

SEQ ID NO: 1556 - RNA, 22 nt, Homo sapiens
uauagcuugaaggaauggucau

SEQ ID NO: 1557 - RNA, 22 nt, Homo sapiens
uugcaacauuguaaguuuauau

SEQ ID NO: 1558 - RNA, 18 nt, Homo sapiens
uuguggccccuacaaauu

SEQ ID NO: 1559 - RNA, 22 nt, Homo sapiens
cagaucaucuugagcuuaggaa

SEQ ID NO: 1560 - RNA, 22 nt, Homo sapiens
ugcauauguucaaaguauucug

SEQ ID NO: 1561 - RNA, 22 nt, Homo sapiens
uugcauagaccgaugucuugga

SEQ ID NO: 1562 - RNA, 22 nt, Homo sapiens
gccauagucauagauggcaggg

SEQ ID NO: 1563 - RNA, 22 nt, Homo sapiens
cugaugguuuuacacaagggca

SEQ ID NO: 1564 - RNA, 18 nt, Homo sapiens
ugccuacugggcucaagc

SEQ ID NO: 1565 - RNA, 22 nt, Homo sapiens
aagggaauguuguggcugguug

SEQ ID NO: 1566 - RNA, 22 nt, Homo sapiens
uucaguggacuuaguagugcuu

SEQ ID NO: 1567 - RNA, 22 nt, Homo sapiens
ccuugcacuucccaagugaggc

SEQ ID NO: 1568 - RNA, 22 nt, Homo sapiens
ucugugcggucuguguuaugaa

SEQ ID NO: 1569 - RNA, 22 nt, Homo sapiens
uagcacuauuuuucacuauccu

SEQ ID NO: 1570 - RNA, 22 nt, Homo sapiens
cugacuaguuuuaaugcagauu

SEQ ID NO: 1571 - RNA, 22 nt, Homo sapiens
ucacaugugacauauauauuug

SEQ ID NO: 1572 - RNA, 22 nt, Homo sapiens
uucaagcuauggugaucuuuuc

SEQ ID NO: 1573 - RNA, 22 nt, Homo sapiens
acuuuuugaugaggucguuugu

SEQ ID NO: 1574 - RNA, 22 nt, Homo sapiens
cuuuaguuaaaauugggguugu

SEQ ID NO: 1575 - RNA, 22 nt, Homo sapiens
cuguucaggaggcauuuggugg

SEQ ID NO: 1576 - RNA, 22 nt, Homo sapiens
accccgagacugccaagaaucc

SEQ ID NO: 1577 - RNA, 20 nt, Homo sapiens
agagaucaguaauucaucaa

SEQ ID NO: 1578 - RNA, 22 nt, Homo sapiens
cagucacugggauuauggucau

SEQ ID NO: 1579 - RNA, 22 nt, Homo sapiens
gaaggugcuuggugaaugcauu

SEQ ID NO: 1580 - RNA, 22 nt, Homo sapiens
ugaacagcaccuccuagaguug

SEQ ID NO: 1581 - RNA, 22 nt, Homo sapiens
aucccuguguccagcaccugug

SEQ ID NO: 1582 - RNA, 22 nt, Homo sapiens
cccagugguuacauaaggagua

SEQ ID NO: 1583 - RNA, 22 nt, Homo sapiens
uacaguccaugcauuauccucc

SEQ ID NO: 1584 - RNA, 22 nt, Homo sapiens
ugaguauagaucaguucaagug

SEQ ID NO: 1585 - RNA, 20 nt, Homo sapiens
ccccuggaguggggcugcuu

SEQ ID NO: 1586 - RNA, 22 nt, Homo sapiens
uaucacagguggacugcacacc

SEQ ID NO: 1587 - RNA, 22 nt, Homo sapiens
uucucugggacauaggucgggu

SEQ ID NO: 1588 - RNA, 22 nt, Homo sapiens
gaucuggagguuuuccucauga

SEQ ID NO: 1589 - RNA, 22 nt, Homo sapiens
uggaauacuauucugugcugga

SEQ ID NO: 1590 - RNA, 20 nt, Homo sapiens
guggaaguagaaacauaugu

SEQ ID NO: 1591 - RNA, 22 nt, Homo sapiens
uucuggaaaucagcagagggug

SEQ ID NO: 1592 - RNA, 22 nt, Homo sapiens
ugagaacauuccucuuccuggc

SEQ ID NO: 1593 - RNA, 22 nt, Homo sapiens
ugguccaguucugugauauugc

SEQ ID NO: 1594 - RNA, 22 nt, Homo sapiens
aggugguuuugaugagcaggua

SEQ ID NO: 1595 - RNA, 22 nt, Homo sapiens
guuaugacacucuuuuuaucau

SEQ ID NO: 1596 - RNA, 22 nt, Homo sapiens
uaccaaguauuuucacaugaac

SEQ ID NO: 1597 - RNA, 22 nt, Homo sapiens
uuuuaguugcucagguauucuc

SEQ ID NO: 1598 - RNA, 22 nt, Homo sapiens
uugugguuuuuaaaacuaggug

SEQ ID NO: 1599 - RNA, 22 nt, Homo sapiens
aguucaaaucgagccuggccau

SEQ ID NO: 1600 - RNA, 22 nt, Homo sapiens
uugugcuccuaugagaaucuaa

SEQ ID NO: 1601 - RNA, 22 nt, Homo sapiens
acugcacuccagccuguugaca

SEQ ID NO: 1602 - RNA, 22 nt, Homo sapiens
gucaaagucuauuggcuaauuc

SEQ ID NO: 1603 - RNA, 22 nt, Homo sapiens
agagguaagaauaguaguugga

SEQ ID NO: 1604 - RNA, 22 nt, Homo sapiens
ggcaagaaccacaauuacuuuu

SEQ ID NO: 1605 - RNA, 22 nt, Homo sapiens
ugacaagggaaaugcaaaaugu

SEQ ID NO: 1606 - RNA, 22 nt, Homo sapiens
ugagugugaggaagaauuagaa

SEQ ID NO: 1607 - RNA, 22 nt, Homo sapiens
aggcauguggcucuguucugac

SEQ ID NO: 1608 - RNA, 22 nt, Homo sapiens
uacaaagcuuucugcaaaucau

SEQ ID NO: 1609 - RNA, 21 nt, Homo sapiens
aaucacugucuguuuccccuu

SEQ ID NO: 1610 - RNA, 22 nt, Homo sapiens
augagagcuaacuguggguaca

SEQ ID NO: 1611 - RNA, 22 nt, Homo sapiens
ucaaggcacuagcugagcugca

SEQ ID NO: 1612 - RNA, 22 nt, Homo sapiens
uugcacuucauguaggccaaag

SEQ ID NO: 1613 - RNA, 18 nt, Homo sapiens
acccuucagcacugggcc

SEQ ID NO: 1614 - RNA, 22 nt, Homo sapiens
uggucaccuucuugcucugucu

SEQ ID NO: 1615 - RNA, 22 nt, Homo sapiens
auggcuagauuguaugguaguu

SEQ ID NO: 1616 - RNA, 22 nt, Homo sapiens
uaucacuguuguuuguuuaagg

SEQ ID NO: 1617 - RNA, 22 nt, Homo sapiens
uugcacuccagcucuaggugac

SEQ ID NO: 1618 - RNA, 22 nt, Homo sapiens
guagaucucaacacuggaagua

SEQ ID NO: 1619 - RNA, 22 nt, Homo sapiens
ggacuggaagcauauuuauuuu

SEQ ID NO: 1620 - RNA, 22 nt, Homo sapiens
gucacuguuuccuauuauauuu

SEQ ID NO: 1621 - RNA, 22 nt, Homo sapiens
cucuuuuguuccuaguuugauc

SEQ ID NO: 1622 - RNA, 22 nt, Homo sapiens
ugacuugaucauuacacauucu

SEQ ID NO: 1623 - RNA, 22 nt, Homo sapiens
gucagucugucccugccuggcg

SEQ ID NO: 1624 - RNA, 22 nt, Homo sapiens
ugagaugcucgccggccagcau

SEQ ID NO: 1625 - RNA, 22 nt, Homo sapiens
ucacauggcagagaagaagcuc

SEQ ID NO: 1626 - RNA, 20 nt, Homo sapiens
ugugaacuguagauagucuu

SEQ ID NO: 1627 - RNA, 22 nt, Homo sapiens
gcuaggagaucugcugcucucu

SEQ ID NO: 1628 - RNA, 22 nt, Homo sapiens
uggucguggagucccuggcuuc

SEQ ID NO: 1629 - RNA, 20 nt, Homo sapiens
ugcagauucaaccaacugug

SEQ ID NO: 1630 - RNA, 22 nt, Homo sapiens
ucacauggggaagggacuagcu

SEQ ID NO: 1631 - RNA, 22 nt, Homo sapiens
aucauccagccccagaagggag

SEQ ID NO: 1632 - RNA, 22 nt, Homo sapiens
acccuguaggugcuggcagaga

SEQ ID NO: 1633 - RNA, 22 nt, Homo sapiens
ugagauggagucuugucgccua

SEQ ID NO: 1634 - RNA, 22 nt, Homo sapiens
auugcagcccacccugggugau

SEQ ID NO: 1635 - RNA, 22 nt, Homo sapiens
agguaagaugugacuugguguu

SEQ ID NO: 1636 - RNA, 22 nt, Homo sapiens
auggcacuguguauuuuucugu

SEQ ID NO: 1637 - RNA, 23 nt, Homo sapiens
agcaaaugcucuagcacuccaac

SEQ ID NO: 1638 - RNA, 22 nt, Homo sapiens
uacagaauugcagguguggcag

SEQ ID NO: 1639 - RNA, 22 nt, Homo sapiens
ggcauuguccaauuucugcccu

SEQ ID NO: 1640 - RNA, 22 nt, Homo sapiens
aucacuuucuauuucugugcca

SEQ ID NO: 1641 - RNA, 22 nt, Homo sapiens
augaaugucuuauuuugagaaa

SEQ ID NO: 1642 - RNA, 22 nt, Homo sapiens
uacuagaggaaaacuugaagac

SEQ ID NO: 1643 - RNA, 22 nt, Homo sapiens
aaaugcucuuuaugaaguugga

SEQ ID NO: 1644 - RNA, 22 nt, Homo sapiens
uuggcaauucagauucuuuuau

SEQ ID NO: 1645 - RNA, 22 nt, Homo sapiens
auagcagcucacuuauuuaugg

SEQ ID NO: 1646 - RNA, 22 nt, Homo sapiens
uagagcuaguuuuuaaucuaac

SEQ ID NO: 1647 - RNA, 22 nt, Homo sapiens
augggguaggcuuugcugcagu

SEQ ID NO: 1648 - RNA, 22 nt, Homo sapiens
uuagaugaagucacagaaccca

SEQ ID NO: 1649 - RNA, 22 nt, Homo sapiens
cugugaacaugggagaaauggc

SEQ ID NO: 1650 - RNA, 22 nt, Homo sapiens
gugcacaacgugcaggcuuguu

SEQ ID NO: 1651 - RNA, 22 nt, Homo sapiens
uuacuggcuuucacugguguua

SEQ ID NO: 1652 - RNA, 22 nt, Homo sapiens
uggcaucuguucuacacauaaa

SEQ ID NO: 1653 - RNA, 19 nt, Homo sapiens
gacaugagauuuggugggg

SEQ ID NO: 1654 - RNA, 23 nt, Homo sapiens
auuaagguuacuacaguaugagg

SEQ ID NO: 1655 - RNA, 22 nt, Homo sapiens
ucauugguagcucauggaaccg

SEQ ID NO: 1656 - RNA, 19 nt, Homo sapiens
uuacacaaccuaguggggc

SEQ ID NO: 1657 - RNA, 22 nt, Homo sapiens
ucccuacuggggcacugccuag

SEQ ID NO: 1658 - RNA, 18 nt, Homo sapiens
auauugcauuggauggau

SEQ ID NO: 1659 - RNA, 22 nt, Homo sapiens
uagacaacugaaacacugugca

SEQ ID NO: 1660 - RNA, 20 nt, Homo sapiens
cauugcacuccagccugcug

SEQ ID NO: 1661 - RNA, 22 nt, Homo sapiens
acagguacaagggauuaggaug

SEQ ID NO: 1662 - RNA, 22 nt, Homo sapiens
aguaccauuacucacuuauuuu

SEQ ID NO: 1663 - RNA, 22 nt, Homo sapiens
uaauagagucauuauuauuguu

SEQ ID NO: 1664 - RNA, 22 nt, Homo sapiens
cuuccauaguauuuuuacaaaa

SEQ ID NO: 1665 - RNA, 22 nt, Homo sapiens
ugaucugucacuuaucacauuu

SEQ ID NO: 1666 - RNA, 19 nt, Homo sapiens
uaugcuagagagggaagcu

SEQ ID NO: 1667 - RNA, 22 nt, Homo sapiens
guaucucaguucucgugauuag

SEQ ID NO: 1668 - RNA, 22 nt, Homo sapiens
uauaguuuuuccugggaggaaa

SEQ ID NO: 1669 - RNA, 22 nt, Homo sapiens
acugcacugcagccuggccaac

SEQ ID NO: 1670 - RNA, 22 nt, Homo sapiens
acugcacuccagccugcccaac

SEQ ID NO: 1671 - RNA, 22 nt, Homo sapiens
auggcuuaagacaaccuuucau

SEQ ID NO: 1672 - RNA, 22 nt, Homo sapiens
ccucauggagaacuucugcuag

SEQ ID NO: 1673 - RNA, 22 nt, Homo sapiens
uagauaguuaugauuugaugau

SEQ ID NO: 1674 - RNA, 22 nt, Homo sapiens
ccuguguuaugguuucuaaugu

SEQ ID NO: 1675 - RNA, 23 nt, Homo sapiens
aagugagcuccaauugggugaga

SEQ ID NO: 1676 - RNA, 22 nt, Homo sapiens
ugcauggagauauacaguuuuu

SEQ ID NO: 1677 - RNA, 22 nt, Homo sapiens
uuuguacuugaaacccagggcc

SEQ ID NO: 1678 - RNA, 22 nt, Homo sapiens
uggccagagggcaauuagcugu

SEQ ID NO: 1679 - RNA, 22 nt, Homo sapiens
auguagauaucaagaggcauau

SEQ ID NO: 1680 - RNA, 22 nt, Homo sapiens
aacuggcauaugaacuuguucu

SEQ ID NO: 1681 - RNA, 18 nt, Homo sapiens
cuuccuuagucugguuaa

SEQ ID NO: 1682 - RNA, 22 nt, Homo sapiens
acaaagcuagggaauccaucuu

SEQ ID NO: 1683 - RNA, 22 nt, Homo sapiens
auaaaagcaggucuaggucagg

SEQ ID NO: 1684 - RNA, 20 nt, Homo sapiens
ccaguguuauuuauguucua

SEQ ID NO: 1685 - RNA, 22 nt, Homo sapiens
cauugcacuccaucuugggcaa

SEQ ID NO: 1686 - RNA, 20 nt, Homo sapiens
aucucugggcaaaggaaaau

SEQ ID NO: 1687 - RNA, 22 nt, Homo sapiens
gcuagcacauugucaccucuca

SEQ ID NO: 1688 - RNA, 22 nt, Homo sapiens
uuauuugguuauuguaauuggg

SEQ ID NO: 1689 - RNA, 22 nt, Homo sapiens
gaggcaaugugcccggcccaca

SEQ ID NO: 1690 - RNA, 22 nt, Homo sapiens
uugagauguggguuggugacuu

SEQ ID NO: 1691 - RNA, 22 nt, Homo sapiens
uauacgugcagaucacagggga

SEQ ID NO: 1692 - RNA, 22 nt, Homo sapiens
ugugcguguaagagaucuaggu

SEQ ID NO: 1693 - RNA, 22 nt, Homo sapiens
agcuguaguuugguggauguaa

SEQ ID NO: 1694 - RNA, 23 nt, Homo sapiens
agguuaugauuauagagcgagga

SEQ ID NO: 1695 - RNA, 22 nt, Homo sapiens
ugauguaggcauuuaagguuau

SEQ ID NO: 1696 - RNA, 19 nt, Homo sapiens
agccaguuuucccagcacc

SEQ ID NO: 1697 - RNA, 22 nt, Homo sapiens
gugaggucagggcuguggacag

SEQ ID NO: 1698 - RNA, 22 nt, Homo sapiens
uucagugccuggaagucgugcu

SEQ ID NO: 1699 - RNA, 22 nt, Homo sapiens
gaauagugcugcaagaaacaua

SEQ ID NO: 1700 - RNA, 22 nt, Homo sapiens
augaggugggcggcuuggaaga

SEQ ID NO: 1701 - RNA, 22 nt, Homo sapiens
cugugcuugauuauaugagugu

SEQ ID NO: 1702 - RNA, 22 nt, Homo sapiens
agagugcaaagguuggggcugg

SEQ ID NO: 1703 - RNA, 22 nt, Homo sapiens
uauaccacugauuuuauucuga

SEQ ID NO: 1704 - RNA, 22 nt, Homo sapiens
uuggcagaaaaggucggggguu

SEQ ID NO: 1705 - RNA, 22 nt, Homo sapiens
agcuuguauuuguagccuguug

SEQ ID NO: 1706 - RNA, 22 nt, Homo sapiens
uuagcacaguucauucauguua

SEQ ID NO: 1707 - RNA, 21 nt, Homo sapiens
auuguauguaaaccaaaugag

SEQ ID NO: 1708 - RNA, 23 nt, Homo sapiens
cucccugaacaugacacaccaga

SEQ ID NO: 1709 - RNA, 22 nt, Homo sapiens
ucucccauccguacacggauug

SEQ ID NO: 1710 - RNA, 22 nt, Homo sapiens
ucucaaguaacugggacaauaa

SEQ ID NO: 1711 - RNA, 17 nt, Homo sapiens
cuaaggcaagagucugc

SEQ ID NO: 1712 - RNA, 22 nt, Homo sapiens
ggcaagaagagaguuuaaacau

SEQ ID NO: 1713 - RNA, 22 nt, Homo sapiens
acuuugcuuaucccaggcacug

SEQ ID NO: 1714 - RNA, 22 nt, Homo sapiens
uucuugguugcucacacccauc

SEQ ID NO: 1715 - RNA, 20 nt, Homo sapiens
ugagcucaauuguugcaagu

SEQ ID NO: 1716 - RNA, 22 nt, Homo sapiens
auugcacuccagccuaggcaac

SEQ ID NO: 1717 - RNA, 22 nt, Homo sapiens
aggaguguguauuaaugaaauu

SEQ ID NO: 1718 - RNA, 22 nt, Homo sapiens
uaccuaguguugacuucucuuc

SEQ ID NO: 1719 - RNA, 22 nt, Homo sapiens
aucauguuuauguguaggauau

SEQ ID NO: 1720 - RNA, 22 nt, Homo sapiens
auugcacuccagccugggcagc

SEQ ID NO: 1721 - RNA, 19 nt, Homo sapiens
uaucacuucccuggaaaca

SEQ ID NO: 1722 - RNA, 22 nt, Homo sapiens
agggccuuuguagauguacuca

SEQ ID NO: 1723 - RNA, 22 nt, Homo sapiens
uugagguagcuuugauggaggu

SEQ ID NO: 1724 - RNA, 23 nt, Homo sapiens
uuaguaaacucaaugacaccaca

SEQ ID NO: 1725 - RNA, 22 nt, Homo sapiens
ugaaaugucuuuaggaggcuuc

SEQ ID NO: 1726 - RNA, 22 nt, Homo sapiens
cauugcacuccagccugcugac

SEQ ID NO: 1727 - RNA, 22 nt, Homo sapiens
aagcagauguguugaaaguacu

SEQ ID NO: 1728 - RNA, 22 nt, Homo sapiens
gcacauggccccaucgugccga

SEQ ID NO: 1729 - RNA, 22 nt, Homo sapiens
aucagugcauguuuguugagcu

SEQ ID NO: 1730 - RNA, 22 nt, Homo sapiens
ucaccgugaauuaacaacacuu

SEQ ID NO: 1731 - RNA, 22 nt, Homo sapiens
uuugucccuuugcaguggcaca

SEQ ID NO: 1732 - RNA, 22 nt, Homo sapiens
ucacauagcauaaugucugcaa

SEQ ID NO: 1733 - RNA, 22 nt, Homo sapiens
ugacuacaaccuccaccucccg

SEQ ID NO: 1734 - RNA, 22 nt, Homo sapiens
uuugauuguacuaaaauuguac

SEQ ID NO: 1735 - RNA, 22 nt, Homo sapiens
ucuuaguuugggguggggauag

SEQ ID NO: 1736 - RNA, 22 nt, Homo sapiens
uugguuaccuucagaaaugagu

SEQ ID NO: 1737 - RNA, 20 nt, Homo sapiens
ugagaugcauugggauguuu

SEQ ID NO: 1738 - RNA, 22 nt, Homo sapiens
cuagacuagacccaaauugaag

SEQ ID NO: 1739 - RNA, 22 nt, Homo sapiens
uagcaacauucagcucagguac

SEQ ID NO: 1740 - RNA, 22 nt, Homo sapiens
gagguguagagauauaccugaa

SEQ ID NO: 1741 - RNA, 22 nt, Homo sapiens
uuucccauuguucugcucugug

SEQ ID NO: 1742 - RNA, 22 nt, Homo sapiens
ggaguguguaggagaaagguaa

SEQ ID NO: 1743 - RNA, 22 nt, Homo sapiens
cuuugugugggccaagggcugg

SEQ ID NO: 1744 - RNA, 22 nt, Homo sapiens
uucccagagagggacuucuaau

SEQ ID NO: 1745 - RNA, 22 nt, Homo sapiens
ucacauucaauuguaauccccg

SEQ ID NO: 1746 - RNA, 22 nt, Homo sapiens
caucccauucgaggggcacagc

SEQ ID NO: 1747 - RNA, 22 nt, Homo sapiens
uaucacagaggguauccuagag

SEQ ID NO: 1748 - RNA, 22 nt, Homo sapiens
ucgagcaauugucaugucucag

SEQ ID NO: 1749 - RNA, 22 nt, Homo sapiens
auggcagcugacacuuccgucu

SEQ ID NO: 1750 - RNA, 22 nt, Homo sapiens
auggauuuuaggauacaguuga

SEQ ID NO: 1751 - RNA, 22 nt, Homo sapiens
guacacguggcuguguaggagu

SEQ ID NO: 1752 - RNA, 17 nt, Homo sapiens
gaucacagucgucuccu

SEQ ID NO: 1753 - RNA, 22 nt, Homo sapiens
ucaaaguaaagccucaggaugg

SEQ ID NO: 1754 - RNA, 22 nt, Homo sapiens
guguagagaaaaguaccauuuu

SEQ ID NO: 1755 - RNA, 22 nt, Homo sapiens
ucagaaccucugauuuauacuu

SEQ ID NO: 1756 - RNA, 22 nt, Homo sapiens
aggacacugagcaugggagguu

SEQ ID NO: 1757 - RNA, 22 nt, Homo sapiens
aggugcucuuccuguaggucac

SEQ ID NO: 1758 - RNA, 22 nt, Homo sapiens
agccaguauuuugaguuggucu

SEQ ID NO: 1759 - RNA, 22 nt, Homo sapiens
uagacacugcauauuuuuuuaa

SEQ ID NO: 1760 - RNA, 22 nt, Homo sapiens
uguaaaccauauauguauguag

SEQ ID NO: 1761 - RNA, 22 nt, Homo sapiens
agguaauuuucccagagggaaa

SEQ ID NO: 1762 - RNA, 22 nt, Homo sapiens
uaggaaguuuucuugcugggcc

SEQ ID NO: 1763 - RNA, 22 nt, Homo sapiens
uguggcuucuuugguucaguau

SEQ ID NO: 1764 - RNA, 22 nt, Homo sapiens
aucugugaaugaaguuauuuug

SEQ ID NO: 1765 - RNA, 22 nt, Homo sapiens
aggaaguaauaaguuugguucu

SEQ ID NO: 1766 - RNA, 22 nt, Homo sapiens
aagucaaggagagaggcgucag

SEQ ID NO: 1767 - RNA, 22 nt, Homo sapiens
acugcacuccagccuugugaca

SEQ ID NO: 1768 - RNA, 20 nt, Homo sapiens
ucaaggcaggaacuguacau

SEQ ID NO: 1769 - RNA, 22 nt, Homo sapiens
augaacuaugugggauguuuua

SEQ ID NO: 1770 - RNA, 22 nt, Homo sapiens
gauuucacuuucuggaugugca

SEQ ID NO: 1771 - RNA, 22 nt, Homo sapiens
uguaauguuugguagguuaggu

SEQ ID NO: 1772 - RNA, 22 nt, Homo sapiens
ugcccuguaucccacuguuuca

SEQ ID NO: 1773 - RNA, 22 nt, Homo sapiens
uagguagcuuuggcguuucuug

SEQ ID NO: 1774 - RNA, 22 nt, Homo sapiens
cauugcuuuuggugguuuagac

SEQ ID NO: 1775 - RNA, 22 nt, Homo sapiens
gugaacagcagaugagugagug

SEQ ID NO: 1776 - RNA, 22 nt, Homo sapiens
ggagauguuuaaccuuuuaucu

SEQ ID NO: 1777 - RNA, 22 nt, Homo sapiens
gcugugauucuguguagauagu

SEQ ID NO: 1778 - RNA, 22 nt, Homo sapiens
ccaguguuuuugaauuccagga

SEQ ID NO: 1779 - RNA, 22 nt, Homo sapiens
uugaauguaugcuggguuuacu

SEQ ID NO: 1780 - RNA, 22 nt, Homo sapiens
cugcaagaugcauaggaauuuu

SEQ ID NO: 1781 - RNA, 22 nt, Homo sapiens
aacagcuaguaccaauccacua

SEQ ID NO: 1782 - RNA, 22 nt, Homo sapiens
uuuagggcaggccuggugguga

SEQ ID NO: 1783 - RNA, 22 nt, Homo sapiens
uuaaaguguuuucaaaauguca

SEQ ID NO: 1784 - RNA, 22 nt, Homo sapiens
acugagccuuuaaaugacuuca

SEQ ID NO: 1785 - RNA, 22 nt, Homo sapiens
aucgcacuccauccugggcaac

SEQ ID NO: 1786 - RNA, 22 nt, Homo sapiens
guggcacgaugaucugggcuca

SEQ ID NO: 1787 - RNA, 21 nt, Homo sapiens
cuuugguagaguuuuuagggu

SEQ ID NO: 1788 - RNA, 22 nt, Homo sapiens
auaugcacgugcauacacacuu

SEQ ID NO: 1789 - RNA, 22 nt, Homo sapiens
gacuagugcccucagaccuaga

SEQ ID NO: 1790 - RNA, 22 nt, Homo sapiens
aucugacuuuuaauuugaaaac

SEQ ID NO: 1791 - RNA, 22 nt, Homo sapiens
uuggaaggcugaauggccucuc

SEQ ID NO: 1792 - RNA, 22 nt, Homo sapiens
cagugguuuuuagcuugcuggg

SEQ ID NO: 1793 - RNA, 21 nt, Homo sapiens
aucaccgugcaguucuccagg

SEQ ID NO: 1794 - RNA, 22 nt, Homo sapiens
gugauaguucuuacuccaaagu

SEQ ID NO: 1795 - RNA, 22 nt, Homo sapiens
gugcacaacgugcagguuaguu

SEQ ID NO: 1796 - RNA, 22 nt, Homo sapiens
cugagauuaagauauugggagu

SEQ ID NO: 1797 - RNA, 20 nt, Homo sapiens
aucagagccggugaaagggc

SEQ ID NO: 1798 - RNA, 22 nt, Homo sapiens
uuauacuacuauaaagagguag

SEQ ID NO: 1799 - RNA, 22 nt, Homo sapiens
gagauagguauuucauuuaccc

SEQ ID NO: 1800 - RNA, 22 nt, Homo sapiens
caccgagguuggagugcagugg

SEQ ID NO: 1801 - RNA, 22 nt, Homo sapiens
uauugcuaaauucuuuuccuag

SEQ ID NO: 1802 - RNA, 22 nt, Homo sapiens
cacugcaguaaauugcgucggu

SEQ ID NO: 1803 - RNA, 22 nt, Homo sapiens
gacacuggguguuuguuggcgu

SEQ ID NO: 1804 - RNA, 22 nt, Homo sapiens
uuggcuacagauuaugaauuuc

SEQ ID NO: 1805 - RNA, 20 nt, Homo sapiens
gcugugcuuaauacacuuuc

SEQ ID NO: 1806 - RNA, 22 nt, Homo sapiens
aguauugcuaauaagagauuug

SEQ ID NO: 1807 - RNA, 22 nt, Homo sapiens
cauggcuuucacaguaaagccu

SEQ ID NO: 1808 - RNA, 22 nt, Homo sapiens
uuggaaacgucaccuuuuccuu

SEQ ID NO: 1809 - RNA, 22 nt, Homo sapiens
aucaaguaaucugaguaagagu

SEQ ID NO: 1810 - RNA, 21 nt, Homo sapiens
uggauuguacacccuaucauu

SEQ ID NO: 1811 - RNA, 22 nt, Homo sapiens
uuaaggcuuuaaguaaacacag

SEQ ID NO: 1812 - RNA, 22 nt, Homo sapiens
aauagcauugaaucuaccaauu

SEQ ID NO: 1813 - RNA, 22 nt, Homo sapiens
ugagacugaguuucacuuuugu

SEQ ID NO: 1814 - RNA, 22 nt, Homo sapiens
ucaaguacugccuugcucuggc

SEQ ID NO: 1815 - RNA, 22 nt, Homo sapiens
uugaaguaugaccgcugagaau

SEQ ID NO: 1816 - RNA, 22 nt, Homo sapiens
ugagguagaggugaacuugacc

SEQ ID NO: 1817 - RNA, 21 nt, Homo sapiens
uugccugacacuggaagaaau

SEQ ID NO: 1818 - RNA, 22 nt, Homo sapiens
aggcaguuucagugagagguga

SEQ ID NO: 1819 - RNA, 22 nt, Homo sapiens
uuguaaaguucuuaggaagcuc

SEQ ID NO: 1820 - RNA, 23 nt, Homo sapiens
ucacaguggcugcuuaauuguga

SEQ ID NO: 1821 - RNA, 19 nt, Homo sapiens
uuauauaguuucugaggcu

SEQ ID NO: 1822 - RNA, 22 nt, Homo sapiens
gccgagagauuuggaaugggga

SEQ ID NO: 1823 - RNA, 22 nt, Homo sapiens
uagugcuagaugacuuugccau

SEQ ID NO: 1824 - RNA, 22 nt, Homo sapiens
guguucaaagcugauugagauu

SEQ ID NO: 1825 - RNA, 22 nt, Homo sapiens
auugagcuuuuuaaaauauagu

SEQ ID NO: 1826 - RNA, 22 nt, Homo sapiens
ugcuuuguugaaaaucauuugg

SEQ ID NO: 1827 - RNA, 22 nt, Homo sapiens
cacaguguuacugguaugaagu

SEQ ID NO: 1828 - RNA, 22 nt, Homo sapiens
ggcaaauucuuguaugccuacu

SEQ ID NO: 1829 - RNA, 18 nt, Homo sapiens
ccauucaacagauuuguc

SEQ ID NO: 1830 - RNA, 22 nt, Homo sapiens
gaucaauuggcugaagacacgu

SEQ ID NO: 1831 - RNA, 22 nt, Homo sapiens
gucagugucuuaacagagauua

SEQ ID NO: 1832 - RNA, 22 nt, Homo sapiens
cacacugucuucauuacuguag

SEQ ID NO: 1833 - RNA, 22 nt, Homo sapiens
uugguaccccugguguacuaau

SEQ ID NO: 1834 - RNA, 22 nt, Homo sapiens
cuccuguagccccaucaucuuu

SEQ ID NO: 1835 - RNA, 22 nt, Homo sapiens
acuacauaugacaucuucuuua

SEQ ID NO: 1836 - RNA, 22 nt, Homo sapiens
ucagaugaugucccuguucuaa

SEQ ID NO: 1837 - RNA, 21 nt, Homo sapiens
acaguaguaauaguguagcca

SEQ ID NO: 1838 - RNA, 23 nt, Homo sapiens
auauaguagaugugcaguaacau

SEQ ID NO: 1839 - RNA, 22 nt, Homo sapiens
gcgcagugggcugugccaucca

SEQ ID NO: 1840 - RNA, 22 nt, Homo sapiens
ccaaguguucucauuguucaau

SEQ ID NO: 1841 - RNA, 22 nt, Homo sapiens
uuucgguuaucuagcuuuauga

SEQ ID NO: 1842 - RNA, 21 nt, Homo sapiens
uagcuacacugugauucaugg

SEQ ID NO: 1843 - RNA, 22 nt, Homo sapiens
cauugcacucuaucccgguggg

SEQ ID NO: 1844 - RNA, 22 nt, Homo sapiens
uagaaguaggcuacgugucugg

SEQ ID NO: 1845 - RNA, 22 nt, Homo sapiens
gcaagagguaucuuauuuuccc

SEQ ID NO: 1846 - RNA, 22 nt, Homo sapiens
uagccuguggugaauguuucug

SEQ ID NO: 1847 - RNA, 22 nt, Homo sapiens
ugucaguguaugagccccggau

SEQ ID NO: 1848 - RNA, 17 nt, Homo sapiens
cccuaguagcugggacu

SEQ ID NO: 1849 - RNA, 22 nt, Homo sapiens
acagugcuucugauaugaugcc

SEQ ID NO: 1850 - RNA, 22 nt, Homo sapiens
gugcuuuguuguggcaguggca

SEQ ID NO: 1851 - RNA, 22 nt, Homo sapiens
uagcacagggaauugguucucu

SEQ ID NO: 1852 - RNA, 22 nt, Homo sapiens
uaaagcuagaauuguuccagca

SEQ ID NO: 1853 - RNA, 22 nt, Homo sapiens
auggucccuguuccaugcuccu

SEQ ID NO: 1854 - RNA, 22 nt, Homo sapiens
acugcacuccagccuuggagac

SEQ ID NO: 1855 - RNA, 22 nt, Homo sapiens
aagugguuuuuacaaagacaga

SEQ ID NO: 1856 - RNA, 22 nt, Homo sapiens
ugaguagaacaucaagucauac

SEQ ID NO: 1857 - RNA, 22 nt, Homo sapiens
accagucucagguaugucuuua

SEQ ID NO: 1858 - RNA, 22 nt, Homo sapiens
uagcugcaaaauauagacuucu

SEQ ID NO: 1859 - RNA, 22 nt, Homo sapiens
aacagauugcugagccccaccc

SEQ ID NO: 1860 - RNA, 16 nt, Homo sapiens
gacaugaucuuguuua

SEQ ID NO: 1861 - RNA, 21 nt, Homo sapiens
uggaccccuacuucucaccau

SEQ ID NO: 1862 - RNA, 22 nt, Homo sapiens
uugagauggagucucgcugugu

SEQ ID NO: 1863 - RNA, 22 nt, Homo sapiens
ugagaugagggaagccuaggca

SEQ ID NO: 1864 - RNA, 20 nt, Homo sapiens
ugagcucaugacauuuuucu

SEQ ID NO: 1865 - RNA, 22 nt, Homo sapiens
ugagaugagucucgcucuguca

SEQ ID NO: 1866 - RNA, 22 nt, Homo sapiens
ggacuguaguuucccgggcugg

SEQ ID NO: 1867 - RNA, 21 nt, Homo sapiens
gucugguguuuuaaugaggac

SEQ ID NO: 1868 - RNA, 22 nt, Homo sapiens
uauggcacacguuuaccuaugu

SEQ ID NO: 1869 - RNA, 22 nt, Homo sapiens
gcuguguugugcccagcaucau

SEQ ID NO: 1870 - RNA, 22 nt, Homo sapiens
ugacauggagggugcggcugca

SEQ ID NO: 1871 - RNA, 22 nt, Homo sapiens
acuccauuuggacucugggagg

SEQ ID NO: 1872 - RNA, 22 nt, Homo sapiens
accuggcacuuagcaaaucuga

SEQ ID NO: 1873 - RNA, 22 nt, Homo sapiens
ggcccugauacaaguaaggucu

SEQ ID NO: 1874 - RNA, 22 nt, Homo sapiens
uagagcucaucuucuuuaaacu

SEQ ID NO: 1875 - RNA, 22 nt, Homo sapiens
uagagccauugcagauguuuga

SEQ ID NO: 1876 - RNA, 22 nt, Homo sapiens
cagggcaugugggucuauuggc

SEQ ID NO: 1877 - RNA, 22 nt, Homo sapiens
auggcacagacucuuggucaag

SEQ ID NO: 1878 - RNA, 22 nt, Homo sapiens
auaacaggaaauacagggcuuu

SEQ ID NO: 1879 - RNA, 22 nt, Homo sapiens
aagugcucuugaaacugucuua

SEQ ID NO: 1880 - RNA, 22 nt, Homo sapiens
uuaacagucacuuagcucauuu

SEQ ID NO: 1881 - RNA, 22 nt, Homo sapiens
gccauugcacuccagccuaggc

SEQ ID NO: 1882 - RNA, 22 nt, Homo sapiens
uguccguuuuguuucaggcuca

SEQ ID NO: 1883 - RNA, 22 nt, Homo sapiens
guugcaugucugggaggccagc

SEQ ID NO: 1884 - RNA, 19 nt, Homo sapiens
augccucaguuuuguacuu

SEQ ID NO: 1885 - RNA, 22 nt, Homo sapiens
gugauagaucugggauucagaa

SEQ ID NO: 1886 - RNA, 22 nt, Homo sapiens
accugguuuuaacauuguauua

SEQ ID NO: 1887 - RNA, 22 nt, Homo sapiens
ugagaagaugaacuccuugguc

SEQ ID NO: 1888 - RNA, 22 nt, Homo sapiens
cauggcuuuaagcaacaccaag

SEQ ID NO: 1889 - RNA, 22 nt, Homo sapiens
aaaugccucccauucuacugac

SEQ ID NO: 1890 - RNA, 21 nt, Homo sapiens
uuggucuucucugugauucuu

SEQ ID NO: 1891 - RNA, 22 nt, Homo sapiens
acaaccauuguaagggcuuugg

SEQ ID NO: 1892 - RNA, 22 nt, Homo sapiens
uucagugguuauuugugagauu

SEQ ID NO: 1893 - RNA, 22 nt, Homo sapiens
gagaugaucaugugguuuuguc

SEQ ID NO: 1894 - RNA, 22 nt, Homo sapiens
ccacacugucuuggugggaaac

SEQ ID NO: 1895 - RNA, 17 nt, Homo sapiens
augaagucaucauuuuu

SEQ ID NO: 1896 - RNA, 22 nt, Homo sapiens
uauagcuagugauuguguguau

SEQ ID NO: 1897 - RNA, 22 nt, Homo sapiens
ccugagacuugagggggcuucu

SEQ ID NO: 1898 - RNA, 22 nt, Homo sapiens
aagugcugggauuggccgggca

SEQ ID NO: 1899 - RNA, 19 nt, Homo sapiens
uccccuguggauaccaaga

SEQ ID NO: 1900 - RNA, 17 nt, Homo sapiens
ccccugagcgaugcagu

SEQ ID NO: 1901 - RNA, 17 nt, Homo sapiens
cuuguugugguaguuug

SEQ ID NO: 1902 - RNA, 22 nt, Homo sapiens
auuguucuuacaugcugucauc

SEQ ID NO: 1903 - RNA, 22 nt, Homo sapiens
gugguacuaucuuugguuucag

SEQ ID NO: 1904 - RNA, 22 nt, Homo sapiens
uaaagaugcugggaaggcuagg

SEQ ID NO: 1905 - RNA, 22 nt, Homo sapiens
uaaaugacugucaguagaugaa

SEQ ID NO: 1906 - RNA, 22 nt, Homo sapiens
gcaguauuguugaaauguccau

SEQ ID NO: 1907 - RNA, 22 nt, Homo sapiens
uuuugguuaggauggguggcau

SEQ ID NO: 1908 - RNA, 22 nt, Homo sapiens
uuguuaagaugcagauucugga

SEQ ID NO: 1909 - RNA, 22 nt, Homo sapiens
cuggcacccuugcuuaggaaga

SEQ ID NO: 1910 - RNA, 22 nt, Homo sapiens
agcacuacugcacuccagccug

SEQ ID NO: 1911 - RNA, 22 nt, Homo sapiens
ugaacuaguaguuuacuugaug

SEQ ID NO: 1912 - RNA, 22 nt, Homo sapiens
acuugacacuuauauuacucac

SEQ ID NO: 1913 - RNA, 22 nt, Homo sapiens
gucuccggcuguccuuugaggu

SEQ ID NO: 1914 - RNA, 22 nt, Homo sapiens
cuggaaagaaacccuuaauucu

SEQ ID NO: 1915 - RNA, 22 nt, Homo sapiens
ucuugcauuuuuaaauagugcu

SEQ ID NO: 1916 - RNA, 22 nt, Homo sapiens
uggcaagaaggauuuauuccuu

SEQ ID NO: 1917 - RNA, 22 nt, Homo sapiens
ucacacgugaacucaucacaga

SEQ ID NO: 1918 - RNA, 22 nt, Homo sapiens
ugagcugagaucgugccauugu

SEQ ID NO: 1919 - RNA, 22 nt, Homo sapiens
cuaugcuuucugggcccugggu

SEQ ID NO: 1920 - RNA, 22 nt, Homo sapiens
ugugaucaauuagugaugucug

SEQ ID NO: 1921 - RNA, 22 nt, Homo sapiens
gugugucuugaccaggaucgga

SEQ ID NO: 1922 - RNA, 22 nt, Homo sapiens
ugacauguagagaacuucucau

SEQ ID NO: 1923 - RNA, 22 nt, Homo sapiens
uuagaauggaaaugcgagguua

SEQ ID NO: 1924 - RNA, 22 nt, Homo sapiens
gugauguguuucaacagcuccu

SEQ ID NO: 1925 - RNA, 22 nt, Homo sapiens
ucacaaguguauagacaugucc

SEQ ID NO: 1926 - RNA, 22 nt, Homo sapiens
auagacacugaaaucccugcca

SEQ ID NO: 1927 - RNA, 22 nt, Homo sapiens
uaggugaaugcuggaagaaaug

SEQ ID NO: 1928 - RNA, 22 nt, Homo sapiens
cacuaggcuggagugcaguggc

SEQ ID NO: 1929 - RNA, 22 nt, Homo sapiens
gagccauggagaaaacagcuau

SEQ ID NO: 1930 - RNA, 23 nt, Homo sapiens
ccgugagagaguucauagaaagc

SEQ ID NO: 1931 - RNA, 22 nt, Homo sapiens
uuuaguacugcuuuaugugugu

SEQ ID NO: 1932 - RNA, 22 nt, Homo sapiens
acuuuuugauggggagaacauu

SEQ ID NO: 1933 - RNA, 22 nt, Homo sapiens
uucaccuugggucccacuugcu

SEQ ID NO: 1934 - RNA, 22 nt, Homo sapiens
ucaaguacuuauuugauaauua

SEQ ID NO: 1935 - RNA, 22 nt, Homo sapiens
aagaggccuaggaaucuguauu

SEQ ID NO: 1936 - RNA, 22 nt, Homo sapiens
agagauaaagauuuuaauuuug

SEQ ID NO: 1937 - RNA, 22 nt, Homo sapiens
agguuaugauuauagagcgagg

SEQ ID NO: 1938 - RNA, 22 nt, Homo sapiens
ucuugcuuuugcagagcuucuc

SEQ ID NO: 1939 - RNA, 22 nt, Homo sapiens
augcaaacaucugaagagacau

SEQ ID NO: 1940 - RNA, 22 nt, Homo sapiens
uuggcaauauuuacugaaguug

SEQ ID NO: 1941 - RNA, 22 nt, Homo sapiens
ugcauugcacuugcaugagaua

SEQ ID NO: 1942 - RNA, 22 nt, Homo sapiens
ugucauggugcucugggcccug

SEQ ID NO: 1943 - RNA, 22 nt, Homo sapiens
auggaggaggaagcugaaacaa

SEQ ID NO: 1944 - RNA, 22 nt, Homo sapiens
uuguauguuuguucuuucagau

SEQ ID NO: 1945 - RNA, 22 nt, Homo sapiens
gcacccugucaaaauggaccaa

SEQ ID NO: 1946 - RNA, 22 nt, Homo sapiens
agguaaacauggggacugcuac

SEQ ID NO: 1947 - RNA, 16 nt, Homo sapiens
ggaggucaucugggaa

SEQ ID NO: 1948 - RNA, 22 nt, Homo sapiens
cauagcacugagcucuacccuc

SEQ ID NO: 1949 - RNA, 22 nt, Homo sapiens
auuggaacugaaauaauaacuu

SEQ ID NO: 1950 - RNA, 22 nt, Homo sapiens
uuggcuguguuucccuacaaau

SEQ ID NO: 1951 - RNA, 22 nt, Homo sapiens
agguauguuuuaugguccauaa

SEQ ID NO: 1952 - RNA, 22 nt, Homo sapiens
auggaguuuacuuaguguaaua

SEQ ID NO: 1953 - RNA, 19 nt, Homo sapiens
uuugccuaggcacauggcc

SEQ ID NO: 1954 - RNA, 22 nt, Homo sapiens
uuggcagugcccgaugcugggg

SEQ ID NO: 1955 - RNA, 22 nt, Homo sapiens
aaagugcugggauuggcugggc

SEQ ID NO: 1956 - RNA, 22 nt, Homo sapiens
cgcaguguuugugucccugggu

SEQ ID NO: 1957 - RNA, 22 nt, Homo sapiens
ugucaaggaaugucauugguuu

SEQ ID NO: 1958 - RNA, 22 nt, Homo sapiens
gaguauguauaugagugugucu

SEQ ID NO: 1959 - RNA, 22 nt, Homo sapiens
aagaugcagucauacuggagga

SEQ ID NO: 1960 - RNA, 22 nt, Homo sapiens
caauacuguguugaauaagagu

SEQ ID NO: 1961 - RNA, 22 nt, Homo sapiens
ugaggacugagaggcacugugg

SEQ ID NO: 1962 - RNA, 22 nt, Homo sapiens
ugauggccuguucuccauaugu

SEQ ID NO: 1963 - RNA, 22 nt, Homo sapiens
uguggaguguaugugacagaga

SEQ ID NO: 1964 - RNA, 22 nt, Homo sapiens
ugcuuagucuugcuuuagcuau

SEQ ID NO: 1965 - RNA, 22 nt, Homo sapiens
uugagcaaugucacugaggcuu

SEQ ID NO: 1966 - RNA, 21 nt, Homo sapiens
aggugucuuggguucccuggc

SEQ ID NO: 1967 - RNA, 22 nt, Homo sapiens
uagaauguaaauuccaagggca

SEQ ID NO: 1968 - RNA, 22 nt, Homo sapiens
uggagcccuaaacuucuaauau

SEQ ID NO: 1969 - RNA, 22 nt, Homo sapiens
uagcaguauggagcgaggccca

SEQ ID NO: 1970 - RNA, 22 nt, Homo sapiens
uuagcagcucuggugacaaggu

SEQ ID NO: 1971 - RNA, 22 nt, Homo sapiens
auggcauuuuuagggcugggug

SEQ ID NO: 1972 - RNA, 22 nt, Homo sapiens
auucaagugaugcagcuguuuu

SEQ ID NO: 1973 - RNA, 22 nt, Homo sapiens
acacauuagcaagugcuguuau

SEQ ID NO: 1974 - RNA, 22 nt, Homo sapiens
cugugcauaugacuuuauugga

SEQ ID NO: 1975 - RNA, 16 nt, Homo sapiens
ugugaucuuuuuucuu

SEQ ID NO: 1976 - RNA, 22 nt, Homo sapiens
uucugccaaucaacccacaucc

SEQ ID NO: 1977 - RNA, 22 nt, Homo sapiens
auaaagcaaauaggacuauugc

SEQ ID NO: 1978 - RNA, 22 nt, Homo sapiens
ucaaacugcuugaggccauuua

SEQ ID NO: 1979 - RNA, 22 nt, Homo sapiens
cacugcaguguaauuaagguug

SEQ ID NO: 1980 - RNA, 22 nt, Homo sapiens
ggagucugauguucuaaggcag

SEQ ID NO: 1981 - RNA, 21 nt, Homo sapiens
aaaugcacauuacugcuggug

SEQ ID NO: 1982 - RNA, 21 nt, Homo sapiens
aggagcauucaugacgagguu

SEQ ID NO: 1983 - RNA, 22 nt, Homo sapiens
agugguuuuggaauggaauuca

SEQ ID NO: 1984 - RNA, 20 nt, Homo sapiens
ugguaauguaagagaggaga

SEQ ID NO: 1985 - RNA, 22 nt, Homo sapiens
aacuggccuggcgugcagaggg

SEQ ID NO: 1986 - RNA, 22 nt, Homo sapiens
aggagguagaacauugccauuu

SEQ ID NO: 1987 - RNA, 22 nt, Homo sapiens
ugacaucguugccauguuaugc

SEQ ID NO: 1988 - RNA, 22 nt, Homo sapiens
ugccuacugaauuuaccuggcu

SEQ ID NO: 1989 - RNA, 22 nt, Homo sapiens
uagaucacucaggcaauaaaag

SEQ ID NO: 1990 - RNA, 22 nt, Homo sapiens
uacucugcagccauaaaacaga

SEQ ID NO: 1991 - RNA, 22 nt, Homo sapiens
gugacugggaguggugaagaua

SEQ ID NO: 1992 - RNA, 22 nt, Homo sapiens
uuugugcugcaauuaauuuccc

SEQ ID NO: 1993 - RNA, 22 nt, Homo sapiens
auguugcaguuuaauuauccua

SEQ ID NO: 1994 - RNA, 22 nt, Homo sapiens
agugauggagccaggauuuaau

SEQ ID NO: 1995 - RNA, 22 nt, Homo sapiens
uaggagugugaacccuaugaac

SEQ ID NO: 1996 - RNA, 22 nt, Homo sapiens
gcaugcacaugugaaaaaauga

SEQ ID NO: 1997 - RNA, 22 nt, Homo sapiens
gaugaacugucuuacuacucac

SEQ ID NO: 1998 - RNA, 22 nt, Homo sapiens
gggagguaggaguuauuauuuu

SEQ ID NO: 1999 - RNA, 22 nt, Homo sapiens
ucugugcauuguaacaacuaaa

SEQ ID NO: 2000 - RNA, 17 nt, Homo sapiens
gcaguacuuaguaagga

SEQ ID NO: 2001 - RNA, 22 nt, Homo sapiens
acccaguguucaacauucacau

SEQ ID NO: 2002 - RNA, 22 nt, Homo sapiens
ggcaagaacuucacucacuuuu

SEQ ID NO: 2003 - RNA, 22 nt, Homo sapiens
gugagauuaguucuggaccugg

SEQ ID NO: 2004 - RNA, 22 nt, Homo sapiens
uucaugugagucuguauuaacu

SEQ ID NO: 2005 - RNA, 22 nt, Homo sapiens
aaaguucugcguuagggcuaaa

SEQ ID NO: 2006 - RNA, 22 nt, Homo sapiens
auggagcuugacaguuguagag

SEQ ID NO: 2007 - RNA, 22 nt, Homo sapiens
uaccucuguaaguaaagauuca

SEQ ID NO: 2008 - RNA, 22 nt, Homo sapiens
uucccuagaacacauggaggga

SEQ ID NO: 2009 - RNA, 22 nt, Homo sapiens
gauaagagaugauuuugccaug

SEQ ID NO: 2010 - RNA, 23 nt, Homo sapiens
uggcaagaauucuuaccgugugg

SEQ ID NO: 2011 - RNA, 22 nt, Homo sapiens
augagauucuuagagaagucug

SEQ ID NO: 2012 - RNA, 22 nt, Homo sapiens
uuucuuggagcucuuagggucg

SEQ ID NO: 2013 - RNA, 22 nt, Homo sapiens
guguucaaacccaggucugucu

SEQ ID NO: 2014 - RNA, 22 nt, Homo sapiens
gugguguccugcaccuauaguc

SEQ ID NO: 2015 - RNA, 22 nt, Homo sapiens
auacaagugccauguuggugug

SEQ ID NO: 2016 - RNA, 20 nt, Homo sapiens
ucacauccucucccaacaug

SEQ ID NO: 2017 - RNA, 22 nt, Homo sapiens
agcuggaauuuaagguagauag

SEQ ID NO: 2018 - RNA, 22 nt, Homo sapiens
augaagagaaaguggaucuugg

SEQ ID NO: 2019 - RNA, 22 nt, Homo sapiens
agugcauuuguucugugucagg

SEQ ID NO: 2020 - RNA, 22 nt, Homo sapiens
uuuuucacuuaaguuaggcuca

SEQ ID NO: 2021 - RNA, 22 nt, Homo sapiens
ugaaugauuuuaaaagccucuc

SEQ ID NO: 2022 - RNA, 22 nt, Homo sapiens
auuauugacucauagaaaggau

SEQ ID NO: 2023 - RNA, 22 nt, Homo sapiens
ugcucaguuuaaaacuuuugag

SEQ ID NO: 2024 - RNA, 22 nt, Homo sapiens
uucucaauggaugugggaccag

SEQ ID NO: 2025 - RNA, 22 nt, Homo sapiens
ucaacaggucaauugcauagaa

SEQ ID NO: 2026 - RNA, 22 nt, Homo sapiens
cagugcauccauguucagcagu

SEQ ID NO: 2027 - RNA, 18 nt, Homo sapiens
guaaauguaucuauugcc

SEQ ID NO: 2028 - RNA, 22 nt, Homo sapiens
auggcuguuuuuuauguuacag

SEQ ID NO: 2029 - RNA, 22 nt, Homo sapiens
uucauugaaugauuuuuagaag

SEQ ID NO: 2030 - RNA, 22 nt, Homo sapiens
gugggaagcuggaacucccucc

SEQ ID NO: 2031 - RNA, 22 nt, Homo sapiens
gcccuguugcccaggcuggagu

SEQ ID NO: 2032 - RNA, 22 nt, Homo sapiens
ugugauuauuuaaauaggacag

SEQ ID NO: 2033 - RNA, 22 nt, Homo sapiens
uuggauauucaguuuuuccauc

SEQ ID NO: 2034 - RNA, 22 nt, Homo sapiens
aaagugguuuuucagacuuuga

SEQ ID NO: 2035 - RNA, 22 nt, Homo sapiens
ugacaggagauuaugugauguu

SEQ ID NO: 2036 - RNA, 22 nt, Homo sapiens
gucaaggaauuuauccauuucu

SEQ ID NO: 2037 - RNA, 22 nt, Homo sapiens
aggcaugaguucagaggguaug

SEQ ID NO: 2038 - RNA, 22 nt, Homo sapiens
ucauacuguccaauucuagugg

SEQ ID NO: 2039 - RNA, 22 nt, Homo sapiens
uuugaaguguggcacugaguuu

SEQ ID NO: 2040 - RNA, 22 nt, Homo sapiens
gugcuuguguuaauauguagcu

SEQ ID NO: 2041 - RNA, 22 nt, Homo sapiens
ucccugaacacauguugagaag

SEQ ID NO: 2042 - RNA, 22 nt, Homo sapiens
uucccagucaaacgaaggacuu

SEQ ID NO: 2043 - RNA, 22 nt, Homo sapiens
uuccguguaguugagcaguuuu

SEQ ID NO: 2044 - RNA, 22 nt, Homo sapiens
gaugacagugaguaaccccaac

SEQ ID NO: 2045 - RNA, 22 nt, Homo sapiens
aguauuuguuggaauaccuguu

SEQ ID NO: 2046 - RNA, 22 nt, Homo sapiens
gcuacugucuaucugugcuucu

SEQ ID NO: 2047 - RNA, 22 nt, Homo sapiens
ugcaagaaucuuucaggcuagc

SEQ ID NO: 2048 - RNA, 22 nt, Homo sapiens
ucuuuguugcauaggcuuguuc

SEQ ID NO: 2049 - RNA, 19 nt, Homo sapiens
ucacaggguugacuugagg

SEQ ID NO: 2050 - RNA, 22 nt, Homo sapiens
ugcaagaugagauuuuggaugg

SEQ ID NO: 2051 - RNA, 22 nt, Homo sapiens
gaggguguuguguugcuuaaua

SEQ ID NO: 2052 - RNA, 22 nt, Homo sapiens
cauugcaaugaggucuugcagu

SEQ ID NO: 2053 - RNA, 22 nt, Homo sapiens
uuuugguauauacggggguccu

SEQ ID NO: 2054 - RNA, 22 nt, Homo sapiens
uugacauauuugugcuuaagaa

SEQ ID NO: 2055 - RNA, 22 nt, Homo sapiens
uugcagagucaguuauuuugcc

SEQ ID NO: 2056 - RNA, 21 nt, Homo sapiens
uccagcuuugagaguuguggu

SEQ ID NO: 2057 - RNA, 23 nt, Homo sapiens
ucuggcuuugggaugcucaaggg

SEQ ID NO: 2058 - RNA, 22 nt, Homo sapiens
aauugcacuaagcauaguccag

SEQ ID NO: 2059 - RNA, 22 nt, Homo sapiens
gcauggaaggcgcuuugugacu

SEQ ID NO: 2060 - RNA, 22 nt, Homo sapiens
gacccuguugggguuuagggcu

SEQ ID NO: 2061 - RNA, 19 nt, Homo sapiens
uaccagcacaguguuugag

SEQ ID NO: 2062 - RNA, 22 nt, Homo sapiens
ucucuguuuagagccagcaauu

SEQ ID NO: 2063 - RNA, 22 nt, Homo sapiens
acuggcuguuaggaauuaccuc

SEQ ID NO: 2064 - RNA, 21 nt, Homo sapiens
auacuugcauccuuggagaga

SEQ ID NO: 2065 - RNA, 16 nt, Homo sapiens
uguaaauguuuugcau

SEQ ID NO: 2066 - RNA, 21 nt, Homo sapiens
uagcugaugauguaggggaug

SEQ ID NO: 2067 - RNA, 22 nt, Homo sapiens
gauauguuguuggauucgguua

SEQ ID NO: 2068 - RNA, 22 nt, Homo sapiens
ggagaucauuuccuauuugaag

SEQ ID NO: 2069 - RNA, 22 nt, Homo sapiens
ugugaccaaaaucaacauaccu

SEQ ID NO: 2070 - RNA, 22 nt, Homo sapiens
uauuguuaaagauguuaaugau

SEQ ID NO: 2071 - RNA, 22 nt, Homo sapiens
cuauuacuuuuauugaacucag

SEQ ID NO: 2072 - RNA, 23 nt, Homo sapiens
uaagucacacagauuaauuuauu

SEQ ID NO: 2073 - RNA, 22 nt, Homo sapiens
ugagaacaugcacuugagguug

SEQ ID NO: 2074 - RNA, 23 nt, Homo sapiens
ccaguauuuauguaaggaagugu

SEQ ID NO: 2075 - RNA, 18 nt, Homo sapiens
ugucacuggauaaugguc

SEQ ID NO: 2076 - RNA, 22 nt, Homo sapiens
acaguggaauguaggguuugag

SEQ ID NO: 2077 - RNA, 22 nt, Homo sapiens
ggcucagugaucuguuucugua

SEQ ID NO: 2078 - RNA, 22 nt, Homo sapiens
uugcauaagugcauucugugau

SEQ ID NO: 2079 - RNA, 16 nt, Homo sapiens
ucauaguaucucuucu

SEQ ID NO: 2080 - RNA, 23 nt, Homo sapiens
augugugcuuggagagcaggaug

SEQ ID NO: 2081 - RNA, 22 nt, Homo sapiens
cauugcaugccagccugggcaa

SEQ ID NO: 2082 - RNA, 22 nt, Homo sapiens
cauugcacuccagcccuggcaa

SEQ ID NO: 2083 - RNA, 22 nt, Homo sapiens
gaaaucucuacuauuuugaucu

SEQ ID NO: 2084 - RNA, 22 nt, Homo sapiens
augauaaguuauuagaagaaga

SEQ ID NO: 2085 - RNA, 22 nt, Homo sapiens
ugagauuaucuugaucuugaaa

SEQ ID NO: 2086 - RNA, 22 nt, Homo sapiens
uccauuugucuauguuucuguu

SEQ ID NO: 2087 - RNA, 22 nt, Homo sapiens
ggucauggauguuuauaguaca

SEQ ID NO: 2088 - RNA, 19 nt, Homo sapiens
aaguacuugucuuuugaag

SEQ ID NO: 2089 - RNA, 22 nt, Homo sapiens
uuccacaaugguugaacuagcu

SEQ ID NO: 2090 - RNA, 22 nt, Homo sapiens
ccccaguguguaaaggccuugc

SEQ ID NO: 2091 - RNA, 22 nt, Homo sapiens
ucagguaucucuauagcaaugu

SEQ ID NO: 2092 - RNA, 22 nt, Homo sapiens
auugcacaccagucugggcaaa

SEQ ID NO: 2093 - RNA, 18 nt, Homo sapiens
auugcacaccagccuggg

SEQ ID NO: 2094 - RNA, 22 nt, Homo sapiens
ggucaacaucaucaugguaagu

SEQ ID NO: 2095 - RNA, 18 nt, Homo sapiens
augaccugcggguuauau

SEQ ID NO: 2096 - RNA, 23 nt, Homo sapiens
cuaaagucugucacugaggacuu

SEQ ID NO: 2097 - RNA, 22 nt, Homo sapiens
agccuauccaauaucagugaga

SEQ ID NO: 2098 - RNA, 22 nt, Homo sapiens
ugauaguugucagugggggacc

SEQ ID NO: 2099 - RNA, 19 nt, Homo sapiens
acagauagaauguucuaca

SEQ ID NO: 2100 - RNA, 22 nt, Homo sapiens
ucacugcgcuucagccugggug

SEQ ID NO: 2101 - RNA, 21 nt, Homo sapiens
uuaagugcuuuguaugcacua

SEQ ID NO: 2102 - RNA, 22 nt, Homo sapiens
uucauagaggacauuacuggag

SEQ ID NO: 2103 - RNA, 17 nt, Homo sapiens
ugugauugaagucaucc

SEQ ID NO: 2104 - RNA, 23 nt, Homo sapiens
uuacaguggcaugaucucugcuc

SEQ ID NO: 2105 - RNA, 22 nt, Homo sapiens
ccacccuggagaauuugagguc

SEQ ID NO: 2106 - RNA, 22 nt, Homo sapiens
uugcaugguuuuuaucugaaau

SEQ ID NO: 2107 - RNA, 22 nt, Homo sapiens
uggaaugcuaagcaugugggag

SEQ ID NO: 2108 - RNA, 22 nt, Homo sapiens
uauggcuuuuauuauguuguag

SEQ ID NO: 2109 - RNA, 22 nt, Homo sapiens
caccagguggcugaggccauga

SEQ ID NO: 2110 - RNA, 22 nt, Homo sapiens
uagguagguggaaaaguaauug

SEQ ID NO: 2111 - RNA, 22 nt, Homo sapiens
augagcuauggagcucccaccu

SEQ ID NO: 2112 - RNA, 22 nt, Homo sapiens
auaugucuguuuagucuguaau

SEQ ID NO: 2113 - RNA, 22 nt, Homo sapiens
ugagacacugaauccggccuga

SEQ ID NO: 2114 - RNA, 22 nt, Homo sapiens
uguccaguguuccucagaagaa

SEQ ID NO: 2115 - RNA, 21 nt, Homo sapiens
ugagacaauccuggucaauau

SEQ ID NO: 2116 - RNA, 21 nt, Homo sapiens
auuuuugcagagcugguagug

SEQ ID NO: 2117 - RNA, 22 nt, Homo sapiens
agaugcauuuuuauuggaauac

SEQ ID NO: 2118 - RNA, 20 nt, Homo sapiens
auggaccuggauuaacagca

SEQ ID NO: 2119 - RNA, 22 nt, Homo sapiens
gugcuaggugcuaggaagauag

SEQ ID NO: 2120 - RNA, 22 nt, Homo sapiens
gaggaaguuuacaaagcaucug

SEQ ID NO: 2121 - RNA, 18 nt, Homo sapiens
ucaauguggauguucuuu

SEQ ID NO: 2122 - RNA, 22 nt, Homo sapiens
uuuuggacuugcuccccugucc

SEQ ID NO: 2123 - RNA, 22 nt, Homo sapiens
uagcagugucuagguaggccau

SEQ ID NO: 2124 - RNA, 22 nt, Homo sapiens
cucauuaguuguuuuaagauga

SEQ ID NO: 2125 - RNA, 22 nt, Homo sapiens
acacgggugccggcaucagcac

SEQ ID NO: 2126 - RNA, 22 nt, Homo sapiens
aucagcacugaucauacagcuu

SEQ ID NO: 2127 - RNA, 22 nt, Homo sapiens
ugccauagcaaugguaagcuga

SEQ ID NO: 2128 - RNA, 22 nt, Homo sapiens
uugagauccuuuugcucaucag

SEQ ID NO: 2129 - RNA, 22 nt, Homo sapiens
uugagauggagccucacucugc

SEQ ID NO: 2130 - RNA, 22 nt, Homo sapiens
uugacuuuuaggaggaaaauga

SEQ ID NO: 2131 - RNA, 22 nt, Homo sapiens
cugaagugugaaagucuuuuuu

SEQ ID NO: 2132 - RNA, 22 nt, Homo sapiens
ugagguuggguaauuuaugaag

SEQ ID NO: 2133 - RNA, 22 nt, Homo sapiens
auagguauuuuuaaaugacugu

SEQ ID NO: 2134 - RNA, 22 nt, Homo sapiens
gagauaauagcuauaggaucuu

SEQ ID NO: 2135 - RNA, 22 nt, Homo sapiens
gaaucauuggguugauucaaga

SEQ ID NO: 2136 - RNA, 23 nt, Homo sapiens
uuuugcaauaagucacuggaaua

SEQ ID NO: 2137 - RNA, 22 nt, Homo sapiens
uucaaguaagaaagacaucagg

SEQ ID NO: 2138 - RNA, 19 nt, Homo sapiens
caaaguguucuucuuugcc

SEQ ID NO: 2139 - RNA, 22 nt, Homo sapiens
aaggaguaucuguuuucucacc

SEQ ID NO: 2140 - RNA, 22 nt, Homo sapiens
uguguacugcagaguauucugu

SEQ ID NO: 2141 - RNA, 23 nt, Homo sapiens
uuugagugugauaaacacuguca

SEQ ID NO: 2142 - RNA, 22 nt, Homo sapiens
ucccugaaaauuagcauuuuaa

SEQ ID NO: 2143 - RNA, 22 nt, Homo sapiens
gugcaagagugacugcaguuuu

SEQ ID NO: 2144 - RNA, 22 nt, Homo sapiens
ugcaguaggcccagcgggaggc

SEQ ID NO: 2145 - RNA, 22 nt, Homo sapiens
uaggacacagaccuggauggaa

SEQ ID NO: 2146 - RNA, 22 nt, Homo sapiens
uaugacugagacuuaaauugug

SEQ ID NO: 2147 - RNA, 22 nt, Homo sapiens
ugagauuguaucugcaaugugu

SEQ ID NO: 2148 - RNA, 22 nt, Homo sapiens
uagagguauaccaaaaaggcau

SEQ ID NO: 2149 - RNA, 22 nt, Homo sapiens
uuuugguaaugaacuuaggaag

SEQ ID NO: 2150 - RNA, 22 nt, Homo sapiens
uggaagacacauaccugauaac

SEQ ID NO: 2151 - RNA, 20 nt, Homo sapiens
gugacugagcacgggcacag

SEQ ID NO: 2152 - RNA, 22 nt, Homo sapiens
ugcaguuuaggaacugguaaca

SEQ ID NO: 2153 - RNA, 22 nt, Homo sapiens
ugcauuagucuguucucacacu

SEQ ID NO: 2154 - RNA, 23 nt, Homo sapiens
aaaugcucucaggugccaguaga

SEQ ID NO: 2155 - RNA, 22 nt, Homo sapiens
ugauauguuagaaucuugcaag

SEQ ID NO: 2156 - RNA, 22 nt, Homo sapiens
caggcaacauggcgaaacucug

SEQ ID NO: 2157 - RNA, 22 nt, Homo sapiens
uuauacucgucugaaugauucu

SEQ ID NO: 2158 - RNA, 22 nt, Homo sapiens
gaugugaaaucauaguuucuag

SEQ ID NO: 2159 - RNA, 22 nt, Homo sapiens
gagaacuggcgugaacugcacg

SEQ ID NO: 2160 - RNA, 22 nt, Homo sapiens
agccuucauucugacaguagga

SEQ ID NO: 2161 - RNA, 22 nt, Homo sapiens
guggaagugucuggggccaggg

SEQ ID NO: 2162 - RNA, 22 nt, Homo sapiens
gaaauggaucagagcaagcuuu

SEQ ID NO: 2163 - RNA, 21 nt, Homo sapiens
auauggaacuggugacguguu

SEQ ID NO: 2164 - RNA, 22 nt, Homo sapiens
ucauugguagcuugaaggggau

SEQ ID NO: 2165 - RNA, 22 nt, Homo sapiens
uugaaugaaauuggugugggga

SEQ ID NO: 2166 - RNA, 22 nt, Homo sapiens
uugucuugcagcuuaggcauca

SEQ ID NO: 2167 - RNA, 22 nt, Homo sapiens
ugugacagguagguaauuuuug

SEQ ID NO: 2168 - RNA, 22 nt, Homo sapiens
uagagauaucaauuucauggug

SEQ ID NO: 2169 - RNA, 22 nt, Homo sapiens
guacuuagagauagggucuuua

SEQ ID NO: 2170 - RNA, 19 nt, Homo sapiens
ugaaguauagggcuucuga

SEQ ID NO: 2171 - RNA, 22 nt, Homo sapiens
agcuccauuguaaucaccuggu

SEQ ID NO: 2172 - RNA, 22 nt, Homo sapiens
uugagauggaguucauuuuugu

SEQ ID NO: 2173 - RNA, 22 nt, Homo sapiens
ggcaauauauucugaauucagu

SEQ ID NO: 2174 - RNA, 22 nt, Homo sapiens
aagcuguguguaagcucucaca

SEQ ID NO: 2175 - RNA, 22 nt, Homo sapiens
uauauguucuugcacuggaaag

SEQ ID NO: 2176 - RNA, 22 nt, Homo sapiens
ucaguaguaaauggauuuggaa

SEQ ID NO: 2177 - RNA, 22 nt, Homo sapiens
gguggucuuccccuggaguucg

SEQ ID NO: 2178 - RNA, 22 nt, Homo sapiens
cugcuguuguuaacuuuuggag

SEQ ID NO: 2179 - RNA, 22 nt, Homo sapiens
uaacuaguggaauuugauuuca

SEQ ID NO: 2180 - RNA, 22 nt, Homo sapiens
uggcucuguuuguuaacuagac

SEQ ID NO: 2181 - RNA, 22 nt, Homo sapiens
aauaaguugagaugaggucaua

SEQ ID NO: 2182 - RNA, 22 nt, Homo sapiens
auuguccuacuaggguuccagu

SEQ ID NO: 2183 - RNA, 22 nt, Homo sapiens
ugacaagaacuuuccauaguaa

SEQ ID NO: 2184 - RNA, 22 nt, Homo sapiens
acacuauugagguuuguuugca

SEQ ID NO: 2185 - RNA, 22 nt, Homo sapiens
cuggucaugggggcacccucug

SEQ ID NO: 2186 - RNA, 22 nt, Homo sapiens
uggaaucuagagaaaugcaaac

SEQ ID NO: 2187 - RNA, 22 nt, Homo sapiens
uuggccccucccaaauuucaug

SEQ ID NO: 2188 - RNA, 22 nt, Homo sapiens
aggcagucugaguuuugaaagg

SEQ ID NO: 2189 - RNA, 21 nt, Homo sapiens
uagauaguugguucugaaucu

SEQ ID NO: 2190 - RNA, 22 nt, Homo sapiens
gagguaagaguuuuccauuucu

SEQ ID NO: 2191 - RNA, 22 nt, Homo sapiens
ucccuuagccaaauccccagcc

SEQ ID NO: 2192 - RNA, 22 nt, Homo sapiens
uuuggcccugagggauggcaua

SEQ ID NO: 2193 - RNA, 22 nt, Homo sapiens
guauaggcuuucaccacgccau

SEQ ID NO: 2194 - RNA, 22 nt, Homo sapiens
ugaguagugccacaauaagcau

SEQ ID NO: 2195 - RNA, 22 nt, Homo sapiens
guuacugucuuccugauugcuu

SEQ ID NO: 2196 - RNA, 22 nt, Homo sapiens
ugggaaacauccagcacauacu

SEQ ID NO: 2197 - RNA, 23 nt, Homo sapiens
cccucagaagugcagggagagaa

SEQ ID NO: 2198 - RNA, 22 nt, Homo sapiens
uauuccacuuacaugagguauc

SEQ ID NO: 2199 - RNA, 19 nt, Homo sapiens
ucagugcuauguaauguag

SEQ ID NO: 2200 - RNA, 22 nt, Homo sapiens
gaucuguuucaauugucuuagu

SEQ ID NO: 2201 - RNA, 22 nt, Homo sapiens
ucuuuguucaggagccaacucc

SEQ ID NO: 2202 - RNA, 21 nt, Homo sapiens
caauggcacaaucucugcuca

SEQ ID NO: 2203 - RNA, 22 nt, Homo sapiens
aguaaaucacuaauggcuuccg

SEQ ID NO: 2204 - RNA, 22 nt, Homo sapiens
augaacucaucauuuuuuaugg

SEQ ID NO: 2205 - RNA, 18 nt, Homo sapiens
ugagaucagcaucaaggg

SEQ ID NO: 2206 - RNA, 19 nt, Homo sapiens
augcacgugaaaugcauuu

SEQ ID NO: 2207 - RNA, 22 nt, Homo sapiens
cugugacugcagggcauauuug

SEQ ID NO: 2208 - RNA, 22 nt, Homo sapiens
gauauguucuuucacguuggug

SEQ ID NO: 2209 - RNA, 22 nt, Homo sapiens
auggcuucuucuaaaagugggg

SEQ ID NO: 2210 - RNA, 22 nt, Homo sapiens
uugcauauguugaaccagccuu

SEQ ID NO: 2211 - RNA, 22 nt, Homo sapiens
guuauccugucuuuacauacaa

SEQ ID NO: 2212 - RNA, 22 nt, Homo sapiens
aaauaguagcugaaugagggaa

SEQ ID NO: 2213 - RNA, 22 nt, Homo sapiens
uccgaguguuagagagcugugu

SEQ ID NO: 2214 - RNA, 22 nt, Homo sapiens
uuggucagcucaauggagaggg

SEQ ID NO: 2215 - RNA, 22 nt, Homo sapiens
ugcauggaagggagggaaagag

SEQ ID NO: 2216 - RNA, 22 nt, Homo sapiens
uaucagauugcugccaucugcu

SEQ ID NO: 2217 - RNA, 21 nt, Homo sapiens
ucucauagaguuucacuuucu

SEQ ID NO: 2218 - RNA, 22 nt, Homo sapiens
aggaccaugguauugcuuuggg

SEQ ID NO: 2219 - RNA, 22 nt, Homo sapiens
agagcacugcugcaggguucug

SEQ ID NO: 2220 - RNA, 22 nt, Homo sapiens
uugagauggagucuugcacugu

SEQ ID NO: 2221 - RNA, 22 nt, Homo sapiens
cuggcacagugucagaaacaca

SEQ ID NO: 2222 - RNA, 22 nt, Homo sapiens
uccuuuaguuaauaaagacaag

SEQ ID NO: 2223 - RNA, 21 nt, Homo sapiens
uaucccagucacaucuaccca

SEQ ID NO: 2224 - RNA, 22 nt, Homo sapiens
gcuguugguaaaaaggacauga

SEQ ID NO: 2225 - RNA, 22 nt, Homo sapiens
ugagcuccuucauaaaaaggca

SEQ ID NO: 2226 - RNA, 19 nt, Homo sapiens
uuggcccugguucucuucu

SEQ ID NO: 2227 - RNA, 22 nt, Homo sapiens
cuuccugaguccugggcucaca

SEQ ID NO: 2228 - RNA, 22 nt, Homo sapiens
ugccagaugugcccucuccacc

SEQ ID NO: 2229 - RNA, 22 nt, Homo sapiens
uuugcacauauuugggcaaaag

SEQ ID NO: 2230 - RNA, 22 nt, Homo sapiens
guauuaguuuccuguugcugcu

SEQ ID NO: 2231 - RNA, 19 nt, Homo sapiens
ugaguauauuguauucauu

SEQ ID NO: 2232 - RNA, 22 nt, Homo sapiens
uuggaagacauucugucugcua

SEQ ID NO: 2233 - RNA, 16 nt, Homo sapiens
ugccuucuucuguauu

SEQ ID NO: 2234 - RNA, 22 nt, Homo sapiens
augcuuguguuggggcagugga

SEQ ID NO: 2235 - RNA, 22 nt, Homo sapiens
uuauggcuauugaugacaauug

SEQ ID NO: 2236 - RNA, 22 nt, Homo sapiens
aggaaugcuaaguuuuccuccu

SEQ ID NO: 2237 - RNA, 22 nt, Homo sapiens
augcacaguccagcccaugugg

SEQ ID NO: 2238 - RNA, 22 nt, Homo sapiens
acaucccuugcucggggccccu

SEQ ID NO: 2239 - RNA, 22 nt, Homo sapiens
uaaacugucuugcaguuacaug

SEQ ID NO: 2240 - RNA, 22 nt, Homo sapiens
gucagcuuguccagagacucug

SEQ ID NO: 2241 - RNA, 22 nt, Homo sapiens
uaucacaaacuuagcaguuuaa

SEQ ID NO: 2242 - RNA, 23 nt, Homo sapiens
agaugcaucuggcugcgaggcaa

SEQ ID NO: 2243 - RNA, 22 nt, Homo sapiens
cuuugcaaauggccuuuccaag

SEQ ID NO: 2244 - RNA, 22 nt, Homo sapiens
ugcagugucaauaauaauuagu

SEQ ID NO: 2245 - RNA, 22 nt, Homo sapiens
uugagaucuacuacuguaggag

SEQ ID NO: 2246 - RNA, 22 nt, Homo sapiens
ugagcuagagaguuuaguguca

SEQ ID NO: 2247 - RNA, 22 nt, Homo sapiens
ucugacucugugaugggcccaa

SEQ ID NO: 2248 - RNA, 22 nt, Homo sapiens
cuagcagaacaauacaauucgg

SEQ ID NO: 2249 - RNA, 22 nt, Homo sapiens
ugagaggugaauggcaggcuca

SEQ ID NO: 2250 - RNA, 22 nt, Homo sapiens
uugcagcauucugguuccuggu

SEQ ID NO: 2251 - RNA, 22 nt, Homo sapiens
uucccuuuuuucuaguagguag

SEQ ID NO: 2252 - RNA, 23 nt, Homo sapiens
aauaucacaguggguguacaccc

SEQ ID NO: 2253 - RNA, 20 nt, Homo sapiens
ugauauuucuggaaguggag

SEQ ID NO: 2254 - RNA, 22 nt, Homo sapiens
ggcaguuuggcaguuucauaaa

SEQ ID NO: 2255 - RNA, 22 nt, Homo sapiens
uagcuggaguuuuuguuauagg

SEQ ID NO: 2256 - RNA, 22 nt, Homo sapiens
gagugguuuugauuuauagcug

SEQ ID NO: 2257 - RNA, 22 nt, Homo sapiens
cugaggauauucagccucugug

SEQ ID NO: 2258 - RNA, 22 nt, Homo sapiens
gagcaucaauggcaugugggaa

SEQ ID NO: 2259 - RNA, 22 nt, Homo sapiens
cuaugcuucuuaaauuaguuau

SEQ ID NO: 2260 - RNA, 19 nt, Homo sapiens
gcucaccuugcugcuccag

SEQ ID NO: 2261 - RNA, 22 nt, Homo sapiens
ugacucaguuucucagguagua

SEQ ID NO: 2262 - RNA, 22 nt, Homo sapiens
uaacaguauauuuaccaaaccu

SEQ ID NO: 2263 - RNA, 22 nt, Homo sapiens
ucugucaaaucuuauguuguag

SEQ ID NO: 2264 - RNA, 22 nt, Homo sapiens
uucagguaguuuaacuguucca

SEQ ID NO: 2265 - RNA, 22 nt, Homo sapiens
ugaccagaaaacaaauuaguuu

SEQ ID NO: 2266 - RNA, 22 nt, Homo sapiens
agaugcuguuaucaacuguagc

SEQ ID NO: 2267 - RNA, 22 nt, Homo sapiens
ugugcacaugauauaucacaua

SEQ ID NO: 2268 - RNA, 22 nt, Homo sapiens
uugcacuugcugaggagugauu

SEQ ID NO: 2269 - RNA, 21 nt, Homo sapiens
ugaaaugcaugugcacauuaa

SEQ ID NO: 2270 - RNA, 22 nt, Homo sapiens
ugaugucuugcaggcacgagau

SEQ ID NO: 2271 - RNA, 22 nt, Homo sapiens
ucacaaagcuuggccugcuucu

SEQ ID NO: 2272 - RNA, 22 nt, Homo sapiens
uggauguauacaugcaggucac

SEQ ID NO: 2273 - RNA, 22 nt, Homo sapiens
uugcagagaaauuucugguuua

SEQ ID NO: 2274 - RNA, 22 nt, Homo sapiens
uccauuuguuguaggguauagu

SEQ ID NO: 2275 - RNA, 22 nt, Homo sapiens
augaauacagcuaugcgugcau

SEQ ID NO: 2276 - RNA, 22 nt, Homo sapiens
uuauuguccaaguuucccuuug

SEQ ID NO: 2277 - RNA, 22 nt, Homo sapiens
ucuguggugggcuccacccagu

SEQ ID NO: 2278 - RNA, 22 nt, Homo sapiens
acucagagugggccccuagaua

SEQ ID NO: 2279 - RNA, 22 nt, Homo sapiens
guucuauguugggaguucacua

SEQ ID NO: 2280 - RNA, 22 nt, Homo sapiens
cuuggcacugcucacccuccuu

SEQ ID NO: 2281 - RNA, 20 nt, Homo sapiens
uuacuauguaguauuggcuc

SEQ ID NO: 2282 - RNA, 22 nt, Homo sapiens
ugacuagcagagugagaaacuc

SEQ ID NO: 2283 - RNA, 22 nt, Homo sapiens
uaugaugcugagguuuggagug

SEQ ID NO: 2284 - RNA, 17 nt, Homo sapiens
uguggcucuuaugcuga

SEQ ID NO: 2285 - RNA, 22 nt, Homo sapiens
aacaccuugcagggauuaugac

SEQ ID NO: 2286 - RNA, 22 nt, Homo sapiens
cucgaagacuaagcaucucuga

SEQ ID NO: 2287 - RNA, 22 nt, Homo sapiens
gucugguacuuguuuguaaggg

SEQ ID NO: 2288 - RNA, 22 nt, Homo sapiens
uuuguggaaugcccuuauuuau

SEQ ID NO: 2289 - RNA, 19 nt, Homo sapiens
aacuggugugagaugguau

SEQ ID NO: 2290 - RNA, 22 nt, Homo sapiens
cuuccaaguggggcacgugcca

SEQ ID NO: 2291 - RNA, 22 nt, Homo sapiens
uauuugguuauaugaguaaguu

SEQ ID NO: 2292 - RNA, 22 nt, Homo sapiens
caguuacuugacacaaccaauu

SEQ ID NO: 2293 - RNA, 22 nt, Homo sapiens
ucaaacacuccauaucgcgauu

SEQ ID NO: 2294 - RNA, 22 nt, Homo sapiens
uugucacucuuccuaggguagg

SEQ ID NO: 2295 - RNA, 21 nt, Homo sapiens
uaccuacugcaugccaggcac

SEQ ID NO: 2296 - RNA, 22 nt, Homo sapiens
uggcauguuggguguugacucc

SEQ ID NO: 2297 - RNA, 22 nt, Homo sapiens
ucacuuuggguacuauggaaau

SEQ ID NO: 2298 - RNA, 22 nt, Homo sapiens
uucauagucuaugcaaguaaga

SEQ ID NO: 2299 - RNA, 22 nt, Homo sapiens
uggcagcgugaaagacuuuuuc

SEQ ID NO: 2300 - RNA, 22 nt, Homo sapiens
ugagaacauggagaacccccca

SEQ ID NO: 2301 - RNA, 22 nt, Homo sapiens
auugcacuggggguuagaauuu

SEQ ID NO: 2302 - RNA, 22 nt, Homo sapiens
uuugucccccguaguucauaua

SEQ ID NO: 2303 - RNA, 22 nt, Homo sapiens
gucagcaaaguucuccugcaga

SEQ ID NO: 2304 - RNA, 22 nt, Homo sapiens
agagguauuggaaggaguguca

SEQ ID NO: 2305 - RNA, 20 nt, Homo sapiens
uuuuggcuuaaagcagucug

SEQ ID NO: 2306 - RNA, 22 nt, Homo sapiens
uguggcugguggcaccuuuucc

SEQ ID NO: 2307 - RNA, 22 nt, Homo sapiens
ugucagcacaacucagguuccu

SEQ ID NO: 2308 - RNA, 22 nt, Homo sapiens
uauugcuccuaauaucacggug

SEQ ID NO: 2309 - RNA, 22 nt, Homo sapiens
ugaacacuggauaaggagucag

SEQ ID NO: 2310 - RNA, 19 nt, Homo sapiens
gcuuguccacgugagauaa

SEQ ID NO: 2311 - RNA, 22 nt, Homo sapiens
ugaguucuuccaccgggaccag

SEQ ID NO: 2312 - RNA, 22 nt, Homo sapiens
ucauggcuuuuauuauguugag

SEQ ID NO: 2313 - RNA, 20 nt, Homo sapiens
cugcacauccacucuacuuc

SEQ ID NO: 2314 - RNA, 22 nt, Homo sapiens
gcuggguucagagugggcugcg

SEQ ID NO: 2315 - RNA, 22 nt, Homo sapiens
uugagauggaguuucgcucuuu

SEQ ID NO: 2316 - RNA, 22 nt, Homo sapiens
uugagcucaucuucagggguga

SEQ ID NO: 2317 - RNA, 22 nt, Homo sapiens
guggcauuucccaaaguauucu

SEQ ID NO: 2318 - RNA, 23 nt, Homo sapiens
ugacagucucccgauggcuaggc

SEQ ID NO: 2319 - RNA, 22 nt, Homo sapiens
ugcagcacaguagguuugcaau

SEQ ID NO: 2320 - RNA, 22 nt, Homo sapiens
aggugguguuggguuccagccc

SEQ ID NO: 2321 - RNA, 22 nt, Homo sapiens
uugaacugguaguuggaaaucu

SEQ ID NO: 2322 - RNA, 22 nt, Homo sapiens
gaguaacauugacaacuucaug

SEQ ID NO: 2323 - RNA, 22 nt, Homo sapiens
uugggcaauaggaagcaggugg

SEQ ID NO: 2324 - RNA, 22 nt, Homo sapiens
uugggacccuguccuguaacaa

SEQ ID NO: 2325 - RNA, 22 nt, Homo sapiens
uguguaauaccuuugacuauau

SEQ ID NO: 2326 - RNA, 22 nt, Homo sapiens
uacagaguagaagauuugcaga

SEQ ID NO: 2327 - RNA, 22 nt, Homo sapiens
ggcaagugggagggaguguuuc

SEQ ID NO: 2328 - RNA, 22 nt, Homo sapiens
uuggaauuuauuuggaugggag

SEQ ID NO: 2329 - RNA, 21 nt, Homo sapiens
ucucucaaccaggaagugggc

SEQ ID NO: 2330 - RNA, 22 nt, Homo sapiens
cuucaaaguuggcuaggagaca

SEQ ID NO: 2331 - RNA, 22 nt, Homo sapiens
uauuaugcacuuuauaaaaauu

SEQ ID NO: 2332 - RNA, 22 nt, Homo sapiens
ucugugcauggcagaggaauga

SEQ ID NO: 2333 - RNA, 23 nt, Homo sapiens
ucuggaucauucguagugccagc

SEQ ID NO: 2334 - RNA, 20 nt, Homo sapiens
gauuagagagaggcugugca

SEQ ID NO: 2335 - RNA, 22 nt, Homo sapiens
aaagcaucacuuuuccuacuuu

SEQ ID NO: 2336 - RNA, 22 nt, Homo sapiens
gucauaucauuggccaguggaa

SEQ ID NO: 2337 - RNA, 22 nt, Homo sapiens
aacugcacauauuuguaugggu

SEQ ID NO: 2338 - RNA, 22 nt, Homo sapiens
acugcacuccagccuuagugac

SEQ ID NO: 2339 - RNA, 19 nt, Homo sapiens
ucauggcuuuuucagcugu

SEQ ID NO: 2340 - RNA, 22 nt, Homo sapiens
gugcacauauggugcauaagug

SEQ ID NO: 2341 - RNA, 22 nt, Homo sapiens
uuauagcagugcaggaacagac

SEQ ID NO: 2342 - RNA, 22 nt, Homo sapiens
uuaaagcuggcguuacaguuug

SEQ ID NO: 2343 - RNA, 22 nt, Homo sapiens
uaugguuuucucuuacguguug

SEQ ID NO: 2344 - RNA, 22 nt, Homo sapiens
agugauuuuaacuuccagcaau

SEQ ID NO: 2345 - RNA, 22 nt, Homo sapiens
guauuguacuacaagcucuuua

SEQ ID NO: 2346 - RNA, 22 nt, Homo sapiens
ugcagugugcuggggucuccau

SEQ ID NO: 2347 - RNA, 22 nt, Homo sapiens
aucccugugauccaaucacuuc

SEQ ID NO: 2348 - RNA, 21 nt, Homo sapiens
agagaacugaaacaugugacu

SEQ ID NO: 2349 - RNA, 22 nt, Homo sapiens
uguugcuuaagccacccagucu

SEQ ID NO: 2350 - RNA, 22 nt, Homo sapiens
aagguacuggaaagaggaaugg

SEQ ID NO: 2351 - RNA, 22 nt, Homo sapiens
gcagugcuggagcccccgugug

SEQ ID NO: 2352 - RNA, 22 nt, Homo sapiens
uggaaugugaauaacuuccuuc

SEQ ID NO: 2353 - RNA, 22 nt, Homo sapiens
augacguugugggcucucaagc

SEQ ID NO: 2354 - RNA, 22 nt, Homo sapiens
ggucaguuuuuuuaaccaucca

SEQ ID NO: 2355 - RNA, 22 nt, Homo sapiens
aucugcuccuggugaggguuuc

SEQ ID NO: 2356 - RNA, 22 nt, Homo sapiens
uucacagugugaucuaugggca

SEQ ID NO: 2357 - RNA, 22 nt, Homo sapiens
acacacgugcauguaugcguau

SEQ ID NO: 2358 - RNA, 22 nt, Homo sapiens
auugaaucuaaaaugagucucu

SEQ ID NO: 2359 - RNA, 21 nt, Homo sapiens
ugauguugaccuaaguaguga

SEQ ID NO: 2360 - RNA, 22 nt, Homo sapiens
ugaggcuaggauaggcugauuc

SEQ ID NO: 2361 - RNA, 22 nt, Homo sapiens
uauugaauuuuuaagcccuuug

SEQ ID NO: 2362 - RNA, 22 nt, Homo sapiens
cugagaucguggggcugcuguc

SEQ ID NO: 2363 - RNA, 22 nt, Homo sapiens
uaauauguauacagacagauac

SEQ ID NO: 2364 - RNA, 22 nt, Homo sapiens
uuggcucuggcugggcuccagc

SEQ ID NO: 2365 - RNA, 22 nt, Homo sapiens
gagaugguacacauacgauucu

SEQ ID NO: 2366 - RNA, 22 nt, Homo sapiens
auccaagagacugaugacuucc

SEQ ID NO: 2367 - RNA, 21 nt, Homo sapiens
auauuacuguuagaggacugc

SEQ ID NO: 2368 - RNA, 22 nt, Homo sapiens
gccaagaucugaauaauuaaga

SEQ ID NO: 2369 - RNA, 23 nt, Homo sapiens
uugaggcauguaccaucaauauc

SEQ ID NO: 2370 - RNA, 22 nt, Homo sapiens
uaggggcacacuucgguuagca

SEQ ID NO: 2371 - RNA, 22 nt, Homo sapiens
uaaagagcuuuugaggugucau

SEQ ID NO: 2372 - RNA, 22 nt, Homo sapiens
aucagaaucucuagaggacugu

SEQ ID NO: 2373 - RNA, 22 nt, Homo sapiens
auuguacuccagccugggcaag

SEQ ID NO: 2374 - RNA, 22 nt, Homo sapiens
gaggugguagguucacagcagc

SEQ ID NO: 2375 - RNA, 22 nt, Homo sapiens
ugaaucauuucuugucuucagu

SEQ ID NO: 2376 - RNA, 22 nt, Homo sapiens
ugucaugaacucacauucuggg

SEQ ID NO: 2377 - RNA, 22 nt, Homo sapiens
uacauagucuucuuuugguuau

SEQ ID NO: 2378 - RNA, 22 nt, Homo sapiens
cuguaugugagaaauaauaagu

SEQ ID NO: 2379 - RNA, 22 nt, Homo sapiens
uucaucagggagaaauaauuuc

SEQ ID NO: 2380 - RNA, 22 nt, Homo sapiens
guaaggcuucuggucaacagca

SEQ ID NO: 2381 - RNA, 22 nt, Homo sapiens
ccagugcauggaucccaggggg

SEQ ID NO: 2382 - RNA, 22 nt, Homo sapiens
auagugcagugaugaaccuagg

SEQ ID NO: 2383 - RNA, 22 nt, Homo sapiens
agcuguuguuaauuaacucauu

SEQ ID NO: 2384 - RNA, 22 nt, Homo sapiens
gagaacugacauuaucguguau

SEQ ID NO: 2385 - RNA, 22 nt, Homo sapiens
agagaugaagauggggcucccg

SEQ ID NO: 2386 - RNA, 22 nt, Homo sapiens
guucucacuggugcugguaagu

SEQ ID NO: 2387 - RNA, 22 nt, Homo sapiens
cauugcacuccaucccgggaaa

SEQ ID NO: 2388 - RNA, 23 nt, Homo sapiens
cagcuucauugaacauaacuccu

SEQ ID NO: 2389 - RNA, 22 nt, Homo sapiens
uggcaaauguaguacccaauag

SEQ ID NO: 2390 - RNA, 19 nt, Homo sapiens
ugcaaagucagugaagggu

SEQ ID NO: 2391 - RNA, 22 nt, Homo sapiens
uguauaguugagucaaguuuca

SEQ ID NO: 2392 - RNA, 22 nt, Homo sapiens
gaguuccuuugagccugagagg

SEQ ID NO: 2393 - RNA, 22 nt, Homo sapiens
cuggaaagaaucaggcuaaacu

SEQ ID NO: 2394 - RNA, 22 nt, Homo sapiens
uuccuugagaaaguacaaggcu

SEQ ID NO: 2395 - RNA, 22 nt, Homo sapiens
acugcacucuagccccugcgac

SEQ ID NO: 2396 - RNA, 22 nt, Homo sapiens
cauuguacauaaguauggagua

SEQ ID NO: 2397 - RNA, 22 nt, Homo sapiens
uccuacaugcaguacauucaaa

SEQ ID NO: 2398 - RNA, 22 nt, Homo sapiens
auagcaaugccccacuccuugg

SEQ ID NO: 2399 - RNA, 22 nt, Homo sapiens
auagccucauucuucagaugag

SEQ ID NO: 2400 - RNA, 22 nt, Homo sapiens
ugucuugagagaggacaugacu

SEQ ID NO: 2401 - RNA, 22 nt, Homo sapiens
uucuugguguaguaguugaaaa

SEQ ID NO: 2402 - RNA, 22 nt, Homo sapiens
uucacagacaacuggucccuua

SEQ ID NO: 2403 - RNA, 22 nt, Homo sapiens
accaugcaguccaauaugcaca

SEQ ID NO: 2404 - RNA, 22 nt, Homo sapiens
aaguauguaucaagucauacuu

SEQ ID NO: 2405 - RNA, 22 nt, Homo sapiens
caugcagcacacaugucugugc

SEQ ID NO: 2406 - RNA, 20 nt, Homo sapiens
ucguugguagagagcagggc

SEQ ID NO: 2407 - RNA, 22 nt, Homo sapiens
uggagugauaugguuauauggg

SEQ ID NO: 2408 - RNA, 22 nt, Homo sapiens
acaaaguguuuucugaaggccu

SEQ ID NO: 2409 - RNA, 22 nt, Homo sapiens
uuugggccaugcuucccgguca

SEQ ID NO: 2410 - RNA, 22 nt, Homo sapiens
uauugggcuucucagaauagag

SEQ ID NO: 2411 - RNA, 22 nt, Homo sapiens
aguccaguguuaugaucaguag

SEQ ID NO: 2412 - RNA, 22 nt, Homo sapiens
gucuggagacuugggucaucaa

SEQ ID NO: 2413 - RNA, 22 nt, Homo sapiens
ugggugugaccgcucaaggggg

SEQ ID NO: 2414 - RNA, 22 nt, Homo sapiens
ucagaaccuccuagcaguguuc

SEQ ID NO: 2415 - RNA, 22 nt, Homo sapiens
cucuuagauuagccauccuaau

SEQ ID NO: 2416 - RNA, 22 nt, Homo sapiens
uuuccauguuggugaaaugagg

SEQ ID NO: 2417 - RNA, 20 nt, Homo sapiens
auggcccugcugggaguguc

SEQ ID NO: 2418 - RNA, 22 nt, Homo sapiens
uugccacuucucuugccccauu

SEQ ID NO: 2419 - RNA, 22 nt, Homo sapiens
uggaugacuguuauaugcauau

SEQ ID NO: 2420 - RNA, 23 nt, Homo sapiens
uacagcugcagaaucaggcuaag

SEQ ID NO: 2421 - RNA, 22 nt, Homo sapiens
uugagggagccuguuagucccg

SEQ ID NO: 2422 - RNA, 22 nt, Homo sapiens
aggucaccucaggaaauacuga

SEQ ID NO: 2423 - RNA, 22 nt, Homo sapiens
ugaacagagaaacacuggccau

SEQ ID NO: 2424 - RNA, 22 nt, Homo sapiens
uuaauagugacucauuuuccac

SEQ ID NO: 2425 - RNA, 22 nt, Homo sapiens
gauaaagauagcaauagggaca

SEQ ID NO: 2426 - RNA, 22 nt, Homo sapiens
gagauauucugguuuacuaaau

SEQ ID NO: 2427 - RNA, 22 nt, Homo sapiens
gugcaugcaucuuuauaguagc

SEQ ID NO: 2428 - RNA, 22 nt, Homo sapiens
uugaaagacaucaccuacugcu

SEQ ID NO: 2429 - RNA, 23 nt, Homo sapiens
ugcugagaccuagauccuaaaga

SEQ ID NO: 2430 - RNA, 22 nt, Homo sapiens
aaaggcacugaucuuauccagu

SEQ ID NO: 2431 - RNA, 22 nt, Homo sapiens
uuggacugugagguuucguggg

SEQ ID NO: 2432 - RNA, 22 nt, Homo sapiens
gucaugaacuguacuacuccua

SEQ ID NO: 2433 - RNA, 22 nt, Homo sapiens
aaagucuguuuugucagagacu

SEQ ID NO: 2434 - RNA, 22 nt, Homo sapiens
cuacauuguagguauucaaacu

SEQ ID NO: 2435 - RNA, 22 nt, Homo sapiens
cuuuuacacuguuagugggaau

SEQ ID NO: 2436 - RNA, 22 nt, Homo sapiens
aguaaagccagaccuguuaauu

SEQ ID NO: 2437 - RNA, 22 nt, Homo sapiens
gugagaacugcuggggccacag

SEQ ID NO: 2438 - RNA, 22 nt, Homo sapiens
ugucauguggcuaacgauucau

SEQ ID NO: 2439 - RNA, 22 nt, Homo sapiens
cugaagugcuugccacauaaaa

SEQ ID NO: 2440 - RNA, 22 nt, Homo sapiens
uuucaguguggcaggcauagcu

SEQ ID NO: 2441 - RNA, 22 nt, Homo sapiens
agugggccccuagaggugaggu

SEQ ID NO: 2442 - RNA, 22 nt, Homo sapiens
ggaauauaaaacuuuugacagg

SEQ ID NO: 2443 - RNA, 22 nt, Homo sapiens
gcagaguauagagggcugggcc

SEQ ID NO: 2444 - RNA, 22 nt, Homo sapiens
uuggccgugucauuugcuuuga

SEQ ID NO: 2445 - RNA, 22 nt, Homo sapiens
cacauguucaggagcacuuaga

SEQ ID NO: 2446 - RNA, 22 nt, Homo sapiens
caaguguuggcuuguauacaaa

SEQ ID NO: 2447 - RNA, 22 nt, Homo sapiens
caucacaucugcaugguaagua

SEQ ID NO: 2448 - RNA, 22 nt, Homo sapiens
gagaacauacggcauuugguuu

SEQ ID NO: 2449 - RNA, 22 nt, Homo sapiens
cagcuaguuuuugguuuacagu

SEQ ID NO: 2450 - RNA, 22 nt, Homo sapiens
aagcuggagugcaguggugcga

SEQ ID NO: 2451 - RNA, 22 nt, Homo sapiens
uugagcuaguugcaccagcagg

SEQ ID NO: 2452 - RNA, 22 nt, Homo sapiens
cuccacgugaaugccaaguauu

SEQ ID NO: 2453 - RNA, 22 nt, Homo sapiens
ugaaguguuuauuuuggccuuc

SEQ ID NO: 2454 - RNA, 22 nt, Homo sapiens
aagggaauguuguggcugguuu

SEQ ID NO: 2455 - RNA, 19 nt, Homo sapiens
cugcacugagaaaaggagg

SEQ ID NO: 2456 - RNA, 22 nt, Homo sapiens
gucaggaugauuuggggaggug

SEQ ID NO: 2457 - RNA, 22 nt, Homo sapiens
ggacaagaucuuccaccauuca

SEQ ID NO: 2458 - RNA, 20 nt, Homo sapiens
acugcacuccagucucuggg

SEQ ID NO: 2459 - RNA, 21 nt, Homo sapiens
uucauaaggcuucucuccugu

SEQ ID NO: 2460 - RNA, 22 nt, Homo sapiens
ccaguauugaacacaaugaaag

SEQ ID NO: 2461 - RNA, 22 nt, Homo sapiens
agccgauguugacaccagggga

SEQ ID NO: 2462 - RNA, 22 nt, Homo sapiens
ugucaucauuugagagaagaaa

SEQ ID NO: 2463 - RNA, 21 nt, Homo sapiens
ggugagaaaggagacauagac

SEQ ID NO: 2464 - RNA, 22 nt, Homo sapiens
ggagcuuugaaaguuuccgguu

SEQ ID NO: 2465 - RNA, 22 nt, Homo sapiens
ucuggagugugaaguggauaug

SEQ ID NO: 2466 - RNA, 23 nt, Homo sapiens
gugugguaggcuauaccaucuag

SEQ ID NO: 2467 - RNA, 23 nt, Homo sapiens
uaacauguuuuuaagggaagcuu

SEQ ID NO: 2468 - RNA, 19 nt, Homo sapiens
augaacucaucauuucuca

SEQ ID NO: 2469 - RNA, 22 nt, Homo sapiens
acacuugcuugcaauagccucc

SEQ ID NO: 2470 - RNA, 22 nt, Homo sapiens
caaauugcuuguggaggauaau

SEQ ID NO: 2471 - RNA, 22 nt, Homo sapiens
guagcaccagugcucuucucaa

SEQ ID NO: 2472 - RNA, 22 nt, Homo sapiens
uugccgggugcaguggcucaug

SEQ ID NO: 2473 - RNA, 22 nt, Homo sapiens
uguaagugugcaauucagugau

SEQ ID NO: 2474 - RNA, 22 nt, Homo sapiens
acaaaguauggaauguuggugu

SEQ ID NO: 2475 - RNA, 22 nt, Homo sapiens
auacugcacauuuagggaggga

SEQ ID NO: 2476 - RNA, 23 nt, Homo sapiens
ugguaacauguuguggcagggga

SEQ ID NO: 2477 - RNA, 20 nt, Homo sapiens
ucaaggcacgaauaaaaguu

SEQ ID NO: 2478 - RNA, 22 nt, Homo sapiens
ccagaauucucauuggaaggaa

SEQ ID NO: 2479 - RNA, 22 nt, Homo sapiens
uggcauggaaagcuuuucauac

SEQ ID NO: 2480 - RNA, 22 nt, Homo sapiens
uaguaaacaccucagguaauuc

SEQ ID NO: 2481 - RNA, 22 nt, Homo sapiens
ugcagcucaaauuccuaacaag

SEQ ID NO: 2482 - RNA, 22 nt, Homo sapiens
aagagguagucugucccuuagc

SEQ ID NO: 2483 - RNA, 22 nt, Homo sapiens
gagugcugagcccacuuccuug

SEQ ID NO: 2484 - RNA, 22 nt, Homo sapiens
uucaaaucuucguuuugccaua

SEQ ID NO: 2485 - RNA, 22 nt, Homo sapiens
aucaccagaugcuucaagcaga

SEQ ID NO: 2486 - RNA, 22 nt, Homo sapiens
auagugaacuuugugagaacaa

SEQ ID NO: 2487 - RNA, 22 nt, Homo sapiens
gagauaacuacuggauuaaguu

SEQ ID NO: 2488 - RNA, 22 nt, Homo sapiens
ucugagguuacugcuuuguaga

SEQ ID NO: 2489 - RNA, 22 nt, Homo sapiens
ucuuuguuggaguccaaggaua

SEQ ID NO: 2490 - RNA, 22 nt, Homo sapiens
ugcgccauugcacucuagccug

SEQ ID NO: 2491 - RNA, 22 nt, Homo sapiens
cauugggugagaacaugcuccu

SEQ ID NO: 2492 - RNA, 19 nt, Homo sapiens
agaguauugaauuugcccu

SEQ ID NO: 2493 - RNA, 19 nt, Homo sapiens
ccccuguggauaccgaggg

SEQ ID NO: 2494 - RNA, 22 nt, Homo sapiens
uuccuguagcgauuuuaguaau

SEQ ID NO: 2495 - RNA, 18 nt, Homo sapiens
uguggcuguuuuccaaua

SEQ ID NO: 2496 - RNA, 22 nt, Homo sapiens
gccuaaaguagugguuuaggcu

SEQ ID NO: 2497 - RNA, 22 nt, Homo sapiens
gcccuguugcccugaauacaua

SEQ ID NO: 2498 - RNA, 22 nt, Homo sapiens
uggugccgugguccuggggcca

SEQ ID NO: 2499 - RNA, 20 nt, Homo sapiens
ucaaauucuuggccuccagc

SEQ ID NO: 2500 - RNA, 22 nt, Homo sapiens
uagccgggugugguggaacucc

SEQ ID NO: 2501 - RNA, 22 nt, Homo sapiens
ugccuaguagaaggugaacaug

SEQ ID NO: 2502 - RNA, 22 nt, Homo sapiens
agggcauuguacaaaucaucau

SEQ ID NO: 2503 - RNA, 22 nt, Homo sapiens
aaaguucuugcugaaggauuau

SEQ ID NO: 2504 - RNA, 22 nt, Homo sapiens
gcaccaugguagaauaauggua

SEQ ID NO: 2505 - RNA, 22 nt, Homo sapiens
uagguaucuugguauaucagga

SEQ ID NO: 2506 - RNA, 22 nt, Homo sapiens
uuaugggucuuggaaugcaaua

SEQ ID NO: 2507 - RNA, 22 nt, Homo sapiens
cacagugaacugguggguuuuu

SEQ ID NO: 2508 - RNA, 22 nt, Homo sapiens
uggccuguaacgcugucucagc

SEQ ID NO: 2509 - RNA, 22 nt, Homo sapiens
gagcuaguagagugcacccggc

SEQ ID NO: 2510 - RNA, 21 nt, Homo sapiens
ggcauugugcccuugcucuag

SEQ ID NO: 2511 - RNA, 22 nt, Homo sapiens
auaaauaguaguugugguggcc

SEQ ID NO: 2512 - RNA, 22 nt, Homo sapiens
uuaaggaaggagucuuaaaugg

SEQ ID NO: 2513 - RNA, 22 nt, Homo sapiens
gugcgggaggcgcgccuaggug

SEQ ID NO: 2514 - RNA, 22 nt, Homo sapiens
ucuuuggguguauuucacagcc

SEQ ID NO: 2515 - RNA, 22 nt, Homo sapiens
auccuguacuaagguuuuccca

SEQ ID NO: 2516 - RNA, 22 nt, Homo sapiens
uauuccacucuguuggagguaa

SEQ ID NO: 2517 - RNA, 22 nt, Homo sapiens
gugcccacugucuguccuguag

SEQ ID NO: 2518 - RNA, 22 nt, Homo sapiens
uuccaauguuccguguugcagu

SEQ ID NO: 2519 - RNA, 18 nt, Homo sapiens
uggcaaguuuaguagcac

SEQ ID NO: 2520 - RNA, 22 nt, Homo sapiens
ucaguguuuuauccuccagagc

SEQ ID NO: 2521 - RNA, 22 nt, Homo sapiens
uaaggcccgugaguuucauauc

SEQ ID NO: 2522 - RNA, 22 nt, Homo sapiens
aucuuuggucaucacagcuaga

SEQ ID NO: 2523 - RNA, 22 nt, Homo sapiens
gaagacauuugcugcacguccu

SEQ ID NO: 2524 - RNA, 22 nt, Homo sapiens
uauuacuguuauuccuaucaaa

SEQ ID NO: 2525 - RNA, 22 nt, Homo sapiens
ucuagcacuuacuggcugugug

SEQ ID NO: 2526 - RNA, 22 nt, Homo sapiens
ugcuucauuggccaccaggaag

SEQ ID NO: 2527 - RNA, 19 nt, Homo sapiens
ucacgugcagcagccacac

SEQ ID NO: 2528 - RNA, 22 nt, Homo sapiens
uaucacugucaggcccucauau

SEQ ID NO: 2529 - RNA, 19 nt, Homo sapiens
uggaaugaaauguuagggg

SEQ ID NO: 2530 - RNA, 22 nt, Homo sapiens
uugccauagugcugccagauau

SEQ ID NO: 2531 - RNA, 22 nt, Homo sapiens
augagguauccaagcccagaaa

SEQ ID NO: 2532 - RNA, 22 nt, Homo sapiens
ucagcaucacaggcagugagug

SEQ ID NO: 2533 - RNA, 22 nt, Homo sapiens
aucacagugagcauaugucuau

SEQ ID NO: 2534 - RNA, 22 nt, Homo sapiens
ugacaggucuaauuuacugaca

SEQ ID NO: 2535 - RNA, 22 nt, Homo sapiens
agcaagauccagucgcacagga

SEQ ID NO: 2536 - RNA, 22 nt, Homo sapiens
caggguccccuaccuuuugaug

SEQ ID NO: 2537 - RNA, 22 nt, Homo sapiens
aagguaguuagaaaauauaacu

SEQ ID NO: 2538 - RNA, 22 nt, Homo sapiens
aaaguggugggauuccaggcau

SEQ ID NO: 2539 - RNA, 22 nt, Homo sapiens
auccuguagagaugagggugga

SEQ ID NO: 2540 - RNA, 22 nt, Homo sapiens
cucaaguagugguuuucauuga

SEQ ID NO: 2541 - RNA, 22 nt, Homo sapiens
ugagacugguuaauugauaaag

SEQ ID NO: 2542 - RNA, 22 nt, Homo sapiens
uuuagguauuugguauagcagu

SEQ ID NO: 2543 - RNA, 22 nt, Homo sapiens
ccagaguugccucagguuucug

SEQ ID NO: 2544 - RNA, 19 nt, Homo sapiens
ucuuugaggcaucgcccuc

SEQ ID NO: 2545 - RNA, 22 nt, Homo sapiens
gauagaccauccaggauguuug

SEQ ID NO: 2546 - RNA, 22 nt, Homo sapiens
uuguaacucugaauacauccua

SEQ ID NO: 2547 - RNA, 22 nt, Homo sapiens
uccauuuguucagcuucaggaa

SEQ ID NO: 2548 - RNA, 19 nt, Homo sapiens
acauggauuuugugcaaac

SEQ ID NO: 2549 - RNA, 22 nt, Homo sapiens
auugcaacuuccgccuccuggg

SEQ ID NO: 2550 - RNA, 22 nt, Homo sapiens
gacuggagcuguaugugguuac

SEQ ID NO: 2551 - RNA, 22 nt, Homo sapiens
ucagguagcauuuuggaaacag

SEQ ID NO: 2552 - RNA, 22 nt, Homo sapiens
uucaaggacuaaggauuuuugg

SEQ ID NO: 2553 - RNA, 22 nt, Homo sapiens
ccccguuacagccucagugccu

SEQ ID NO: 2554 - RNA, 22 nt, Homo sapiens
ugauaucugaauagauacacaa

SEQ ID NO: 2555 - RNA, 22 nt, Homo sapiens
auugcauaaacacauuucuuau

SEQ ID NO: 2556 - RNA, 21 nt, Homo sapiens
ugagaugauccugcaugcaug

SEQ ID NO: 2557 - RNA, 22 nt, Homo sapiens
aguauuaggugaguguauuuca

SEQ ID NO: 2558 - RNA, 19 nt, Homo sapiens
uguggucauccugggacga

SEQ ID NO: 2559 - RNA, 22 nt, Homo sapiens
uuugugucccuacccgaaucuc

SEQ ID NO: 2560 - RNA, 22 nt, Homo sapiens
auagaauguaauguaccuccuu

SEQ ID NO: 2561 - RNA, 22 nt, Homo sapiens
uugaucuaugugucuguuuuua

SEQ ID NO: 2562 - RNA, 22 nt, Homo sapiens
auuaaauguuggacguauacau

SEQ ID NO: 2563 - RNA, 22 nt, Homo sapiens
ugcaagaaacauauuccacaag

SEQ ID NO: 2564 - RNA, 18 nt, Homo sapiens
uuagagugcauuacuuug

SEQ ID NO: 2565 - RNA, 22 nt, Homo sapiens
uugaaaguguucacaaugguau

SEQ ID NO: 2566 - RNA, 22 nt, Homo sapiens
uuugucacccugaauguaagau

SEQ ID NO: 2567 - RNA, 22 nt, Homo sapiens
uaaaccuagcauuuugcauaug

SEQ ID NO: 2568 - RNA, 20 nt, Homo sapiens
cagcaaccugcucucuuccu

SEQ ID NO: 2569 - RNA, 17 nt, Homo sapiens
gucuuugguugaguuua

SEQ ID NO: 2570 - RNA, 22 nt, Homo sapiens
ugguauguugucucuuuguucu

SEQ ID NO: 2571 - RNA, 22 nt, Homo sapiens
uuugguugccucuaugagccug

SEQ ID NO: 2572 - RNA, 20 nt, Homo sapiens
gucugucuccgaguagaauu

SEQ ID NO: 2573 - RNA, 22 nt, Homo sapiens
augcagacacaaguuauaguaa

SEQ ID NO: 2574 - RNA, 22 nt, Homo sapiens
uaccaugaagguggagagagaa

SEQ ID NO: 2575 - RNA, 22 nt, Homo sapiens
auugucccucuuaaucccagca

SEQ ID NO: 2576 - RNA, 22 nt, Homo sapiens
cuggcgagacagcuccaucacu

SEQ ID NO: 2577 - RNA, 22 nt, Homo sapiens
guugcugagucccaucaccaga

SEQ ID NO: 2578 - RNA, 20 nt, Homo sapiens
uuugcagaaucuaagaagag

SEQ ID NO: 2579 - RNA, 22 nt, Homo sapiens
ugcgcacugcagauuugaacuc

SEQ ID NO: 2580 - RNA, 22 nt, Homo sapiens
ccauugcacuccauccugggca

SEQ ID NO: 2581 - RNA, 22 nt, Homo sapiens
agugccauggcugcuagauggc

SEQ ID NO: 2582 - RNA, 22 nt, Homo sapiens
uucacuguagcuuggauguuua

SEQ ID NO: 2583 - RNA, 22 nt, Homo sapiens
uugcaugggagcugggugaggc

SEQ ID NO: 2584 - RNA, 22 nt, Homo sapiens
uauggcccuuaaguauugguug

SEQ ID NO: 2585 - RNA, 22 nt, Homo sapiens
uuuggcuuuugugauacguaau

SEQ ID NO: 2586 - RNA, 22 nt, Homo sapiens
ucaaaugcuguauuguaguaau

SEQ ID NO: 2587 - RNA, 22 nt, Homo sapiens
uuuaaggcaggucuggugguga

SEQ ID NO: 2588 - RNA, 22 nt, Homo sapiens
uucacuguaaaaugaagagggu

SEQ ID NO: 2589 - RNA, 22 nt, Homo sapiens
ggguucccugaugagaguuagu

SEQ ID NO: 2590 - RNA, 22 nt, Homo sapiens
ucccagucuagagccggauugg

SEQ ID NO: 2591 - RNA, 22 nt, Homo sapiens
accuguagcagacuuaauauuu

SEQ ID NO: 2592 - RNA, 22 nt, Homo sapiens
gucauucauucagcaagcacug

SEQ ID NO: 2593 - RNA, 22 nt, Homo sapiens
uggaagacucuagucucuugag

SEQ ID NO: 2594 - RNA, 22 nt, Homo sapiens
aaggauuguaaaguugacaaau

SEQ ID NO: 2595 - RNA, 22 nt, Homo sapiens
gcauauguuuggguguguauau

SEQ ID NO: 2596 - RNA, 22 nt, Homo sapiens
guucagguauucuggaacagag

SEQ ID NO: 2597 - RNA, 22 nt, Homo sapiens
augagauuauguaaagagacca

SEQ ID NO: 2598 - RNA, 22 nt, Homo sapiens
gugccacaguguuaagggauuc

SEQ ID NO: 2599 - RNA, 22 nt, Homo sapiens
uaucaugucuguguguaccuag

SEQ ID NO: 2600 - RNA, 23 nt, Homo sapiens
uuuguguccccacccaaaucuca

SEQ ID NO: 2601 - RNA, 22 nt, Homo sapiens
cuggcaguguuucuugugggcu

SEQ ID NO: 2602 - RNA, 22 nt, Homo sapiens
ucacuggcaaauauauccguug

SEQ ID NO: 2603 - RNA, 22 nt, Homo sapiens
uagugcacuacuugugggaaug

SEQ ID NO: 2604 - RNA, 22 nt, Homo sapiens
auagugcugcagucaauguacg

SEQ ID NO: 2605 - RNA, 22 nt, Homo sapiens
guuagcuaguagacaauuuucc

SEQ ID NO: 2606 - RNA, 22 nt, Homo sapiens
ugacuaguuggauaaccuagga

SEQ ID NO: 2607 - RNA, 22 nt, Homo sapiens
cuccauguggcuaacuuuuaaa

SEQ ID NO: 2608 - RNA, 22 nt, Homo sapiens
uugcuuuguuacugcaguuucc

SEQ ID NO: 2609 - RNA, 22 nt, Homo sapiens
uuaggcuuuguguccccaccca

SEQ ID NO: 2610 - RNA, 22 nt, Homo sapiens
uaccagugucagcuuccugugu

SEQ ID NO: 2611 - RNA, 22 nt, Homo sapiens
gugagguguuaaccaaccugug

SEQ ID NO: 2612 - RNA, 22 nt, Homo sapiens
aaauugcaaugcgaggcagagg

SEQ ID NO: 2613 - RNA, 22 nt, Homo sapiens
uugaggucuucaggaucaggcu

SEQ ID NO: 2614 - RNA, 22 nt, Homo sapiens
acagugcuguuguguuuucacg

SEQ ID NO: 2615 - RNA, 22 nt, Homo sapiens
cuucuguuaguucugauaacuu

SEQ ID NO: 2616 - RNA, 22 nt, Homo sapiens
uugauauucuuucuggauccca

SEQ ID NO: 2617 - RNA, 22 nt, Homo sapiens
uuaaggguuuuagaauuuucca

SEQ ID NO: 2618 - RNA, 22 nt, Homo sapiens
uugucauggucuugauccauua

SEQ ID NO: 2619 - RNA, 22 nt, Homo sapiens
uagguucuccacagguucucca

SEQ ID NO: 2620 - RNA, 22 nt, Homo sapiens
uuagguagucucugucagaggg

SEQ ID NO: 2621 - RNA, 21 nt, Homo sapiens
uuuugcacacuaugcagcuuu

SEQ ID NO: 2622 - RNA, 22 nt, Homo sapiens
ugagaaugcagaaucucgugca

SEQ ID NO: 2623 - RNA, 22 nt, Homo sapiens
gaucauggaguuggguucaagg

SEQ ID NO: 2624 - RNA, 22 nt, Homo sapiens
auugugucuuguagagagauau

SEQ ID NO: 2625 - RNA, 22 nt, Homo sapiens
uaggagugugaacccuguuuug

SEQ ID NO: 2626 - RNA, 18 nt, Homo sapiens
agcaucacugaucauccu

SEQ ID NO: 2627 - RNA, 23 nt, Homo sapiens
agacugaaguaucugagacucag

SEQ ID NO: 2628 - RNA, 22 nt, Homo sapiens
cuugacaaugcuucaggcugaa

SEQ ID NO: 2629 - RNA, 22 nt, Homo sapiens
uggaagucuauggcauuugagu

SEQ ID NO: 2630 - RNA, 22 nt, Homo sapiens
uccacaguaaggacccugccuu

SEQ ID NO: 2631 - RNA, 22 nt, Homo sapiens
ugugucacugcacuccagccug

SEQ ID NO: 2632 - RNA, 19 nt, Homo sapiens
uggguagugaugagacaua

SEQ ID NO: 2633 - RNA, 22 nt, Homo sapiens
aacuccauuuuagacccuagau

SEQ ID NO: 2634 - RNA, 22 nt, Homo sapiens
ugacuagggacauucuuccacg

SEQ ID NO: 2635 - RNA, 22 nt, Homo sapiens
ucacugcgaccuccgccucccg

SEQ ID NO: 2636 - RNA, 19 nt, Homo sapiens
gaaguguuguccuccagua

SEQ ID NO: 2637 - RNA, 22 nt, Homo sapiens
ugucuuugguucaggcaaggag

SEQ ID NO: 2638 - RNA, 22 nt, Homo sapiens
uuaaucacagcugaacucaaac

SEQ ID NO: 2639 - RNA, 22 nt, Homo sapiens
uacccuuauguaaucauuauac

SEQ ID NO: 2640 - RNA, 21 nt, Homo sapiens
acauguacacauguaugcaca

SEQ ID NO: 2641 - RNA, 22 nt, Homo sapiens
cuucacuggagucccuggauuc

SEQ ID NO: 2642 - RNA, 22 nt, Homo sapiens
accuucauuguugccaugucca

SEQ ID NO: 2643 - RNA, 22 nt, Homo sapiens
uugaaaucuuccacagcccaag

SEQ ID NO: 2644 - RNA, 22 nt, Homo sapiens
uguucuggagaguuuagucugg

SEQ ID NO: 2645 - RNA, 22 nt, Homo sapiens
acgcagcacauucacagcuaug

SEQ ID NO: 2646 - RNA, 22 nt, Homo sapiens
uucccugugguauagaagccgu

SEQ ID NO: 2647 - RNA, 22 nt, Homo sapiens
ugucauagaugauuuuuuucgg

SEQ ID NO: 2648 - RNA, 22 nt, Homo sapiens
agaaugucagcuggauucagcu

SEQ ID NO: 2649 - RNA, 22 nt, Homo sapiens
auagagcuggcagacacccuua

SEQ ID NO: 2650 - RNA, 19 nt, Homo sapiens
uauguaguugucaagggag

SEQ ID NO: 2651 - RNA, 22 nt, Homo sapiens
uuucuauguugaccagucuaga

SEQ ID NO: 2652 - RNA, 22 nt, Homo sapiens
ugaguguccaccccuuucacag

SEQ ID NO: 2653 - RNA, 22 nt, Homo sapiens
aucagaaucucuagugggacca

SEQ ID NO: 2654 - RNA, 22 nt, Homo sapiens
uugagaucaugcuacugcacuc

SEQ ID NO: 2655 - RNA, 22 nt, Homo sapiens
uugauauauugcaugggcuacu

SEQ ID NO: 2656 - RNA, 22 nt, Homo sapiens
ucugacagugagagaaaucuga

SEQ ID NO: 2657 - RNA, 22 nt, Homo sapiens
auugcacucuaaccuaggugac

SEQ ID NO: 2658 - RNA, 22 nt, Homo sapiens
uucaucaguuauauuggccuga

SEQ ID NO: 2659 - RNA, 22 nt, Homo sapiens
cugugcauuggaugucucccug

SEQ ID NO: 2660 - RNA, 22 nt, Homo sapiens
ugugauagagaaugguggagaa

SEQ ID NO: 2661 - RNA, 22 nt, Homo sapiens
acugcacuccaucuuagguggc

SEQ ID NO: 2662 - RNA, 22 nt, Homo sapiens
uguggaaauaaaagaaagguua

SEQ ID NO: 2663 - RNA, 22 nt, Homo sapiens
uucccucagaaacacacagccc

SEQ ID NO: 2664 - RNA, 22 nt, Homo sapiens
cagcuggugggagcuggguucc

SEQ ID NO: 2665 - RNA, 23 nt, Homo sapiens
ugcaguagugagaucuaggcuca

SEQ ID NO: 2666 - RNA, 22 nt, Homo sapiens
ggcauugugaacauuucccugc

SEQ ID NO: 2667 - RNA, 22 nt, Homo sapiens
cuggaauuacaggguugagcua

SEQ ID NO: 2668 - RNA, 22 nt, Homo sapiens
aauaaagcuuugagcuuugcug

SEQ ID NO: 2669 - RNA, 22 nt, Homo sapiens
cauggcuacugcagauguaggg

SEQ ID NO: 2670 - RNA, 22 nt, Homo sapiens
gaggugaaggucucaauaaaua

SEQ ID NO: 2671 - RNA, 22 nt, Homo sapiens
ugugcgugugccuguaagaauu

SEQ ID NO: 2672 - RNA, 22 nt, Homo sapiens
uuucuacagggcuugccaggua

SEQ ID NO: 2673 - RNA, 22 nt, Homo sapiens
aaugguuuuaucagcguccaaa

SEQ ID NO: 2674 - RNA, 19 nt, Homo sapiens
auugacauugggguguuca

SEQ ID NO: 2675 - RNA, 18 nt, Homo sapiens
auauugccuucagacuag

SEQ ID NO: 2676 - RNA, 18 nt, Homo sapiens
gaaaugccucuugcuuac

SEQ ID NO: 2677 - RNA, 22 nt, Homo sapiens
cuggccagagacauucauuaaa

SEQ ID NO: 2678 - RNA, 22 nt, Homo sapiens
ugaguggagaucgcaccauugc

SEQ ID NO: 2679 - RNA, 22 nt, Homo sapiens
gagaugaaguuaaggaucuuua

SEQ ID NO: 2680 - RNA, 22 nt, Homo sapiens
uuuuggcuuaaagagaauguau

SEQ ID NO: 2681 - RNA, 22 nt, Homo sapiens
uggaaguuaaaugacucuuucu

SEQ ID NO: 2682 - RNA, 20 nt, Homo sapiens
uguaacacauggagaacucu

SEQ ID NO: 2683 - RNA, 22 nt, Homo sapiens
uugcgaugaagacaaaacaugc

SEQ ID NO: 2684 - RNA, 22 nt, Homo sapiens
guugcaaaguaauugugguuuu

SEQ ID NO: 2685 - RNA, 22 nt, Homo sapiens
caucaaaguggagggaaggacc

SEQ ID NO: 2686 - RNA, 21 nt, Homo sapiens
ccauggcaaugguaaacugac

SEQ ID NO: 2687 - RNA, 22 nt, Homo sapiens
ugauaugucccucgacaucagg

SEQ ID NO: 2688 - RNA, 22 nt, Homo sapiens
caauggcacuauuggaaaaggu

SEQ ID NO: 2689 - RNA, 22 nt, Homo sapiens
uuaagcucauuuccauucuaca

SEQ ID NO: 2690 - RNA, 22 nt, Homo sapiens
aauaucacaguggguguacacc

SEQ ID NO: 2691 - RNA, 22 nt, Homo sapiens
gagaacauuuaagccacucagg

SEQ ID NO: 2692 - RNA, 22 nt, Homo sapiens
uuuuuugcuguaugcaaacauc

SEQ ID NO: 2693 - RNA, 22 nt, Homo sapiens
guguaacaacagcacuccacug

SEQ ID NO: 2694 - RNA, 22 nt, Homo sapiens
caaaguaauugcuguuuugcca

SEQ ID NO: 2695 - RNA, 22 nt, Homo sapiens
aucagcagcaugaaaagcaacu

SEQ ID NO: 2696 - RNA, 22 nt, Homo sapiens
guagaagcacagggccuguauu

SEQ ID NO: 2697 - RNA, 22 nt, Homo sapiens
cugaaagguauacgcuuguuau

SEQ ID NO: 2698 - RNA, 22 nt, Homo sapiens
agccaguauuuuauugaggauu

SEQ ID NO: 2699 - RNA, 22 nt, Homo sapiens
guaaucucagcuccucaugagg

SEQ ID NO: 2700 - RNA, 22 nt, Homo sapiens
ggagauaauccagggagggacu

SEQ ID NO: 2701 - RNA, 22 nt, Homo sapiens
uuuacagucucauagguggaag

SEQ ID NO: 2702 - RNA, 22 nt, Homo sapiens
aucgcaccauugcacuccagca

SEQ ID NO: 2703 - RNA, 22 nt, Homo sapiens
ugucaggaggguccagagaaaa

SEQ ID NO: 2704 - RNA, 22 nt, Homo sapiens
auagcucuugcuuacccacugu

SEQ ID NO: 2705 - RNA, 22 nt, Homo sapiens
guucuggagauaaagccaaggu

SEQ ID NO: 2706 - RNA, 22 nt, Homo sapiens
cauacagcuaguaaguguaaga

SEQ ID NO: 2707 - RNA, 22 nt, Homo sapiens
cacagcacaggcaugaguguca

SEQ ID NO: 2708 - RNA, 23 nt, Homo sapiens
ggauucaucuguuuguucgcugu

SEQ ID NO: 2709 - RNA, 22 nt, Homo sapiens
agcugguuuauuucucacaaca

SEQ ID NO: 2710 - RNA, 22 nt, Homo sapiens
gugaacaagcaaaggcaggagg

SEQ ID NO: 2711 - RNA, 22 nt, Homo sapiens
uuaccuugcacugagucugaaa

SEQ ID NO: 2712 - RNA, 22 nt, Homo sapiens
acccugucauccacauggugcu

SEQ ID NO: 2713 - RNA, 22 nt, Homo sapiens
gcuaugguuuuuagcuccauca

SEQ ID NO: 2714 - RNA, 22 nt, Homo sapiens
ugcauugccgugauuacugucu

SEQ ID NO: 2715 - RNA, 22 nt, Homo sapiens
uucccagugguuagcucugguc

SEQ ID NO: 2716 - RNA, 22 nt, Homo sapiens
aucacaguuuuaccauuuggua

SEQ ID NO: 2717 - RNA, 22 nt, Homo sapiens
aauccaugugcuuuaccauuuu

SEQ ID NO: 2718 - RNA, 22 nt, Homo sapiens
cauugcacuccagccugaggga

SEQ ID NO: 2719 - RNA, 22 nt, Homo sapiens
uugagauggagucucguucugu

SEQ ID NO: 2720 - RNA, 22 nt, Homo sapiens
auagcagacauuucaaggcagg

SEQ ID NO: 2721 - RNA, 22 nt, Homo sapiens
aacauagucaugggguaauguu

SEQ ID NO: 2722 - RNA, 22 nt, Homo sapiens
uugugguugacuaaauuuguaa

SEQ ID NO: 2723 - RNA, 21 nt, Homo sapiens
uuguaugguugaacuugauac

SEQ ID NO: 2724 - RNA, 22 nt, Homo sapiens
uucucaguuccuacuuugguga

SEQ ID NO: 2725 - RNA, 22 nt, Homo sapiens
aauagcacuguagauggaggaa

SEQ ID NO: 2726 - RNA, 22 nt, Homo sapiens
agcugcauucguaucauauugu

SEQ ID NO: 2727 - RNA, 22 nt, Homo sapiens
ugacaugaagaaaaacagauuu

SEQ ID NO: 2728 - RNA, 22 nt, Homo sapiens
uaugaaagcuacuucucacaau

SEQ ID NO: 2729 - RNA, 22 nt, Homo sapiens
uauucacaggugugggacaaag

SEQ ID NO: 2730 - RNA, 22 nt, Homo sapiens
aguaccacgugaugccauuuuc

SEQ ID NO: 2731 - RNA, 22 nt, Homo sapiens
gcagugugugaggaauuugggu

SEQ ID NO: 2732 - RNA, 22 nt, Homo sapiens
augagcuaguguaggguacuga

SEQ ID NO: 2733 - RNA, 22 nt, Homo sapiens
gcccagauguuuggggucaugg

SEQ ID NO: 2734 - RNA, 22 nt, Homo sapiens
aaggaauucaaauuuucucugg

SEQ ID NO: 2735 - RNA, 22 nt, Homo sapiens
cugagauacacuaauagucucu

SEQ ID NO: 2736 - RNA, 22 nt, Homo sapiens
uucacugagccagacuaagaca

SEQ ID NO: 2737 - RNA, 22 nt, Homo sapiens
ucucagugugguaaaaguuuuu

SEQ ID NO: 2738 - RNA, 22 nt, Homo sapiens
ucugucuuugccuaaguuuguc

SEQ ID NO: 2739 - RNA, 22 nt, Homo sapiens
ugagaugaagucucacucuguc

SEQ ID NO: 2740 - RNA, 22 nt, Homo sapiens
aucaaaguaggcauauguuuuu

SEQ ID NO: 2741 - RNA, 22 nt, Homo sapiens
augguuagauguauccuuucca

SEQ ID NO: 2742 - RNA, 19 nt, Homo sapiens
caucacagagucuuccauu

SEQ ID NO: 2743 - RNA, 22 nt, Homo sapiens
ugucuggaaggguggccuccug

SEQ ID NO: 2744 - RNA, 22 nt, Homo sapiens
uuuggcagaaaacaagaaucug

SEQ ID NO: 2745 - RNA, 20 nt, Homo sapiens
auaaauguauagguguacau

SEQ ID NO: 2746 - RNA, 22 nt, Homo sapiens
agcacagugguuaaguuucuua

SEQ ID NO: 2747 - RNA, 22 nt, Homo sapiens
uuauugcacuccagccugggua

SEQ ID NO: 2748 - RNA, 22 nt, Homo sapiens
cccaguagagauugccgaauug

SEQ ID NO: 2749 - RNA, 22 nt, Homo sapiens
uaugucacagguuuuggugaaa

SEQ ID NO: 2750 - RNA, 20 nt, Homo sapiens
cuuccaguggccccaucuuu

SEQ ID NO: 2751 - RNA, 22 nt, Homo sapiens
guaauaacuguggaaaaagguu

SEQ ID NO: 2752 - RNA, 22 nt, Homo sapiens
accauugcacuccagccuuggc

SEQ ID NO: 2753 - RNA, 19 nt, Homo sapiens
agugucauggucauuauuu

SEQ ID NO: 2754 - RNA, 22 nt, Homo sapiens
uguuggcauugcugcugacccu

SEQ ID NO: 2755 - RNA, 22 nt, Homo sapiens
uaugaaucugagagaucuggaa

SEQ ID NO: 2756 - RNA, 22 nt, Homo sapiens
ggcaaaucugcaauuacuuuug

SEQ ID NO: 2757 - RNA, 22 nt, Homo sapiens
ggaaaguaacccauucucuuac

SEQ ID NO: 2758 - RNA, 22 nt, Homo sapiens
uaucagagcugucagccuaccu

SEQ ID NO: 2759 - RNA, 22 nt, Homo sapiens
gagaaugaacagacugccucuu

SEQ ID NO: 2760 - RNA, 22 nt, Homo sapiens
ugcuuuguuauauggggauucu

SEQ ID NO: 2761 - RNA, 22 nt, Homo sapiens
ggcaacaugccgaaaccacguc

SEQ ID NO: 2762 - RNA, 22 nt, Homo sapiens
uuagguuauuacugacaauaau

SEQ ID NO: 2763 - RNA, 22 nt, Homo sapiens
aauugcuuuuauuuagggccag

SEQ ID NO: 2764 - RNA, 22 nt, Homo sapiens
cugacaagugaucacagcagca

SEQ ID NO: 2765 - RNA, 22 nt, Homo sapiens
auugcacacagaaucaggguaa

SEQ ID NO: 2766 - RNA, 22 nt, Homo sapiens
gagcaucauucaacaaaagucu

SEQ ID NO: 2767 - RNA, 22 nt, Homo sapiens
ugucacaguuuguacuuuauag

SEQ ID NO: 2768 - RNA, 22 nt, Homo sapiens
ucagguaaucuauuugucuuuu

SEQ ID NO: 2769 - RNA, 22 nt, Homo sapiens
auaaaugcuuccagucauuaaa

SEQ ID NO: 2770 - RNA, 22 nt, Homo sapiens
auagaguccugcucgaguugcu

SEQ ID NO: 2771 - RNA, 20 nt, Homo sapiens
ugauuaguccacuuggcucu

SEQ ID NO: 2772 - RNA, 22 nt, Homo sapiens
gcacuacugcacuccagucuag

SEQ ID NO: 2773 - RNA, 20 nt, Homo sapiens
gggcaaguaugugggaaguc

SEQ ID NO: 2774 - RNA, 22 nt, Homo sapiens
uuguaauggagcaaacagguug

SEQ ID NO: 2775 - RNA, 22 nt, Homo sapiens
gucucauugcaguuagaccugu

SEQ ID NO: 2776 - RNA, 22 nt, Homo sapiens
ugacaagauauggucuuaucaa

SEQ ID NO: 2777 - RNA, 17 nt, Homo sapiens
ugcuuagagagccucag

SEQ ID NO: 2778 - RNA, 22 nt, Homo sapiens
cuugacacugucacucaggcca

SEQ ID NO: 2779 - RNA, 18 nt, Homo sapiens
uuuacaguagaaggacuu

SEQ ID NO: 2780 - RNA, 22 nt, Homo sapiens
uucauguagucaucauccugcu

SEQ ID NO: 2781 - RNA, 18 nt, Homo sapiens
ucacagguaaaguugaca

SEQ ID NO: 2782 - RNA, 22 nt, Homo sapiens
aagcaggugaugagugggugug

SEQ ID NO: 2783 - RNA, 19 nt, Homo sapiens
ugagguauuuguugggaga

SEQ ID NO: 2784 - RNA, 16 nt, Homo sapiens
ugugucuugggcccug

SEQ ID NO: 2785 - RNA, 19 nt, Homo sapiens
auugcaguguaaaacuauu

SEQ ID NO: 2786 - RNA, 22 nt, Homo sapiens
uugacuacaccaugccaggaac

SEQ ID NO: 2787 - RNA, 22 nt, Homo sapiens
uuugacuuuuagaauaugaguu

SEQ ID NO: 2788 - RNA, 18 nt, Homo sapiens
gugucugguuaugggagu

SEQ ID NO: 2789 - RNA, 22 nt, Homo sapiens
auuguacuccagccugggcugc

SEQ ID NO: 2790 - RNA, 22 nt, Homo sapiens
aaggcucuuucaacguaaauua

SEQ ID NO: 2791 - RNA, 22 nt, Homo sapiens
auuuccuguaggggcuugcgaa

SEQ ID NO: 2792 - RNA, 22 nt, Homo sapiens
agcuuuuugggcagcuauugac

SEQ ID NO: 2793 - RNA, 22 nt, Homo sapiens
acuuuuugcaaccauuuggacc

SEQ ID NO: 2794 - RNA, 22 nt, Homo sapiens
ucacugugugucucuguaucug

SEQ ID NO: 2795 - RNA, 22 nt, Homo sapiens
uugcauaauaagauuggggggg

SEQ ID NO: 2796 - RNA, 22 nt, Homo sapiens
aagguggaguugacaauuuuca

SEQ ID NO: 2797 - RNA, 22 nt, Homo sapiens
aaguauuaagacuaagaggcuu

SEQ ID NO: 2798 - RNA, 22 nt, Homo sapiens
auuggcaauagcuuucuuacua

SEQ ID NO: 2799 - RNA, 22 nt, Homo sapiens
gagcucguuuuugcugacucuu

SEQ ID NO: 2800 - RNA, 22 nt, Homo sapiens
auuuugcauugcuguaaaggaa

SEQ ID NO: 2801 - RNA, 22 nt, Homo sapiens
aaagugcugggauuaggccagg

SEQ ID NO: 2802 - RNA, 22 nt, Homo sapiens
cuagcacauaguuauucacuca

SEQ ID NO: 2803 - RNA, 22 nt, Homo sapiens
uuugcuaaucaacacuggccug

SEQ ID NO: 2804 - RNA, 23 nt, Homo sapiens
ccacacuguuuagaauggcauca

SEQ ID NO: 2805 - RNA, 22 nt, Homo sapiens
gguaaaucuucacuaagacuga

SEQ ID NO: 2806 - RNA, 22 nt, Homo sapiens
auuugucacuuaacagccauua

SEQ ID NO: 2807 - RNA, 22 nt, Homo sapiens
ucccugaaaaauuggcuuaaca

SEQ ID NO: 2808 - RNA, 22 nt, Homo sapiens
gaguaaauguccuagcuucuug

SEQ ID NO: 2809 - RNA, 17 nt, Homo sapiens
ugaggcacuaguaucac

SEQ ID NO: 2810 - RNA, 22 nt, Homo sapiens
uuucuacagugaacgauuucua

SEQ ID NO: 2811 - RNA, 22 nt, Homo sapiens
uuacccauuagagaauuuaaga

SEQ ID NO: 2812 - RNA, 22 nt, Homo sapiens
augagggcggacgcccuggaga

SEQ ID NO: 2813 - RNA, 22 nt, Homo sapiens
uaucagaguuacacugaagacu

SEQ ID NO: 2814 - RNA, 22 nt, Homo sapiens
ucauacuguuaaaugguuuagu

SEQ ID NO: 2815 - RNA, 22 nt, Homo sapiens
agcugguccugugacuugcuuc

SEQ ID NO: 2816 - RNA, 22 nt, Homo sapiens
augaggagguaugauuuucuga

SEQ ID NO: 2817 - RNA, 22 nt, Homo sapiens
uugcauuguacuugguacggcu

SEQ ID NO: 2818 - RNA, 22 nt, Homo sapiens
agcuggauuguuuaccuggggc

SEQ ID NO: 2819 - RNA, 22 nt, Homo sapiens
acauacacuagggauguggugu

SEQ ID NO: 2820 - RNA, 22 nt, Homo sapiens
uauggcuuuguucaacagccuc

SEQ ID NO: 2821 - RNA, 22 nt, Homo sapiens
gagugcaauggcaugaucuggg

SEQ ID NO: 2822 - RNA, 22 nt, Homo sapiens
ugucacuuugccuucuggacuu

SEQ ID NO: 2823 - RNA, 22 nt, Homo sapiens
ugucaguguacuguaagaauua

SEQ ID NO: 2824 - RNA, 22 nt, Homo sapiens
ucacugcacuagguaaugccac

SEQ ID NO: 2825 - RNA, 22 nt, Homo sapiens
uucuggcucgauucucugaccg

SEQ ID NO: 2826 - RNA, 22 nt, Homo sapiens
cugauauuuuaaaauuggcugg

SEQ ID NO: 2827 - RNA, 22 nt, Homo sapiens
augccacugcacucuagccugg

SEQ ID NO: 2828 - RNA, 22 nt, Homo sapiens
augccauugcacuccagccugg

SEQ ID NO: 2829 - RNA, 22 nt, Homo sapiens
aguauguuuugaaaccaagaag

SEQ ID NO: 2830 - RNA, 22 nt, Homo sapiens
gcagugcaugacgguauauaua

SEQ ID NO: 2831 - RNA, 22 nt, Homo sapiens
gucaaagugauuguaauuaggu

SEQ ID NO: 2832 - RNA, 22 nt, Homo sapiens
ccauuucacucuuccugaagga

SEQ ID NO: 2833 - RNA, 22 nt, Homo sapiens
cuuguuguggaggggagugcag

SEQ ID NO: 2834 - RNA, 22 nt, Homo sapiens
ucuugguugaaaauucauaaua

SEQ ID NO: 2835 - RNA, 22 nt, Homo sapiens
uacagugggcacuggcgcccug

SEQ ID NO: 2836 - RNA, 22 nt, Homo sapiens
auggcacugaagcguauugaca

SEQ ID NO: 2837 - RNA, 22 nt, Homo sapiens
ugugcaaaaacaauugcgguuu

SEQ ID NO: 2838 - RNA, 22 nt, Homo sapiens
auuagguuaggcaaacuucugu

SEQ ID NO: 2839 - RNA, 22 nt, Homo sapiens
uugcaguaguaacuccuuaccu

SEQ ID NO: 2840 - RNA, 22 nt, Homo sapiens
uuaaaccugucuucucacuaau

SEQ ID NO: 2841 - RNA, 20 nt, Homo sapiens
ugacuggauacccuuuggcu

SEQ ID NO: 2842 - RNA, 20 nt, Homo sapiens
gaacugguguauguuuaacu

SEQ ID NO: 2843 - RNA, 22 nt, Homo sapiens
uugcaugucugcuucuccuccu

SEQ ID NO: 2844 - RNA, 22 nt, Homo sapiens
agucaagaaucucagcaucuuu

SEQ ID NO: 2845 - RNA, 22 nt, Homo sapiens
aucccuuccuagcacuuggugu

SEQ ID NO: 2846 - RNA, 22 nt, Homo sapiens
caagagagcugaugguuuuaaa

SEQ ID NO: 2847 - RNA, 22 nt, Homo sapiens
gcuggucugccguaguaggugc

SEQ ID NO: 2848 - RNA, 22 nt, Homo sapiens
cauugcagauccuucaaaugac

SEQ ID NO: 2849 - RNA, 22 nt, Homo sapiens
caagugaauaguugcucucaga

SEQ ID NO: 2850 - RNA, 22 nt, Homo sapiens
uauuacuugucugugucucaau

SEQ ID NO: 2851 - RNA, 21 nt, Homo sapiens
uaauggcaugaucucggcuca

SEQ ID NO: 2852 - RNA, 22 nt, Homo sapiens
uugcacuccagccuggaugaca

SEQ ID NO: 2853 - RNA, 22 nt, Homo sapiens
uucaacagugauggccuuugua

SEQ ID NO: 2854 - RNA, 22 nt, Homo sapiens
gagauacacccagugcagaggc

SEQ ID NO: 2855 - RNA, 22 nt, Homo sapiens
aaucccauuucucuguguuuuu

SEQ ID NO: 2856 - RNA, 22 nt, Homo sapiens
uuaacacugccauugauacugu

SEQ ID NO: 2857 - RNA, 23 nt, Homo sapiens
agucaguaugcuccuuggauccc

SEQ ID NO: 2858 - RNA, 22 nt, Homo sapiens
uuuggcacuauagguaaauuug

SEQ ID NO: 2859 - RNA, 22 nt, Homo sapiens
cuuuagcaaggauauggggaug

SEQ ID NO: 2860 - RNA, 22 nt, Homo sapiens
ggagucugauuuuuauguugcu

SEQ ID NO: 2861 - RNA, 22 nt, Homo sapiens
cauagcacacguauaccuaugu

SEQ ID NO: 2862 - RNA, 22 nt, Homo sapiens
ugugaaccucuggccaagauga

SEQ ID NO: 2863 - RNA, 23 nt, Homo sapiens
acaguauguggauguggcuaagu

SEQ ID NO: 2864 - RNA, 22 nt, Homo sapiens
uggauuguaacauagaguaaau

SEQ ID NO: 2865 - RNA, 22 nt, Homo sapiens
ggagauuauuaguguuucaugc

SEQ ID NO: 2866 - RNA, 22 nt, Homo sapiens
gagaugguguuccacugccagu

SEQ ID NO: 2867 - RNA, 22 nt, Homo sapiens
uccuugagaggacagagccaua

SEQ ID NO: 2868 - RNA, 22 nt, Homo sapiens
ucuuuuguaaaaugaggaggug

SEQ ID NO: 2869 - RNA, 22 nt, Homo sapiens
uggcagacaaauuugagcauau

SEQ ID NO: 2870 - RNA, 22 nt, Homo sapiens
gucucagugcgaaucucaaaga

SEQ ID NO: 2871 - RNA, 22 nt, Homo sapiens
uuggacuuuuauucugcaggca

SEQ ID NO: 2872 - RNA, 22 nt, Homo sapiens
ucucugguuuucaaagcaguau

SEQ ID NO: 2873 - RNA, 22 nt, Homo sapiens
guccaagacuaggaguuggcag

SEQ ID NO: 2874 - RNA, 22 nt, Homo sapiens
auguuaacaucuuaguuuucau

SEQ ID NO: 2875 - RNA, 20 nt, Homo sapiens
agcuccauuccugaaggcug

SEQ ID NO: 2876 - RNA, 22 nt, Homo sapiens
uauacuguuuucuauaguggcu

SEQ ID NO: 2877 - RNA, 22 nt, Homo sapiens
uuuggcucugugucccacccaa

SEQ ID NO: 2878 - RNA, 22 nt, Homo sapiens
uguacccuuagagagugaucga

SEQ ID NO: 2879 - RNA, 21 nt, Homo sapiens
uauagcagcacgauuuauagu

SEQ ID NO: 2880 - RNA, 22 nt, Homo sapiens
aagagguuauagaguguauacu

SEQ ID NO: 2881 - RNA, 22 nt, Homo sapiens
agugacuagaauaugaauuuua

SEQ ID NO: 2882 - RNA, 22 nt, Homo sapiens
uuagauaguacuuagggaaaua

SEQ ID NO: 2883 - RNA, 20 nt, Homo sapiens
uuccagcacauuagggaagc

SEQ ID NO: 2884 - RNA, 22 nt, Homo sapiens
cacugcauccuccauauccugg

SEQ ID NO: 2885 - RNA, 22 nt, Homo sapiens
uaaugcacuuuccuccaaggcu

SEQ ID NO: 2886 - RNA, 22 nt, Homo sapiens
cuaaagugcuuaaaaucucauu

SEQ ID NO: 2887 - RNA, 18 nt, Homo sapiens
acuggaauuaaacuuuuu

SEQ ID NO: 2888 - RNA, 22 nt, Homo sapiens
cuguccugcagagucagaauga

SEQ ID NO: 2889 - RNA, 22 nt, Homo sapiens
augagguaguagaaagucaggu

SEQ ID NO: 2890 - RNA, 23 nt, Homo sapiens
aguacuguaguaauugaggggaa

SEQ ID NO: 2891 - RNA, 22 nt, Homo sapiens
uugugucccugcggcugaggag

SEQ ID NO: 2892 - RNA, 22 nt, Homo sapiens
auugcacuccagccugggcuag

SEQ ID NO: 2893 - RNA, 22 nt, Homo sapiens
uucaguauugcaccuggagucc

SEQ ID NO: 2894 - RNA, 22 nt, Homo sapiens
cuauggcucugucuuuuaaguu

SEQ ID NO: 2895 - RNA, 22 nt, Homo sapiens
uaagcuguguggacuaugccuc

SEQ ID NO: 2896 - RNA, 20 nt, Homo sapiens
ggagguguugauuuuucuuu

SEQ ID NO: 2897 - RNA, 22 nt, Homo sapiens
auggcucuguuuuuuaugcucu

SEQ ID NO: 2898 - RNA, 22 nt, Homo sapiens
aagagcucucuguagcauguga

SEQ ID NO: 2899 - RNA, 22 nt, Homo sapiens
ccuggcacugggccccguggcu

SEQ ID NO: 2900 - RNA, 22 nt, Homo sapiens
uuggaaugcacacugagccugc

SEQ ID NO: 2901 - RNA, 22 nt, Homo sapiens
uaguguuuuucauuggcagagg

SEQ ID NO: 2902 - RNA, 22 nt, Homo sapiens
caaaggcuuccacugcauccuu

SEQ ID NO: 2903 - RNA, 22 nt, Homo sapiens
cuauucacaggcaauauguaca

SEQ ID NO: 2904 - RNA, 22 nt, Homo sapiens
ucacauuguacaaacagguaag

SEQ ID NO: 2905 - RNA, 22 nt, Homo sapiens
augcaugucaaauuuguagguu

SEQ ID NO: 2906 - RNA, 22 nt, Homo sapiens
aaggaaguaauuugguuuauag

SEQ ID NO: 2907 - RNA, 22 nt, Homo sapiens
gagcuuggguuaaaguugccuu

SEQ ID NO: 2908 - RNA, 22 nt, Homo sapiens
uaggcacacaucuacuacaaau

SEQ ID NO: 2909 - RNA, 22 nt, Homo sapiens
uugaguauuugcagucugaaca

SEQ ID NO: 2910 - RNA, 22 nt, Homo sapiens
aaggaagcuagcaggaauuggu

SEQ ID NO: 2911 - RNA, 22 nt, Homo sapiens
auacaugugcaggucagguuac

SEQ ID NO: 2912 - RNA, 22 nt, Homo sapiens
gucucugagaugucaacaccua

SEQ ID NO: 2913 - RNA, 20 nt, Homo sapiens
auucauggugguacguuguc

SEQ ID NO: 2914 - RNA, 22 nt, Homo sapiens
agcagcauuccaaaaaucugcu

SEQ ID NO: 2915 - RNA, 22 nt, Homo sapiens
ucagaugcauccauaccccacu

SEQ ID NO: 2916 - RNA, 22 nt, Homo sapiens
auaauaguguuuagauuuggga

SEQ ID NO: 2917 - RNA, 22 nt, Homo sapiens
uuagguuguuucuggucuuagg

SEQ ID NO: 2918 - RNA, 22 nt, Homo sapiens
uuggcagugguucugacggacc

SEQ ID NO: 2919 - RNA, 17 nt, Homo sapiens
acuuuuugaggaggcau

SEQ ID NO: 2920 - RNA, 22 nt, Homo sapiens
uggcaaauuccaaaguuaauuc

SEQ ID NO: 2921 - RNA, 22 nt, Homo sapiens
ucuaucacagugauguuccaga

SEQ ID NO: 2922 - RNA, 23 nt, Homo sapiens
uauugcacuaugguaacccuuuu

SEQ ID NO: 2923 - RNA, 22 nt, Homo sapiens
acacuggaggagagcuguugcu

SEQ ID NO: 2924 - RNA, 22 nt, Homo sapiens
aauugaaugauaugggacauuu

SEQ ID NO: 2925 - RNA, 22 nt, Homo sapiens
guguaugguuguuguagagaga

SEQ ID NO: 2926 - RNA, 19 nt, Homo sapiens
ucagaucagcccaagggau

SEQ ID NO: 2927 - RNA, 22 nt, Homo sapiens
uugauauguguauagcaugugg

SEQ ID NO: 2928 - RNA, 20 nt, Homo sapiens
ugguccccaccaaaucucau

SEQ ID NO: 2929 - RNA, 21 nt, Homo sapiens
uuugugguuacugugugagcu

SEQ ID NO: 2930 - RNA, 22 nt, Homo sapiens
gucucacaggcaugaugccagc

SEQ ID NO: 2931 - RNA, 22 nt, Homo sapiens
auagugcugcacuaaacauaca

SEQ ID NO: 2932 - RNA, 22 nt, Homo sapiens
augccacugcacuccaaccugg

SEQ ID NO: 2933 - RNA, 20 nt, Homo sapiens
ucacugagugguccacagua

SEQ ID NO: 2934 - RNA, 22 nt, Homo sapiens
uagacugguuuagcacugaaua

SEQ ID NO: 2935 - RNA, 22 nt, Homo sapiens
augugcuuauagguguauguuu

SEQ ID NO: 2936 - RNA, 22 nt, Homo sapiens
uacugcacuccacccuggguga

SEQ ID NO: 2937 - RNA, 22 nt, Homo sapiens
auugcacuccagccugggggac

SEQ ID NO: 2938 - RNA, 22 nt, Homo sapiens
ugaauguucuuaaaacccuugu

SEQ ID NO: 2939 - RNA, 22 nt, Homo sapiens
ggcaaguucuaaugauuagaau

SEQ ID NO: 2940 - RNA, 22 nt, Homo sapiens
aaugccaucagagaaaacucuu

SEQ ID NO: 2941 - RNA, 22 nt, Homo sapiens
uucaaaaccucugcuuaagccc

SEQ ID NO: 2942 - RNA, 22 nt, Homo sapiens
uaagucguggaugauucuucgg

SEQ ID NO: 2943 - RNA, 22 nt, Homo sapiens
cacuguggauggaacuauguga

SEQ ID NO: 2944 - RNA, 18 nt, Homo sapiens
ccuuaguuauagagaguc

SEQ ID NO: 2945 - RNA, 22 nt, Homo sapiens
uugagauggaguuucacucuug

SEQ ID NO: 2946 - RNA, 22 nt, Homo sapiens
cuacagcacugagcugugugca

SEQ ID NO: 2947 - RNA, 22 nt, Homo sapiens
cauggcuuuauuuucagcuucu

SEQ ID NO: 2948 - RNA, 22 nt, Homo sapiens
gagguauagaacaccuuucaag

SEQ ID NO: 2949 - RNA, 22 nt, Homo sapiens
uaaagcuuagauccaugguggc

SEQ ID NO: 2950 - RNA, 22 nt, Homo sapiens
uuuggguuaguuuuccaaucuu

SEQ ID NO: 2951 - RNA, 22 nt, Homo sapiens
ugacaagaguagagagggugcc

SEQ ID NO: 2952 - RNA, 21 nt, Homo sapiens
ugaaccccugcucucaagaaa

SEQ ID NO: 2953 - RNA, 22 nt, Homo sapiens
ugguauguauacuagcgacacu

SEQ ID NO: 2954 - RNA, 22 nt, Homo sapiens
gaaagauuuuaacugggagacu

SEQ ID NO: 2955 - RNA, 22 nt, Homo sapiens
uuacugcuuaagugauucaaca

SEQ ID NO: 2956 - RNA, 22 nt, Homo sapiens
uuacuacucucuaugaccaguu

SEQ ID NO: 2957 - RNA, 22 nt, Homo sapiens
cagcuugugguauugcugguug

SEQ ID NO: 2958 - RNA, 22 nt, Homo sapiens
auugcaaugggaaacuaugaaa

SEQ ID NO: 2959 - RNA, 22 nt, Homo sapiens
auggcaguuuggucucugugcu

SEQ ID NO: 2960 - RNA, 22 nt, Homo sapiens
augagcuaggacagaaugucag

SEQ ID NO: 2961 - RNA, 22 nt, Homo sapiens
cucugacagugguuagcacugu

SEQ ID NO: 2962 - RNA, 22 nt, Homo sapiens
uagcugguauuaggaguugugu

SEQ ID NO: 2963 - RNA, 22 nt, Homo sapiens
aacacggcccgcagagcaagcu

SEQ ID NO: 2964 - RNA, 23 nt, Homo sapiens
uuguaacuggagaguaacauucc

SEQ ID NO: 2965 - RNA, 22 nt, Homo sapiens
uugccuaggcuggagugcagug

SEQ ID NO: 2966 - RNA, 22 nt, Homo sapiens
acccugacacgauucuucacuu

SEQ ID NO: 2967 - RNA, 21 nt, Homo sapiens
augacccuggguguccuuucc

SEQ ID NO: 2968 - RNA, 22 nt, Homo sapiens
ucaccggagguggguugaccag

SEQ ID NO: 2969 - RNA, 22 nt, Homo sapiens
cauuuugcaguuucugucucca

SEQ ID NO: 2970 - RNA, 22 nt, Homo sapiens
uaugaagccaggauuuauuauu

SEQ ID NO: 2971 - RNA, 20 nt, Homo sapiens
auugaacucaguauucugaa

SEQ ID NO: 2972 - RNA, 22 nt, Homo sapiens
uaggagcacaaaccccauugug

SEQ ID NO: 2973 - RNA, 22 nt, Homo sapiens
uuggagagugauauucagaugc

SEQ ID NO: 2974 - RNA, 22 nt, Homo sapiens
cauagcacugcacuucagccug

SEQ ID NO: 2975 - RNA, 22 nt, Homo sapiens
aucucuugccagucagaauggu

SEQ ID NO: 2976 - RNA, 19 nt, Homo sapiens
acuuuggugauuagaggga

SEQ ID NO: 2977 - RNA, 22 nt, Homo sapiens
uugaccaaagaagagucauugc

SEQ ID NO: 2978 - RNA, 22 nt, Homo sapiens
cugcauuagucuguuuaguguu

SEQ ID NO: 2979 - RNA, 22 nt, Homo sapiens
gagguaggaauaaacauuugaa

SEQ ID NO: 2980 - RNA, 22 nt, Homo sapiens
gugagcgaggaaacgacggcgc

SEQ ID NO: 2981 - RNA, 22 nt, Homo sapiens
caucacaugcuuauuuuccuca

SEQ ID NO: 2982 - RNA, 22 nt, Homo sapiens
uguacaaauuucugugguggug

SEQ ID NO: 2983 - RNA, 22 nt, Homo sapiens
aucuuugauuguagguacaaug

SEQ ID NO: 2984 - RNA, 22 nt, Homo sapiens
auugcaaagcguagacucuaaa

SEQ ID NO: 2985 - RNA, 22 nt, Homo sapiens
gcugcuguuauucaucagaacu

SEQ ID NO: 2986 - RNA, 22 nt, Homo sapiens
uuggcuuguaaaaugaaaagcu

SEQ ID NO: 2987 - RNA, 22 nt, Homo sapiens
ugcauaucuucuuuugagaaau

SEQ ID NO: 2988 - RNA, 22 nt, Homo sapiens
guguaguuugagguaugggggc

SEQ ID NO: 2989 - RNA, 20 nt, Homo sapiens
uuucuccccuauaaaucuca

SEQ ID NO: 2990 - RNA, 22 nt, Homo sapiens
cuggaagaaaaucacgccaucu

SEQ ID NO: 2991 - RNA, 22 nt, Homo sapiens
auggcacucaaucaaguugaga

SEQ ID NO: 2992 - RNA, 22 nt, Homo sapiens
uaggagcauaggauuguuugag

SEQ ID NO: 2993 - RNA, 22 nt, Homo sapiens
uaaggcaaucagucaugguguu

SEQ ID NO: 2994 - RNA, 18 nt, Homo sapiens
augagagccgauuccugg

SEQ ID NO: 2995 - RNA, 22 nt, Homo sapiens
cagcaguuguuucggauuggga

SEQ ID NO: 2996 - RNA, 22 nt, Homo sapiens
agucagucuguccugugcugag

SEQ ID NO: 2997 - RNA, 22 nt, Homo sapiens
ucuaagaauucauuuauaagcc

SEQ ID NO: 2998 - RNA, 22 nt, Homo sapiens
ugcauacuguaugcgugcauac

SEQ ID NO: 2999 - RNA, 19 nt, Homo sapiens
guauuugguaaacucucca

SEQ ID NO: 3000 - RNA, 22 nt, Homo sapiens
uaguucguguuugaacuagauc

SEQ ID NO: 3001 - RNA, 20 nt, Homo sapiens
auaugguugugagugauuuu

SEQ ID NO: 3002 - RNA, 22 nt, Homo sapiens
guucaucagggauauuggccug

SEQ ID NO: 3003 - RNA, 20 nt, Homo sapiens
ugcaguguccucacuuguca

SEQ ID NO: 3004 - RNA, 22 nt, Homo sapiens
uuuggguuuuauguaacagcua

SEQ ID NO: 3005 - RNA, 18 nt, Homo sapiens
ggaaaacuuuucuaagua

SEQ ID NO: 3006 - RNA, 22 nt, Homo sapiens
ugcuuaggcuaacaaaaauagc

SEQ ID NO: 3007 - RNA, 22 nt, Homo sapiens
aucccugaggaauuucugcacu

SEQ ID NO: 3008 - RNA, 22 nt, Homo sapiens
uaguagcauaccuaaguauacu

SEQ ID NO: 3009 - RNA, 22 nt, Homo sapiens
ucauacgucuccuugugccacc

SEQ ID NO: 3010 - RNA, 22 nt, Homo sapiens
uuugcuugaggucuagcuaccc

SEQ ID NO: 3011 - RNA, 22 nt, Homo sapiens
acaguggugcgaucucggcuca

SEQ ID NO: 3012 - RNA, 22 nt, Homo sapiens
guaguggcaugaucuuggcuca

SEQ ID NO: 3013 - RNA, 23 nt, Homo sapiens
gcagucauuuggaaaagguugaa

SEQ ID NO: 3014 - RNA, 22 nt, Homo sapiens
cucagaguacuuuucccacuuc

SEQ ID NO: 3015 - RNA, 22 nt, Homo sapiens
uucuugguuuaucgcuuuaaaa

SEQ ID NO: 3016 - RNA, 22 nt, Homo sapiens
ucacaagugagaggaauuagau

SEQ ID NO: 3017 - RNA, 22 nt, Homo sapiens
auugcacuccauccuaggugac

SEQ ID NO: 3018 - RNA, 19 nt, Homo sapiens
ugacacuguuggugggagg

SEQ ID NO: 3019 - RNA, 22 nt, Homo sapiens
uaccauguaucugggaugcuuu

SEQ ID NO: 3020 - RNA, 22 nt, Homo sapiens
gaggacauuaugcuaaguggaa

SEQ ID NO: 3021 - RNA, 22 nt, Homo sapiens
auggaauggcacuuugaagauu

SEQ ID NO: 3022 - RNA, 22 nt, Homo sapiens
gucacugugacggcaguuacau

SEQ ID NO: 3023 - RNA, 22 nt, Homo sapiens
uguaugaguuguuuauaaauuu

SEQ ID NO: 3024 - RNA, 22 nt, Homo sapiens
uuaugcagcaaagugcuugaaa

SEQ ID NO: 3025 - RNA, 22 nt, Homo sapiens
aaggugcuguaagcauccaugu

SEQ ID NO: 3026 - RNA, 22 nt, Homo sapiens
cuggaaagcaaagggugcauug

SEQ ID NO: 3027 - RNA, 22 nt, Homo sapiens
agguauguaugucuguacagcg

SEQ ID NO: 3028 - RNA, 22 nt, Homo sapiens
gaaucaauugaucuaugugucu

SEQ ID NO: 3029 - RNA, 22 nt, Homo sapiens
ugcagcucagcugcggaguuuu

SEQ ID NO: 3030 - RNA, 22 nt, Homo sapiens
uugagaguggcagagguggaac

SEQ ID NO: 3031 - RNA, 22 nt, Homo sapiens
auggcugagugauuucaaacag

SEQ ID NO: 3032 - RNA, 22 nt, Homo sapiens
uuacacguaauaucacggugug

SEQ ID NO: 3033 - RNA, 23 nt, Homo sapiens
ucuuuggcucuaauauaccuugu

SEQ ID NO: 3034 - RNA, 22 nt, Homo sapiens
augauuagaacucauuuccagg

SEQ ID NO: 3035 - RNA, 22 nt, Homo sapiens
uucucagugaacuccagcuugu

SEQ ID NO: 3036 - RNA, 22 nt, Homo sapiens
uagcaguauugaaagaugaggg

SEQ ID NO: 3037 - RNA, 21 nt, Homo sapiens
uugguucccucugacaggucu

SEQ ID NO: 3038 - RNA, 22 nt, Homo sapiens
augauauggucacccuuaugaa

SEQ ID NO: 3039 - RNA, 22 nt, Homo sapiens
ucauggcacugaugagaguuuc

SEQ ID NO: 3040 - RNA, 22 nt, Homo sapiens
agguuaacaucuauuuuggaug

SEQ ID NO: 3041 - RNA, 23 nt, Homo sapiens
uaacauugcaugauuaccugcau

SEQ ID NO: 3042 - RNA, 22 nt, Homo sapiens
uagaauguaacaguuaaaagca

SEQ ID NO: 3043 - RNA, 22 nt, Homo sapiens
agccaguuuggcuaauuuuggc

SEQ ID NO: 3044 - RNA, 22 nt, Homo sapiens
augugguaguuauagugauaag

SEQ ID NO: 3045 - RNA, 22 nt, Homo sapiens
uggcaaaaaucacaaguaccuu

SEQ ID NO: 3046 - RNA, 22 nt, Homo sapiens
aucugcacaucuguguuuuugu

SEQ ID NO: 3047 - RNA, 22 nt, Homo sapiens
ucaggguacuuguggccaaagu

SEQ ID NO: 3048 - RNA, 22 nt, Homo sapiens
uuugcuuguguaaaaaucugga

SEQ ID NO: 3049 - RNA, 22 nt, Homo sapiens
gaacccuggaggcggagguugc

SEQ ID NO: 3050 - RNA, 22 nt, Homo sapiens
ugagaacugguagcacuuguga

SEQ ID NO: 3051 - RNA, 22 nt, Homo sapiens
ggcccaguugcgggugguaccg

SEQ ID NO: 3052 - RNA, 22 nt, Homo sapiens
auuccacuuauaugagguaucu

SEQ ID NO: 3053 - RNA, 18 nt, Homo sapiens
ucacggggagcagcagcc

SEQ ID NO: 3054 - RNA, 22 nt, Homo sapiens
caucaggugaggauucaaugca

SEQ ID NO: 3055 - RNA, 22 nt, Homo sapiens
acagaacugggcuugcuuuugg

SEQ ID NO: 3056 - RNA, 22 nt, Homo sapiens
ugcauaucuuguggaauaucuc

SEQ ID NO: 3057 - RNA, 22 nt, Homo sapiens
cuauggguuauaauucauuagu

SEQ ID NO: 3058 - RNA, 22 nt, Homo sapiens
uguguagagaaauauuacuuau

SEQ ID NO: 3059 - RNA, 23 nt, Homo sapiens
uucaaauguucucugguugucag

SEQ ID NO: 3060 - RNA, 17 nt, Homo sapiens
cucucugguuuaaagca

SEQ ID NO: 3061 - RNA, 22 nt, Homo sapiens
agcagcauggguauaaaucucc

SEQ ID NO: 3062 - RNA, 22 nt, Homo sapiens
uucauaguucuuuuagucauua

SEQ ID NO: 3063 - RNA, 22 nt, Homo sapiens
ugcugcauuggggauuaaguuu

SEQ ID NO: 3064 - RNA, 22 nt, Homo sapiens
uuaagagcauggugccagguug

SEQ ID NO: 3065 - RNA, 22 nt, Homo sapiens
uuguuauguaucucaagauaaa

SEQ ID NO: 3066 - RNA, 18 nt, Homo sapiens
uuauaugcauguguagga

SEQ ID NO: 3067 - RNA, 22 nt, Homo sapiens
uaaugcuguggucugguuuaaa

SEQ ID NO: 3068 - RNA, 22 nt, Homo sapiens
uaagaugaaggcucaccuagaa

SEQ ID NO: 3069 - RNA, 22 nt, Homo sapiens
uuuguacuaugguuuuucacua

SEQ ID NO: 3070 - RNA, 22 nt, Homo sapiens
uuaaugcuuggggaguaguucu

SEQ ID NO: 3071 - RNA, 19 nt, Homo sapiens
uggucccccgcaaucucau

SEQ ID NO: 3072 - RNA, 22 nt, Homo sapiens
uauugauuuucaguguucagcu

SEQ ID NO: 3073 - RNA, 22 nt, Homo sapiens
uaacccugaggggcuuggggac

SEQ ID NO: 3074 - RNA, 22 nt, Homo sapiens
uaguugcauuggcugcuaugcu

SEQ ID NO: 3075 - RNA, 22 nt, Homo sapiens
guucaguuuugaaauguuaauu

SEQ ID NO: 3076 - RNA, 22 nt, Homo sapiens
uauaaccauuucuucucucuuc

SEQ ID NO: 3077 - RNA, 22 nt, Homo sapiens
cagugauaggugguuguuggca

SEQ ID NO: 3078 - RNA, 22 nt, Homo sapiens
acaccuguggucccaguaacuu

SEQ ID NO: 3079 - RNA, 22 nt, Homo sapiens
aggugcuugagggaagaaauua

SEQ ID NO: 3080 - RNA, 22 nt, Homo sapiens
accuuguaucuguuaggauugc

SEQ ID NO: 3081 - RNA, 22 nt, Homo sapiens
cuugcacuagugcagaggcgcu

SEQ ID NO: 3082 - RNA, 22 nt, Homo sapiens
ucagaugauucuguuguugugu

SEQ ID NO: 3083 - RNA, 22 nt, Homo sapiens
ugcgauaguuugcugguaaauu

SEQ ID NO: 3084 - RNA, 22 nt, Homo sapiens
ccuucuuuuguaaggcugaaua

SEQ ID NO: 3085 - RNA, 22 nt, Homo sapiens
cugaaaucagccaguuaguuuc

SEQ ID NO: 3086 - RNA, 22 nt, Homo sapiens
uuugugcuccugugagaaucua

SEQ ID NO: 3087 - RNA, 19 nt, Homo sapiens
agcuagugcucagcuguca

SEQ ID NO: 3088 - RNA, 22 nt, Homo sapiens
aagugcuuuuuagauaugguuu

SEQ ID NO: 3089 - RNA, 20 nt, Homo sapiens
ucccuaagagccuuuccuuc

SEQ ID NO: 3090 - RNA, 22 nt, Homo sapiens
augcagauauuuuugugguugc

SEQ ID NO: 3091 - RNA, 21 nt, Homo sapiens
uuuggcauuaugucaccagag

SEQ ID NO: 3092 - RNA, 22 nt, Homo sapiens
auauggcauucagaacuguaua

SEQ ID NO: 3093 - RNA, 22 nt, Homo sapiens
ugcauauguugaaccaggcuug

SEQ ID NO: 3094 - RNA, 20 nt, Homo sapiens
aggagcauuuacauuggcuc

SEQ ID NO: 3095 - RNA, 22 nt, Homo sapiens
auacagugaauacuuacagugu

SEQ ID NO: 3096 - RNA, 22 nt, Homo sapiens
uugaggacuggaacacaggucu

SEQ ID NO: 3097 - RNA, 22 nt, Homo sapiens
gggcgagaaucggcugcucagc

SEQ ID NO: 3098 - RNA, 22 nt, Homo sapiens
ugucuuguagacugaaggcuuc

SEQ ID NO: 3099 - RNA, 22 nt, Homo sapiens
ucacugcgaccuccaccuccug

SEQ ID NO: 3100 - RNA, 22 nt, Homo sapiens
uacaaaucuagguuuguuacug

SEQ ID NO: 3101 - RNA, 22 nt, Homo sapiens
uuuggcagaugacccucaaguu

SEQ ID NO: 3102 - RNA, 21 nt, Homo sapiens
ugucaugcagagacccuggag

SEQ ID NO: 3103 - RNA, 23 nt, Homo sapiens
guucaucagggauauuggccuga

SEQ ID NO: 3104 - RNA, 22 nt, Homo sapiens
uccuuuguuacaguuggcucug

SEQ ID NO: 3105 - RNA, 22 nt, Homo sapiens
cuguugguuaaauuccaugcag

SEQ ID NO: 3106 - RNA, 22 nt, Homo sapiens
gucacugucuacuguaauagcc

SEQ ID NO: 3107 - RNA, 22 nt, Homo sapiens
gugagcaaacuuaccuaagguu

SEQ ID NO: 3108 - RNA, 22 nt, Homo sapiens
gaggucauguggcaggcagcca

SEQ ID NO: 3109 - RNA, 22 nt, Homo sapiens
gacccauagaagcgagcuugug

SEQ ID NO: 3110 - RNA, 18 nt, Homo sapiens
acauucagcuugaagaua

SEQ ID NO: 3111 - RNA, 22 nt, Homo sapiens
cuagugcaauccuuugauggua

SEQ ID NO: 3112 - RNA, 22 nt, Homo sapiens
ggacaaaguauuuucaaaugua

SEQ ID NO: 3113 - RNA, 22 nt, Homo sapiens
ugacuauaguuuucuugacaca

SEQ ID NO: 3114 - RNA, 20 nt, Homo sapiens
uccugagauucccaguucuc

SEQ ID NO: 3115 - RNA, 22 nt, Homo sapiens
uugagauguaguuucacuccug

SEQ ID NO: 3116 - RNA, 22 nt, Homo sapiens
auugcacucuagccugggugac

SEQ ID NO: 3117 - RNA, 22 nt, Homo sapiens
ggguucaaaucuuggcucuuac

SEQ ID NO: 3118 - RNA, 22 nt, Homo sapiens
gucaugucuugaaauucaguuu

SEQ ID NO: 3119 - RNA, 22 nt, Homo sapiens
ucagauguuugagaaguauacu

SEQ ID NO: 3120 - RNA, 22 nt, Homo sapiens
uuaguaucauccuucugcauuc

SEQ ID NO: 3121 - RNA, 22 nt, Homo sapiens
auacccucugggugguuaguug

SEQ ID NO: 3122 - RNA, 22 nt, Homo sapiens
agcaacauugagacugcaguug

SEQ ID NO: 3123 - RNA, 22 nt, Homo sapiens
agaaauguuuauucaaacccgu

SEQ ID NO: 3124 - RNA, 20 nt, Homo sapiens
aucccauuccugaagauacu

SEQ ID NO: 3125 - RNA, 22 nt, Homo sapiens
uugaucaauagaauacaacaga

SEQ ID NO: 3126 - RNA, 22 nt, Homo sapiens
ucugagacuguuucuaacaagc

SEQ ID NO: 3127 - RNA, 22 nt, Homo sapiens
uagcuccacagcuauauauaau

SEQ ID NO: 3128 - RNA, 23 nt, Homo sapiens
uuuauacguugucauuuaucagg

SEQ ID NO: 3129 - RNA, 22 nt, Homo sapiens
uaaguaguguugagacaaguuu

SEQ ID NO: 3130 - RNA, 18 nt, Homo sapiens
uauugcuugguuuggaga

SEQ ID NO: 3131 - RNA, 22 nt, Homo sapiens
ugggaagauucuguguuuuucc

SEQ ID NO: 3132 - RNA, 22 nt, Homo sapiens
auugaaugaaauggcagacacu

SEQ ID NO: 3133 - RNA, 22 nt, Homo sapiens
cugauugugcagagguguaauu

SEQ ID NO: 3134 - RNA, 22 nt, Homo sapiens
uuggggcacggccucuguugcc

SEQ ID NO: 3135 - RNA, 22 nt, Homo sapiens
aucucaguucaggcuggccaca

SEQ ID NO: 3136 - RNA, 22 nt, Homo sapiens
ucuugguaaugucacauuuccu

SEQ ID NO: 3137 - RNA, 22 nt, Homo sapiens
agugaauguuggaaaguuauuu

SEQ ID NO: 3138 - RNA, 22 nt, Homo sapiens
uagcaucaauucauguuaugau

SEQ ID NO: 3139 - RNA, 22 nt, Homo sapiens
augaaguauuaggacacauuua

SEQ ID NO: 3140 - RNA, 22 nt, Homo sapiens
uucccugagcaucuguugagcc

SEQ ID NO: 3141 - RNA, 22 nt, Homo sapiens
uuuggcaacguuggaucccuca

SEQ ID NO: 3142 - RNA, 21 nt, Homo sapiens
agcagaguggcagcucuuuug

SEQ ID NO: 3143 - RNA, 22 nt, Homo sapiens
guucaagugauagcugggauua

SEQ ID NO: 3144 - RNA, 22 nt, Homo sapiens
ucaaguaguaacuaacugugac

SEQ ID NO: 3145 - RNA, 21 nt, Homo sapiens
ucauaagcucaacaucuguag

SEQ ID NO: 3146 - RNA, 22 nt, Homo sapiens
cacagcuaacaacuguuucuuc

SEQ ID NO: 3147 - RNA, 22 nt, Homo sapiens
ucaaaaucucuuagcugugucu

SEQ ID NO: 3148 - RNA, 19 nt, Homo sapiens
ugcagcaauguaaaagaca

SEQ ID NO: 3149 - RNA, 22 nt, Homo sapiens
ugagaauauuugaagauguuag

SEQ ID NO: 3150 - RNA, 22 nt, Homo sapiens
aaacccguagauccgaucuugu

SEQ ID NO: 3151 - RNA, 22 nt, Homo sapiens
ucucagugaauguggaaaaagc

SEQ ID NO: 3152 - RNA, 20 nt, Homo sapiens
cuuuuagcagcagcaagaga

SEQ ID NO: 3153 - RNA, 22 nt, Homo sapiens
agcagcucaagacuuaaauuug

SEQ ID NO: 3154 - RNA, 22 nt, Homo sapiens
ugugagacugacagggcagggu

SEQ ID NO: 3155 - RNA, 19 nt, Homo sapiens
caugauacugcucccucuc

SEQ ID NO: 3156 - RNA, 22 nt, Homo sapiens
uugaaguaguacuuuauuauag

SEQ ID NO: 3157 - RNA, 22 nt, Homo sapiens
cauccccugcaccaaccuuuac

SEQ ID NO: 3158 - RNA, 22 nt, Homo sapiens
guagcaucauuugcaauuucau

SEQ ID NO: 3159 - RNA, 22 nt, Homo sapiens
aaucccuggacuuucggaggcu

SEQ ID NO: 3160 - RNA, 17 nt, Homo sapiens
acaaauugccagcuagg

SEQ ID NO: 3161 - RNA, 20 nt, Homo sapiens
agucaguuuauuuucucucu

SEQ ID NO: 3162 - RNA, 22 nt, Homo sapiens
cuuuuggugugaagaagcucuu

SEQ ID NO: 3163 - RNA, 22 nt, Homo sapiens
ugcauacugggagguugggugu

SEQ ID NO: 3164 - RNA, 22 nt, Homo sapiens
uauugcacaugaggagacauug

SEQ ID NO: 3165 - RNA, 22 nt, Homo sapiens
uacugguuuuauauauuucucc

SEQ ID NO: 3166 - RNA, 22 nt, Homo sapiens
aaugcuguguuauuucaugacc

SEQ ID NO: 3167 - RNA, 20 nt, Homo sapiens
uuaugucguuucuugcuuau

SEQ ID NO: 3168 - RNA, 22 nt, Homo sapiens
ucacagucacugucacguugaa

SEQ ID NO: 3169 - RNA, 22 nt, Homo sapiens
agguaauuuuaucauuauguga

SEQ ID NO: 3170 - RNA, 21 nt, Homo sapiens
uucauaugcacugagugccca

SEQ ID NO: 3171 - RNA, 22 nt, Homo sapiens
uucuuugcaugaucucaaaguc

SEQ ID NO: 3172 - RNA, 22 nt, Homo sapiens
uuuuauguuuguucccugccaa

SEQ ID NO: 3173 - RNA, 22 nt, Homo sapiens
auggcaaaauguuccuaguggu

SEQ ID NO: 3174 - RNA, 22 nt, Homo sapiens
gugacacuggagcuggcacaau

SEQ ID NO: 3175 - RNA, 22 nt, Homo sapiens
uguuggacuuacuuggcagauu

SEQ ID NO: 3176 - RNA, 20 nt, Homo sapiens
gacuugagagugggagagua

SEQ ID NO: 3177 - RNA, 22 nt, Homo sapiens
uaauacucuucucauuuuacag

SEQ ID NO: 3178 - RNA, 18 nt, Homo sapiens
uggauaugaaauucugga

SEQ ID NO: 3179 - RNA, 22 nt, Homo sapiens
uuaagggaggagcuucaagaug

SEQ ID NO: 3180 - RNA, 22 nt, Homo sapiens
ugucaucuagguauuaagcccc

SEQ ID NO: 3181 - RNA, 22 nt, Homo sapiens
ugaucacagcuugacuaaagga

SEQ ID NO: 3182 - RNA, 20 nt, Homo sapiens
auagaagacuagugcagcag

SEQ ID NO: 3183 - RNA, 19 nt, Homo sapiens
ucugacagccccagucaac

SEQ ID NO: 3184 - RNA, 22 nt, Homo sapiens
agacuuagagagucuauucuau

SEQ ID NO: 3185 - RNA, 22 nt, Homo sapiens
augucacagguccuagccaagu

SEQ ID NO: 3186 - RNA, 22 nt, Homo sapiens
ucaccuugcacaguuguguggg

SEQ ID NO: 3187 - RNA, 22 nt, Homo sapiens
gaugaaacaucuuuggaaacug

SEQ ID NO: 3188 - RNA, 19 nt, Homo sapiens
ugacaugaaacccaagauc

SEQ ID NO: 3189 - RNA, 22 nt, Homo sapiens
auggcggugugggcggugcagc

SEQ ID NO: 3190 - RNA, 22 nt, Homo sapiens
auggcuagaaccuguauauuca

SEQ ID NO: 3191 - RNA, 22 nt, Homo sapiens
uugugggaggugauuagaucau

SEQ ID NO: 3192 - RNA, 22 nt, Homo sapiens
gcaguguugugauccaggucuu

SEQ ID NO: 3193 - RNA, 22 nt, Homo sapiens
auuccauuuguguggaauggcu

SEQ ID NO: 3194 - RNA, 22 nt, Homo sapiens
aggccaguuuuuggagggaaac

SEQ ID NO: 3195 - RNA, 22 nt, Homo sapiens
ugugacaguguuacauuucaug

SEQ ID NO: 3196 - RNA, 22 nt, Homo sapiens
uugaauagaaguguugaaagug

SEQ ID NO: 3197 - RNA, 22 nt, Homo sapiens
uuaugguuuucucucacgcagg

SEQ ID NO: 3198 - RNA, 22 nt, Homo sapiens
gacugaggaagcgcucucuccu

SEQ ID NO: 3199 - RNA, 22 nt, Homo sapiens
ccagucuuggugucuguagcac

SEQ ID NO: 3200 - RNA, 22 nt, Homo sapiens
aucccuugacguggagucucug

SEQ ID NO: 3201 - RNA, 22 nt, Homo sapiens
uucaaauguucuuucaccaccc

SEQ ID NO: 3202 - RNA, 22 nt, Homo sapiens
uucuggcuuuuaaagaaauguu

SEQ ID NO: 3203 - RNA, 22 nt, Homo sapiens
ggucacccugaugcuggugguc

SEQ ID NO: 3204 - RNA, 22 nt, Homo sapiens
uaaguaauugugguuucugcca

SEQ ID NO: 3205 - RNA, 22 nt, Homo sapiens
uugguacuagcugaucgcagag

SEQ ID NO: 3206 - RNA, 22 nt, Homo sapiens
augagggaagcucacgugucca

SEQ ID NO: 3207 - RNA, 22 nt, Homo sapiens
uagguaagauguuaacagcuga

SEQ ID NO: 3208 - RNA, 21 nt, Homo sapiens
ugcuacugucacuuccuuugu

SEQ ID NO: 3209 - RNA, 23 nt, Homo sapiens
guuaagugaauguguacucuauu

SEQ ID NO: 3210 - RNA, 22 nt, Homo sapiens
acuccacuuucaccacagcgga

SEQ ID NO: 3211 - RNA, 22 nt, Homo sapiens
ccugagacgaauggagugaaca

SEQ ID NO: 3212 - RNA, 22 nt, Homo sapiens
guccuugaggcuuugacugugg

SEQ ID NO: 3213 - RNA, 22 nt, Homo sapiens
ucaggugcagagaagaaauggg

SEQ ID NO: 3214 - RNA, 22 nt, Homo sapiens
ugauaugaaguuagcuggcugu

SEQ ID NO: 3215 - RNA, 22 nt, Homo sapiens
auguccuaaucuccuguucuua

SEQ ID NO: 3216 - RNA, 22 nt, Homo sapiens
uugacuguaagauggcuauuac

SEQ ID NO: 3217 - RNA, 22 nt, Homo sapiens
uacguaucagucguuucuguga

SEQ ID NO: 3218 - RNA, 22 nt, Homo sapiens
aucagugagugguuagugaaug

SEQ ID NO: 3219 - RNA, 22 nt, Homo sapiens
cuggagaucuugacauugaagu

SEQ ID NO: 3220 - RNA, 22 nt, Homo sapiens
ucugggguuagucaaagguaug

SEQ ID NO: 3221 - RNA, 22 nt, Homo sapiens
uaaggcuuugcuggacucaguc

SEQ ID NO: 3222 - RNA, 22 nt, Homo sapiens
uacaggacuucucagaguuauu

SEQ ID NO: 3223 - RNA, 22 nt, Homo sapiens
ugaagugggaaaugaguauuaa

SEQ ID NO: 3224 - RNA, 20 nt, Homo sapiens
cuuaucaguggcaaguauaa

SEQ ID NO: 3225 - RNA, 22 nt, Homo sapiens
aacagucuccaguuguauccau

SEQ ID NO: 3226 - RNA, 22 nt, Homo sapiens
guucaucaggcuuucucuagag

SEQ ID NO: 3227 - RNA, 23 nt, Homo sapiens
uaucccuugccuuaugaugugag

SEQ ID NO: 3228 - RNA, 22 nt, Homo sapiens
ugaggagugaacuauuucugau

SEQ ID NO: 3229 - RNA, 22 nt, Homo sapiens
uauugcuacuuugccuuccaaa

SEQ ID NO: 3230 - RNA, 22 nt, Homo sapiens
cagcuaaauuguuaaauccaag

SEQ ID NO: 3231 - RNA, 22 nt, Homo sapiens
auugcacuccagccuagucaac

SEQ ID NO: 3232 - RNA, 22 nt, Homo sapiens
auagcugcucaggcuuuccuca

SEQ ID NO: 3233 - RNA, 22 nt, Homo sapiens
uaguacccuugaagcagacaua

SEQ ID NO: 3234 - RNA, 22 nt, Homo sapiens
uuggcuaagaucacgugagaau

SEQ ID NO: 3235 - RNA, 22 nt, Homo sapiens
agaguauagcaacuuaguaaaa

SEQ ID NO: 3236 - RNA, 22 nt, Homo sapiens
uugucacauggggcggcugccc

SEQ ID NO: 3237 - RNA, 22 nt, Homo sapiens
caugggacugucuuggcuauac

SEQ ID NO: 3238 - RNA, 22 nt, Homo sapiens
ugcauacugaaauauuuuagag

SEQ ID NO: 3239 - RNA, 22 nt, Homo sapiens
ugauuagagagcuggguguccu

SEQ ID NO: 3240 - RNA, 22 nt, Homo sapiens
uacaggaaugucagguugcugu

SEQ ID NO: 3241 - RNA, 22 nt, Homo sapiens
ugagaagacaucuuugcuuugu

SEQ ID NO: 3242 - RNA, 22 nt, Homo sapiens
uaacauucacaugcugcaaaaa

SEQ ID NO: 3243 - RNA, 22 nt, Homo sapiens
ucagcaguggacagaaugguag

SEQ ID NO: 3244 - RNA, 22 nt, Homo sapiens
cacugcacuccagcuugugggc

SEQ ID NO: 3245 - RNA, 22 nt, Homo sapiens
ucaccaguacuccaaauugagg

SEQ ID NO: 3246 - RNA, 22 nt, Homo sapiens
gagaacauuaauaguuaauuuu

SEQ ID NO: 3247 - RNA, 22 nt, Homo sapiens
ucuucuagcggaacccucuugu

SEQ ID NO: 3248 - RNA, 22 nt, Homo sapiens
caugccacuguggacaaagaca

SEQ ID NO: 3249 - RNA, 16 nt, Homo sapiens
uacauuuguuacaugg

SEQ ID NO: 3250 - RNA, 22 nt, Homo sapiens
uucuuccagccuugaggggccc

SEQ ID NO: 3251 - RNA, 22 nt, Homo sapiens
uggcaagagcugcauucaucug

SEQ ID NO: 3252 - RNA, 22 nt, Homo sapiens
cucccuuugcugaauguuuuuc

SEQ ID NO: 3253 - RNA, 22 nt, Homo sapiens
ucccuguuaggcacagauuuau

SEQ ID NO: 3254 - RNA, 22 nt, Homo sapiens
ucuucagucauauuggccugga

SEQ ID NO: 3255 - RNA, 22 nt, Homo sapiens
cucuuuggaugccuuaggguua

SEQ ID NO: 3256 - RNA, 22 nt, Homo sapiens
auugcacuccagccugagcaaa

SEQ ID NO: 3257 - RNA, 22 nt, Homo sapiens
cugugauagguuagucaugaau

SEQ ID NO: 3258 - RNA, 22 nt, Homo sapiens
ucaucaggaaacuuaugcagug

SEQ ID NO: 3259 - RNA, 22 nt, Homo sapiens
uuggcauugccaaacugucaac

SEQ ID NO: 3260 - RNA, 19 nt, Homo sapiens
uugucuuagaguugucauu

SEQ ID NO: 3261 - RNA, 21 nt, Homo sapiens
auugcccaaaguggaggggaa

SEQ ID NO: 3262 - RNA, 22 nt, Homo sapiens
augugggaggaauguguuucca

SEQ ID NO: 3263 - RNA, 22 nt, Homo sapiens
uggcagcgcaguugaaaaagaa

SEQ ID NO: 3264 - RNA, 22 nt, Homo sapiens
gaagugcuuuuggacuaacagu

SEQ ID NO: 3265 - RNA, 22 nt, Homo sapiens
gugauacugaugacuuagagaa

SEQ ID NO: 3266 - RNA, 22 nt, Homo sapiens
auggcaaugcgaugaugacuga

SEQ ID NO: 3267 - RNA, 21 nt, Homo sapiens
acugcacuccaaccucaacag

SEQ ID NO: 3268 - RNA, 21 nt, Homo sapiens
gagauagguaccgaagcuuag

SEQ ID NO: 3269 - RNA, 22 nt, Homo sapiens
cuuggcaugaagaauaauuuuu

SEQ ID NO: 3270 - RNA, 22 nt, Homo sapiens
augauugaccaucugcugggcu

SEQ ID NO: 3271 - RNA, 22 nt, Homo sapiens
uagauuauuggcugauuugauc

SEQ ID NO: 3272 - RNA, 22 nt, Homo sapiens
auguaacuaucugagccauggg

SEQ ID NO: 3273 - RNA, 18 nt, Homo sapiens
uuuggcuguucaugacuc

SEQ ID NO: 3274 - RNA, 22 nt, Homo sapiens
ucagcguguggacggccaucuu

SEQ ID NO: 3275 - RNA, 22 nt, Homo sapiens
auguauggaguuuaggggaugg

SEQ ID NO: 3276 - RNA, 22 nt, Homo sapiens
uucacaaugccuuguugauggu

SEQ ID NO: 3277 - RNA, 22 nt, Homo sapiens
uuuagggcagggacaguucuuc

SEQ ID NO: 3278 - RNA, 21 nt, Homo sapiens
gcuuuuucggaagucuuuggc

SEQ ID NO: 3279 - RNA, 22 nt, Homo sapiens
aaaggcacacacuccuuguuau

SEQ ID NO: 3280 - RNA, 22 nt, Homo sapiens
cugagguuaggaguuugagacc

SEQ ID NO: 3281 - RNA, 22 nt, Homo sapiens
gugucuccugccuucaugcagc

SEQ ID NO: 3282 - RNA, 22 nt, Homo sapiens
acccaguguugggcagaacugu

SEQ ID NO: 3283 - RNA, 22 nt, Homo sapiens
acacagucaaauccacuuggcu

SEQ ID NO: 3284 - RNA, 22 nt, Homo sapiens
aucacacuguuauuuuaguuaa

SEQ ID NO: 3285 - RNA, 22 nt, Homo sapiens
caguucaugguaggcaccauag

SEQ ID NO: 3286 - RNA, 22 nt, Homo sapiens
gugggauauaaucaguccugua

SEQ ID NO: 3287 - RNA, 22 nt, Homo sapiens
agaugguauuauagguuucugu

SEQ ID NO: 3288 - RNA, 22 nt, Homo sapiens
uggcauguagucugggaccugg

SEQ ID NO: 3289 - RNA, 22 nt, Homo sapiens
ggccagaugaucuaugaaggaa

SEQ ID NO: 3290 - RNA, 22 nt, Homo sapiens
aaguagugcuugugcucaucuc

SEQ ID NO: 3291 - RNA, 22 nt, Homo sapiens
acugggucaaaguagaaaacua

SEQ ID NO: 3292 - RNA, 22 nt, Homo sapiens
uugaacuagaaccugcaaauuu

SEQ ID NO: 3293 - RNA, 22 nt, Homo sapiens
auuagguuggugcaaaaguaau

SEQ ID NO: 3294 - RNA, 22 nt, Homo sapiens
augugaacaucauagaaugcac

SEQ ID NO: 3295 - RNA, 22 nt, Homo sapiens
agcuuguuuuauagaaagucaa

SEQ ID NO: 3296 - RNA, 18 nt, Homo sapiens
auucuacaggccuuuuga

SEQ ID NO: 3297 - RNA, 22 nt, Homo sapiens
gagcaaugagcugccugcugag

SEQ ID NO: 3298 - RNA, 22 nt, Homo sapiens
agcaguagaauuccugcaucac

SEQ ID NO: 3299 - RNA, 22 nt, Homo sapiens
uucugagguuauauucucucaa

SEQ ID NO: 3300 - RNA, 22 nt, Homo sapiens
gucccguugugacuuacaaugg

SEQ ID NO: 3301 - RNA, 23 nt, Homo sapiens
ugacuggagacuguugauccuuu

SEQ ID NO: 3302 - RNA, 22 nt, Homo sapiens
ccacauuaccuugcuugcucca

SEQ ID NO: 3303 - RNA, 22 nt, Homo sapiens
ugagguaaugcuguagcuguga

SEQ ID NO: 3304 - RNA, 22 nt, Homo sapiens
uaacauugcuggacuaccugcu

SEQ ID NO: 3305 - RNA, 22 nt, Homo sapiens
augaguugaagcuacaagaggc

SEQ ID NO: 3306 - RNA, 22 nt, Homo sapiens
ugugcacaaugugcagguuuga

SEQ ID NO: 3307 - RNA, 22 nt, Homo sapiens
aggugguuuuucaacacacacu

SEQ ID NO: 3308 - RNA, 19 nt, Homo sapiens
caccagugcaugcuacuau

SEQ ID NO: 3309 - RNA, 22 nt, Homo sapiens
gaacuggcuuagugaaacuucc

SEQ ID NO: 3310 - RNA, 18 nt, Homo sapiens
uuucaggguggacaugag

SEQ ID NO: 3311 - RNA, 21 nt, Homo sapiens
cccagguucucugaggguaga

SEQ ID NO: 3312 - RNA, 22 nt, Homo sapiens
auggcagugagucucuaguauu

SEQ ID NO: 3313 - RNA, 22 nt, Homo sapiens
uuuggcauuuuacuacucaaau

SEQ ID NO: 3314 - RNA, 22 nt, Homo sapiens
ugacugaguaguauuccacuau

SEQ ID NO: 3315 - RNA, 22 nt, Homo sapiens
augguacuggggucccggaguu

SEQ ID NO: 3316 - RNA, 22 nt, Homo sapiens
gaccaaagaggcaggcauuaga

SEQ ID NO: 3317 - RNA, 22 nt, Homo sapiens
ugagcagagggagaaguaaauu

SEQ ID NO: 3318 - RNA, 22 nt, Homo sapiens
gcacacuuacacgaaccuagau

SEQ ID NO: 3319 - RNA, 22 nt, Homo sapiens
ugagacugaguuucgcucuugu

SEQ ID NO: 3320 - RNA, 22 nt, Homo sapiens
aaggcuagagaagaagggcauc

SEQ ID NO: 3321 - RNA, 22 nt, Homo sapiens
uugaggaggcagucucuccauu

SEQ ID NO: 3322 - RNA, 22 nt, Homo sapiens
ggcuagaugcuagagauaucau

SEQ ID NO: 3323 - RNA, 22 nt, Homo sapiens
augagauaggaacaaacuuaca

SEQ ID NO: 3324 - RNA, 22 nt, Homo sapiens
ugucagaaucuagaggcugcua

SEQ ID NO: 3325 - RNA, 22 nt, Homo sapiens
uugcucaggcuggaguacaaug

SEQ ID NO: 3326 - RNA, 22 nt, Homo sapiens
gugguuuucaacuccaccugca

SEQ ID NO: 3327 - RNA, 22 nt, Homo sapiens
uggaugacauccuuguaugcag

SEQ ID NO: 3328 - RNA, 21 nt, Homo sapiens
ugguucaguucguuacgugug

SEQ ID NO: 3329 - RNA, 19 nt, Homo sapiens
uaugcuauuuauuagaagu

SEQ ID NO: 3330 - RNA, 19 nt, Homo sapiens
ugagauuguaugaggagau

SEQ ID NO: 3331 - RNA, 22 nt, Homo sapiens
uuaaagcgacucucaugccuca

SEQ ID NO: 3332 - RNA, 22 nt, Homo sapiens
auguuagcaucaauauucauca

SEQ ID NO: 3333 - RNA, 22 nt, Homo sapiens
gaucuguuguuuggaaguauca

SEQ ID NO: 3334 - RNA, 21 nt, Homo sapiens
uuggcuacugcuucagaggga

SEQ ID NO: 3335 - RNA, 22 nt, Homo sapiens
ugauagaucugggcaaaguaaa

SEQ ID NO: 3336 - RNA, 22 nt, Homo sapiens
uuauccucuagacauagguuua

SEQ ID NO: 3337 - RNA, 22 nt, Homo sapiens
uggcauggucugcccaaguuuc

SEQ ID NO: 3338 - RNA, 22 nt, Homo sapiens
uggcacaaugacccuugugggc

SEQ ID NO: 3339 - RNA, 22 nt, Homo sapiens
gacugacgaccgcucuaccugc

SEQ ID NO: 3340 - RNA, 22 nt, Homo sapiens
gcuggauguuucaauacaaaua

SEQ ID NO: 3341 - RNA, 22 nt, Homo sapiens
ugggaucauuaugcauagugua

SEQ ID NO: 3342 - RNA, 22 nt, Homo sapiens
gugagaugauggguauguuaau

SEQ ID NO: 3343 - RNA, 20 nt, Homo sapiens
auacccaguagcacaacagc

SEQ ID NO: 3344 - RNA, 22 nt, Homo sapiens
gauuccauugcgaauuuucaga

SEQ ID NO: 3345 - RNA, 22 nt, Homo sapiens
acuacugucagacugccacuga

SEQ ID NO: 3346 - RNA, 22 nt, Homo sapiens
uggaacacauaaauagcauagu

SEQ ID NO: 3347 - RNA, 22 nt, Homo sapiens
agugcauuugcaucucaauaua

SEQ ID NO: 3348 - RNA, 22 nt, Homo sapiens
aauccauuugccgucuauccau

SEQ ID NO: 3349 - RNA, 22 nt, Homo sapiens
ucauuguccaacuucuuucagu

SEQ ID NO: 3350 - RNA, 22 nt, Homo sapiens
auaaguagaaugauggucaaaa

SEQ ID NO: 3351 - RNA, 22 nt, Homo sapiens
aaagugcuuacuaaguugccaa

SEQ ID NO: 3352 - RNA, 19 nt, Homo sapiens
uguacacuguaaaccugug

SEQ ID NO: 3353 - RNA, 22 nt, Homo sapiens
caaaagugauugcgguuuuugc

SEQ ID NO: 3354 - RNA, 19 nt, Homo sapiens
caucccugagcugaagugg

SEQ ID NO: 3355 - RNA, 22 nt, Homo sapiens
augcuacugauaagcaaucauu

SEQ ID NO: 3356 - RNA, 22 nt, Homo sapiens
ugugcacaaugugcagguuugu

SEQ ID NO: 3357 - RNA, 16 nt, Homo sapiens
gugcuguguuguuagg

SEQ ID NO: 3358 - RNA, 22 nt, Homo sapiens
uugguccauuacauugaugaca

SEQ ID NO: 3359 - RNA, 22 nt, Homo sapiens
uugugaaugaugucgcaauaaa

SEQ ID NO: 3360 - RNA, 19 nt, Homo sapiens
cauggcuuauaauuuuaau

SEQ ID NO: 3361 - RNA, 22 nt, Homo sapiens
auagcacauggcauccucucuu

SEQ ID NO: 3362 - RNA, 22 nt, Homo sapiens
ucugcauaucaugcagaacuau

SEQ ID NO: 3363 - RNA, 17 nt, Homo sapiens
gugagguauccucaaaa

SEQ ID NO: 3364 - RNA, 20 nt, Homo sapiens
ugucauuaagcacugugcca

SEQ ID NO: 3365 - RNA, 19 nt, Homo sapiens
uuuugcucuuuauaccuau

SEQ ID NO: 3366 - RNA, 22 nt, Homo sapiens
gagcacauaugacauuuucuuc

SEQ ID NO: 3367 - RNA, 22 nt, Homo sapiens
uuugauugguguaccugaaagu

SEQ ID NO: 3368 - RNA, 22 nt, Homo sapiens
gaagcauugauccacaggcgug

SEQ ID NO: 3369 - RNA, 22 nt, Homo sapiens
uugcagaucccacacucacccu

SEQ ID NO: 3370 - RNA, 22 nt, Homo sapiens
ugagaagcauaccagugucugu

SEQ ID NO: 3371 - RNA, 22 nt, Homo sapiens
cugugguuacguucuuugugcu

SEQ ID NO: 3372 - RNA, 17 nt, Homo sapiens
gugagguggguaguauc

SEQ ID NO: 3373 - RNA, 22 nt, Homo sapiens
ucaguuuguauuucagguugca

SEQ ID NO: 3374 - RNA, 22 nt, Homo sapiens
ucuuugguauuuguggggaauu

SEQ ID NO: 3375 - RNA, 23 nt, Homo sapiens
uucaucagggauauuggccugaa

SEQ ID NO: 3376 - RNA, 22 nt, Homo sapiens
aaucacauuaaugcucccucag

SEQ ID NO: 3377 - RNA, 21 nt, Homo sapiens
uucuacuccggcguuguuuuu

SEQ ID NO: 3378 - RNA, 22 nt, Homo sapiens
acugcacuguccuagaguccuc

SEQ ID NO: 3379 - RNA, 22 nt, Homo sapiens
uauuacacuuuagugucuucca

SEQ ID NO: 3380 - RNA, 22 nt, Homo sapiens
uaacuaaagagaagucaauguc

SEQ ID NO: 3381 - RNA, 22 nt, Homo sapiens
uuggagugugucuuauuccauu

SEQ ID NO: 3382 - RNA, 22 nt, Homo sapiens
ugugauguggagggcagaucca

SEQ ID NO: 3383 - RNA, 22 nt, Homo sapiens
uagguaguuagcauacuacaca

SEQ ID NO: 3384 - RNA, 22 nt, Homo sapiens
ugauaggucuguuuugaaaagg

SEQ ID NO: 3385 - RNA, 22 nt, Homo sapiens
uucaaaucuuuggcucccacua

SEQ ID NO: 3386 - RNA, 22 nt, Homo sapiens
gugcgguauuagcaagccaaca

SEQ ID NO: 3387 - RNA, 17 nt, Homo sapiens
acccagucuuuuugcac

SEQ ID NO: 3388 - RNA, 22 nt, Homo sapiens
auaggcacauuaggaacuuuug

SEQ ID NO: 3389 - RNA, 22 nt, Homo sapiens
gagaucuuggccaaguuucuua

SEQ ID NO: 3390 - RNA, 22 nt, Homo sapiens
uguauguaauugaaguuaaguu

SEQ ID NO: 3391 - RNA, 21 nt, Homo sapiens
uuuggcuucucugcugcagcc

SEQ ID NO: 3392 - RNA, 22 nt, Homo sapiens
uaacuucaucauaagucaagaa

SEQ ID NO: 3393 - RNA, 22 nt, Homo sapiens
ugagcaucauucacaccuuggu

SEQ ID NO: 3394 - RNA, 22 nt, Homo sapiens
caugugcaugcuuucuuaugug

SEQ ID NO: 3395 - RNA, 22 nt, Homo sapiens
ucagcagucacuccuaugacaa

SEQ ID NO: 3396 - RNA, 22 nt, Homo sapiens
auugcagcuugcagggugugua

SEQ ID NO: 3397 - RNA, 22 nt, Homo sapiens
guggcagagucagagggaaaug

SEQ ID NO: 3398 - RNA, 22 nt, Homo sapiens
cuagugcaguuccccugucuua

SEQ ID NO: 3399 - RNA, 19 nt, Homo sapiens
uuggcagaguugcccccua

SEQ ID NO: 3400 - RNA, 22 nt, Homo sapiens
uguuuaguuaagacauagaauu

SEQ ID NO: 3401 - RNA, 22 nt, Homo sapiens
uuuugucccaugggcuguuccc

SEQ ID NO: 3402 - RNA, 22 nt, Homo sapiens
ucuaugguuuaagucaccaaga

SEQ ID NO: 3403 - RNA, 22 nt, Homo sapiens
augauacugaguugaguucuca

SEQ ID NO: 3404 - RNA, 22 nt, Homo sapiens
auucacuguggcuuucucugau

SEQ ID NO: 3405 - RNA, 20 nt, Homo sapiens
gugagucauuaguaaccaaa

SEQ ID NO: 3406 - RNA, 22 nt, Homo sapiens
ugagaucgaguaucgcugucac

SEQ ID NO: 3407 - RNA, 22 nt, Homo sapiens
cauaaugcuaagagcugccccu

SEQ ID NO: 3408 - RNA, 22 nt, Homo sapiens
cucaugcugucuucugggguaa

SEQ ID NO: 3409 - RNA, 22 nt, Homo sapiens
uggaguguguugcagaugaagg

SEQ ID NO: 3410 - RNA, 22 nt, Homo sapiens
aucacuaugcaggugucucggg

SEQ ID NO: 3411 - RNA, 22 nt, Homo sapiens
gacuuugguaaacucgguggca

SEQ ID NO: 3412 - RNA, 22 nt, Homo sapiens
uaaggaacucugauaucuggaa

SEQ ID NO: 3413 - RNA, 19 nt, Homo sapiens
ucugucacuggggguauuc

SEQ ID NO: 3414 - RNA, 22 nt, Homo sapiens
uauugcugaugcugaagggaag

SEQ ID NO: 3415 - RNA, 22 nt, Homo sapiens
cuccuaaccagggcuguuaguc

SEQ ID NO: 3416 - RNA, 19 nt, Homo sapiens
ucccaauguuuccaggcag

SEQ ID NO: 3417 - RNA, 22 nt, Homo sapiens
uuggcagaguuaauuuguugag

SEQ ID NO: 3418 - RNA, 22 nt, Homo sapiens
ugcagcacuguucacaauagcc

SEQ ID NO: 3419 - RNA, 22 nt, Homo sapiens
guaaugaacuugaaagccuguu

SEQ ID NO: 3420 - RNA, 22 nt, Homo sapiens
cuggaggccugaacauaaaugg

SEQ ID NO: 3421 - RNA, 22 nt, Homo sapiens
aauggcuucuuauugugguuca

SEQ ID NO: 3422 - RNA, 22 nt, Homo sapiens
acccugucagcuggccugggca

SEQ ID NO: 3423 - RNA, 22 nt, Homo sapiens
guuugccuuuuagauaggaaug

SEQ ID NO: 3424 - RNA, 22 nt, Homo sapiens
ucaaagugacaaaguugcagca

SEQ ID NO: 3425 - RNA, 22 nt, Homo sapiens
uugugguugauacacguaggaa

SEQ ID NO: 3426 - RNA, 22 nt, Homo sapiens
aucuggcuucuuuuaguccaca

SEQ ID NO: 3427 - RNA, 22 nt, Homo sapiens
cccaguuuugccacuuacuagc

SEQ ID NO: 3428 - RNA, 22 nt, Homo sapiens
ggcaaagagacaugcaucgggg

SEQ ID NO: 3429 - RNA, 22 nt, Homo sapiens
uugagggaagccagaggucugc

SEQ ID NO: 3430 - RNA, 22 nt, Homo sapiens
uagcugcugcuaggcuaaggau

SEQ ID NO: 3431 - RNA, 22 nt, Homo sapiens
uaagggacauguguugccuaag

SEQ ID NO: 3432 - RNA, 22 nt, Homo sapiens
ccugugguuaaccagcuagaug

SEQ ID NO: 3433 - RNA, 18 nt, Homo sapiens
uacuaguaaggcuucuga

SEQ ID NO: 3434 - RNA, 22 nt, Homo sapiens
gaauugcacaaaaacugcuugu

SEQ ID NO: 3435 - RNA, 22 nt, Homo sapiens
ugggaucuuuccuauuagcgag

SEQ ID NO: 3436 - RNA, 22 nt, Homo sapiens
augaagauguugccuuuuuaau

SEQ ID NO: 3437 - RNA, 22 nt, Homo sapiens
caguggauuggauggauaaugc

SEQ ID NO: 3438 - RNA, 22 nt, Homo sapiens
uugcacuccagccugggugaca

SEQ ID NO: 3439 - RNA, 22 nt, Homo sapiens
uuucauggaggauuugcuucuu

SEQ ID NO: 3440 - RNA, 22 nt, Homo sapiens
ucaaugaaugaugguugguaug

SEQ ID NO: 3441 - RNA, 22 nt, Homo sapiens
auaaugcuuuucuagguugcau

SEQ ID NO: 3442 - RNA, 20 nt, Homo sapiens
uaugacacugucauaaaaau

SEQ ID NO: 3443 - RNA, 20 nt, Homo sapiens
augucagaguguggguacgg

SEQ ID NO: 3444 - RNA, 22 nt, Homo sapiens
uuguauaggcucaguaagaauc

SEQ ID NO: 3445 - RNA, 22 nt, Homo sapiens
aaguaucaggaauaguuauugg

SEQ ID NO: 3446 - RNA, 22 nt, Homo sapiens
guggcaaagaugccuucuccaa

SEQ ID NO: 3447 - RNA, 22 nt, Homo sapiens
auagguuuucacuguagauucu

SEQ ID NO: 3448 - RNA, 20 nt, Homo sapiens
gagaccugagauucacucaa

SEQ ID NO: 3449 - RNA, 22 nt, Homo sapiens
auaauaccugccucagagaguu

SEQ ID NO: 3450 - RNA, 20 nt, Homo sapiens
agguagauagaugauagaua

SEQ ID NO: 3451 - RNA, 22 nt, Homo sapiens
uggcaugauguguucauugaaa

SEQ ID NO: 3452 - RNA, 22 nt, Homo sapiens
uguaagcauuauauaauuguug

SEQ ID NO: 3453 - RNA, 20 nt, Homo sapiens
gacauggaggaggauuauua

SEQ ID NO: 3454 - RNA, 22 nt, Homo sapiens
uccacguggucuaucuguccuu

SEQ ID NO: 3455 - RNA, 22 nt, Homo sapiens
agcaacauuguucauaauagcu

SEQ ID NO: 3456 - RNA, 22 nt, Homo sapiens
uggcaaaugaagucagcuguac

SEQ ID NO: 3457 - RNA, 22 nt, Homo sapiens
ucccauugucucugaccuugcc

SEQ ID NO: 3458 - RNA, 22 nt, Homo sapiens
agcaccacauacuacagagaua

SEQ ID NO: 3459 - RNA, 22 nt, Homo sapiens
ugauaacauugggggaagcuga

SEQ ID NO: 3460 - RNA, 22 nt, Homo sapiens
uugguccccuucaaccagcugu

SEQ ID NO: 3461 - RNA, 23 nt, Homo sapiens
aaguucaugcucaucuguuacac

SEQ ID NO: 3462 - RNA, 22 nt, Homo sapiens
guauuuuguuagggugugguau

SEQ ID NO: 3463 - RNA, 22 nt, Homo sapiens
uggaagacaggcuguauuuuaa

SEQ ID NO: 3464 - RNA, 22 nt, Homo sapiens
aaaguacucaguucaguuccgu

SEQ ID NO: 3465 - RNA, 22 nt, Homo sapiens
gacuggccuauaauggcgaauu

SEQ ID NO: 3466 - RNA, 22 nt, Homo sapiens
uaaggaguagaauaguaaggca

SEQ ID NO: 3467 - RNA, 22 nt, Homo sapiens
ucagugguuaaaagauucuaga

SEQ ID NO: 3468 - RNA, 23 nt, Homo sapiens
agccugguuucccugcuucuccc

SEQ ID NO: 3469 - RNA, 22 nt, Homo sapiens
uugauauuaaguacugaagugg

SEQ ID NO: 3470 - RNA, 22 nt, Homo sapiens
uuucauagccuuugucgucuga

SEQ ID NO: 3471 - RNA, 18 nt, Homo sapiens
uugcacuccugccugggu

SEQ ID NO: 3472 - RNA, 22 nt, Homo sapiens
ugucucccuucccauuaggaag

SEQ ID NO: 3473 - RNA, 22 nt, Homo sapiens
uugcagcaacauggaugaaacu

SEQ ID NO: 3474 - RNA, 22 nt, Homo sapiens
uugagagaaaaggccaugccuu

SEQ ID NO: 3475 - RNA, 22 nt, Homo sapiens
uggcaaaucagaggcauggaca

SEQ ID NO: 3476 - RNA, 23 nt, Homo sapiens
ugggucaguuuuucugacaucau

SEQ ID NO: 3477 - RNA, 23 nt, Homo sapiens
aggccaguuuuuccugcuugcug

SEQ ID NO: 3478 - RNA, 22 nt, Homo sapiens
ugagauaaugcaugugaagauc

SEQ ID NO: 3479 - RNA, 19 nt, Homo sapiens
ugcaaagucuuuuccuauu

SEQ ID NO: 3480 - RNA, 22 nt, Homo sapiens
cuagcaggcaagauaagauuca

SEQ ID NO: 3481 - RNA, 22 nt, Homo sapiens
uggcaguuuacaaaugccauga

SEQ ID NO: 3482 - RNA, 23 nt, Homo sapiens
caccaguagaaugugugggaggg

SEQ ID NO: 3483 - RNA, 22 nt, Homo sapiens
auggauuuugaacuugagaguu

SEQ ID NO: 3484 - RNA, 22 nt, Homo sapiens
uuacaacugucuuacugguuau

SEQ ID NO: 3485 - RNA, 22 nt, Homo sapiens
uugagaaucuuugcuaaaggaa

SEQ ID NO: 3486 - RNA, 17 nt, Homo sapiens
ggaagccuuugguuuaa

SEQ ID NO: 3487 - RNA, 22 nt, Homo sapiens
auagugcugcaagaaacauacg

SEQ ID NO: 3488 - RNA, 22 nt, Homo sapiens
gccauugcacuccagcuugggc

SEQ ID NO: 3489 - RNA, 21 nt, Homo sapiens
auuugcacugagcuccugugc

SEQ ID NO: 3490 - RNA, 22 nt, Homo sapiens
uaguagcaccucucaugagcuu

SEQ ID NO: 3491 - RNA, 22 nt, Homo sapiens
cucagugucuggggccccaggg

SEQ ID NO: 3492 - RNA, 22 nt, Homo sapiens
agugcaaggacauuuagguugu

SEQ ID NO: 3493 - RNA, 22 nt, Homo sapiens
uggacaugaagggcacaggagg

SEQ ID NO: 3494 - RNA, 22 nt, Homo sapiens
uggauggucagaggguuucugu

SEQ ID NO: 3495 - RNA, 22 nt, Homo sapiens
uguaauggcagacuccggugga

SEQ ID NO: 3496 - RNA, 22 nt, Homo sapiens
uucacagcuuaauaaggcucag

SEQ ID NO: 3497 - RNA, 22 nt, Homo sapiens
ugugcuugcuucuucuccuagu

SEQ ID NO: 3498 - RNA, 22 nt, Homo sapiens
aggcaagaaugcuuguuucacc

SEQ ID NO: 3499 - RNA, 22 nt, Homo sapiens
aucgugucuggcccugaaugcu

SEQ ID NO: 3500 - RNA, 22 nt, Homo sapiens
uaugcuuauugucucauccacu

SEQ ID NO: 3501 - RNA, 22 nt, Homo sapiens
ugauauuuuugauccuuaaguu

SEQ ID NO: 3502 - RNA, 19 nt, Homo sapiens
ugucaaaugucuccugggg

SEQ ID NO: 3503 - RNA, 22 nt, Homo sapiens
augucaaggugaagaaagauca

SEQ ID NO: 3504 - RNA, 22 nt, Homo sapiens
aaucucagagauaucugugucc

SEQ ID NO: 3505 - RNA, 22 nt, Homo sapiens
uuaucaaacccuaggagguggu

SEQ ID NO: 3506 - RNA, 22 nt, Homo sapiens
uagucccauaugauuuagugaa

SEQ ID NO: 3507 - RNA, 22 nt, Homo sapiens
ucaccuggggcacagcugaaga

SEQ ID NO: 3508 - RNA, 22 nt, Homo sapiens
gucuuugaugucuaugugcuuc

SEQ ID NO: 3509 - RNA, 22 nt, Homo sapiens
ugaauguaacuaaaggacuuuu

SEQ ID NO: 3510 - RNA, 22 nt, Homo sapiens
uccaguggacagacauaccaug

SEQ ID NO: 3511 - RNA, 22 nt, Homo sapiens
uauucacuguaucauugauggg

SEQ ID NO: 3512 - RNA, 22 nt, Homo sapiens
uuguuauguuggucaguaaugu

SEQ ID NO: 3513 - RNA, 22 nt, Homo sapiens
auuuugguuacauaguugagcu

SEQ ID NO: 3514 - RNA, 22 nt, Homo sapiens
guaaucucagcuacuugggagu

SEQ ID NO: 3515 - RNA, 22 nt, Homo sapiens
auaacagcugcaaggcaaaagc

SEQ ID NO: 3516 - RNA, 22 nt, Homo sapiens
uguuuguuugauaugggauaaa

SEQ ID NO: 3517 - RNA, 22 nt, Homo sapiens
auugcacuccagccuggccaac

SEQ ID NO: 3518 - RNA, 22 nt, Homo sapiens
augaaugcuuuuggauguaucu

SEQ ID NO: 3519 - RNA, 22 nt, Homo sapiens
uagggcauguguggaguguaug

SEQ ID NO: 3520 - RNA, 22 nt, Homo sapiens
uauggcacuaguacuggaaagc

SEQ ID NO: 3521 - RNA, 21 nt, Homo sapiens
aggcaaaugaagcagccgcuc

SEQ ID NO: 3522 - RNA, 22 nt, Homo sapiens
gcaugacaaugauugcucuuca

SEQ ID NO: 3523 - RNA, 22 nt, Homo sapiens
gaaaugucugagauguggcuca

SEQ ID NO: 3524 - RNA, 22 nt, Homo sapiens
aguaccauuccguuggagcugg

SEQ ID NO: 3525 - RNA, 22 nt, Homo sapiens
uaucacaggucaggaaucuugc

SEQ ID NO: 3526 - RNA, 22 nt, Homo sapiens
ugcacuguggucugagagacag

SEQ ID NO: 3527 - RNA, 22 nt, Homo sapiens
ucuuuguuagaacccucuccuu

SEQ ID NO: 3528 - RNA, 22 nt, Homo sapiens
gucuuccagccuccaucuuucu

SEQ ID NO: 3529 - RNA, 22 nt, Homo sapiens
ugggugaguaucuauuauucag

SEQ ID NO: 3530 - RNA, 22 nt, Homo sapiens
gaccacagacuggaaagagggc

SEQ ID NO: 3531 - RNA, 22 nt, Homo sapiens
uuaauguaauugauugauugac

SEQ ID NO: 3532 - RNA, 22 nt, Homo sapiens
ucucaguggugcuggcagggga

SEQ ID NO: 3533 - RNA, 22 nt, Homo sapiens
cccuugcacuucagagcugcau

SEQ ID NO: 3534 - RNA, 21 nt, Homo sapiens
uggaccccuuccagucaucau

SEQ ID NO: 3535 - RNA, 23 nt, Homo sapiens
auggcccuggugggagugucuuu

SEQ ID NO: 3536 - RNA, 22 nt, Homo sapiens
ugcugcacaguucuuaagauua

SEQ ID NO: 3537 - RNA, 22 nt, Homo sapiens
aggcugguauuuacaaaagcuc

SEQ ID NO: 3538 - RNA, 22 nt, Homo sapiens
ugauauguggauucagcucaaa

SEQ ID NO: 3539 - RNA, 22 nt, Homo sapiens
uggcaagaacgaaauguagggu

SEQ ID NO: 3540 - RNA, 22 nt, Homo sapiens
uuguacuagucauauuuugaaa

SEQ ID NO: 3541 - RNA, 23 nt, Homo sapiens
ucauguauucccuguaaugggua

SEQ ID NO: 3542 - RNA, 20 nt, Homo sapiens
aagugcaucguugugucugc

SEQ ID NO: 3543 - RNA, 22 nt, Homo sapiens
gagcaucauggggccaaagcgc

SEQ ID NO: 3544 - RNA, 20 nt, Homo sapiens
aggcauguugguuugcgugu

SEQ ID NO: 3545 - RNA, 22 nt, Homo sapiens
gagguacgaaauacacuguacu

SEQ ID NO: 3546 - RNA, 22 nt, Homo sapiens
accaccauugcacugaacuuuc

SEQ ID NO: 3547 - RNA, 22 nt, Homo sapiens
uggcaggugcacuggcuuugaa

SEQ ID NO: 3548 - RNA, 22 nt, Homo sapiens
auuggcagaaaucuuuauagua

SEQ ID NO: 3549 - RNA, 22 nt, Homo sapiens
uuaggcucuuugaggugcccag

SEQ ID NO: 3550 - RNA, 22 nt, Homo sapiens
ugacggaggacaccugcggaau

SEQ ID NO: 3551 - RNA, 22 nt, Homo sapiens
ggauacaucuggacagccgaau

SEQ ID NO: 3552 - RNA, 22 nt, Homo sapiens
agcugguuuauuucuauauccu

SEQ ID NO: 3553 - RNA, 22 nt, Homo sapiens
guaaaucucuguuuucauggac

SEQ ID NO: 3554 - RNA, 22 nt, Homo sapiens
ucaauugcaucaacaguguaca

SEQ ID NO: 3555 - RNA, 22 nt, Homo sapiens
uugaguaguaaggauauuaucu

SEQ ID NO: 3556 - RNA, 22 nt, Homo sapiens
ucaaguacuuugcauagugccg

SEQ ID NO: 3557 - RNA, 22 nt, Homo sapiens
uugcggcaguacagcccaggua

SEQ ID NO: 3558 - RNA, 22 nt, Homo sapiens
aauuacauggcaauugggaaau

SEQ ID NO: 3559 - RNA, 22 nt, Homo sapiens
auacacgguaggcacauauuua

SEQ ID NO: 3560 - RNA, 22 nt, Homo sapiens
augacuggaacggcacuuuaca

SEQ ID NO: 3561 - RNA, 22 nt, Homo sapiens
acccuguugguggaucagauug

SEQ ID NO: 3562 - RNA, 22 nt, Homo sapiens
ucagguaguuugugggagauga

SEQ ID NO: 3563 - RNA, 22 nt, Homo sapiens
ugagauauugggaguaauguca

SEQ ID NO: 3564 - RNA, 22 nt, Homo sapiens
ggcauguguggguuauuaaaga

SEQ ID NO: 3565 - RNA, 22 nt, Homo sapiens
uguaaacucaguauguuuuacu

SEQ ID NO: 3566 - RNA, 22 nt, Homo sapiens
cugagcaagucauuuuguuaaa

SEQ ID NO: 3567 - RNA, 22 nt, Homo sapiens
uggcuguuuauuucaccuggau

SEQ ID NO: 3568 - RNA, 22 nt, Homo sapiens
ccuguagcauccaagaagcugc

SEQ ID NO: 3569 - RNA, 22 nt, Homo sapiens
uuccucuagacugucgguuucu

SEQ ID NO: 3570 - RNA, 22 nt, Homo sapiens
uacaucagccugaaagagcucg

SEQ ID NO: 3571 - RNA, 19 nt, Homo sapiens
uuugcauagugagaauaua

SEQ ID NO: 3572 - RNA, 22 nt, Homo sapiens
ucagugcuuggcacagagagcu

SEQ ID NO: 3573 - RNA, 22 nt, Homo sapiens
auaacagcauuauugcauacgu

SEQ ID NO: 3574 - RNA, 22 nt, Homo sapiens
aucccugugacgagcaucccua

SEQ ID NO: 3575 - RNA, 22 nt, Homo sapiens
uggaguguuggggcaggaucuc

SEQ ID NO: 3576 - RNA, 22 nt, Homo sapiens
ggcuguguguuaaaauaggcuu

SEQ ID NO: 3577 - RNA, 22 nt, Homo sapiens
uuagacaguggugcacugcacu

SEQ ID NO: 3578 - RNA, 22 nt, Homo sapiens
auagcaggagaauggucauggg

SEQ ID NO: 3579 - RNA, 22 nt, Homo sapiens
uucugcuagucugucagaucuu

SEQ ID NO: 3580 - RNA, 22 nt, Homo sapiens
gcugguguucaggcccucaguc

SEQ ID NO: 3581 - RNA, 22 nt, Homo sapiens
ccugaugacacgggagauguac

SEQ ID NO: 3582 - RNA, 21 nt, Homo sapiens
uggagugaagaguuuauugac

SEQ ID NO: 3583 - RNA, 22 nt, Homo sapiens
agacaguguguguauauauggu

SEQ ID NO: 3584 - RNA, 20 nt, Homo sapiens
aucagagacuaggauugcca

SEQ ID NO: 3585 - RNA, 22 nt, Homo sapiens
aaauucaugucaccucuaggua

SEQ ID NO: 3586 - RNA, 22 nt, Homo sapiens
cugacguguuuuccagaccuuu

SEQ ID NO: 3587 - RNA, 20 nt, Homo sapiens
ugucaagaaacauuacuuau

SEQ ID NO: 3588 - RNA, 22 nt, Homo sapiens
uuuugcuugugaauagccacau

SEQ ID NO: 3589 - RNA, 22 nt, Homo sapiens
uuaccucagaccugcucugugu

SEQ ID NO: 3590 - RNA, 22 nt, Homo sapiens
uugauaucugaugccuauggaa

SEQ ID NO: 3591 - RNA, 22 nt, Homo sapiens
ugcaagaugauuucaauugaua

SEQ ID NO: 3592 - RNA, 22 nt, Homo sapiens
uuuugcaaauuccaguggccau

SEQ ID NO: 3593 - RNA, 22 nt, Homo sapiens
gaguagugcugcaguaaacaua

SEQ ID NO: 3594 - RNA, 20 nt, Homo sapiens
ucuggccccucuaaaucuca

SEQ ID NO: 3595 - RNA, 21 nt, Homo sapiens
uucucaggguguguccuaccc

SEQ ID NO: 3596 - RNA, 22 nt, Homo sapiens
ugugaacaaaauuuguugcaua

SEQ ID NO: 3597 - RNA, 22 nt, Homo sapiens
cuugcagagucauucuaauuuc

SEQ ID NO: 3598 - RNA, 22 nt, Homo sapiens
uuuggcauuagauaauugugua

SEQ ID NO: 3599 - RNA, 22 nt, Homo sapiens
uggaaugucagcuacaagaggg

SEQ ID NO: 3600 - RNA, 22 nt, Homo sapiens
ugauaugugaguauaugguuau

SEQ ID NO: 3601 - RNA, 22 nt, Homo sapiens
gcucaugagacaagcaggagua

SEQ ID NO: 3602 - RNA, 22 nt, Homo sapiens
aucaaaguaucucaauauggua

SEQ ID NO: 3603 - RNA, 22 nt, Homo sapiens
cacugcauucuccaccucccag

SEQ ID NO: 3604 - RNA, 22 nt, Homo sapiens
uuaucauagugcaguuuucuga

SEQ ID NO: 3605 - RNA, 22 nt, Homo sapiens
uuucaucagccagggucagucu

SEQ ID NO: 3606 - RNA, 22 nt, Homo sapiens
uuguacuagaaaauuauucuuu

SEQ ID NO: 3607 - RNA, 22 nt, Homo sapiens
uuugccaaugggaauuuuccua

SEQ ID NO: 3608 - RNA, 22 nt, Homo sapiens
acccugucacucccaucaauuu

SEQ ID NO: 3609 - RNA, 22 nt, Homo sapiens
aucagcaguguaaaaacggacu

SEQ ID NO: 3610 - RNA, 21 nt, Homo sapiens
agguuguguuuccucuuacuu

SEQ ID NO: 3611 - RNA, 22 nt, Homo sapiens
auuccagguggcgccauucaca

SEQ ID NO: 3612 - RNA, 22 nt, Homo sapiens
uggcaaaugaaagaaagccagu

SEQ ID NO: 3613 - RNA, 22 nt, Homo sapiens
aguggcuuuuuaguggcagaug

SEQ ID NO: 3614 - RNA, 22 nt, Homo sapiens
gugaccaaagauagcucaaguu

SEQ ID NO: 3615 - RNA, 21 nt, Homo sapiens
uaucacauuggugauuaaguu

SEQ ID NO: 3616 - RNA, 20 nt, Homo sapiens
augagcucaucuugaaaacc

SEQ ID NO: 3617 - RNA, 22 nt, Homo sapiens
uucacugugaauaaaggcuccc

SEQ ID NO: 3618 - RNA, 22 nt, Homo sapiens
ugacuccagagacugugcuguc

SEQ ID NO: 3619 - RNA, 22 nt, Homo sapiens
uucaagaauuaaaguggcuuuu

SEQ ID NO: 3620 - RNA, 22 nt, Homo sapiens
ggcagcaugggugccuuuguga

SEQ ID NO: 3621 - RNA, 22 nt, Homo sapiens
uugguacuaaaaaguagggugu

SEQ ID NO: 3622 - RNA, 22 nt, Homo sapiens
gcaggauuggagccucucugaa

SEQ ID NO: 3623 - RNA, 22 nt, Homo sapiens
gucaccagcuguguuagccccu

SEQ ID NO: 3624 - RNA, 22 nt, Homo sapiens
uaaauggauauugccaucuccu

SEQ ID NO: 3625 - RNA, 22 nt, Homo sapiens
uuugugcuccucucaguaugug

SEQ ID NO: 3626 - RNA, 22 nt, Homo sapiens
gagcccauuucacuuguccagc

SEQ ID NO: 3627 - RNA, 22 nt, Homo sapiens
gauaaauccagauucugaugua

SEQ ID NO: 3628 - RNA, 22 nt, Homo sapiens
uugagguaguacuuauuauugg

SEQ ID NO: 3629 - RNA, 22 nt, Homo sapiens
uucccugugugcagaugggugu

SEQ ID NO: 3630 - RNA, 18 nt, Homo sapiens
acagugucauggcucaau

SEQ ID NO: 3631 - RNA, 18 nt, Homo sapiens
auuguaagauguauggga

SEQ ID NO: 3632 - RNA, 22 nt, Homo sapiens
gugugacagcuauagacaugau

SEQ ID NO: 3633 - RNA, 21 nt, Homo sapiens
uugagcaacuaggguuauagg

SEQ ID NO: 3634 - RNA, 22 nt, Homo sapiens
uagauuaucccugauuugucca

SEQ ID NO: 3635 - RNA, 22 nt, Homo sapiens
ugucuuggaugaggauuaacag

SEQ ID NO: 3636 - RNA, 22 nt, Homo sapiens
gagguagggucccacuauguug

SEQ ID NO: 3637 - RNA, 22 nt, Homo sapiens
agcugguauuuugucgaggacu

SEQ ID NO: 3638 - RNA, 22 nt, Homo sapiens
gaaugcaugaggggaucagaug

SEQ ID NO: 3639 - RNA, 22 nt, Homo sapiens
uccagugcauucagacacuugg

SEQ ID NO: 3640 - RNA, 22 nt, Homo sapiens
gggagguagguauuagcuuuuc

SEQ ID NO: 3641 - RNA, 22 nt, Homo sapiens
uuucacagagggcuucuuucua

SEQ ID NO: 3642 - RNA, 22 nt, Homo sapiens
ugacauuacagucacuugcugu

SEQ ID NO: 3643 - RNA, 21 nt, Homo sapiens
uugaguugaagcaaggaggga

SEQ ID NO: 3644 - RNA, 22 nt, Homo sapiens
uauuacauccauaggcucugcu

SEQ ID NO: 3645 - RNA, 22 nt, Homo sapiens
uauaugcauugugggguacuga

SEQ ID NO: 3646 - RNA, 22 nt, Homo sapiens
augggugaguaugaguugacuu

SEQ ID NO: 3647 - RNA, 22 nt, Homo sapiens
auucccuguagaauaaggaugg

SEQ ID NO: 3648 - RNA, 22 nt, Homo sapiens
gugagggagcuggaauauuuau

SEQ ID NO: 3649 - RNA, 22 nt, Homo sapiens
aggcuuguuuuacuaacuggua

SEQ ID NO: 3650 - RNA, 21 nt, Homo sapiens
ccaguguaaugauagcaggca

SEQ ID NO: 3651 - RNA, 22 nt, Homo sapiens
auugcacuccagucucaccagg

SEQ ID NO: 3652 - RNA, 22 nt, Homo sapiens
augagcagaagagauacacugu

SEQ ID NO: 3653 - RNA, 22 nt, Homo sapiens
cuuagcaugucagcaccggguu

SEQ ID NO: 3654 - RNA, 19 nt, Homo sapiens
uauguaguuuucucaauau

SEQ ID NO: 3655 - RNA, 22 nt, Homo sapiens
ucacagacauugaggggaccuu

SEQ ID NO: 3656 - RNA, 22 nt, Homo sapiens
gugcaguuuuaagugaguuucu

SEQ ID NO: 3657 - RNA, 22 nt, Homo sapiens
uagcaggaaaggggucagaucu

SEQ ID NO: 3658 - RNA, 22 nt, Homo sapiens
aucccugagaacuuuuaauguu

SEQ ID NO: 3659 - RNA, 22 nt, Homo sapiens
guggaaggucaugaauguucuu

SEQ ID NO: 3660 - RNA, 22 nt, Homo sapiens
auggagaugugcgaacugagua

SEQ ID NO: 3661 - RNA, 22 nt, Homo sapiens
ucacaguagcaaauguuagaaa

SEQ ID NO: 3662 - RNA, 20 nt, Homo sapiens
uuacuccuuaaugagguuuu

SEQ ID NO: 3663 - RNA, 22 nt, Homo sapiens
guacccuggaacaacccaauuu

SEQ ID NO: 3664 - RNA, 22 nt, Homo sapiens
cugaccauagacuacucugggc

SEQ ID NO: 3665 - RNA, 22 nt, Homo sapiens
ucuaaaguacuacuacuguugg

SEQ ID NO: 3666 - RNA, 22 nt, Homo sapiens
uaucacacgccuugcuucauuu

SEQ ID NO: 3667 - RNA, 22 nt, Homo sapiens
ggcauugaguggguaggaguca

SEQ ID NO: 3668 - RNA, 22 nt, Homo sapiens
ugaggcuagucagaucagauga

SEQ ID NO: 3669 - RNA, 22 nt, Homo sapiens
auacauguuucauguuggugug

SEQ ID NO: 3670 - RNA, 22 nt, Homo sapiens
aucgcaauguuuagaauuuugu

SEQ ID NO: 3671 - RNA, 22 nt, Homo sapiens
ugacaguaaacagucuugauua

SEQ ID NO: 3672 - RNA, 22 nt, Homo sapiens
ucucauggcucacccugcauag

SEQ ID NO: 3673 - RNA, 22 nt, Homo sapiens
augucaacauagacaguagagu

SEQ ID NO: 3674 - RNA, 22 nt, Homo sapiens
auuauauguguaugugcauacc

SEQ ID NO: 3675 - RNA, 22 nt, Homo sapiens
ugcagagaaacauuuuguauuu

SEQ ID NO: 3676 - RNA, 22 nt, Homo sapiens
auuccauagugucuguggcaga

SEQ ID NO: 3677 - RNA, 22 nt, Homo sapiens
auauaugcuaagugcuaauaaa

SEQ ID NO: 3678 - RNA, 22 nt, Homo sapiens
cuuguacacuguuggugggaau

SEQ ID NO: 3679 - RNA, 22 nt, Homo sapiens
cuuuuacacugguggugggaau

SEQ ID NO: 3680 - RNA, 22 nt, Homo sapiens
ucagaugauuccguugacgaga

SEQ ID NO: 3681 - RNA, 22 nt, Homo sapiens
ccacaguggauuaaaguuacug

SEQ ID NO: 3682 - RNA, 22 nt, Homo sapiens
uggagcaaaguugaggccaagc

SEQ ID NO: 3683 - RNA, 22 nt, Homo sapiens
cagcuguuguuaugucugcagg

SEQ ID NO: 3684 - RNA, 22 nt, Homo sapiens
aacuggucuuuggaggaggagg

SEQ ID NO: 3685 - RNA, 22 nt, Homo sapiens
uuacagauggcacacucaaggg

SEQ ID NO: 3686 - RNA, 22 nt, Homo sapiens
aaagcgcuguuaagaagacuga

SEQ ID NO: 3687 - RNA, 22 nt, Homo sapiens
uugaucacuguacuaugacuau

SEQ ID NO: 3688 - RNA, 22 nt, Homo sapiens
aucugggguuggcaaaguuugg

SEQ ID NO: 3689 - RNA, 22 nt, Homo sapiens
auugcauuuucagguuggucug

SEQ ID NO: 3690 - RNA, 22 nt, Homo sapiens
uuagugaaugcaccacuucuga

SEQ ID NO: 3691 - RNA, 22 nt, Homo sapiens
uuuguacuugguguucuggaaa

SEQ ID NO: 3692 - RNA, 22 nt, Homo sapiens
uguuaugaagaugccugguaca

SEQ ID NO: 3693 - RNA, 18 nt, Homo sapiens
aggaaugguaauacuuca

SEQ ID NO: 3694 - RNA, 22 nt, Homo sapiens
uaaguugcagguugugauucca

SEQ ID NO: 3695 - RNA, 22 nt, Homo sapiens
uaagaugcagauuugggcgggg

SEQ ID NO: 3696 - RNA, 22 nt, Homo sapiens
auggcuuuaagagugucugaau

SEQ ID NO: 3697 - RNA, 22 nt, Homo sapiens
uauugaauuugagcugucucuu

SEQ ID NO: 3698 - RNA, 22 nt, Homo sapiens
aucuugggugggaacugagaau

SEQ ID NO: 3699 - RNA, 18 nt, Homo sapiens
ugcauacuaucugauuuu

SEQ ID NO: 3700 - RNA, 22 nt, Homo sapiens
uugcauaaguugaaccagccuu

SEQ ID NO: 3701 - RNA, 23 nt, Homo sapiens
gcuaggagagaugaaacacaggu

SEQ ID NO: 3702 - RNA, 22 nt, Homo sapiens
uugcaagaaaucagagccuucc

SEQ ID NO: 3703 - RNA, 22 nt, Homo sapiens
ugggaaugaaauuacauagcuu

SEQ ID NO: 3704 - RNA, 22 nt, Homo sapiens
cauugcacuccagccuggcaac

SEQ ID NO: 3705 - RNA, 22 nt, Homo sapiens
gacucagucuuggauuuuuaau

SEQ ID NO: 3706 - RNA, 22 nt, Homo sapiens
auugcccauaaggauauuguca

SEQ ID NO: 3707 - RNA, 22 nt, Homo sapiens
uuugccaaucagaggcaucuug

SEQ ID NO: 3708 - RNA, 20 nt, Homo sapiens
uggagugcuguguugagaag

SEQ ID NO: 3709 - RNA, 22 nt, Homo sapiens
uucauggugguacaaaagcaau

SEQ ID NO: 3710 - RNA, 22 nt, Homo sapiens
uguggcuuuuucuuggcugagg

SEQ ID NO: 3711 - RNA, 20 nt, Homo sapiens
augugcaguguggcaaccaa

SEQ ID NO: 3712 - RNA, 22 nt, Homo sapiens
gugugacugcucuauuagggcg

SEQ ID NO: 3713 - RNA, 22 nt, Homo sapiens
uggcaagaucacaauuacuuuu

SEQ ID NO: 3714 - RNA, 22 nt, Homo sapiens
guguaauacauuagcaaaccaa

SEQ ID NO: 3715 - RNA, 22 nt, Homo sapiens
uuauuagagauauuugguuagg

SEQ ID NO: 3716 - RNA, 22 nt, Homo sapiens
cucacuaggaaguaaaguuugu

SEQ ID NO: 3717 - RNA, 22 nt, Homo sapiens
uaguaucacaagguguacaccc

SEQ ID NO: 3718 - RNA, 21 nt, Homo sapiens
ugaaugcuuuaaauauuagaa

SEQ ID NO: 3719 - RNA, 22 nt, Homo sapiens
acugcacuccagccuugagagc

SEQ ID NO: 3720 - RNA, 22 nt, Homo sapiens
uuaaaagcuaucuccaagguca

SEQ ID NO: 3721 - RNA, 22 nt, Homo sapiens
auaugguguuugcuauucagcu

SEQ ID NO: 3722 - RNA, 20 nt, Homo sapiens
cugaggugggagaaucgcuu

SEQ ID NO: 3723 - RNA, 22 nt, Homo sapiens
guauacacccugugauauuauu

SEQ ID NO: 3724 - RNA, 21 nt, Homo sapiens
ucaccuguagcugcauguucu

SEQ ID NO: 3725 - RNA, 22 nt, Homo sapiens
acaagugcuuuuccuggagaca

SEQ ID NO: 3726 - RNA, 22 nt, Homo sapiens
uaagucuuuuuggaguuuauaa

SEQ ID NO: 3727 - RNA, 22 nt, Homo sapiens
agcccauuuugcacugagaugc

SEQ ID NO: 3728 - RNA, 22 nt, Homo sapiens
ggcuauagauaugugaacacuu

SEQ ID NO: 3729 - RNA, 22 nt, Homo sapiens
uaagagcuaggauuuuaaauca

SEQ ID NO: 3730 - RNA, 22 nt, Homo sapiens
aucccuguaacuagcagccccu

SEQ ID NO: 3731 - RNA, 22 nt, Homo sapiens
uguguaaauauauacacacgug

SEQ ID NO: 3732 - RNA, 22 nt, Homo sapiens
gaagaaguacaagacaaauuuu

SEQ ID NO: 3733 - RNA, 23 nt, Homo sapiens
cauggcuguuaacacuguuugag

SEQ ID NO: 3734 - RNA, 22 nt, Homo sapiens
augggaaaaucagaaggccugg

SEQ ID NO: 3735 - RNA, 22 nt, Homo sapiens
acugagucauugggugcccaga

SEQ ID NO: 3736 - RNA, 22 nt, Homo sapiens
guagagagaaauacaaagcugu

SEQ ID NO: 3737 - RNA, 22 nt, Homo sapiens
cauugcacuccagucugggcaa

SEQ ID NO: 3738 - RNA, 22 nt, Homo sapiens
uuuugcauuggcugaggagugu

SEQ ID NO: 3739 - RNA, 22 nt, Homo sapiens
uugaucaaaucugagugagaau

SEQ ID NO: 3740 - RNA, 22 nt, Homo sapiens
ugaguaugaguucaggaaaggc

SEQ ID NO: 3741 - RNA, 22 nt, Homo sapiens
cacaggccugucucuuucuaac

SEQ ID NO: 3742 - RNA, 22 nt, Homo sapiens
ugugcaauucgauggagcucau

SEQ ID NO: 3743 - RNA, 20 nt, Homo sapiens
uggaacuuaauugauggaca

SEQ ID NO: 3744 - RNA, 22 nt, Homo sapiens
uagcaaaucaauggaauugaag

SEQ ID NO: 3745 - RNA, 21 nt, Homo sapiens
ucaaaguguucuuuuguugaa

SEQ ID NO: 3746 - RNA, 22 nt, Homo sapiens
uaacccuuaguaucuguggguu

SEQ ID NO: 3747 - RNA, 22 nt, Homo sapiens
ugaguagaaauaaacgcaaacu

SEQ ID NO: 3748 - RNA, 22 nt, Homo sapiens
uugagcucaucaagauagagaa

SEQ ID NO: 3749 - RNA, 20 nt, Homo sapiens
agcuguuguuaugagguuua

SEQ ID NO: 3750 - RNA, 18 nt, Homo sapiens
uugaaugcgucccagaga

SEQ ID NO: 3751 - RNA, 22 nt, Homo sapiens
guggaauauaaagcaucgugua

SEQ ID NO: 3752 - RNA, 22 nt, Homo sapiens
gagguagaauguuuuucagcug

SEQ ID NO: 3753 - RNA, 22 nt, Homo sapiens
uucaguggagaggcugaguggu

SEQ ID NO: 3754 - RNA, 22 nt, Homo sapiens
uuuugcaccauccuaauaguau

SEQ ID NO: 3755 - RNA, 22 nt, Homo sapiens
acagucauagcagccuuuguua

SEQ ID NO: 3756 - RNA, 22 nt, Homo sapiens
aucauugcacaucacagccuca

SEQ ID NO: 3757 - RNA, 22 nt, Homo sapiens
cuaagguaggagaaucacucaa

SEQ ID NO: 3758 - RNA, 21 nt, Homo sapiens
uaucagagacauugagaggca

SEQ ID NO: 3759 - RNA, 22 nt, Homo sapiens
guuggucaaugugauuaggcca

SEQ ID NO: 3760 - RNA, 22 nt, Homo sapiens
ucaccuggagagcuugcuaaua

SEQ ID NO: 3761 - RNA, 22 nt, Homo sapiens
ugagugaggcugggcagucccu

SEQ ID NO: 3762 - RNA, 22 nt, Homo sapiens
guggucagaaaucucaguggca

SEQ ID NO: 3763 - RNA, 22 nt, Homo sapiens
uuuguguccccacccaaacauc

SEQ ID NO: 3764 - RNA, 22 nt, Homo sapiens
ggcaaaauauugucugguauag

SEQ ID NO: 3765 - RNA, 22 nt, Homo sapiens
uugagauggaguuucacucugu

SEQ ID NO: 3766 - RNA, 22 nt, Homo sapiens
uugauguugaggacauaaaccu

SEQ ID NO: 3767 - RNA, 22 nt, Homo sapiens
aauugcuucuguauuuuggaca

SEQ ID NO: 3768 - RNA, 22 nt, Homo sapiens
cagagaucaugcaacugcucgc

SEQ ID NO: 3769 - RNA, 22 nt, Homo sapiens
augaucacaccacugcacucca

SEQ ID NO: 3770 - RNA, 22 nt, Homo sapiens
guaugaaaaucggagauugggu

SEQ ID NO: 3771 - RNA, 22 nt, Homo sapiens
augucaaagaggaaaacuggau

SEQ ID NO: 3772 - RNA, 22 nt, Homo sapiens
uuuggcuuuuguaauaacugcc

SEQ ID NO: 3773 - RNA, 22 nt, Homo sapiens
acagcagugccccacucuacug

SEQ ID NO: 3774 - RNA, 22 nt, Homo sapiens
uagaggaaggauuggaaacgca

SEQ ID NO: 3775 - RNA, 22 nt, Homo sapiens
ucaaggcacauuugacauuuuc

SEQ ID NO: 3776 - RNA, 22 nt, Homo sapiens
aucaucacaguuguguguaaug

SEQ ID NO: 3777 - RNA, 22 nt, Homo sapiens
caugaugcuagguauggaugaa

SEQ ID NO: 3778 - RNA, 18 nt, Homo sapiens
ugaauaguguccccauga

SEQ ID NO: 3779 - RNA, 22 nt, Homo sapiens
uggaagacuuuagaggcuuaua

SEQ ID NO: 3780 - RNA, 22 nt, Homo sapiens
uucccugaaguguuacucuaga

SEQ ID NO: 3781 - RNA, 22 nt, Homo sapiens
agaaauguuuacucacccccuu

SEQ ID NO: 3782 - RNA, 22 nt, Homo sapiens
cagagugcauguuuagaugagu

SEQ ID NO: 3783 - RNA, 20 nt, Homo sapiens
ucucauggagguagagaaua

SEQ ID NO: 3784 - RNA, 22 nt, Homo sapiens
cuguaaagaucacagagcuggu

SEQ ID NO: 3785 - RNA, 16 nt, Homo sapiens
ugucuguuugggcaca

SEQ ID NO: 3786 - RNA, 22 nt, Homo sapiens
uucaccuugcccacagcagucu

SEQ ID NO: 3787 - RNA, 22 nt, Homo sapiens
cuuacagucuaucagccacaac

SEQ ID NO: 3788 - RNA, 22 nt, Homo sapiens
aagcuguuguucauccugaauu

SEQ ID NO: 3789 - RNA, 22 nt, Homo sapiens
auaggagcacgaacucuagugu

SEQ ID NO: 3790 - RNA, 22 nt, Homo sapiens
cauguaacaucccgcuguagga

SEQ ID NO: 3791 - RNA, 22 nt, Homo sapiens
auauugcuuagugaugaagucu

SEQ ID NO: 3792 - RNA, 22 nt, Homo sapiens
ggaagugugaguaggauuugga

SEQ ID NO: 3793 - RNA, 22 nt, Homo sapiens
uggcuuuuaucuacucucaacu

SEQ ID NO: 3794 - RNA, 22 nt, Homo sapiens
uacaaccucugccucccaaguu

SEQ ID NO: 3795 - RNA, 19 nt, Homo sapiens
agaguauuguuacuucucu

SEQ ID NO: 3796 - RNA, 22 nt, Homo sapiens
uacugcacuccagccuugccaa

SEQ ID NO: 3797 - RNA, 20 nt, Homo sapiens
uagcacacauguagaauagu

SEQ ID NO: 3798 - RNA, 20 nt, Homo sapiens
acacugugcuaaggauuuuc

SEQ ID NO: 3799 - RNA, 22 nt, Homo sapiens
uugagauacauaauuaugaaug

SEQ ID NO: 3800 - RNA, 22 nt, Homo sapiens
uggagugcaauggcaccaucuu

SEQ ID NO: 3801 - RNA, 22 nt, Homo sapiens
ugugaaauguuaucccgucgug

SEQ ID NO: 3802 - RNA, 22 nt, Homo sapiens
agaauaauguccccccaaggga

SEQ ID NO: 3803 - RNA, 22 nt, Homo sapiens
uuuguggaaugcucauguguag

SEQ ID NO: 3804 - RNA, 22 nt, Homo sapiens
aucauuaguuguggaauucuug

SEQ ID NO: 3805 - RNA, 22 nt, Homo sapiens
gagauaauuugaaucauggggg

SEQ ID NO: 3806 - RNA, 18 nt, Homo sapiens
ugaggaaaggguuugcua

SEQ ID NO: 3807 - RNA, 22 nt, Homo sapiens
uauugcuccccauaucgcagug

SEQ ID NO: 3808 - RNA, 22 nt, Homo sapiens
ugugccuacugauagagccaag

SEQ ID NO: 3809 - RNA, 22 nt, Homo sapiens
aguaucacaggcaaaacagaau

SEQ ID NO: 3810 - RNA, 22 nt, Homo sapiens
caugucuuuuauucugugugau

SEQ ID NO: 3811 - RNA, 22 nt, Homo sapiens
gagcuacauggauagucugcau

SEQ ID NO: 3812 - RNA, 22 nt, Homo sapiens
ucacugagaaugauguuucuga

SEQ ID NO: 3813 - RNA, 22 nt, Homo sapiens
ugaaauguuaaacaaguggcuc

SEQ ID NO: 3814 - RNA, 22 nt, Homo sapiens
uugaggaaugucauuuguguuu

SEQ ID NO: 3815 - RNA, 22 nt, Homo sapiens
ucuuggguuguuggcuucuccu

SEQ ID NO: 3816 - RNA, 22 nt, Homo sapiens
uugacaaguuguccaguaugag

SEQ ID NO: 3817 - RNA, 22 nt, Homo sapiens
ugaguguccaaguaaggugaaa

SEQ ID NO: 3818 - RNA, 22 nt, Homo sapiens
uagcaguaccccaguauccugg

SEQ ID NO: 3819 - RNA, 22 nt, Homo sapiens
uccuugagucuuugcucagaug

SEQ ID NO: 3820 - RNA, 22 nt, Homo sapiens
uagucagcaauguucauguucu

SEQ ID NO: 3821 - RNA, 22 nt, Homo sapiens
agugauguggaguuuggaugga

SEQ ID NO: 3822 - RNA, 22 nt, Homo sapiens
ugagguguuugugcaccaucug

SEQ ID NO: 3823 - RNA, 22 nt, Homo sapiens
ucuguguuugaucaagauugua

SEQ ID NO: 3824 - RNA, 22 nt, Homo sapiens
ggugaggaaaguugaguuucua

SEQ ID NO: 3825 - RNA, 21 nt, Homo sapiens
ugccuuuguaguaggugucuu

SEQ ID NO: 3826 - RNA, 19 nt, Homo sapiens
uggaugacugucugggucu

SEQ ID NO: 3827 - RNA, 21 nt, Homo sapiens
uacacuacugguggaaaugca

SEQ ID NO: 3828 - RNA, 22 nt, Homo sapiens
ugagcagugaguguggugcagg

SEQ ID NO: 3829 - RNA, 22 nt, Homo sapiens
ccacccuuccauucuuccucuu

SEQ ID NO: 3830 - RNA, 22 nt, Homo sapiens
cauuaguugaagugcagggaga

SEQ ID NO: 3831 - RNA, 22 nt, Homo sapiens
uuuggaagaugccacuguauca

SEQ ID NO: 3832 - RNA, 22 nt, Homo sapiens
ggaauugcaucaaaugcaggua

SEQ ID NO: 3833 - RNA, 22 nt, Homo sapiens
gagcuaguguaauauuuugggg

SEQ ID NO: 3834 - RNA, 22 nt, Homo sapiens
gaucacuuugaugccaggaacu

SEQ ID NO: 3835 - RNA, 22 nt, Homo sapiens
ugaguuaauuuuuguaucaugu

SEQ ID NO: 3836 - RNA, 22 nt, Homo sapiens
uugagacggagucucacucugu

SEQ ID NO: 3837 - RNA, 22 nt, Homo sapiens
uguacuagaaauuaaggcaggg

SEQ ID NO: 3838 - RNA, 22 nt, Homo sapiens
ugugucacugcacuccagcgug

SEQ ID NO: 3839 - RNA, 22 nt, Homo sapiens
gggugguuuuaucucuucccuu

SEQ ID NO: 3840 - RNA, 22 nt, Homo sapiens
auugacuugauauauagcugau

SEQ ID NO: 3841 - RNA, 22 nt, Homo sapiens
gggaguagagaguuucucugac

SEQ ID NO: 3842 - RNA, 22 nt, Homo sapiens
ugugaucauugcuguuaaagug

SEQ ID NO: 3843 - RNA, 20 nt, Homo sapiens
ugacuuguccgagguccccc

SEQ ID NO: 3844 - RNA, 22 nt, Homo sapiens
gugggauggagagaagguauga

SEQ ID NO: 3845 - RNA, 22 nt, Homo sapiens
ggagaucuuguuaaaguacaga

SEQ ID NO: 3846 - RNA, 19 nt, Homo sapiens
uacugcaccucaaccuggg

SEQ ID NO: 3847 - RNA, 22 nt, Homo sapiens
ugcauauguugaaccagccuug

SEQ ID NO: 3848 - RNA, 22 nt, Homo sapiens
uuaccugagaaggugacauuug

SEQ ID NO: 3849 - RNA, 18 nt, Homo sapiens
acucuguauguggagugg

SEQ ID NO: 3850 - RNA, 22 nt, Homo sapiens
agcccugugauuacuuuuauaa

SEQ ID NO: 3851 - RNA, 22 nt, Homo sapiens
uucuagcacuuugggagacuga

SEQ ID NO: 3852 - RNA, 22 nt, Homo sapiens
aucacuggccuuuuuaaaugcu

SEQ ID NO: 3853 - RNA, 22 nt, Homo sapiens
cuuuguccuucaagguguguca

SEQ ID NO: 3854 - RNA, 22 nt, Homo sapiens
ugucacugugcagucaugcauu

SEQ ID NO: 3855 - RNA, 22 nt, Homo sapiens
uugaccuggagaguacuuugac

SEQ ID NO: 3856 - RNA, 22 nt, Homo sapiens
auuccaguuguaagguuuuuca

SEQ ID NO: 3857 - RNA, 22 nt, Homo sapiens
uuuuuugguaauugaacaauga

SEQ ID NO: 3858 - RNA, 22 nt, Homo sapiens
uugaguccccacacuggguccc

SEQ ID NO: 3859 - RNA, 22 nt, Homo sapiens
aggcagcuguuauauacugagu

SEQ ID NO: 3860 - RNA, 22 nt, Homo sapiens
ugugcaugacagcauacaaacg

SEQ ID NO: 3861 - RNA, 20 nt, Homo sapiens
uugaggugugaggggcagag

SEQ ID NO: 3862 - RNA, 22 nt, Homo sapiens
auaaucaugucugaaaccuuug

SEQ ID NO: 3863 - RNA, 22 nt, Homo sapiens
gaugauguugaauguucucacc

SEQ ID NO: 3864 - RNA, 22 nt, Homo sapiens
cauauucacuuuacagagcugu

SEQ ID NO: 3865 - RNA, 22 nt, Homo sapiens
ucagaguagagcgacuucuccu

SEQ ID NO: 3866 - RNA, 22 nt, Homo sapiens
accgaguuagccaggauggucu

SEQ ID NO: 3867 - RNA, 22 nt, Homo sapiens
uugaacuguaagggucugugug

SEQ ID NO: 3868 - RNA, 22 nt, Homo sapiens
cccugagaugcuguuaaucugu

SEQ ID NO: 3869 - RNA, 21 nt, Homo sapiens
uagagcuuggcacagaguaga

SEQ ID NO: 3870 - RNA, 22 nt, Homo sapiens
ucuuugaguggagcgaggcaga

SEQ ID NO: 3871 - RNA, 22 nt, Homo sapiens
aguggcaaugugauguccugaa

SEQ ID NO: 3872 - RNA, 19 nt, Homo sapiens
uggagucaucaugcugcua

SEQ ID NO: 3873 - RNA, 21 nt, Homo sapiens
auuccacuuuuccuucaggga

SEQ ID NO: 3874 - RNA, 22 nt, Homo sapiens
ucuuugguucugugcagccuau

SEQ ID NO: 3875 - RNA, 22 nt, Homo sapiens
uugugcuuuacuuacuaccaga

SEQ ID NO: 3876 - RNA, 22 nt, Homo sapiens
ucaccucgugaucugcccacuu

SEQ ID NO: 3877 - RNA, 22 nt, Homo sapiens
aacaccaucccuuugaugcuuu

SEQ ID NO: 3878 - RNA, 22 nt, Homo sapiens
uggagacugaucccucuuuccu

SEQ ID NO: 3879 - RNA, 22 nt, Homo sapiens
gucagauaauuugcauccaucu

SEQ ID NO: 3880 - RNA, 22 nt, Homo sapiens
gcaugguacuggaugguaguau

SEQ ID NO: 3881 - RNA, 22 nt, Homo sapiens
aaguauagcuaugauaaacauu

SEQ ID NO: 3882 - RNA, 22 nt, Homo sapiens
cagagcacuaaagguaaaaggc

SEQ ID NO: 3883 - RNA, 22 nt, Homo sapiens
uagaagcacuaucccuccuagu

SEQ ID NO: 3884 - RNA, 22 nt, Homo sapiens
uagcaugucagucgccacacgu

SEQ ID NO: 3885 - RNA, 22 nt, Homo sapiens
uuggaguguucugguccgggcu

SEQ ID NO: 3886 - RNA, 22 nt, Homo sapiens
uccaguuuucuuuccuagggcu

SEQ ID NO: 3887 - RNA, 22 nt, Homo sapiens
ggggaguguggacaucacccug

SEQ ID NO: 3888 - RNA, 22 nt, Homo sapiens
ggucauggagcuuuacuuuaug

SEQ ID NO: 3889 - RNA, 22 nt, Homo sapiens
ccaucccuuucugagcaguucc

SEQ ID NO: 3890 - RNA, 22 nt, Homo sapiens
ugaguagagaauucagcuaagg

SEQ ID NO: 3891 - RNA, 22 nt, Homo sapiens
cucagugucuggcacacagaaa

SEQ ID NO: 3892 - RNA, 20 nt, Homo sapiens
ucacugugaacuucuugagg

SEQ ID NO: 3893 - RNA, 22 nt, Homo sapiens
uccuuuggcuaacuuucuaagu

SEQ ID NO: 3894 - RNA, 22 nt, Homo sapiens
ucauuagagacagggugucacu

SEQ ID NO: 3895 - RNA, 21 nt, Homo sapiens
ugggccccuuccuuacaucau

SEQ ID NO: 3896 - RNA, 22 nt, Homo sapiens
gggauguaugauauauguuggu

SEQ ID NO: 3897 - RNA, 22 nt, Homo sapiens
uauagcagccugaacaaaguaa

SEQ ID NO: 3898 - RNA, 22 nt, Homo sapiens
ucuaucacagccccacacucuc

SEQ ID NO: 3899 - RNA, 22 nt, Homo sapiens
caugcauuggucuauuauguga

SEQ ID NO: 3900 - RNA, 22 nt, Homo sapiens
ugacauguugcauuauauuucc

SEQ ID NO: 3901 - RNA, 22 nt, Homo sapiens
uugaggucagagguucgagacc

SEQ ID NO: 3902 - RNA, 22 nt, Homo sapiens
ugcuagaagaucacacacauca

SEQ ID NO: 3903 - RNA, 22 nt, Homo sapiens
uucaguaguaaguuggaacucu

SEQ ID NO: 3904 - RNA, 22 nt, Homo sapiens
ugugaagaaagucauugguagc

SEQ ID NO: 3905 - RNA, 22 nt, Homo sapiens
ucacuggacucuagccugggug

SEQ ID NO: 3906 - RNA, 22 nt, Homo sapiens
uggcuguguccucucccaaauc

SEQ ID NO: 3907 - RNA, 22 nt, Homo sapiens
auauugguuaaauauuauguga

SEQ ID NO: 3908 - RNA, 22 nt, Homo sapiens
gggauuguaauacugaguuggu

SEQ ID NO: 3909 - RNA, 22 nt, Homo sapiens
aagcaggugucugugucuguaa

SEQ ID NO: 3910 - RNA, 22 nt, Homo sapiens
ucaguguuuggaaucucaauuu

SEQ ID NO: 3911 - RNA, 22 nt, Homo sapiens
aauggcucuuccuggaguugug

SEQ ID NO: 3912 - RNA, 22 nt, Homo sapiens
guuugcacuccuaugagaaucu

SEQ ID NO: 3913 - RNA, 22 nt, Homo sapiens
aauagcuguccuuagaagugug

SEQ ID NO: 3914 - RNA, 22 nt, Homo sapiens
ugagcugagacaauaaguuuuu

SEQ ID NO: 3915 - RNA, 22 nt, Homo sapiens
auaaagguaagcacuauccuga

SEQ ID NO: 3916 - RNA, 22 nt, Homo sapiens
gcucaguuuccucagcugcaaa

SEQ ID NO: 3917 - RNA, 22 nt, Homo sapiens
agguaagucucuaauuaugaau

SEQ ID NO: 3918 - RNA, 22 nt, Homo sapiens
auuuaaccaucugcaguggcac

SEQ ID NO: 3919 - RNA, 23 nt, Homo sapiens
uuucacaguagcuggaucagccu

SEQ ID NO: 3920 - RNA, 22 nt, Homo sapiens
uuuguucaccucaaggauggga

SEQ ID NO: 3921 - RNA, 22 nt, Homo sapiens
gggucaguuuugagaaagcgug

SEQ ID NO: 3922 - RNA, 22 nt, Homo sapiens
augcacauauguacugcccuau

SEQ ID NO: 3923 - RNA, 22 nt, Homo sapiens
uugcaaggugcucgaagggcuc

SEQ ID NO: 3924 - RNA, 22 nt, Homo sapiens
cuagaguagaguuuccuuagga

SEQ ID NO: 3925 - RNA, 22 nt, Homo sapiens
agagugcuauagauuagauuuc

SEQ ID NO: 3926 - RNA, 22 nt, Homo sapiens
acaguagaaaacaauggauuug

SEQ ID NO: 3927 - RNA, 22 nt, Homo sapiens
aguggaguguaaagcgucuuuu

SEQ ID NO: 3928 - RNA, 22 nt, Homo sapiens
ugauaggagauuuucaucugua

SEQ ID NO: 3929 - RNA, 22 nt, Homo sapiens
gagcuagcauuuagacaucugg

SEQ ID NO: 3930 - RNA, 22 nt, Homo sapiens
aagugcaaaucuguggcugaaa

SEQ ID NO: 3931 - RNA, 19 nt, Homo sapiens
uuucacacucgccuacuuc

SEQ ID NO: 3932 - RNA, 22 nt, Homo sapiens
ugguaaacaacaggagaacuug

SEQ ID NO: 3933 - RNA, 22 nt, Homo sapiens
gugaggcugguccugccuccca

SEQ ID NO: 3934 - RNA, 22 nt, Homo sapiens
ugagacggagucuggcacuguc

SEQ ID NO: 3935 - RNA, 22 nt, Homo sapiens
gcugguguugugaaucaggccg

SEQ ID NO: 3936 - RNA, 22 nt, Homo sapiens
cuacccuuaaguuucugugggg

SEQ ID NO: 3937 - RNA, 22 nt, Homo sapiens
uggcacuaugugacaagguuuu

SEQ ID NO: 3938 - RNA, 22 nt, Homo sapiens
uuacaugucuugguaagguuag

SEQ ID NO: 3939 - RNA, 20 nt, Homo sapiens
ugucaaggaauucccaaauc

SEQ ID NO: 3940 - RNA, 22 nt, Homo sapiens
cuggaauguuccuaaagauuca

SEQ ID NO: 3941 - RNA, 22 nt, Homo sapiens
ugugaacauuuuguauauauua

SEQ ID NO: 3942 - RNA, 22 nt, Homo sapiens
aggaagguaaacuaacuugccu

SEQ ID NO: 3943 - RNA, 22 nt, Homo sapiens
uuguauacucuauuuuagcagu

SEQ ID NO: 3944 - RNA, 22 nt, Homo sapiens
auggcuugugggaacuuuuaaa

SEQ ID NO: 3945 - RNA, 17 nt, Homo sapiens
ugagaacaugugguauu

SEQ ID NO: 3946 - RNA, 22 nt, Homo sapiens
uagcaccaggguugacugaccu

SEQ ID NO: 3947 - RNA, 22 nt, Homo sapiens
guauugccugugugccagccac

SEQ ID NO: 3948 - RNA, 22 nt, Homo sapiens
ggugaguggugcuuaaguucag

SEQ ID NO: 3949 - RNA, 22 nt, Homo sapiens
cuguaaaguucucauuguagcc

SEQ ID NO: 3950 - RNA, 22 nt, Homo sapiens
uugagguauugauaaaacauuu

SEQ ID NO: 3951 - RNA, 22 nt, Homo sapiens
guaauacuuuugggauauuaga

SEQ ID NO: 3952 - RNA, 22 nt, Homo sapiens
agugaacacagcuucuuugguu

SEQ ID NO: 3953 - RNA, 22 nt, Homo sapiens
acuggcuuauuucacuuagcau

SEQ ID NO: 3954 - RNA, 22 nt, Homo sapiens
ugugcacaacgugcagguuugu

SEQ ID NO: 3955 - RNA, 22 nt, Homo sapiens
auccuguagucucacagcccca

SEQ ID NO: 3956 - RNA, 22 nt, Homo sapiens
ccuccauuugugucaggaaguc

SEQ ID NO: 3957 - RNA, 22 nt, Homo sapiens
uaacauagucauauacuugcuu

SEQ ID NO: 3958 - RNA, 22 nt, Homo sapiens
guugcccuuagcacuucagccu

SEQ ID NO: 3959 - RNA, 22 nt, Homo sapiens
guaugguuguaugaggacccau

SEQ ID NO: 3960 - RNA, 22 nt, Homo sapiens
gcugacacugggcuauagaucu

SEQ ID NO: 3961 - RNA, 21 nt, Homo sapiens
ucuugguauguauuuaggagg

SEQ ID NO: 3962 - RNA, 22 nt, Homo sapiens
ugcugcaaacaggcaucugugg

SEQ ID NO: 3963 - RNA, 22 nt, Homo sapiens
uccacuuuugugcugaauugga

SEQ ID NO: 3964 - RNA, 22 nt, Homo sapiens
gcacccguagugcuuucaauua

SEQ ID NO: 3965 - RNA, 22 nt, Homo sapiens
gccugagaggauaugauccccu

SEQ ID NO: 3966 - RNA, 22 nt, Homo sapiens
gauagguucuaagcagguguug

SEQ ID NO: 3967 - RNA, 22 nt, Homo sapiens
uuccagcugggggcaacucugc

SEQ ID NO: 3968 - RNA, 22 nt, Homo sapiens
ugagcuguuugaagaagcauuu

SEQ ID NO: 3969 - RNA, 22 nt, Homo sapiens
cugagguaggcccugagaauau

SEQ ID NO: 3970 - RNA, 22 nt, Homo sapiens
cuuuuggcuuaagauugucuug

SEQ ID NO: 3971 - RNA, 22 nt, Homo sapiens
ggaaaucucugaggcucccuuc

SEQ ID NO: 3972 - RNA, 21 nt, Homo sapiens
gcaaaggaauugccuaagcuu

SEQ ID NO: 3973 - RNA, 22 nt, Homo sapiens
uacauugucauauucucucucu

SEQ ID NO: 3974 - RNA, 23 nt, Homo sapiens
ugacagugcuugaaauugcucuu

SEQ ID NO: 3975 - RNA, 21 nt, Homo sapiens
uggaugccuaggcagaaguuu

SEQ ID NO: 3976 - RNA, 22 nt, Homo sapiens
uucagagcauugguuuuuugaa

SEQ ID NO: 3977 - RNA, 22 nt, Homo sapiens
uaacugucucccuugguccuga

SEQ ID NO: 3978 - RNA, 22 nt, Homo sapiens
ugacugugcagcuccaucaggg

SEQ ID NO: 3979 - RNA, 22 nt, Homo sapiens
uugcuauguugcccagucugga

SEQ ID NO: 3980 - RNA, 22 nt, Homo sapiens
aaggcaugcaaagaacauuuua

SEQ ID NO: 3981 - RNA, 22 nt, Homo sapiens
acgguauagauuguauccuagg

SEQ ID NO: 3982 - RNA, 22 nt, Homo sapiens
aacacuggcugcucgaguucuc

SEQ ID NO: 3983 - RNA, 22 nt, Homo sapiens
ggaauauaaaaagccccagaau

SEQ ID NO: 3984 - RNA, 22 nt, Homo sapiens
auuuuugguugguaggcuauua

SEQ ID NO: 3985 - RNA, 22 nt, Homo sapiens
ggauugcuuaagaaguuucauu

SEQ ID NO: 3986 - RNA, 22 nt, Homo sapiens
aacagcacacccgcugcuucca

SEQ ID NO: 3987 - RNA, 22 nt, Homo sapiens
uuugcuucacuguuuggcaaaa

SEQ ID NO: 3988 - RNA, 21 nt, Homo sapiens
gugcagaugccacagucacuc

SEQ ID NO: 3989 - RNA, 22 nt, Homo sapiens
uaaggcacuacuuuaggcuuuc

SEQ ID NO: 3990 - RNA, 22 nt, Homo sapiens
ugauuuguuucaggaguuuucu

SEQ ID NO: 3991 - RNA, 22 nt, Homo sapiens
uuccaggugggcgugggccugg

SEQ ID NO: 3992 - RNA, 22 nt, Homo sapiens
cacagcgacuuccgccuaccgg

SEQ ID NO: 3993 - RNA, 22 nt, Homo sapiens
cacugcauuacucaugagcaug

SEQ ID NO: 3994 - RNA, 22 nt, Homo sapiens
ugcaguguggcucacgccugua

SEQ ID NO: 3995 - RNA, 20 nt, Homo sapiens
uacaggacugagaaucugug

SEQ ID NO: 3996 - RNA, 22 nt, Homo sapiens
gugcauauaaguuguuucuagu

SEQ ID NO: 3997 - RNA, 22 nt, Homo sapiens
auggaauguaaguuauguuugc

SEQ ID NO: 3998 - RNA, 22 nt, Homo sapiens
uauggcauguauguguggcgca

SEQ ID NO: 3999 - RNA, 22 nt, Homo sapiens
aagagagccagcugguauauuu

SEQ ID NO: 4000 - RNA, 22 nt, Homo sapiens
cucuuuaguaagcaguugauga

SEQ ID NO: 4001 - RNA, 22 nt, Homo sapiens
cacugcauuggaugguuccucc

SEQ ID NO: 4002 - RNA, 22 nt, Homo sapiens
agcuuguccuccacccacacug

SEQ ID NO: 4003 - RNA, 22 nt, Homo sapiens
uaagacacauguguucccaggc

SEQ ID NO: 4004 - RNA, 22 nt, Homo sapiens
agacacuguugaaaaggcccca

SEQ ID NO: 4005 - RNA, 22 nt, Homo sapiens
guuuggauauuaggcaagagua

SEQ ID NO: 4006 - RNA, 19 nt, Homo sapiens
ugcuuaguuuuauguguaa

SEQ ID NO: 4007 - RNA, 22 nt, Homo sapiens
cuuccauauucuaggacaggcu

SEQ ID NO: 4008 - RNA, 22 nt, Homo sapiens
ugcuaugucagccaggcugguc

SEQ ID NO: 4009 - RNA, 18 nt, Homo sapiens
uucaucaguccucagcug

SEQ ID NO: 4010 - RNA, 22 nt, Homo sapiens
uuggucaaaucugaugggagaa

SEQ ID NO: 4011 - RNA, 23 nt, Homo sapiens
uguaaaagcauuugucagccugg

SEQ ID NO: 4012 - RNA, 22 nt, Homo sapiens
cugugauuauauaguuaaggua

SEQ ID NO: 4013 - RNA, 22 nt, Homo sapiens
aauagagucaggguuucaccau

SEQ ID NO: 4014 - RNA, 22 nt, Homo sapiens
acaagcacaaauuuaauccugu

SEQ ID NO: 4015 - RNA, 22 nt, Homo sapiens
gagaacagaagcauuccuaauu

SEQ ID NO: 4016 - RNA, 22 nt, Homo sapiens
gauuugagagaggguguuuaua

SEQ ID NO: 4017 - RNA, 22 nt, Homo sapiens
ggauccaucuggaaauguggga

SEQ ID NO: 4018 - RNA, 22 nt, Homo sapiens
ugguaugucuuucuuccuguag

SEQ ID NO: 4019 - RNA, 22 nt, Homo sapiens
auaaggcuaguguaggagccag

SEQ ID NO: 4020 - RNA, 22 nt, Homo sapiens
ugcaccauggcacuccaggcug

SEQ ID NO: 4021 - RNA, 22 nt, Homo sapiens
cugggucaguuucugauuauug

SEQ ID NO: 4022 - RNA, 22 nt, Homo sapiens
gugcaugucugugacgacccug

SEQ ID NO: 4023 - RNA, 22 nt, Homo sapiens
ucuuugguaggaguaggaggcc

SEQ ID NO: 4024 - RNA, 22 nt, Homo sapiens
auugaguaacaauuuuguucaa

SEQ ID NO: 4025 - RNA, 22 nt, Homo sapiens
uaccgcagugacauuccuugau

SEQ ID NO: 4026 - RNA, 22 nt, Homo sapiens
ugauguugacuguaggcagaga

SEQ ID NO: 4027 - RNA, 22 nt, Homo sapiens
cuuaaugcuacggcucuguguu

SEQ ID NO: 4028 - RNA, 22 nt, Homo sapiens
aucaaagugaaauauuaguuau

SEQ ID NO: 4029 - RNA, 21 nt, Homo sapiens
ugcauacuucucagaugauua

SEQ ID NO: 4030 - RNA, 22 nt, Homo sapiens
aaggagcaguggacggguccua

SEQ ID NO: 4031 - RNA, 22 nt, Homo sapiens
gcccugagauucuuggauucug

SEQ ID NO: 4032 - RNA, 22 nt, Homo sapiens
cacugcauccuccaccuccugg

SEQ ID NO: 4033 - RNA, 22 nt, Homo sapiens
uuaugguuuauuagcaggguua

SEQ ID NO: 4034 - RNA, 22 nt, Homo sapiens
uuguagcuuuuuaaugugcugc

SEQ ID NO: 4035 - RNA, 22 nt, Homo sapiens
uaaguguaaugucugaaguuug

SEQ ID NO: 4036 - RNA, 22 nt, Homo sapiens
augguacuccagagaagcagaa

SEQ ID NO: 4037 - RNA, 22 nt, Homo sapiens
guaagagcauguaguggcucua

SEQ ID NO: 4038 - RNA, 22 nt, Homo sapiens
gugugauuguuaauuuuaggug

SEQ ID NO: 4039 - RNA, 22 nt, Homo sapiens
uuuuggucuccaguuucugcug

SEQ ID NO: 4040 - RNA, 22 nt, Homo sapiens
uaauucugacaacaguggcguu

SEQ ID NO: 4041 - RNA, 22 nt, Homo sapiens
uuuaugcuacauguguuggaaa

SEQ ID NO: 4042 - RNA, 22 nt, Homo sapiens
gguauguagcaaaagaggugcu

SEQ ID NO: 4043 - RNA, 22 nt, Homo sapiens
uggguagagcacugggggcgag

SEQ ID NO: 4044 - RNA, 22 nt, Homo sapiens
uagggcuuuccggccugucaga

SEQ ID NO: 4045 - RNA, 22 nt, Homo sapiens
acugcacuccagccuucaggac

SEQ ID NO: 4046 - RNA, 22 nt, Homo sapiens
uuaacagugaccccugguggcc

SEQ ID NO: 4047 - RNA, 22 nt, Homo sapiens
acagugcuuucaauguucagua

SEQ ID NO: 4048 - RNA, 22 nt, Homo sapiens
ugacacagcaagauggaaccau

SEQ ID NO: 4049 - RNA, 18 nt, Homo sapiens
augcauauuuuaaguugu

SEQ ID NO: 4050 - RNA, 22 nt, Homo sapiens
uacugcauuucacuguuaaaga

SEQ ID NO: 4051 - RNA, 22 nt, Homo sapiens
acaaagugccuccuuuuagagu

SEQ ID NO: 4052 - RNA, 22 nt, Homo sapiens
gauuuuccaguggcccugauca

SEQ ID NO: 4053 - RNA, 22 nt, Homo sapiens
aauugaaugcagaugccaggga

SEQ ID NO: 4054 - RNA, 22 nt, Homo sapiens
auacaugugccauguugguaug

SEQ ID NO: 4055 - RNA, 22 nt, Homo sapiens
uauggguuuauuucuggucuca

SEQ ID NO: 4056 - RNA, 22 nt, Homo sapiens
uugaagacuaaguuaucaggau

SEQ ID NO: 4057 - RNA, 22 nt, Homo sapiens
uuguccuccacauuugaucagu

SEQ ID NO: 4058 - RNA, 22 nt, Homo sapiens
caucauugcacccuauagagaa

SEQ ID NO: 4059 - RNA, 22 nt, Homo sapiens
gucuagaacuucugaccuuagg

SEQ ID NO: 4060 - RNA, 22 nt, Homo sapiens
ugugauaguuggcuaaagcagu

SEQ ID NO: 4061 - RNA, 22 nt, Homo sapiens
ugaauagacacuaaagacugua

SEQ ID NO: 4062 - RNA, 22 nt, Homo sapiens
cuugaacaaagagauuccauua

SEQ ID NO: 4063 - RNA, 22 nt, Homo sapiens
uuggcagaauguuagaaacuua

SEQ ID NO: 4064 - RNA, 21 nt, Homo sapiens
gaaauacugccuuaggagcug

SEQ ID NO: 4065 - RNA, 22 nt, Homo sapiens
uauaaugcacauucccaaaucu

SEQ ID NO: 4066 - RNA, 22 nt, Homo sapiens
uuacauguuguggguuguggcc

SEQ ID NO: 4067 - RNA, 20 nt, Homo sapiens
aagcugaguguuuuuuuaau

SEQ ID NO: 4068 - RNA, 23 nt, Homo sapiens
ugagauuacccagaaagaguaua

SEQ ID NO: 4069 - RNA, 20 nt, Homo sapiens
ucacuggguucuugaagucu

SEQ ID NO: 4070 - RNA, 22 nt, Homo sapiens
ucagguaucuuuauagcgaugc

SEQ ID NO: 4071 - RNA, 22 nt, Homo sapiens
uaugcuguuucugauuuaggga

SEQ ID NO: 4072 - RNA, 22 nt, Homo sapiens
guauuaguuaucuacugcugug

SEQ ID NO: 4073 - RNA, 22 nt, Homo sapiens
uuuucaguuuuccagguagccg

SEQ ID NO: 4074 - RNA, 22 nt, Homo sapiens
ucacuggagguuccugaaguuc

SEQ ID NO: 4075 - RNA, 22 nt, Homo sapiens
uguccauuuuuaugcuuauggu

SEQ ID NO: 4076 - RNA, 22 nt, Homo sapiens
ugagaucacgccacugcacucc

SEQ ID NO: 4077 - RNA, 22 nt, Homo sapiens
uauccacgugaaaaagauugaa

SEQ ID NO: 4078 - RNA, 22 nt, Homo sapiens
auggcccccuguuugugaacau

SEQ ID NO: 4079 - RNA, 19 nt, Homo sapiens
gacuccagaguugugugcu

SEQ ID NO: 4080 - RNA, 22 nt, Homo sapiens
uagcagcauuuuuguagaguau

SEQ ID NO: 4081 - RNA, 22 nt, Homo sapiens
cuaugguuucuccauaucauca

SEQ ID NO: 4082 - RNA, 17 nt, Homo sapiens
ugagggaugccugguuc

SEQ ID NO: 4083 - RNA, 22 nt, Homo sapiens
acccugguagcuaugaagucuu

SEQ ID NO: 4084 - RNA, 22 nt, Homo sapiens
gucaucaggacgggucaucugc

SEQ ID NO: 4085 - RNA, 22 nt, Homo sapiens
agcagcucaugccuuugggagg

SEQ ID NO: 4086 - RNA, 22 nt, Homo sapiens
uacccguugaggguuugccagc

SEQ ID NO: 4087 - RNA, 22 nt, Homo sapiens
ugagaugaacuugauuguuuua

SEQ ID NO: 4088 - RNA, 22 nt, Homo sapiens
gagaucaauucauggcauaguu

SEQ ID NO: 4089 - RNA, 22 nt, Homo sapiens
uccaugugaaaucuaugaggac

SEQ ID NO: 4090 - RNA, 22 nt, Homo sapiens
acugcacuccagccucgugaca

SEQ ID NO: 4091 - RNA, 22 nt, Homo sapiens
ggcaagaagaacuauaacuuuu

SEQ ID NO: 4092 - RNA, 22 nt, Homo sapiens
guggaaugcaguguugauucaa

SEQ ID NO: 4093 - RNA, 22 nt, Homo sapiens
uagauuaucauucauacaggga

SEQ ID NO: 4094 - RNA, 20 nt, Homo sapiens
uaagugcuugagacuucuga

SEQ ID NO: 4095 - RNA, 22 nt, Homo sapiens
gugucacugugaggauauugua

SEQ ID NO: 4096 - RNA, 22 nt, Homo sapiens
uagggagugucuucauuuugua

SEQ ID NO: 4097 - RNA, 22 nt, Homo sapiens
auaauugcuaagugaagauggu

SEQ ID NO: 4098 - RNA, 22 nt, Homo sapiens
acccguuacuuagcagaccggg

SEQ ID NO: 4099 - RNA, 23 nt, Homo sapiens
aaauuugccuauuauuccuaugg

SEQ ID NO: 4100 - RNA, 22 nt, Homo sapiens
gauguuguuuagccuuugaugu

SEQ ID NO: 4101 - RNA, 22 nt, Homo sapiens
gauauguguuuuagucaggguu

SEQ ID NO: 4102 - RNA, 22 nt, Homo sapiens
aguuggccccuacugggaggug

SEQ ID NO: 4103 - RNA, 22 nt, Homo sapiens
guauuuggugaugccuccaaac

SEQ ID NO: 4104 - RNA, 22 nt, Homo sapiens
guaugaguuuucugaugugugg

SEQ ID NO: 4105 - RNA, 22 nt, Homo sapiens
aggcuagacuuugagaauuuuu

SEQ ID NO: 4106 - RNA, 18 nt, Homo sapiens
auguggcuuuugaaggcu

SEQ ID NO: 4107 - RNA, 22 nt, Homo sapiens
uacuucauucuugaccuugcau

SEQ ID NO: 4108 - RNA, 22 nt, Homo sapiens
agaaaugcagcaugaggcggca

SEQ ID NO: 4109 - RNA, 18 nt, Homo sapiens
gucucacaugguggaagc

SEQ ID NO: 4110 - RNA, 22 nt, Homo sapiens
agucacggugguuugcacuugu

SEQ ID NO: 4111 - RNA, 22 nt, Homo sapiens
cugucuaugagccaggaagcca

SEQ ID NO: 4112 - RNA, 22 nt, Homo sapiens
uuggaauguauggcaucuugcg

SEQ ID NO: 4113 - RNA, 22 nt, Homo sapiens
guugcucaggccggagugcagu

SEQ ID NO: 4114 - RNA, 22 nt, Homo sapiens
ucucauggagguagagaguaaa

SEQ ID NO: 4115 - RNA, 22 nt, Homo sapiens
augaaguguguguucaagucuu

SEQ ID NO: 4116 - RNA, 22 nt, Homo sapiens
uaucagaucccaauuucuggcc

SEQ ID NO: 4117 - RNA, 22 nt, Homo sapiens
uuugcacucaguaagugggagc

SEQ ID NO: 4118 - RNA, 22 nt, Homo sapiens
guggaucacuugagguuagaag

SEQ ID NO: 4119 - RNA, 22 nt, Homo sapiens
gaucugugugauuggaugcauu

SEQ ID NO: 4120 - RNA, 22 nt, Homo sapiens
aucaaagugaauuaaugagaau

SEQ ID NO: 4121 - RNA, 22 nt, Homo sapiens
uaccauguauguuucuccauug

SEQ ID NO: 4122 - RNA, 19 nt, Homo sapiens
ucccuguagaccacagugc

SEQ ID NO: 4123 - RNA, 22 nt, Homo sapiens
uguuacagcagcacaaaaugga

SEQ ID NO: 4124 - RNA, 22 nt, Homo sapiens
uaagcagugcaagaauggaaua

SEQ ID NO: 4125 - RNA, 22 nt, Homo sapiens
acugcacucuagcuugggugac

SEQ ID NO: 4126 - RNA, 22 nt, Homo sapiens
auugcacuccagcuugggugac

SEQ ID NO: 4127 - RNA, 22 nt, Homo sapiens
uuguaccacagggcaugaagug

SEQ ID NO: 4128 - RNA, 22 nt, Homo sapiens
ugugaucauuucaggaauuuug

SEQ ID NO: 4129 - RNA, 22 nt, Homo sapiens
auugcucaaaucaguacuugag

SEQ ID NO: 4130 - RNA, 22 nt, Homo sapiens
uggaauacaugucgcugagcug

SEQ ID NO: 4131 - RNA, 22 nt, Homo sapiens
gugguucuaaaccuuuuuuggu

SEQ ID NO: 4132 - RNA, 18 nt, Homo sapiens
gacagugugaagauuccu

SEQ ID NO: 4133 - RNA, 22 nt, Homo sapiens
uaagguacuuuggagaaaacug

SEQ ID NO: 4134 - RNA, 22 nt, Homo sapiens
uauggauuugccuauucuguau

SEQ ID NO: 4135 - RNA, 20 nt, Homo sapiens
uuuuagcuuuuauugaaagc

SEQ ID NO: 4136 - RNA, 22 nt, Homo sapiens
gaagguacgcuuaggaaaugau

SEQ ID NO: 4137 - RNA, 19 nt, Homo sapiens
gugagcacagacaauacaa

SEQ ID NO: 4138 - RNA, 22 nt, Homo sapiens
uacauacuucacagacuuuaaa

SEQ ID NO: 4139 - RNA, 22 nt, Homo sapiens
guacugagagacaguuacuguu

SEQ ID NO: 4140 - RNA, 22 nt, Homo sapiens
guguaaaugagugcugaaggag

SEQ ID NO: 4141 - RNA, 20 nt, Homo sapiens
uaucacaggucagaaacccu

SEQ ID NO: 4142 - RNA, 22 nt, Homo sapiens
aucaaagccaugcucaguuuuc

SEQ ID NO: 4143 - RNA, 22 nt, Homo sapiens
gugcaguuuugagugaguuucu

SEQ ID NO: 4144 - RNA, 22 nt, Homo sapiens
ucucagugacugcugggucccc

SEQ ID NO: 4145 - RNA, 22 nt, Homo sapiens
cuugaauguaaauaauguacag

SEQ ID NO: 4146 - RNA, 22 nt, Homo sapiens
uucaaaguuggaggacaaacug

SEQ ID NO: 4147 - RNA, 22 nt, Homo sapiens
auggucuuuuuguuaugagaga

SEQ ID NO: 4148 - RNA, 22 nt, Homo sapiens
uuaagugaauuaucuaacaugu

SEQ ID NO: 4149 - RNA, 22 nt, Homo sapiens
cugagacacucuuaucugcaua

SEQ ID NO: 4150 - RNA, 22 nt, Homo sapiens
uuaaguagaugaaugugaaugu

SEQ ID NO: 4151 - RNA, 22 nt, Homo sapiens
ucaccaccuuccaggaccacug

SEQ ID NO: 4152 - RNA, 22 nt, Homo sapiens
uuuggaaugugcacucagauug

SEQ ID NO: 4153 - RNA, 22 nt, Homo sapiens
gcaaaugcuaugccauuuuaua

SEQ ID NO: 4154 - RNA, 18 nt, Homo sapiens
uccuuuugggguaggaga

SEQ ID NO: 4155 - RNA, 22 nt, Homo sapiens
cagugcauaggaucuaaaauuu

SEQ ID NO: 4156 - RNA, 22 nt, Homo sapiens
uuaucucaguguuuguaaacaa

SEQ ID NO: 4157 - RNA, 22 nt, Homo sapiens
ugagcagaaagcugcaaggucg

SEQ ID NO: 4158 - RNA, 22 nt, Homo sapiens
ucagaguagaaacacuuccaua

SEQ ID NO: 4159 - RNA, 22 nt, Homo sapiens
gaacuuguguugcuucacaugu

SEQ ID NO: 4160 - RNA, 22 nt, Homo sapiens
aagugguguuuguauuuaugca

SEQ ID NO: 4161 - RNA, 20 nt, Homo sapiens
agccccauguaaaccacaug

SEQ ID NO: 4162 - RNA, 22 nt, Homo sapiens
ggacuaggagcuaggaagaucu

SEQ ID NO: 4163 - RNA, 22 nt, Homo sapiens
uaugucuauuauguagcaggaa

SEQ ID NO: 4164 - RNA, 22 nt, Homo sapiens
ucuggucccugcacauauuuuc

SEQ ID NO: 4165 - RNA, 22 nt, Homo sapiens
uaauacuagugaauagcaggau

SEQ ID NO: 4166 - RNA, 22 nt, Homo sapiens
gucacugggugcugcgccuguc

SEQ ID NO: 4167 - RNA, 22 nt, Homo sapiens
gugaggaaggaaaccugcuagc

SEQ ID NO: 4168 - RNA, 22 nt, Homo sapiens
ugagguacaacauggacugaag

SEQ ID NO: 4169 - RNA, 22 nt, Homo sapiens
ggaaagacaccuuacuauguua

SEQ ID NO: 4170 - RNA, 22 nt, Homo sapiens
agguagaguguuuuguucuucu

SEQ ID NO: 4171 - RNA, 22 nt, Homo sapiens
acucagagagaacugucauuug

SEQ ID NO: 4172 - RNA, 22 nt, Homo sapiens
ugaugugucaucugagagagug

SEQ ID NO: 4173 - RNA, 22 nt, Homo sapiens
guaucauugccuaaugcucuca

SEQ ID NO: 4174 - RNA, 22 nt, Homo sapiens
gcuuguguauuaaaccuugcag

SEQ ID NO: 4175 - RNA, 19 nt, Homo sapiens
auaugggguuugaacugug

SEQ ID NO: 4176 - RNA, 22 nt, Homo sapiens
ugauaggucagaugauauugaa

SEQ ID NO: 4177 - RNA, 22 nt, Homo sapiens
aucagagugaauaaugacaaaa

SEQ ID NO: 4178 - RNA, 22 nt, Homo sapiens
uacauaguagauauaggguuua

SEQ ID NO: 4179 - RNA, 22 nt, Homo sapiens
uuuugguauaugcaggggucuu

SEQ ID NO: 4180 - RNA, 22 nt, Homo sapiens
ugaaugcuucaugucugggcug

SEQ ID NO: 4181 - RNA, 22 nt, Homo sapiens
uggauagaaauguacuguuuuc

SEQ ID NO: 4182 - RNA, 22 nt, Homo sapiens
uuguaugucuucauuugaaaaa

SEQ ID NO: 4183 - RNA, 22 nt, Homo sapiens
accgggcugagcgcaggccccg

SEQ ID NO: 4184 - RNA, 16 nt, Homo sapiens
aguaguuuuacagauu

SEQ ID NO: 4185 - RNA, 22 nt, Homo sapiens
uugaaauguuuagaaguuugga

SEQ ID NO: 4186 - RNA, 22 nt, Homo sapiens
auccacaugcaguuggaaacag

SEQ ID NO: 4187 - RNA, 16 nt, Homo sapiens
uuuuugcagaaaugac

SEQ ID NO: 4188 - RNA, 23 nt, Homo sapiens
uacuacacuuuucccaagguuuu

SEQ ID NO: 4189 - RNA, 22 nt, Homo sapiens
uggaauuuagguugauaguaua

SEQ ID NO: 4190 - RNA, 22 nt, Homo sapiens
gccuguagaagaguagaugacc

SEQ ID NO: 4191 - RNA, 22 nt, Homo sapiens
augucuggcagaagacuucuca

SEQ ID NO: 4192 - RNA, 20 nt, Homo sapiens
agaaccuguaguguagaggg

SEQ ID NO: 4193 - RNA, 22 nt, Homo sapiens
uguaacugcuuagaagguuuua

SEQ ID NO: 4194 - RNA, 22 nt, Homo sapiens
uguggaaauggugcuacgaaca

SEQ ID NO: 4195 - RNA, 22 nt, Homo sapiens
ugauuguucuguccccaggggc

SEQ ID NO: 4196 - RNA, 22 nt, Homo sapiens
uugugucccugcccaaaucuca

SEQ ID NO: 4197 - RNA, 22 nt, Homo sapiens
uccauguagaugcuauguuguc

SEQ ID NO: 4198 - RNA, 22 nt, Homo sapiens
agugcauaugucuuuuuggaag

SEQ ID NO: 4199 - RNA, 22 nt, Homo sapiens
ugaauugucucucacuggguuc

SEQ ID NO: 4200 - RNA, 22 nt, Homo sapiens
cacauugaauuucugaugacaa

SEQ ID NO: 4201 - RNA, 22 nt, Homo sapiens
gagugcaauggcgcgaucucgg

SEQ ID NO: 4202 - RNA, 22 nt, Homo sapiens
uauugccuugccuacuuuucca

SEQ ID NO: 4203 - RNA, 22 nt, Homo sapiens
aaugacucugccuaaauuucac

SEQ ID NO: 4204 - RNA, 16 nt, Homo sapiens
ugagaacaugggguau

SEQ ID NO: 4205 - RNA, 22 nt, Homo sapiens
gugagucaugucccaucugauu

SEQ ID NO: 4206 - RNA, 18 nt, Homo sapiens
ggaagccuauuuaguaac

SEQ ID NO: 4207 - RNA, 22 nt, Homo sapiens
uaauaguuggcacuggagaaag

SEQ ID NO: 4208 - RNA, 22 nt, Homo sapiens
uuaugguuuuuagcagaguaau

SEQ ID NO: 4209 - RNA, 22 nt, Homo sapiens
ugugaagauguuucuuaauuga

SEQ ID NO: 4210 - RNA, 15 nt, Homo sapiens
uuucuacugcacuuc

SEQ ID NO: 4211 - RNA, 22 nt, Homo sapiens
gugagaugugacuucugccucu

SEQ ID NO: 4212 - RNA, 22 nt, Homo sapiens
ucauaguacuuuguuuugaaaa

SEQ ID NO: 4213 - RNA, 22 nt, Homo sapiens
uagaucaacuuugguaagagaa

SEQ ID NO: 4214 - RNA, 21 nt, Homo sapiens
ucugagucauucaguggccug

SEQ ID NO: 4215 - RNA, 22 nt, Homo sapiens
aaauccaucucuuggggcauug

SEQ ID NO: 4216 - RNA, 22 nt, Homo sapiens
cacaccuaccucauuauggaca

SEQ ID NO: 4217 - RNA, 22 nt, Homo sapiens
gaugaucaugaccuacagaugg

SEQ ID NO: 4218 - RNA, 22 nt, Homo sapiens
ugagcucaguauuucauaaaca

SEQ ID NO: 4219 - RNA, 22 nt, Homo sapiens
gaucccauuggcugccaugugg

SEQ ID NO: 4220 - RNA, 22 nt, Homo sapiens
cauugcacuccagccuugguga

SEQ ID NO: 4221 - RNA, 22 nt, Homo sapiens
uuauuacuccuauuuuguagau

SEQ ID NO: 4222 - RNA, 22 nt, Homo sapiens
cugagguacugggggccaggau

SEQ ID NO: 4223 - RNA, 22 nt, Homo sapiens
acccuggaggucuacagugcag

SEQ ID NO: 4224 - RNA, 22 nt, Homo sapiens
auaaccuauggaucuacucggg

SEQ ID NO: 4225 - RNA, 22 nt, Homo sapiens
ugaguuaggagaguguggcucu

SEQ ID NO: 4226 - RNA, 22 nt, Homo sapiens
ugagguuggggucagggcuagc

SEQ ID NO: 4227 - RNA, 21 nt, Homo sapiens
ccccugauacuuagucaagag

SEQ ID NO: 4228 - RNA, 22 nt, Homo sapiens
gucauggguuaaagguggauac

SEQ ID NO: 4229 - RNA, 22 nt, Homo sapiens
uacaacacugguucgacaugug

SEQ ID NO: 4230 - RNA, 22 nt, Homo sapiens
uuguacuucagacaugccaaag

SEQ ID NO: 4231 - RNA, 22 nt, Homo sapiens
ugcauauucuaggauuuuguau

SEQ ID NO: 4232 - RNA, 22 nt, Homo sapiens
aguuagcaaaacucccaaaggu

SEQ ID NO: 4233 - RNA, 22 nt, Homo sapiens
ugucauacaguaacaugguugg

SEQ ID NO: 4234 - RNA, 22 nt, Homo sapiens
caugaaagugagaaacuccugg

SEQ ID NO: 4235 - RNA, 22 nt, Homo sapiens
acagugacagaaagcugauuau

SEQ ID NO: 4236 - RNA, 22 nt, Homo sapiens
gugacacagcaagacuccgucu

SEQ ID NO: 4237 - RNA, 22 nt, Homo sapiens
uuugcaagaugaaaaaguucua

SEQ ID NO: 4238 - RNA, 22 nt, Homo sapiens
uggauaguucuucuacuagagu

SEQ ID NO: 4239 - RNA, 22 nt, Homo sapiens
gagugcaaagguccugaggugg

SEQ ID NO: 4240 - RNA, 22 nt, Homo sapiens
ucaggcacuaguaagaaaaagg

SEQ ID NO: 4241 - RNA, 22 nt, Homo sapiens
uuugcacuuuuguaauaugguu

SEQ ID NO: 4242 - RNA, 22 nt, Homo sapiens
ucuguaacauccaccuucuggg

SEQ ID NO: 4243 - RNA, 22 nt, Homo sapiens
cugacaagauucaucacucagu

SEQ ID NO: 4244 - RNA, 22 nt, Homo sapiens
aauugaaucaugugggcagacu

SEQ ID NO: 4245 - RNA, 22 nt, Homo sapiens
cuagcugcacuuccugcuacug

SEQ ID NO: 4246 - RNA, 22 nt, Homo sapiens
auagucaguagucucauaauga

SEQ ID NO: 4247 - RNA, 22 nt, Homo sapiens
guucacucuggagaauauugac

SEQ ID NO: 4248 - RNA, 22 nt, Homo sapiens
uuggguccucugguccuugguu

SEQ ID NO: 4249 - RNA, 22 nt, Homo sapiens
uugguauguaauuuauauugua

SEQ ID NO: 4250 - RNA, 22 nt, Homo sapiens
ugugcuaauacauacagugcua

SEQ ID NO: 4251 - RNA, 22 nt, Homo sapiens
ugcaucacaguacuccagccug

SEQ ID NO: 4252 - RNA, 22 nt, Homo sapiens
augaaaucacugugaugcccua

SEQ ID NO: 4253 - RNA, 22 nt, Homo sapiens
guggaaugaaaacucucucaca

SEQ ID NO: 4254 - RNA, 22 nt, Homo sapiens
ggcgccauugcacuccagccug

SEQ ID NO: 4255 - RNA, 17 nt, Homo sapiens
uggaaugucuaagccug

SEQ ID NO: 4256 - RNA, 22 nt, Homo sapiens
augacauuccacagccguagag

SEQ ID NO: 4257 - RNA, 23 nt, Homo sapiens
agcaccaccccaggucacaagug

SEQ ID NO: 4258 - RNA, 22 nt, Homo sapiens
aaaggcacuagaaguuaccuuu

SEQ ID NO: 4259 - RNA, 22 nt, Homo sapiens
gagauauguuggcagcugguau

SEQ ID NO: 4260 - RNA, 22 nt, Homo sapiens
cagugguuuucaacccugguug

SEQ ID NO: 4261 - RNA, 22 nt, Homo sapiens
aagugcuuccuuucagaggguu

SEQ ID NO: 4262 - RNA, 22 nt, Homo sapiens
gcauaugucuuuauagcagcau

SEQ ID NO: 4263 - RNA, 22 nt, Homo sapiens
auagcaaugccccaauccuugg

SEQ ID NO: 4264 - RNA, 22 nt, Homo sapiens
ugaaagguauagguucuggagg

SEQ ID NO: 4265 - RNA, 22 nt, Homo sapiens
uguauauguuuguacauauguc

SEQ ID NO: 4266 - RNA, 22 nt, Homo sapiens
augggauaguaucaguggaaua

SEQ ID NO: 4267 - RNA, 22 nt, Homo sapiens
uuuaaggcaugccuguacaugc

SEQ ID NO: 4268 - RNA, 22 nt, Homo sapiens
gugacaucagcuccagguauaa

SEQ ID NO: 4269 - RNA, 22 nt, Homo sapiens
agcagauguuuagugagcgccu

SEQ ID NO: 4270 - RNA, 22 nt, Homo sapiens
augccaagagacaaagggaauc

SEQ ID NO: 4271 - RNA, 22 nt, Homo sapiens
uuugcaccuuccuaguggcuga

SEQ ID NO: 4272 - RNA, 22 nt, Homo sapiens
uaccucaguucaauaacagaua

SEQ ID NO: 4273 - RNA, 22 nt, Homo sapiens
ugcuguguugcuggcuuaaaga

SEQ ID NO: 4274 - RNA, 22 nt, Homo sapiens
uugugcauaucagagguuugcu

SEQ ID NO: 4275 - RNA, 22 nt, Homo sapiens
gauaaaucuuggcuagucuaag

SEQ ID NO: 4276 - RNA, 19 nt, Homo sapiens
ggcaagaguuguucugugu

SEQ ID NO: 4277 - RNA, 22 nt, Homo sapiens
gagagcaugugcuggcaucagu

SEQ ID NO: 4278 - RNA, 22 nt, Homo sapiens
gucacugacaagagagaagaac

SEQ ID NO: 4279 - RNA, 23 nt, Homo sapiens
uggguucauucuugaagucagug

SEQ ID NO: 4280 - RNA, 22 nt, Homo sapiens
uaauucacauaaagcacuuaga

SEQ ID NO: 4281 - RNA, 22 nt, Homo sapiens
uuauagguuucuacaggacuau

SEQ ID NO: 4282 - RNA, 22 nt, Homo sapiens
gugagauuaccauuuaaaucag

SEQ ID NO: 4283 - RNA, 22 nt, Homo sapiens
uggguaauggagaaauaaaucu

SEQ ID NO: 4284 - RNA, 22 nt, Homo sapiens
gaggaucucuugagcccagaag

SEQ ID NO: 4285 - RNA, 22 nt, Homo sapiens
ugcauuaucagauguuugcuuu

SEQ ID NO: 4286 - RNA, 19 nt, Homo sapiens
augaccauuuccauaguau

SEQ ID NO: 4287 - RNA, 22 nt, Homo sapiens
cugagcaucauggcagaaucuu

SEQ ID NO: 4288 - RNA, 22 nt, Homo sapiens
uaaacugcuugaaaugguguca

SEQ ID NO: 4289 - RNA, 21 nt, Homo sapiens
ugucaguuuccagaguucaac

SEQ ID NO: 4290 - RNA, 22 nt, Homo sapiens
cuaaaggaaucugagccccuga

SEQ ID NO: 4291 - RNA, 22 nt, Homo sapiens
cuuucucagugagacccgagau

SEQ ID NO: 4292 - RNA, 21 nt, Homo sapiens
uuauaguggcaugauuuauaa

SEQ ID NO: 4293 - RNA, 22 nt, Homo sapiens
agagguguuaaagucucuuuua

SEQ ID NO: 4294 - RNA, 22 nt, Homo sapiens
auggcuuugggcugcucugccc

SEQ ID NO: 4295 - RNA, 22 nt, Homo sapiens
ucacagugcaggaucaguuaau

SEQ ID NO: 4296 - RNA, 22 nt, Homo sapiens
ugauuuguuuagugccaaguuu

SEQ ID NO: 4297 - RNA, 22 nt, Homo sapiens
uacucagugacugguggaucaa

SEQ ID NO: 4298 - RNA, 22 nt, Homo sapiens
auuccaguggguuuacauccca

SEQ ID NO: 4299 - RNA, 22 nt, Homo sapiens
uaguaucauugaaacggcuugu

SEQ ID NO: 4300 - RNA, 22 nt, Homo sapiens
caccggauucauggggaagaag

SEQ ID NO: 4301 - RNA, 22 nt, Homo sapiens
uuccugugacccccaagcccac

SEQ ID NO: 4302 - RNA, 22 nt, Homo sapiens
ucagauuggugcaaaaguaauu

SEQ ID NO: 4303 - RNA, 22 nt, Homo sapiens
cucacagucucucccuaauuuu

SEQ ID NO: 4304 - RNA, 22 nt, Homo sapiens
cuggcucugggcuaaagaaaua

SEQ ID NO: 4305 - RNA, 22 nt, Homo sapiens
auggcaauguaagucagaaaaa

SEQ ID NO: 4306 - RNA, 22 nt, Homo sapiens
uuugagauaucuuccaucagua

SEQ ID NO: 4307 - RNA, 22 nt, Homo sapiens
uugagaguggaggcuauaucuu

SEQ ID NO: 4308 - RNA, 22 nt, Homo sapiens
augccuagagucaguggaggug

SEQ ID NO: 4309 - RNA, 22 nt, Homo sapiens
cuugccuacucacugguuuacu

SEQ ID NO: 4310 - RNA, 21 nt, Homo sapiens
aacagugcugaacagacaccu

SEQ ID NO: 4311 - RNA, 22 nt, Homo sapiens
ugaggucauucaugugggcgca

SEQ ID NO: 4312 - RNA, 22 nt, Homo sapiens
cugaauguucuggauggaagag

SEQ ID NO: 4313 - RNA, 22 nt, Homo sapiens
ggcagaguggacauuuaaaugu

SEQ ID NO: 4314 - RNA, 22 nt, Homo sapiens
guaccucaguuggaaaugcaga

SEQ ID NO: 4315 - RNA, 22 nt, Homo sapiens
acaguaaugggccccuuuuccu

SEQ ID NO: 4316 - RNA, 22 nt, Homo sapiens
ucaagcaauucuccucucagcc

SEQ ID NO: 4317 - RNA, 22 nt, Homo sapiens
gagaucauucugauccagaguc

SEQ ID NO: 4318 - RNA, 22 nt, Homo sapiens
uuuguauguuggagauuggaga

SEQ ID NO: 4319 - RNA, 22 nt, Homo sapiens
auaugcacuauacacacguaua

SEQ ID NO: 4320 - RNA, 21 nt, Homo sapiens
gauaaguuggcagccagcacc

SEQ ID NO: 4321 - RNA, 22 nt, Homo sapiens
guguauacauagaauuguguau

SEQ ID NO: 4322 - RNA, 22 nt, Homo sapiens
ugggaagagggagcgauuuugg

SEQ ID NO: 4323 - RNA, 22 nt, Homo sapiens
agugguaguacaggagauaccg

SEQ ID NO: 4324 - RNA, 22 nt, Homo sapiens
auagugcuggaauaaauauacg

SEQ ID NO: 4325 - RNA, 22 nt, Homo sapiens
ugaagugaagcaguaguguggg

SEQ ID NO: 4326 - RNA, 22 nt, Homo sapiens
guaagagaauggguuacuuucc

SEQ ID NO: 4327 - RNA, 19 nt, Homo sapiens
uuuguauguuuccaguaau

SEQ ID NO: 4328 - RNA, 22 nt, Homo sapiens
caucgcacuccagcuugggcaa

SEQ ID NO: 4329 - RNA, 22 nt, Homo sapiens
acuggcuuuugagaaaaacacu

SEQ ID NO: 4330 - RNA, 22 nt, Homo sapiens
gaccuguaguuuaguugccugu

SEQ ID NO: 4331 - RNA, 22 nt, Homo sapiens
ugaaguaauguuuuauucuauu

SEQ ID NO: 4332 - RNA, 22 nt, Homo sapiens
ugcugcuguuaucauuuuacca

SEQ ID NO: 4333 - RNA, 17 nt, Homo sapiens
ucuucuguuacuguggc

SEQ ID NO: 4334 - RNA, 22 nt, Homo sapiens
uggaucaugcgaggccuccccu

SEQ ID NO: 4335 - RNA, 22 nt, Homo sapiens
cuggauguaaaugaaacuacag

SEQ ID NO: 4336 - RNA, 22 nt, Homo sapiens
ugggagcauugcauuagaagcc

SEQ ID NO: 4337 - RNA, 22 nt, Homo sapiens
ccugaugacuaaugguuuugag

SEQ ID NO: 4338 - RNA, 22 nt, Homo sapiens
aacugcauuuucugauugugug

SEQ ID NO: 4339 - RNA, 22 nt, Homo sapiens
uggaggacugcagaacugaggc

SEQ ID NO: 4340 - RNA, 22 nt, Homo sapiens
ugagguauuuuguuaugcagcc

SEQ ID NO: 4341 - RNA, 22 nt, Homo sapiens
agcaacauuuuugaccuuucuu

SEQ ID NO: 4342 - RNA, 22 nt, Homo sapiens
ugacuacauaaguaaucucaaa

SEQ ID NO: 4343 - RNA, 22 nt, Homo sapiens
agauggguuuucacauguuggc

SEQ ID NO: 4344 - RNA, 23 nt, Homo sapiens
ugcuccccucauggaugaauaaa

SEQ ID NO: 4345 - RNA, 22 nt, Homo sapiens
uugcuucuuucgucuggcccca

SEQ ID NO: 4346 - RNA, 22 nt, Homo sapiens
ucuggguuuuuccauugccggu

SEQ ID NO: 4347 - RNA, 22 nt, Homo sapiens
uucaauaugucauuggcaggca

SEQ ID NO: 4348 - RNA, 19 nt, Homo sapiens
gggcaaaucuggaaauuua

SEQ ID NO: 4349 - RNA, 22 nt, Homo sapiens
gcaugugaauguguaagaaaau

SEQ ID NO: 4350 - RNA, 22 nt, Homo sapiens
uguggucaucacuugaagguaa

SEQ ID NO: 4351 - RNA, 22 nt, Homo sapiens
gguauguuuagaccauuuacau

SEQ ID NO: 4352 - RNA, 22 nt, Homo sapiens
uugugccccuucucagucgggc

SEQ ID NO: 4353 - RNA, 20 nt, Homo sapiens
auaccacagacuggguaguu

SEQ ID NO: 4354 - RNA, 22 nt, Homo sapiens
gcuugguccccacccaaaucgc

SEQ ID NO: 4355 - RNA, 22 nt, Homo sapiens
caacugcucacuccuggguuca

SEQ ID NO: 4356 - RNA, 22 nt, Homo sapiens
ugccauugcacuccagccuggg

SEQ ID NO: 4357 - RNA, 22 nt, Homo sapiens
uggauugaaagcuuuaauauug

SEQ ID NO: 4358 - RNA, 22 nt, Homo sapiens
uaauacugcugugcuugaguug

SEQ ID NO: 4359 - RNA, 22 nt, Homo sapiens
uagaucaauuaauuguuacuug

SEQ ID NO: 4360 - RNA, 22 nt, Homo sapiens
uugccuaguuuaggucugugcu

SEQ ID NO: 4361 - RNA, 22 nt, Homo sapiens
uacagcacaggugcagguguug

SEQ ID NO: 4362 - RNA, 22 nt, Homo sapiens
aauugaccuaaucugauuacug

SEQ ID NO: 4363 - RNA, 22 nt, Homo sapiens
uuugggaaaugaaguugguaga

SEQ ID NO: 4364 - RNA, 19 nt, Homo sapiens
caccgccugcccccugcug

SEQ ID NO: 4365 - RNA, 22 nt, Homo sapiens
ucuuugaguguauacuuagauu

SEQ ID NO: 4366 - RNA, 22 nt, Homo sapiens
guggaggacuggauaaagaaaa

SEQ ID NO: 4367 - RNA, 22 nt, Homo sapiens
gagcuguugguuugaaagaauu

SEQ ID NO: 4368 - RNA, 20 nt, Homo sapiens
cuugaagacuaugcugcuga

SEQ ID NO: 4369 - RNA, 22 nt, Homo sapiens
aaggcgguguggauccuacagc

SEQ ID NO: 4370 - RNA, 22 nt, Homo sapiens
aggcagaugagguccucagcug

SEQ ID NO: 4371 - RNA, 20 nt, Homo sapiens
auguaauguaugauauguac

SEQ ID NO: 4372 - RNA, 22 nt, Homo sapiens
auccccugcacggggugucauu

SEQ ID NO: 4373 - RNA, 22 nt, Homo sapiens
augcacuguuuucuugaugaga

SEQ ID NO: 4374 - RNA, 22 nt, Homo sapiens
uauggcuauggcuguggcuaug

SEQ ID NO: 4375 - RNA, 22 nt, Homo sapiens
ugugcauauaaguguguauaua

SEQ ID NO: 4376 - RNA, 22 nt, Homo sapiens
auaggacuauugugaggauuaa

SEQ ID NO: 4377 - RNA, 21 nt, Homo sapiens
gccaguguggcaauuuuucaa

SEQ ID NO: 4378 - RNA, 22 nt, Homo sapiens
uugauagguuuuauguauaguu

SEQ ID NO: 4379 - RNA, 22 nt, Homo sapiens
gugaauguuuucuuacauggua

SEQ ID NO: 4380 - RNA, 22 nt, Homo sapiens
cucugagccugagguuccuacu

SEQ ID NO: 4381 - RNA, 22 nt, Homo sapiens
gugcaguuuacaguuacccagu

SEQ ID NO: 4382 - RNA, 19 nt, Homo sapiens
gcugauguuacauucuugc

SEQ ID NO: 4383 - RNA, 22 nt, Homo sapiens
agcagcaugcaaauggacuaau

SEQ ID NO: 4384 - RNA, 22 nt, Homo sapiens
guuauugcucucgaagacucuc

SEQ ID NO: 4385 - RNA, 22 nt, Homo sapiens
ucagugcuguuugcccucguuu

SEQ ID NO: 4386 - RNA, 22 nt, Homo sapiens
ucugugcugagaguugaaaguu

SEQ ID NO: 4387 - RNA, 22 nt, Homo sapiens
ggaagccugcacucgggcaggg

SEQ ID NO: 4388 - RNA, 22 nt, Homo sapiens
gugcuuguauuuaaaucaugug

SEQ ID NO: 4389 - RNA, 16 nt, Homo sapiens
cauugcacucuagccu

SEQ ID NO: 4390 - RNA, 22 nt, Homo sapiens
uuuuggugguuaugugucaaug

SEQ ID NO: 4391 - RNA, 22 nt, Homo sapiens
cugaggaaguucuuuaacaguu

SEQ ID NO: 4392 - RNA, 22 nt, Homo sapiens
cucaccuugugauccuccugcc

SEQ ID NO: 4393 - RNA, 22 nt, Homo sapiens
acauggcuuaugaauuuggaga

SEQ ID NO: 4394 - RNA, 22 nt, Homo sapiens
gucaauguaucuagcuguauua

SEQ ID NO: 4395 - RNA, 18 nt, Homo sapiens
ugacagcacaugugggga

SEQ ID NO: 4396 - RNA, 22 nt, Homo sapiens
augagcugauuuccuuaccaua

SEQ ID NO: 4397 - RNA, 22 nt, Homo sapiens
uuuagcaaagcaauuuacacca

SEQ ID NO: 4398 - RNA, 21 nt, Homo sapiens
ugagaacaacaggucaagcag

SEQ ID NO: 4399 - RNA, 22 nt, Homo sapiens
guucaucagggacacugguuug

SEQ ID NO: 4400 - RNA, 22 nt, Homo sapiens
gaugagauguucucauggauug

SEQ ID NO: 4401 - RNA, 22 nt, Homo sapiens
uagccucacaaagugcuuaaga

SEQ ID NO: 4402 - RNA, 22 nt, Homo sapiens
ugaaaugaucaguuugguuacu

SEQ ID NO: 4403 - RNA, 22 nt, Homo sapiens
ugaaaucauguaguuauugcaa

SEQ ID NO: 4404 - RNA, 22 nt, Homo sapiens
gaacacaucuuugguuagagga

SEQ ID NO: 4405 - RNA, 22 nt, Homo sapiens
agcagcauauuuuuauaaugua

SEQ ID NO: 4406 - RNA, 20 nt, Homo sapiens
uuuuagcacuuguuauggug

SEQ ID NO: 4407 - RNA, 22 nt, Homo sapiens
aggcaugaaauacaugcauuga

SEQ ID NO: 4408 - RNA, 22 nt, Homo sapiens
ucuggcuuuuaacaucuauaaa

SEQ ID NO: 4409 - RNA, 22 nt, Homo sapiens
cuuagguaggugccagguuuuu

SEQ ID NO: 4410 - RNA, 21 nt, Homo sapiens
cucaaaguacugauauuacag

SEQ ID NO: 4411 - RNA, 22 nt, Homo sapiens
gguagacaucgugcucugugau

SEQ ID NO: 4412 - RNA, 22 nt, Homo sapiens
uugagcaucauguuagcacuca

SEQ ID NO: 4413 - RNA, 22 nt, Homo sapiens
auguagugugauuuucacuaga

SEQ ID NO: 4414 - RNA, 22 nt, Homo sapiens
uaguacuggcauguauuuccca

SEQ ID NO: 4415 - RNA, 22 nt, Homo sapiens
uuagugcuuacgaugagcuaag

SEQ ID NO: 4416 - RNA, 22 nt, Homo sapiens
ucuucaugcuugaaauaauagc

SEQ ID NO: 4417 - RNA, 17 nt, Homo sapiens
augagcucaucauuuuu

SEQ ID NO: 4418 - RNA, 22 nt, Homo sapiens
acacaugcuccacuguggccuc

SEQ ID NO: 4419 - RNA, 22 nt, Homo sapiens
agagaugauuaacauuuuggua

SEQ ID NO: 4420 - RNA, 22 nt, Homo sapiens
uuggauccauccugucuucucu

SEQ ID NO: 4421 - RNA, 22 nt, Homo sapiens
uuucaagugcugucuuagcugu

SEQ ID NO: 4422 - RNA, 22 nt, Homo sapiens
uucuggcuuauaaacgugacuu

SEQ ID NO: 4423 - RNA, 22 nt, Homo sapiens
cucaaaguguggucuguggguu

SEQ ID NO: 4424 - RNA, 22 nt, Homo sapiens
uuagggcaggcaugagagaacu

SEQ ID NO: 4425 - RNA, 20 nt, Homo sapiens
ccaucaguccucucuuguuc

SEQ ID NO: 4426 - RNA, 19 nt, Homo sapiens
uggauuguuagagcagugu

SEQ ID NO: 4427 - RNA, 22 nt, Homo sapiens
ucagauugaugcauacuuaaau

SEQ ID NO: 4428 - RNA, 22 nt, Homo sapiens
uuaaaggcaugguuagacaugg

SEQ ID NO: 4429 - RNA, 22 nt, Homo sapiens
cuauacuguacacugaaugagg

SEQ ID NO: 4430 - RNA, 22 nt, Homo sapiens
auggcacuguguccugggguca

SEQ ID NO: 4431 - RNA, 22 nt, Homo sapiens
uacucaguagucuguugcuguc

SEQ ID NO: 4432 - RNA, 22 nt, Homo sapiens
ugacuucagacugaaaugauuc

SEQ ID NO: 4433 - RNA, 22 nt, Homo sapiens
ugguagugugagucuaaauugg

SEQ ID NO: 4434 - RNA, 22 nt, Homo sapiens
gaaauguugauagugggcauug

SEQ ID NO: 4435 - RNA, 19 nt, Homo sapiens
ucccuuuguauggacauac

SEQ ID NO: 4436 - RNA, 22 nt, Homo sapiens
acuggcauagggcgggcacagu

SEQ ID NO: 4437 - RNA, 22 nt, Homo sapiens
cucauugcaaucucugccuccc

SEQ ID NO: 4438 - RNA, 22 nt, Homo sapiens
ugagaucagugaagaaguguuu

SEQ ID NO: 4439 - RNA, 22 nt, Homo sapiens
augaggcuauaauuuuuaugua

SEQ ID NO: 4440 - RNA, 22 nt, Homo sapiens
uugaggaagugguuccccagag

SEQ ID NO: 4441 - RNA, 21 nt, Homo sapiens
uucaucuggccguauuccagg

SEQ ID NO: 4442 - RNA, 22 nt, Homo sapiens
ugguaagaggcccugaguuugu

SEQ ID NO: 4443 - RNA, 22 nt, Homo sapiens
ugagaaugaugauuuccaguuu

SEQ ID NO: 4444 - RNA, 21 nt, Homo sapiens
gugucaugguugacuuuggca

SEQ ID NO: 4445 - RNA, 20 nt, Homo sapiens
guucuugcucguguaucuuc

SEQ ID NO: 4446 - RNA, 20 nt, Homo sapiens
cucuaguaauaaaguuuccc

SEQ ID NO: 4447 - RNA, 22 nt, Homo sapiens
aaucagagcccucugagcuuca

SEQ ID NO: 4448 - RNA, 20 nt, Homo sapiens
uaagugcuuuauauugauua

SEQ ID NO: 4449 - RNA, 20 nt, Homo sapiens
uuuaagacaugcugaauuga

SEQ ID NO: 4450 - RNA, 22 nt, Homo sapiens
aauauguccaguguuuugggag

SEQ ID NO: 4451 - RNA, 22 nt, Homo sapiens
gcccuacuguuuauacauagga

SEQ ID NO: 4452 - RNA, 22 nt, Homo sapiens
aacagugcuguuauaaauguac

SEQ ID NO: 4453 - RNA, 22 nt, Homo sapiens
uuggaaacaccuggugagguua

SEQ ID NO: 4454 - RNA, 22 nt, Homo sapiens
ucaucagaaucccuuagggaug

SEQ ID NO: 4455 - RNA, 19 nt, Homo sapiens
auggaacugcuggagccac

SEQ ID NO: 4456 - RNA, 17 nt, Homo sapiens
agccccauuagcuaguu

SEQ ID NO: 4457 - RNA, 22 nt, Homo sapiens
guuuugguuauauggaucaguu

SEQ ID NO: 4458 - RNA, 22 nt, Homo sapiens
aagcugugucuugucagcuacc

SEQ ID NO: 4459 - RNA, 22 nt, Homo sapiens
uuuuggcucuugguaggucaga

SEQ ID NO: 4460 - RNA, 22 nt, Homo sapiens
caacauccaccuccuggguuca

SEQ ID NO: 4461 - RNA, 22 nt, Homo sapiens
uuagcucaguuggugagagcgu

SEQ ID NO: 4462 - RNA, 22 nt, Homo sapiens
guguggcaggugggggcucaga

SEQ ID NO: 4463 - RNA, 22 nt, Homo sapiens
gucaagauuuguaggacagaga

SEQ ID NO: 4464 - RNA, 22 nt, Homo sapiens
cuguuugguuaucuuuuccugu

SEQ ID NO: 4465 - RNA, 22 nt, Homo sapiens
cuuguggugcuuuuacgugggc

SEQ ID NO: 4466 - RNA, 22 nt, Homo sapiens
ucacagucaaaguaaucauaga

SEQ ID NO: 4467 - RNA, 22 nt, Homo sapiens
uucagcaggccaggcccugacu

SEQ ID NO: 4468 - RNA, 22 nt, Homo sapiens
uucuugcacuuaacugacauuc

SEQ ID NO: 4469 - RNA, 22 nt, Homo sapiens
ucauucauucuucaguggguac

SEQ ID NO: 4470 - RNA, 22 nt, Homo sapiens
uuuguguggccuuggccuggca

SEQ ID NO: 4471 - RNA, 22 nt, Homo sapiens
augccacuucucuaagucaugu

SEQ ID NO: 4472 - RNA, 22 nt, Homo sapiens
ucucaguguuaucuaucugccu

SEQ ID NO: 4473 - RNA, 20 nt, Homo sapiens
ugaggucaggaguuacagac

SEQ ID NO: 4474 - RNA, 22 nt, Homo sapiens
gugacagaguaagacccuguau

SEQ ID NO: 4475 - RNA, 22 nt, Homo sapiens
auggaacugaagugcugcccuu

SEQ ID NO: 4476 - RNA, 22 nt, Homo sapiens
uugcaccuuaugucuguucucu

SEQ ID NO: 4477 - RNA, 22 nt, Homo sapiens
uugcaucagcaggcauaauugg

SEQ ID NO: 4478 - RNA, 22 nt, Homo sapiens
uucaagucuuggcuuugccacc

SEQ ID NO: 4479 - RNA, 22 nt, Homo sapiens
gcuggcaaaugguuauaaggcc

SEQ ID NO: 4480 - RNA, 22 nt, Homo sapiens
auaagauaguggaagugggauu

SEQ ID NO: 4481 - RNA, 22 nt, Homo sapiens
uugcacuguaauuuauuuaugu

SEQ ID NO: 4482 - RNA, 21 nt, Homo sapiens
ugauaugguuuggauaugugu

SEQ ID NO: 4483 - RNA, 22 nt, Homo sapiens
aucagaaucucuugagaguguu

SEQ ID NO: 4484 - RNA, 22 nt, Homo sapiens
uauuccacaauaugauuuuuaa

SEQ ID NO: 4485 - RNA, 22 nt, Homo sapiens
uacaaguaauaagggaagaauu

SEQ ID NO: 4486 - RNA, 22 nt, Homo sapiens
augagaaugaagccuggcgugu

SEQ ID NO: 4487 - RNA, 22 nt, Homo sapiens
ugcugcaaucucggcacuuugg

SEQ ID NO: 4488 - RNA, 20 nt, Homo sapiens
aacagcacugucugaagcuu

SEQ ID NO: 4489 - RNA, 22 nt, Homo sapiens
cagguaguauuugguuacauaa

SEQ ID NO: 4490 - RNA, 22 nt, Homo sapiens
uuggaauacucaaaagguuggg

SEQ ID NO: 4491 - RNA, 17 nt, Homo sapiens
guggauagaacaaugaa

SEQ ID NO: 4492 - RNA, 18 nt, Homo sapiens
uuugugcuccacaaagga

SEQ ID NO: 4493 - RNA, 22 nt, Homo sapiens
ggagaucuuuaggaguuggacu

SEQ ID NO: 4494 - RNA, 22 nt, Homo sapiens
aucacagugaaaacagucaauu

SEQ ID NO: 4495 - RNA, 22 nt, Homo sapiens
gggaucaacuuauacuaaaauu

SEQ ID NO: 4496 - RNA, 22 nt, Homo sapiens
ugugccacugcacucuggccug

SEQ ID NO: 4497 - RNA, 22 nt, Homo sapiens
uggaauggagagagggugcacg

SEQ ID NO: 4498 - RNA, 22 nt, Homo sapiens
uaucacacaucaugguaaaucu

SEQ ID NO: 4499 - RNA, 22 nt, Homo sapiens
uucauagucacauucgaugucu

SEQ ID NO: 4500 - RNA, 22 nt, Homo sapiens
uggaagucauugagguguguua

SEQ ID NO: 4501 - RNA, 22 nt, Homo sapiens
ucauucuuucuguggaggggcu

SEQ ID NO: 4502 - RNA, 21 nt, Homo sapiens
uugagcuuuuaguacagacag

SEQ ID NO: 4503 - RNA, 22 nt, Homo sapiens
ugagaguagggguugggauugg

SEQ ID NO: 4504 - RNA, 22 nt, Homo sapiens
ucugagcaauagauguggauau

SEQ ID NO: 4505 - RNA, 22 nt, Homo sapiens
cauagcacacauuuaccuaugu

SEQ ID NO: 4506 - RNA, 22 nt, Homo sapiens
ggucccccuccacucucgcaaa

SEQ ID NO: 4507 - RNA, 22 nt, Homo sapiens
auaauaucagguugugaugaug

SEQ ID NO: 4508 - RNA, 22 nt, Homo sapiens
auuuuugguugucagcacuagg

SEQ ID NO: 4509 - RNA, 23 nt, Homo sapiens
auaagccuuuucuuucugcccca

SEQ ID NO: 4510 - RNA, 22 nt, Homo sapiens
acagagcaaugagcuacggucu

SEQ ID NO: 4511 - RNA, 22 nt, Homo sapiens
ucacaguaucaugggggacaga

SEQ ID NO: 4512 - RNA, 22 nt, Homo sapiens
gugagaauugacacccuugucu

SEQ ID NO: 4513 - RNA, 22 nt, Homo sapiens
gcagugugauguuuuaaucuau

SEQ ID NO: 4514 - RNA, 22 nt, Homo sapiens
acacuggguaacauaucuguua

SEQ ID NO: 4515 - RNA, 22 nt, Homo sapiens
ucacagcuaaaaugaaaguagu

SEQ ID NO: 4516 - RNA, 22 nt, Homo sapiens
ucacaggguguuauuagaauua

SEQ ID NO: 4517 - RNA, 21 nt, Homo sapiens
guauggcauugauuaguuacu

SEQ ID NO: 4518 - RNA, 22 nt, Homo sapiens
cuuugggaccgcgguuuauacu

SEQ ID NO: 4519 - RNA, 22 nt, Homo sapiens
uuuggcaauaaacuccccuaac

SEQ ID NO: 4520 - RNA, 22 nt, Homo sapiens
auggauaugcuuccaacugccu

SEQ ID NO: 4521 - RNA, 17 nt, Homo sapiens
gcccuuugugccucuuc

SEQ ID NO: 4522 - RNA, 22 nt, Homo sapiens
cuuagcaaugucguguacucac

SEQ ID NO: 4523 - RNA, 20 nt, Homo sapiens
ccuaguguucuuaggcugca

SEQ ID NO: 4524 - RNA, 22 nt, Homo sapiens
cuuggguugauugauaaugcca

SEQ ID NO: 4525 - RNA, 19 nt, Homo sapiens
uacugcacuccagucuggg

SEQ ID NO: 4526 - RNA, 22 nt, Homo sapiens
cuuuggauggaaccucucuuuc

SEQ ID NO: 4527 - RNA, 22 nt, Homo sapiens
ugauauggcuuggcuaugucac

SEQ ID NO: 4528 - RNA, 22 nt, Homo sapiens
augauacuggcuucauagaaug

SEQ ID NO: 4529 - RNA, 22 nt, Homo sapiens
uauugccucuuuuguaaaagug

SEQ ID NO: 4530 - RNA, 22 nt, Homo sapiens
ccaagugcuuaaaauuucauuu

SEQ ID NO: 4531 - RNA, 22 nt, Homo sapiens
auggcuuuucacagaggguucu

SEQ ID NO: 4532 - RNA, 20 nt, Homo sapiens
uggucaccuucaggagguuc

SEQ ID NO: 4533 - RNA, 22 nt, Homo sapiens
gaauagugcugcagcaaacaua

SEQ ID NO: 4534 - RNA, 22 nt, Homo sapiens
cauugguuuauagauggggaaa

SEQ ID NO: 4535 - RNA, 22 nt, Homo sapiens
guaugguuuauagggaaauugu

SEQ ID NO: 4536 - RNA, 22 nt, Homo sapiens
aggagcacaauggucaugugga

SEQ ID NO: 4537 - RNA, 21 nt, Homo sapiens
aggucaguaagaaugcagcac

SEQ ID NO: 4538 - RNA, 17 nt, Homo sapiens
ugcauagugggaggaga

SEQ ID NO: 4539 - RNA, 15 nt, Homo sapiens
ucuaguuuugaagac

SEQ ID NO: 4540 - RNA, 22 nt, Homo sapiens
cauacaagcuacaaucacaaag

SEQ ID NO: 4541 - RNA, 22 nt, Homo sapiens
agaauucugucauguuuauauu

SEQ ID NO: 4542 - RNA, 22 nt, Homo sapiens
augugugcuugugacacagccu

SEQ ID NO: 4543 - RNA, 15 nt, Homo sapiens
auagaaugaaaggga

SEQ ID NO: 4544 - RNA, 22 nt, Homo sapiens
ucaucuggcgaaugugaagagu

SEQ ID NO: 4545 - RNA, 22 nt, Homo sapiens
acugcacuccagccugcuggca

SEQ ID NO: 4546 - RNA, 16 nt, Homo sapiens
uuguggcuuuugcaca

SEQ ID NO: 4547 - RNA, 23 nt, Homo sapiens
caccaguauaauuagcuuuuaaa

SEQ ID NO: 4548 - RNA, 22 nt, Homo sapiens
augcaaacaucauagaguguac

SEQ ID NO: 4549 - RNA, 22 nt, Homo sapiens
agauauguuuaguuucaaaaug

SEQ ID NO: 4550 - RNA, 22 nt, Homo sapiens
cugagguauuuaggugaaagaa

SEQ ID NO: 4551 - RNA, 22 nt, Homo sapiens
aagaucaucauagagggcauga

SEQ ID NO: 4552 - RNA, 22 nt, Homo sapiens
aggagaucagccucccugcaac

SEQ ID NO: 4553 - RNA, 22 nt, Homo sapiens
uggucuccuuuguacccugggc

SEQ ID NO: 4554 - RNA, 22 nt, Homo sapiens
aagugcccuauuuggcccuuga

SEQ ID NO: 4555 - RNA, 22 nt, Homo sapiens
uggaguuugacaugccuuuggg

SEQ ID NO: 4556 - RNA, 22 nt, Homo sapiens
acagugcugucugcuuuggcua

SEQ ID NO: 4557 - RNA, 22 nt, Homo sapiens
auaguauaguugaggauggcau

SEQ ID NO: 4558 - RNA, 18 nt, Homo sapiens
uugccuauucacucugau

SEQ ID NO: 4559 - RNA, 22 nt, Homo sapiens
ggaauggaacaaagucuugaaa

SEQ ID NO: 4560 - RNA, 18 nt, Homo sapiens
aagagcucagcacagguu

SEQ ID NO: 4561 - RNA, 22 nt, Homo sapiens
uaaagcuuggauuuaggcuaau

SEQ ID NO: 4562 - RNA, 18 nt, Homo sapiens
uguugguguucacucacu

SEQ ID NO: 4563 - RNA, 19 nt, Homo sapiens
ugcugcauugugaccuugc

SEQ ID NO: 4564 - RNA, 20 nt, Homo sapiens
aucaccacagcucguucaug

SEQ ID NO: 4565 - RNA, 22 nt, Homo sapiens
ucuugcacacaguaaguguuuu

SEQ ID NO: 4566 - RNA, 22 nt, Homo sapiens
uuaugugccuuuuugccauuca

SEQ ID NO: 4567 - RNA, 22 nt, Homo sapiens
uugcacuauuaguauagauguc

SEQ ID NO: 4568 - RNA, 22 nt, Homo sapiens
uuucaguagagacacgguuuug

SEQ ID NO: 4569 - RNA, 22 nt, Homo sapiens
uguucacaguguuucuuugaga

SEQ ID NO: 4570 - RNA, 22 nt, Homo sapiens
ugagaucgagucucgcucuguc

SEQ ID NO: 4571 - RNA, 22 nt, Homo sapiens
ugagacugagucucgcucuauu

SEQ ID NO: 4572 - RNA, 22 nt, Homo sapiens
uauuagugccuaagucuuaggg

SEQ ID NO: 4573 - RNA, 22 nt, Homo sapiens
uuguauaguucuauguguuuug

SEQ ID NO: 4574 - RNA, 22 nt, Homo sapiens
augcccauuuguuuucugaaag

SEQ ID NO: 4575 - RNA, 22 nt, Homo sapiens
uuaugacauugacaguuuuuag

SEQ ID NO: 4576 - RNA, 20 nt, Homo sapiens
uaaagcugcucagggggcuc

SEQ ID NO: 4577 - RNA, 18 nt, Homo sapiens
uccacgugcuuuccagau

SEQ ID NO: 4578 - RNA, 22 nt, Homo sapiens
gacaccugguguggaacuggag

SEQ ID NO: 4579 - RNA, 22 nt, Homo sapiens
uagugcugugauaaacauauau

SEQ ID NO: 4580 - RNA, 22 nt, Homo sapiens
uugaaagacagaggggcaaguu

SEQ ID NO: 4581 - RNA, 22 nt, Homo sapiens
aguaaagcuacucacugugggc

SEQ ID NO: 4582 - RNA, 22 nt, Homo sapiens
uaucaagauggauaaggauaga

SEQ ID NO: 4583 - RNA, 22 nt, Homo sapiens
uucaaguguucaggagcuacag

SEQ ID NO: 4584 - RNA, 22 nt, Homo sapiens
cuuggcauugccccuggaauuu

SEQ ID NO: 4585 - RNA, 22 nt, Homo sapiens
ggaauguuaaggcgcuguuggu

SEQ ID NO: 4586 - RNA, 22 nt, Homo sapiens
uucacaguggugggagacguca

SEQ ID NO: 4587 - RNA, 22 nt, Homo sapiens
uccaguuuuguuaacauauggu

SEQ ID NO: 4588 - RNA, 22 nt, Homo sapiens
acaguguuacuugauaguguau

SEQ ID NO: 4589 - RNA, 19 nt, Homo sapiens
agcagaacaaauguguggg

SEQ ID NO: 4590 - RNA, 22 nt, Homo sapiens
cauugguuccaguuuguccuua

SEQ ID NO: 4591 - RNA, 22 nt, Homo sapiens
uacacaugugaguucuuuucua

SEQ ID NO: 4592 - RNA, 22 nt, Homo sapiens
uuugaaugcaacaaaugcggga

SEQ ID NO: 4593 - RNA, 16 nt, Homo sapiens
ugaacagagaggauuc

SEQ ID NO: 4594 - RNA, 22 nt, Homo sapiens
cuauuagguuggugcaaaaguc

SEQ ID NO: 4595 - RNA, 22 nt, Homo sapiens
ucccugaagcugcagcaacaca

SEQ ID NO: 4596 - RNA, 22 nt, Homo sapiens
auggaguguggaacugggaauc

SEQ ID NO: 4597 - RNA, 22 nt, Homo sapiens
uacagaguauccauuugaguuc

SEQ ID NO: 4598 - RNA, 23 nt, Homo sapiens
accccuacaggcuuguguccugc

SEQ ID NO: 4599 - RNA, 22 nt, Homo sapiens
agaugccuaugaagagaaauua

SEQ ID NO: 4600 - RNA, 22 nt, Homo sapiens
agcucuuguuaguauuagcagu

SEQ ID NO: 4601 - RNA, 22 nt, Homo sapiens
ugugccacugcacuccugggug

SEQ ID NO: 4602 - RNA, 23 nt, Homo sapiens
uugggcaaaucacuaacgucucc

SEQ ID NO: 4603 - RNA, 22 nt, Homo sapiens
uagguauguauauacacacaca

SEQ ID NO: 4604 - RNA, 22 nt, Homo sapiens
uagaaagcaugaccuucagaua

SEQ ID NO: 4605 - RNA, 21 nt, Homo sapiens
gagguaccucauguaagugga

SEQ ID NO: 4606 - RNA, 22 nt, Homo sapiens
uguauagaucugauucaucucc

SEQ ID NO: 4607 - RNA, 22 nt, Homo sapiens
ugacagagcaggacuucaucuc

SEQ ID NO: 4608 - RNA, 22 nt, Homo sapiens
aagcugguguugcugcucuguu

SEQ ID NO: 4609 - RNA, 22 nt, Homo sapiens
aauggcagaugaaauugucauu

SEQ ID NO: 4610 - RNA, 22 nt, Homo sapiens
uaccugagucuagagucuagaa

SEQ ID NO: 4611 - RNA, 22 nt, Homo sapiens
caacagucagcccauccacaga

SEQ ID NO: 4612 - RNA, 22 nt, Homo sapiens
ucugccuuuucaugugggaugg

SEQ ID NO: 4613 - RNA, 22 nt, Homo sapiens
uggauguacagucaguauuugu

SEQ ID NO: 4614 - RNA, 22 nt, Homo sapiens
uauugauuaauugugauuaggc

SEQ ID NO: 4615 - RNA, 22 nt, Homo sapiens
uaaugugaauagugcuguaaug

SEQ ID NO: 4616 - RNA, 19 nt, Homo sapiens
agugagccaagauccuacc

SEQ ID NO: 4617 - RNA, 21 nt, Homo sapiens
acaguacuugagaucuuuuga

SEQ ID NO: 4618 - RNA, 22 nt, Homo sapiens
guagagguagacuuccuugucu

SEQ ID NO: 4619 - RNA, 22 nt, Homo sapiens
ucuuugguagaagcuauuuuau

SEQ ID NO: 4620 - RNA, 22 nt, Homo sapiens
uuggcacuugauaauauucugg

SEQ ID NO: 4621 - RNA, 22 nt, Homo sapiens
uugccaucaucucuuacucagu

SEQ ID NO: 4622 - RNA, 22 nt, Homo sapiens
gauggcaugugcugccaccaag

SEQ ID NO: 4623 - RNA, 22 nt, Homo sapiens
uauggauuuuuuugacaagagc

SEQ ID NO: 4624 - RNA, 21 nt, Homo sapiens
aggcaagacuuuuagguuugu

SEQ ID NO: 4625 - RNA, 22 nt, Homo sapiens
ugcaccacugcacuccacccug

SEQ ID NO: 4626 - RNA, 22 nt, Homo sapiens
ugcguucauuuggccaguggcg

SEQ ID NO: 4627 - RNA, 22 nt, Homo sapiens
augccucugacaauuggauucu

SEQ ID NO: 4628 - RNA, 22 nt, Homo sapiens
aauauugucaaaauggauucca

SEQ ID NO: 4629 - RNA, 22 nt, Homo sapiens
gcaugguaguaaccuacauuug

SEQ ID NO: 4630 - RNA, 22 nt, Homo sapiens
cgaggaguaucuuugugguguu

SEQ ID NO: 4631 - RNA, 20 nt, Homo sapiens
cauugcccuccagccugggc

SEQ ID NO: 4632 - RNA, 22 nt, Homo sapiens
uggauaguuuacugaagagugg

SEQ ID NO: 4633 - RNA, 22 nt, Homo sapiens
uguguaaauaugauagaggaau

SEQ ID NO: 4634 - RNA, 22 nt, Homo sapiens
ggaauguaguaauuugguuagu

SEQ ID NO: 4635 - RNA, 22 nt, Homo sapiens
uuuguguccccacccaaaucuc

SEQ ID NO: 4636 - RNA, 22 nt, Homo sapiens
aaugaucaauguuugaggugau

SEQ ID NO: 4637 - RNA, 19 nt, Homo sapiens
gggaggaugcgucuucagg

SEQ ID NO: 4638 - RNA, 22 nt, Homo sapiens
aagguagcugagugaagugguu

SEQ ID NO: 4639 - RNA, 22 nt, Homo sapiens
uauccuguagcucauccaccgc

SEQ ID NO: 4640 - RNA, 22 nt, Homo sapiens
uuuugguucaauuaauuugcua

SEQ ID NO: 4641 - RNA, 22 nt, Homo sapiens
uaaggcuuugucuuaggacuuu

SEQ ID NO: 4642 - RNA, 23 nt, Homo sapiens
gugccuucugagccuagucucca

SEQ ID NO: 4643 - RNA, 22 nt, Homo sapiens
gaauacugacuauuucaucugg

SEQ ID NO: 4644 - RNA, 22 nt, Homo sapiens
auggcagcccucuuuauccaug

SEQ ID NO: 4645 - RNA, 22 nt, Homo sapiens
uacuggccccaaaguagguagu

SEQ ID NO: 4646 - RNA, 21 nt, Homo sapiens
ugagaugugaccagggcauca

SEQ ID NO: 4647 - RNA, 22 nt, Homo sapiens
aaaguggacuaagugaauauga

SEQ ID NO: 4648 - RNA, 22 nt, Homo sapiens
guuagguagaaguuuacuuuga

SEQ ID NO: 4649 - RNA, 22 nt, Homo sapiens
acugagucauugaggcccucuc

SEQ ID NO: 4650 - RNA, 19 nt, Homo sapiens
ugagaugaagacagggguu

SEQ ID NO: 4651 - RNA, 22 nt, Homo sapiens
uuaagaucagugcaaacuggag

SEQ ID NO: 4652 - RNA, 23 nt, Homo sapiens
ggugaggaguacagagucuucau

SEQ ID NO: 4653 - RNA, 22 nt, Homo sapiens
ucugucuugugguuugagugcc

SEQ ID NO: 4654 - RNA, 22 nt, Homo sapiens
auaucaagugacuggaguucca

SEQ ID NO: 4655 - RNA, 22 nt, Homo sapiens
ggcuacauuguuacaauuagua

SEQ ID NO: 4656 - RNA, 22 nt, Homo sapiens
uugcagcaaagagggaggggca

SEQ ID NO: 4657 - RNA, 22 nt, Homo sapiens
acccugcuaaacagcccccugc

SEQ ID NO: 4658 - RNA, 23 nt, Homo sapiens
agcugguacuagaggcuugcgcc

SEQ ID NO: 4659 - RNA, 22 nt, Homo sapiens
auuguaccccaauguacaauau

SEQ ID NO: 4660 - RNA, 22 nt, Homo sapiens
ugauggcauuucauguuuguaa

SEQ ID NO: 4661 - RNA, 22 nt, Homo sapiens
ugcgccauugcauuccagccug

SEQ ID NO: 4662 - RNA, 22 nt, Homo sapiens
ugagcuagggccuggaauaggg

SEQ ID NO: 4663 - RNA, 22 nt, Homo sapiens
aaguaguuaggaacauucucuc

SEQ ID NO: 4664 - RNA, 22 nt, Homo sapiens
ucaaggacuacauggggugaaa

SEQ ID NO: 4665 - RNA, 22 nt, Homo sapiens
gugaauugagagaacuguguua

SEQ ID NO: 4666 - RNA, 22 nt, Homo sapiens
acugcacuccagccugugcgua

SEQ ID NO: 4667 - RNA, 22 nt, Homo sapiens
cccugugaauauuaccuuauuu

SEQ ID NO: 4668 - RNA, 22 nt, Homo sapiens
ccuuuguggggcgguggguaau

SEQ ID NO: 4669 - RNA, 22 nt, Homo sapiens
aaaagcauucagagugcugggc

SEQ ID NO: 4670 - RNA, 22 nt, Homo sapiens
uaccagugaauuccaggggcua

SEQ ID NO: 4671 - RNA, 22 nt, Homo sapiens
ggcaccauggaaggacgggagc

SEQ ID NO: 4672 - RNA, 22 nt, Homo sapiens
ucuggcaagauauccauugcuu

SEQ ID NO: 4673 - RNA, 22 nt, Homo sapiens
gucgugcagaccucacagcauu

SEQ ID NO: 4674 - RNA, 22 nt, Homo sapiens
gaugccuuuuuguccucaguua

SEQ ID NO: 4675 - RNA, 22 nt, Homo sapiens
caagacuguccaacauauuggg

SEQ ID NO: 4676 - RNA, 22 nt, Homo sapiens
agcagguauuuaagaaacucag

SEQ ID NO: 4677 - RNA, 22 nt, Homo sapiens
uggauuuuaauuauucugucau

SEQ ID NO: 4678 - RNA, 22 nt, Homo sapiens
ugaauagagcugcaguggacau

SEQ ID NO: 4679 - RNA, 19 nt, Homo sapiens
gcggcacuggagacacagc

SEQ ID NO: 4680 - RNA, 22 nt, Homo sapiens
auaagaucauuugcuaagaggg

SEQ ID NO: 4681 - RNA, 22 nt, Homo sapiens
uugacauguaggcagggaaugg

SEQ ID NO: 4682 - RNA, 22 nt, Homo sapiens
ugccuuuguucuggaaugggaa

SEQ ID NO: 4683 - RNA, 21 nt, Homo sapiens
aaggugguggugauugagaug

SEQ ID NO: 4684 - RNA, 22 nt, Homo sapiens
guacuguuucauuggagauuaa

SEQ ID NO: 4685 - RNA, 23 nt, Homo sapiens
ccauugcacuccagccucaguga

SEQ ID NO: 4686 - RNA, 22 nt, Homo sapiens
uagaggaaugaauuuggccaga

SEQ ID NO: 4687 - RNA, 22 nt, Homo sapiens
uucugguuaauacuugcaaaaa

SEQ ID NO: 4688 - RNA, 22 nt, Homo sapiens
cuucggugaguagauggguuaa

SEQ ID NO: 4689 - RNA, 22 nt, Homo sapiens
uggcaaguuucaauccgaggga

SEQ ID NO: 4690 - RNA, 18 nt, Homo sapiens
ucaccuugugagagagag

SEQ ID NO: 4691 - RNA, 22 nt, Homo sapiens
cccugacauucggagauguagu

SEQ ID NO: 4692 - RNA, 22 nt, Homo sapiens
ugaguagaacuagucuagagcu

SEQ ID NO: 4693 - RNA, 19 nt, Homo sapiens
uaagaugaagcugucuggg

SEQ ID NO: 4694 - RNA, 22 nt, Homo sapiens
uucauaguguaccugaaggcac

SEQ ID NO: 4695 - RNA, 22 nt, Homo sapiens
ugugguauuagguguaguaucu

SEQ ID NO: 4696 - RNA, 22 nt, Homo sapiens
caacacagugaaacccgucucu

SEQ ID NO: 4697 - RNA, 22 nt, Homo sapiens
uagaccaauuggcauauaguaa

SEQ ID NO: 4698 - RNA, 22 nt, Homo sapiens
uggugcccuguccuucuguggc

SEQ ID NO: 4699 - RNA, 22 nt, Homo sapiens
ugagaucugucuuuauaguauu

SEQ ID NO: 4700 - RNA, 22 nt, Homo sapiens
uucaaaguaaagggauggagac

SEQ ID NO: 4701 - RNA, 22 nt, Homo sapiens
uacugcuuaaaagucaauuacu

SEQ ID NO: 4702 - RNA, 22 nt, Homo sapiens
ggaguguaguggcuccaucucg

SEQ ID NO: 4703 - RNA, 22 nt, Homo sapiens
aucacagagucacgggcaacuu

SEQ ID NO: 4704 - RNA, 22 nt, Homo sapiens
uuauggcuuugcgguguuagca

SEQ ID NO: 4705 - RNA, 22 nt, Homo sapiens
ugggaagaagguuuacuugcca

SEQ ID NO: 4706 - RNA, 22 nt, Homo sapiens
ccuggguuacaggugugagcca

SEQ ID NO: 4707 - RNA, 22 nt, Homo sapiens
ucaaaugcucuuugcagagagg

SEQ ID NO: 4708 - RNA, 22 nt, Homo sapiens
cuugcacuugaaauuccaguuu

SEQ ID NO: 4709 - RNA, 22 nt, Homo sapiens
ccucauggagaaccucugcuag

SEQ ID NO: 4710 - RNA, 22 nt, Homo sapiens
gagguaagagaauaaacaguuu

SEQ ID NO: 4711 - RNA, 22 nt, Homo sapiens
uugugguaggaguugccauguu

SEQ ID NO: 4712 - RNA, 22 nt, Homo sapiens
uucuucaggcauucccagaagc

SEQ ID NO: 4713 - RNA, 22 nt, Homo sapiens
uaaggcacccuucugaguagag

SEQ ID NO: 4714 - RNA, 22 nt, Homo sapiens
cuauggcuguaaggauaguaac

SEQ ID NO: 4715 - RNA, 22 nt, Homo sapiens
uugagcuaugaguuaauaggac

SEQ ID NO: 4716 - RNA, 22 nt, Homo sapiens
uacuggccuugaacucuggugu

SEQ ID NO: 4717 - RNA, 22 nt, Homo sapiens
ggcaguguggcugcauauagca

SEQ ID NO: 4718 - RNA, 22 nt, Homo sapiens
auucacugugcuuggccaaauu

SEQ ID NO: 4719 - RNA, 22 nt, Homo sapiens
aauagcuguuuuuaauuccugc

SEQ ID NO: 4720 - RNA, 22 nt, Homo sapiens
gcaaaguguuuuccaacuuggu

SEQ ID NO: 4721 - RNA, 20 nt, Homo sapiens
augguaguagcaccuuuaca

SEQ ID NO: 4722 - RNA, 22 nt, Homo sapiens
acccuuagguuaaaguugaguc

SEQ ID NO: 4723 - RNA, 22 nt, Homo sapiens
ugaguucaauguuaaugaagca

SEQ ID NO: 4724 - RNA, 22 nt, Homo sapiens
cacccagucaucuuggguuuuu

SEQ ID NO: 4725 - RNA, 22 nt, Homo sapiens
gugaaaugaaacgcuaugucuu

SEQ ID NO: 4726 - RNA, 22 nt, Homo sapiens
auacugguuuuugucaugugga

SEQ ID NO: 4727 - RNA, 22 nt, Homo sapiens
ugcauagaauguucuguaaaua

SEQ ID NO: 4728 - RNA, 22 nt, Homo sapiens
agauggugauaaaugugguacc

SEQ ID NO: 4729 - RNA, 22 nt, Homo sapiens
augguuuuacugcaaaauggga

SEQ ID NO: 4730 - RNA, 22 nt, Homo sapiens
ucauaggucugagaagaaaaua

SEQ ID NO: 4731 - RNA, 22 nt, Homo sapiens
acccuacauaguagauccuaca

SEQ ID NO: 4732 - RNA, 22 nt, Homo sapiens
cugaucuaugaacacaggauau

SEQ ID NO: 4733 - RNA, 22 nt, Homo sapiens
cccagugugaacuuggcauuuu

SEQ ID NO: 4734 - RNA, 21 nt, Homo sapiens
cucucugcuuaugaauaguga

SEQ ID NO: 4735 - RNA, 22 nt, Homo sapiens
uggcuguuuauuucacaugggu

SEQ ID NO: 4736 - RNA, 22 nt, Homo sapiens
uggacuuuaauaaaagggaaau

SEQ ID NO: 4737 - RNA, 22 nt, Homo sapiens
augaaugcacugcggguggaug

SEQ ID NO: 4738 - RNA, 22 nt, Homo sapiens
uuuccacauggacuuaccuucg

SEQ ID NO: 4739 - RNA, 22 nt, Homo sapiens
ucuuggguggauucauucuuuc

SEQ ID NO: 4740 - RNA, 22 nt, Homo sapiens
ugugaauggugcugcaaugaac

SEQ ID NO: 4741 - RNA, 22 nt, Homo sapiens
augguguauugauuauugcugu

SEQ ID NO: 4742 - RNA, 20 nt, Homo sapiens
ucagguagaucuuugagguc

SEQ ID NO: 4743 - RNA, 22 nt, Homo sapiens
ugaaauuguuugcaaggauagg

SEQ ID NO: 4744 - RNA, 22 nt, Homo sapiens
uuccugagagggcugggugcag

SEQ ID NO: 4745 - RNA, 22 nt, Homo sapiens
ggagugucugugcuggucaaag

SEQ ID NO: 4746 - RNA, 22 nt, Homo sapiens
gggauguaaaagugggcacauu

SEQ ID NO: 4747 - RNA, 22 nt, Homo sapiens
uaaugguuuugcaccaucccuc

SEQ ID NO: 4748 - RNA, 22 nt, Homo sapiens
gucauggaggaugaauggccaa

SEQ ID NO: 4749 - RNA, 22 nt, Homo sapiens
uugucacccuacauaacaggga

SEQ ID NO: 4750 - RNA, 22 nt, Homo sapiens
uugcucaggcuagaguucagcu

SEQ ID NO: 4751 - RNA, 22 nt, Homo sapiens
gccauugcacuccagccuaggu

SEQ ID NO: 4752 - RNA, 22 nt, Homo sapiens
aggaagcuagcauuuguucagu

SEQ ID NO: 4753 - RNA, 22 nt, Homo sapiens
ucuuugauguucugaaagaugg

SEQ ID NO: 4754 - RNA, 22 nt, Homo sapiens
uuuccaagaugcuuacuuucuc

SEQ ID NO: 4755 - RNA, 22 nt, Homo sapiens
ugagaacucaugaaucuuucca

SEQ ID NO: 4756 - RNA, 22 nt, Homo sapiens
uaaguaauuguuaauagggaag

SEQ ID NO: 4757 - RNA, 22 nt, Homo sapiens
gcuaguguuugccagcguagcc

SEQ ID NO: 4758 - RNA, 22 nt, Homo sapiens
ugauaagugaaagugcucuauc

SEQ ID NO: 4759 - RNA, 22 nt, Homo sapiens
uugagagcugaugaaagauaaa

SEQ ID NO: 4760 - RNA, 22 nt, Homo sapiens
auacaaggaaugaagagauuug

SEQ ID NO: 4761 - RNA, 22 nt, Homo sapiens
auggaaugccauuuauaaugga

SEQ ID NO: 4762 - RNA, 22 nt, Homo sapiens
uugagauggaaucucgcuuugu

SEQ ID NO: 4763 - RNA, 22 nt, Homo sapiens
ugggcauuguuccuaguuaucu

SEQ ID NO: 4764 - RNA, 22 nt, Homo sapiens
uuuugcacuguuuuaucugaca

SEQ ID NO: 4765 - RNA, 22 nt, Homo sapiens
gagacauguuugccaauaauuu

SEQ ID NO: 4766 - RNA, 22 nt, Homo sapiens
auuagguaauauaaucauggca

SEQ ID NO: 4767 - RNA, 22 nt, Homo sapiens
caucgcacuccagccuggguaa

SEQ ID NO: 4768 - RNA, 22 nt, Homo sapiens
uaaacugcuugaggguaaguac

SEQ ID NO: 4769 - RNA, 22 nt, Homo sapiens
augaaaagcauaaacgcugaag

SEQ ID NO: 4770 - RNA, 22 nt, Homo sapiens
aguggcacuauucucagaguca

SEQ ID NO: 4771 - RNA, 19 nt, Homo sapiens
gaguugggguuuacuguaa

SEQ ID NO: 4772 - RNA, 22 nt, Homo sapiens
aaagugacuuagugccccauuu

SEQ ID NO: 4773 - RNA, 20 nt, Homo sapiens
uucaagugauucucaugccu

SEQ ID NO: 4774 - RNA, 22 nt, Homo sapiens
uaugagcaaaaugaggguuagu

SEQ ID NO: 4775 - RNA, 22 nt, Homo sapiens
cuggaguuugaggcugcaguga

SEQ ID NO: 4776 - RNA, 22 nt, Homo sapiens
auaugccacugaacuguaccca

SEQ ID NO: 4777 - RNA, 16 nt, Homo sapiens
aucacuugcuucuuuu

SEQ ID NO: 4778 - RNA, 22 nt, Homo sapiens
ucacaugaauugucuuguucca

SEQ ID NO: 4779 - RNA, 22 nt, Homo sapiens
ugacagaggucuuuuaauagcu

SEQ ID NO: 4780 - RNA, 16 nt, Homo sapiens
gcaguguguuuaauag

SEQ ID NO: 4781 - RNA, 22 nt, Homo sapiens
uaggugauccauuuguauuuua

SEQ ID NO: 4782 - RNA, 23 nt, Homo sapiens
uugugucccuacccaaaucucau

SEQ ID NO: 4783 - RNA, 22 nt, Homo sapiens
uaagagagcuccaucuuuuccu

SEQ ID NO: 4784 - RNA, 22 nt, Homo sapiens
cuacucuggagagugacaauca

SEQ ID NO: 4785 - RNA, 22 nt, Homo sapiens
auggaagcugauuagauaguac

SEQ ID NO: 4786 - RNA, 22 nt, Homo sapiens
cauuggugauuagugaaugaac

SEQ ID NO: 4787 - RNA, 22 nt, Homo sapiens
uggcaccauccaggugucucua

SEQ ID NO: 4788 - RNA, 21 nt, Homo sapiens
aacuggugugagaugguaugu

SEQ ID NO: 4789 - RNA, 22 nt, Homo sapiens
cuggcaaauaguagagccagga

SEQ ID NO: 4790 - RNA, 21 nt, Homo sapiens
gagguagggauuaaagaccuc

SEQ ID NO: 4791 - RNA, 22 nt, Homo sapiens
ugagaugagaaucaguucuaau

SEQ ID NO: 4792 - RNA, 22 nt, Homo sapiens
ucauucauucauccagcuugag

SEQ ID NO: 4793 - RNA, 22 nt, Homo sapiens
guugagcaaacagcuuaacagu

SEQ ID NO: 4794 - RNA, 22 nt, Homo sapiens
gauauguucugagaaaugcauu

SEQ ID NO: 4795 - RNA, 22 nt, Homo sapiens
gagaugugugugauuauauaau

SEQ ID NO: 4796 - RNA, 22 nt, Homo sapiens
ugagaacggauacuaagggcug

SEQ ID NO: 4797 - RNA, 22 nt, Homo sapiens
aaggagugugauucuucaguuu

SEQ ID NO: 4798 - RNA, 22 nt, Homo sapiens
uaaagugcugagaugaggcugg

SEQ ID NO: 4799 - RNA, 22 nt, Homo sapiens
uguacacauaugugggguacau

SEQ ID NO: 4800 - RNA, 22 nt, Homo sapiens
gaggcaguguguccguucucgg

SEQ ID NO: 4801 - RNA, 22 nt, Homo sapiens
ugucuuguagacaauguauagu

SEQ ID NO: 4802 - RNA, 21 nt, Homo sapiens
gugucacagacaugacagaug

SEQ ID NO: 4803 - RNA, 22 nt, Homo sapiens
ggugagaaaaacauagucucag

SEQ ID NO: 4804 - RNA, 22 nt, Homo sapiens
uaggcaauguggcgaaacucug

SEQ ID NO: 4805 - RNA, 22 nt, Homo sapiens
gucacauugaugcccauggugg

SEQ ID NO: 4806 - RNA, 22 nt, Homo sapiens
gccuagggacaaaccguccgac

SEQ ID NO: 4807 - RNA, 22 nt, Homo sapiens
auggccuaugacagguauguug

SEQ ID NO: 4808 - RNA, 22 nt, Homo sapiens
ugagcaaaauuuuggacauaga

SEQ ID NO: 4809 - RNA, 20 nt, Homo sapiens
ucccucaaacuuuuccacug

SEQ ID NO: 4810 - RNA, 20 nt, Homo sapiens
cugauacagccugagcucuc

SEQ ID NO: 4811 - RNA, 22 nt, Homo sapiens
gcuuuggcauguagauguaugg

SEQ ID NO: 4812 - RNA, 22 nt, Homo sapiens
gaggcauugaaauauugcuuau

SEQ ID NO: 4813 - RNA, 22 nt, Homo sapiens
uugggauggaaauuuguacccc

SEQ ID NO: 4814 - RNA, 22 nt, Homo sapiens
aauguguuuugaaaucaggaag

SEQ ID NO: 4815 - RNA, 22 nt, Homo sapiens
ugugccacugcacucccgccug

SEQ ID NO: 4816 - RNA, 22 nt, Homo sapiens
uacuaguaagggugguuuggcu

SEQ ID NO: 4817 - RNA, 22 nt, Homo sapiens
ugaaugccauucuguguuagcu

SEQ ID NO: 4818 - RNA, 22 nt, Homo sapiens
auuggccccguuuuaaauguca

SEQ ID NO: 4819 - RNA, 22 nt, Homo sapiens
cuagcaacauuucagugaguuu

SEQ ID NO: 4820 - RNA, 22 nt, Homo sapiens
cuggaauucaaaaucugaauuu

SEQ ID NO: 4821 - RNA, 22 nt, Homo sapiens
ugagaugcuuguaaauucauuu

SEQ ID NO: 4822 - RNA, 22 nt, Homo sapiens
ugucacguugcuuuucuguugu

SEQ ID NO: 4823 - RNA, 22 nt, Homo sapiens
acugcacucuagccuuggcaac

SEQ ID NO: 4824 - RNA, 19 nt, Homo sapiens
uucuuuguugugggggcug

SEQ ID NO: 4825 - RNA, 22 nt, Homo sapiens
uuggucucaucaagagcagcuu

SEQ ID NO: 4826 - RNA, 22 nt, Homo sapiens
ccucauugcuaucccaggcuga

SEQ ID NO: 4827 - RNA, 22 nt, Homo sapiens
ggcacaguuaagugcuaccuaa

SEQ ID NO: 4828 - RNA, 22 nt, Homo sapiens
aguaacaggauccaaagaaugu

SEQ ID NO: 4829 - RNA, 22 nt, Homo sapiens
ucugguguuauucauguaguuu

SEQ ID NO: 4830 - RNA, 22 nt, Homo sapiens
aaauggcaccggcucuucccuc

SEQ ID NO: 4831 - RNA, 22 nt, Homo sapiens
guuauuaguugauauuaaguuc

SEQ ID NO: 4832 - RNA, 22 nt, Homo sapiens
ugagaucgaguuucgcucuugu

SEQ ID NO: 4833 - RNA, 22 nt, Homo sapiens
uuagacacacauacauuuaucu

SEQ ID NO: 4834 - RNA, 21 nt, Homo sapiens
aggagcauucucuugcuuugu

SEQ ID NO: 4835 - RNA, 22 nt, Homo sapiens
uuggacugagaguuccaccauu

SEQ ID NO: 4836 - RNA, 22 nt, Homo sapiens
auauccuggagcauuuuugcaa

SEQ ID NO: 4837 - RNA, 22 nt, Homo sapiens
auugcacuccagccuuggggau

SEQ ID NO: 4838 - RNA, 22 nt, Homo sapiens
guuugguugcauggaaaauuua

SEQ ID NO: 4839 - RNA, 22 nt, Homo sapiens
aagaugcagaagcccagauguu

SEQ ID NO: 4840 - RNA, 22 nt, Homo sapiens
augauguguguuuaagaugucu

SEQ ID NO: 4841 - RNA, 22 nt, Homo sapiens
agguguuguugaggagauuuca

SEQ ID NO: 4842 - RNA, 22 nt, Homo sapiens
auuccuuaggcccuuugguuag

SEQ ID NO: 4843 - RNA, 22 nt, Homo sapiens
ucaaaaccucagagaguagagc

SEQ ID NO: 4844 - RNA, 22 nt, Homo sapiens
cagugcaaccuccaucucucgg

SEQ ID NO: 4845 - RNA, 22 nt, Homo sapiens
agcuuaugcuuggaagagauga

SEQ ID NO: 4846 - RNA, 20 nt, Homo sapiens
guucacaggcuuccuuucag

SEQ ID NO: 4847 - RNA, 22 nt, Homo sapiens
uagcuguuggugggaagucaga

SEQ ID NO: 4848 - RNA, 22 nt, Homo sapiens
aucaaauugucauuuuaaggau

SEQ ID NO: 4849 - RNA, 22 nt, Homo sapiens
cuggacguugaggcugcaguga

SEQ ID NO: 4850 - RNA, 22 nt, Homo sapiens
uggcuacagaaaguacuaguga

SEQ ID NO: 4851 - RNA, 22 nt, Homo sapiens
gaagaucacacuguagaucuau

SEQ ID NO: 4852 - RNA, 22 nt, Homo sapiens
gagguggauacauuaaauaaug

SEQ ID NO: 4853 - RNA, 22 nt, Homo sapiens
gugaauguaaagucaugugacu

SEQ ID NO: 4854 - RNA, 22 nt, Homo sapiens
ugagaacuuauggugauuuuuu

SEQ ID NO: 4855 - RNA, 22 nt, Homo sapiens
aucuagagaggcagucuggccg

SEQ ID NO: 4856 - RNA, 22 nt, Homo sapiens
gugaugcaguacguagaggaga

SEQ ID NO: 4857 - RNA, 22 nt, Homo sapiens
uuaagcaguaguuaaggagagg

SEQ ID NO: 4858 - RNA, 22 nt, Homo sapiens
ucuuaggauacugaagucgguu

SEQ ID NO: 4859 - RNA, 21 nt, Homo sapiens
agccaguguuccuuguggcuc

SEQ ID NO: 4860 - RNA, 22 nt, Homo sapiens
ugauaugcuuugaacucucugg

SEQ ID NO: 4861 - RNA, 22 nt, Homo sapiens
ggcuagagacaaguugcugaga

SEQ ID NO: 4862 - RNA, 22 nt, Homo sapiens
uaaguacugucagaauuggacu

SEQ ID NO: 4863 - RNA, 22 nt, Homo sapiens
aagguagguuccaaaauaccua

SEQ ID NO: 4864 - RNA, 22 nt, Homo sapiens
uguuaacauuuuagagugggaa

SEQ ID NO: 4865 - RNA, 21 nt, Homo sapiens
uggcacuauucacaauagcaa

SEQ ID NO: 4866 - RNA, 22 nt, Homo sapiens
gagaaguaaauuuauuugcaaa

SEQ ID NO: 4867 - RNA, 22 nt, Homo sapiens
ucagaugaucugguaagaacuu

SEQ ID NO: 4868 - RNA, 22 nt, Homo sapiens
uguugcacuccagccuagguga

SEQ ID NO: 4869 - RNA, 22 nt, Homo sapiens
ugccaguauuuuauugaagauu

SEQ ID NO: 4870 - RNA, 22 nt, Homo sapiens
aucaaaugcuggcagagugccu

SEQ ID NO: 4871 - RNA, 22 nt, Homo sapiens
auugcacuccagccuggggaac

SEQ ID NO: 4872 - RNA, 22 nt, Homo sapiens
agagacauugcuccaacucacc

SEQ ID NO: 4873 - RNA, 22 nt, Homo sapiens
guauaaguugacucaaucuuug

SEQ ID NO: 4874 - RNA, 22 nt, Homo sapiens
aagagguagcagucacaaaaga

SEQ ID NO: 4875 - RNA, 22 nt, Homo sapiens
aagugcuguaugggagccuagg

SEQ ID NO: 4876 - RNA, 22 nt, Homo sapiens
ugacuugaacuucuaugucacc

SEQ ID NO: 4877 - RNA, 21 nt, Homo sapiens
aucgcacaauauaccccugua

SEQ ID NO: 4878 - RNA, 23 nt, Homo sapiens
uucaguauugaaugauggcgcug

SEQ ID NO: 4879 - RNA, 22 nt, Homo sapiens
aauaucuguguauagauggggg

SEQ ID NO: 4880 - RNA, 20 nt, Homo sapiens
cugcaaaugcugcugcugau

SEQ ID NO: 4881 - RNA, 22 nt, Homo sapiens
ucaaaguagaaaaggggcaauu

SEQ ID NO: 4882 - RNA, 22 nt, Homo sapiens
gaugguuuuucuccgauuuaua

SEQ ID NO: 4883 - RNA, 22 nt, Homo sapiens
ugaagacucaguuugagggaca

SEQ ID NO: 4884 - RNA, 22 nt, Homo sapiens
ucuuuggcugugaagaauaaug

SEQ ID NO: 4885 - RNA, 22 nt, Homo sapiens
augagaacugucaaugagagcu

SEQ ID NO: 4886 - RNA, 22 nt, Homo sapiens
gcauaaagcuaauaagacgaag

SEQ ID NO: 4887 - RNA, 22 nt, Homo sapiens
uucaguucugcucugaucuuag

SEQ ID NO: 4888 - RNA, 22 nt, Homo sapiens
ccauugcacuccagccuaggca

SEQ ID NO: 4889 - RNA, 22 nt, Homo sapiens
gccagugugaugugaucauggc

SEQ ID NO: 4890 - RNA, 22 nt, Homo sapiens
uucacagaguuauuuuuaugcu

SEQ ID NO: 4891 - RNA, 22 nt, Homo sapiens
auggaggccuacagaauuuugg

SEQ ID NO: 4892 - RNA, 22 nt, Homo sapiens
ccucacaaccuuuauugaagag

SEQ ID NO: 4893 - RNA, 22 nt, Homo sapiens
ugaguaauguugaucuuugaua

SEQ ID NO: 4894 - RNA, 22 nt, Homo sapiens
cuaggcuuuucuuggauccagg

SEQ ID NO: 4895 - RNA, 22 nt, Homo sapiens
uauggaaaucuuaccuuauggu

SEQ ID NO: 4896 - RNA, 20 nt, Homo sapiens
aagugcuauuucuuuugugg

SEQ ID NO: 4897 - RNA, 22 nt, Homo sapiens
ucgugcaaacguaauugugguu

SEQ ID NO: 4898 - RNA, 20 nt, Homo sapiens
uaugguuuuagguauagcau

SEQ ID NO: 4899 - RNA, 22 nt, Homo sapiens
guugccuaggcuggagugcagu

SEQ ID NO: 4900 - RNA, 20 nt, Homo sapiens
uggcaccugacagauagcca

SEQ ID NO: 4901 - RNA, 22 nt, Homo sapiens
acacgugcguauauguacguau

SEQ ID NO: 4902 - RNA, 22 nt, Homo sapiens
cccuuagaauuuuguaguuauu

SEQ ID NO: 4903 - RNA, 22 nt, Homo sapiens
uuagaacuagaggaguuugagu

SEQ ID NO: 4904 - RNA, 22 nt, Homo sapiens
uggagugcgagggugaaacuuu

SEQ ID NO: 4905 - RNA, 21 nt, Homo sapiens
cuaaucucacccuuuucuggg

SEQ ID NO: 4906 - RNA, 22 nt, Homo sapiens
uguuauugagguuacuuauaag

SEQ ID NO: 4907 - RNA, 22 nt, Homo sapiens
gcaacccgucaucuagguuuua

SEQ ID NO: 4908 - RNA, 22 nt, Homo sapiens
ucugacuagacaagcaguguac

SEQ ID NO: 4909 - RNA, 23 nt, Homo sapiens
uagaucaucaaguuuacugugcu

SEQ ID NO: 4910 - RNA, 22 nt, Homo sapiens
cuuuggucaauugcugcgggga

SEQ ID NO: 4911 - RNA, 22 nt, Homo sapiens
ugagauaguacuuuuuuaaagg

SEQ ID NO: 4912 - RNA, 22 nt, Homo sapiens
aguacugucagcaggguguuga

SEQ ID NO: 4913 - RNA, 22 nt, Homo sapiens
gcuagcauucaaaugugcagcc

SEQ ID NO: 4914 - RNA, 21 nt, Homo sapiens
gugcaacucccucucccuaca

SEQ ID NO: 4915 - RNA, 22 nt, Homo sapiens
ggaauaguauaaauaccacaaa

SEQ ID NO: 4916 - RNA, 18 nt, Homo sapiens
auuuuugcaguccacaug

SEQ ID NO: 4917 - RNA, 22 nt, Homo sapiens
ucuggcuugugaacugucuucu

SEQ ID NO: 4918 - RNA, 22 nt, Homo sapiens
ucccugaaagcugagauuggaa

SEQ ID NO: 4919 - RNA, 22 nt, Homo sapiens
uaacacccuucuccagguacau

SEQ ID NO: 4920 - RNA, 20 nt, Homo sapiens
agguuauuauaauuagaaga

SEQ ID NO: 4921 - RNA, 22 nt, Homo sapiens
uucauuggauguuacacugugu

SEQ ID NO: 4922 - RNA, 22 nt, Homo sapiens
uaucauagacaaucaguuauug

SEQ ID NO: 4923 - RNA, 22 nt, Homo sapiens
guaugugacuggaacaguagga

SEQ ID NO: 4924 - RNA, 22 nt, Homo sapiens
aggagguagggugugaaacagc

SEQ ID NO: 4925 - RNA, 20 nt, Homo sapiens
aagcaagcauuugcaaucau

SEQ ID NO: 4926 - RNA, 22 nt, Homo sapiens
uugagcaccaugccuggccaug

SEQ ID NO: 4927 - RNA, 15 nt, Homo sapiens
auuucacuuagcaug

SEQ ID NO: 4928 - RNA, 22 nt, Homo sapiens
uuugugacucauggucuagugc

SEQ ID NO: 4929 - RNA, 22 nt, Homo sapiens
agaugcauugguggcauauuca

SEQ ID NO: 4930 - RNA, 22 nt, Homo sapiens
agcacacuggguggcuuaaaca

SEQ ID NO: 4931 - RNA, 22 nt, Homo sapiens
gugggaugaucacaguucacug

SEQ ID NO: 4932 - RNA, 22 nt, Homo sapiens
aauggcacuuuauaaauguuaa

SEQ ID NO: 4933 - RNA, 22 nt, Homo sapiens
ucaucaguggggaugugguuga

SEQ ID NO: 4934 - RNA, 22 nt, Homo sapiens
uaucacaguagaacucuuucca

SEQ ID NO: 4935 - RNA, 22 nt, Homo sapiens
gagagucacagugaauguggca

SEQ ID NO: 4936 - RNA, 22 nt, Homo sapiens
gagguuuuagugagucccacug

SEQ ID NO: 4937 - RNA, 22 nt, Homo sapiens
aggcacacaacccuggaccuga

SEQ ID NO: 4938 - RNA, 20 nt, Homo sapiens
uguaacaaucuggauguugc

SEQ ID NO: 4939 - RNA, 22 nt, Homo sapiens
uaaagccuagaacuuucagccc

SEQ ID NO: 4940 - RNA, 22 nt, Homo sapiens
uucauacaguggcugcacucca

SEQ ID NO: 4941 - RNA, 22 nt, Homo sapiens
gaggugauaucucauugugguu

SEQ ID NO: 4942 - RNA, 22 nt, Homo sapiens
gagcugguccuuuaaggaugca

SEQ ID NO: 4943 - RNA, 22 nt, Homo sapiens
uauuagguuggugcaaaaguaa

SEQ ID NO: 4944 - RNA, 22 nt, Homo sapiens
gucacaguggccagugauguuc

SEQ ID NO: 4945 - RNA, 22 nt, Homo sapiens
uaaggcuuaugguaaaguccug

SEQ ID NO: 4946 - RNA, 22 nt, Homo sapiens
agagugcuuuauuagauguagc

SEQ ID NO: 4947 - RNA, 22 nt, Homo sapiens
ugacauggugcucuuucaggca

SEQ ID NO: 4948 - RNA, 22 nt, Homo sapiens
aucuggguccguucugcuucuc

SEQ ID NO: 4949 - RNA, 22 nt, Homo sapiens
ugacagguugauaggugcagca

SEQ ID NO: 4950 - RNA, 22 nt, Homo sapiens
aagugucagaguugcuaaugac

SEQ ID NO: 4951 - RNA, 22 nt, Homo sapiens
uacucaguagacacucauaugu

SEQ ID NO: 4952 - RNA, 19 nt, Homo sapiens
uaugggauuuuuagggugu

SEQ ID NO: 4953 - RNA, 22 nt, Homo sapiens
uuuaaaguuagaaggaaagggc

SEQ ID NO: 4954 - RNA, 22 nt, Homo sapiens
caggugaaugccucuccuucug

SEQ ID NO: 4955 - RNA, 22 nt, Homo sapiens
uucacccugguuguagauggac

SEQ ID NO: 4956 - RNA, 22 nt, Homo sapiens
agcugguuuaauaugcugucug

SEQ ID NO: 4957 - RNA, 21 nt, Homo sapiens
auuugguguuagaaauaaauu

SEQ ID NO: 4958 - RNA, 22 nt, Homo sapiens
ugacagcugaagauguugaacc

SEQ ID NO: 4959 - RNA, 22 nt, Homo sapiens
caccagcuggcauugaauaccu

SEQ ID NO: 4960 - RNA, 22 nt, Homo sapiens
gaagaacuaggugagaucuaga

SEQ ID NO: 4961 - RNA, 22 nt, Homo sapiens
cagauaguuguagauaugcagc

SEQ ID NO: 4962 - RNA, 22 nt, Homo sapiens
auagugcugcaauaaacauaug

SEQ ID NO: 4963 - RNA, 22 nt, Homo sapiens
aaguauuagcuaauugugcuua

SEQ ID NO: 4964 - RNA, 22 nt, Homo sapiens
augagauuguuugugugaaaua

SEQ ID NO: 4965 - RNA, 22 nt, Homo sapiens
aagugagaugcaguggaguucc

SEQ ID NO: 4966 - RNA, 22 nt, Homo sapiens
uauugccucagugacuuugggg

SEQ ID NO: 4967 - RNA, 22 nt, Homo sapiens
ucuuuggucagaaagauuacac

SEQ ID NO: 4968 - RNA, 22 nt, Homo sapiens
auugcacuccagccuggaugac

SEQ ID NO: 4969 - RNA, 22 nt, Homo sapiens
ugaguugagauaagguuacauu

SEQ ID NO: 4970 - RNA, 22 nt, Homo sapiens
uauuagguuggugcaacaguaa

SEQ ID NO: 4971 - RNA, 22 nt, Homo sapiens
uugcauagacaauauuaaucuu

SEQ ID NO: 4972 - RNA, 22 nt, Homo sapiens
uggauaguaauaaacauauagg

SEQ ID NO: 4973 - RNA, 22 nt, Homo sapiens
cucagucuaugauacuuugcua

SEQ ID NO: 4974 - RNA, 22 nt, Homo sapiens
auggccuaugaccguuauguug

SEQ ID NO: 4975 - RNA, 22 nt, Homo sapiens
gugagauacuagagauauagug

SEQ ID NO: 4976 - RNA, 22 nt, Homo sapiens
ggccuguaaacuagagacccug

SEQ ID NO: 4977 - RNA, 22 nt, Homo sapiens
caacugguuuuauacaguuuag

SEQ ID NO: 4978 - RNA, 22 nt, Homo sapiens
auugcacuccagccugggugag

SEQ ID NO: 4979 - RNA, 21 nt, Homo sapiens
uaagcuaaacauucaguuaac

SEQ ID NO: 4980 - RNA, 22 nt, Homo sapiens
gugagauaaugucucauugugg

SEQ ID NO: 4981 - RNA, 22 nt, Homo sapiens
ugagucaauucuaacaauggca

SEQ ID NO: 4982 - RNA, 22 nt, Homo sapiens
auacaugugucauguugguuug

SEQ ID NO: 4983 - RNA, 22 nt, Homo sapiens
uaauacuugucauaaaggcauu

SEQ ID NO: 4984 - RNA, 22 nt, Homo sapiens
uuagauuauugguguuuugcaa

SEQ ID NO: 4985 - RNA, 22 nt, Homo sapiens
ucuggccuccuaugagaaucga

SEQ ID NO: 4986 - RNA, 22 nt, Homo sapiens
uugcaagugccguaacuaccaa

SEQ ID NO: 4987 - RNA, 22 nt, Homo sapiens
gugggguaggguaggacucaac

SEQ ID NO: 4988 - RNA, 22 nt, Homo sapiens
aaucagauuccagugguuggaa

SEQ ID NO: 4989 - RNA, 18 nt, Homo sapiens
uaucucauuucuuagguc

SEQ ID NO: 4990 - RNA, 20 nt, Homo sapiens
guucauguaauuaguucagg

SEQ ID NO: 4991 - RNA, 22 nt, Homo sapiens
ugugucuacugagaugaucaug

SEQ ID NO: 4992 - RNA, 22 nt, Homo sapiens
cuauguaccuggaacuguauua

SEQ ID NO: 4993 - RNA, 22 nt, Homo sapiens
uugggaaugcuaaaccucuauu

SEQ ID NO: 4994 - RNA, 22 nt, Homo sapiens
uuguccccuuccaaaucucaug

SEQ ID NO: 4995 - RNA, 22 nt, Homo sapiens
auaaagccaggagacguaauug

SEQ ID NO: 4996 - RNA, 22 nt, Homo sapiens
uuaagccaggugugguggcaca

SEQ ID NO: 4997 - RNA, 22 nt, Homo sapiens
gaaugcuaccagcaucuagugg

SEQ ID NO: 4998 - RNA, 22 nt, Homo sapiens
cacauguuugcuacauuuuucu

SEQ ID NO: 4999 - RNA, 22 nt, Homo sapiens
aagcuggagugcaguggugcaa

SEQ ID NO: 5000 - RNA, 22 nt, Homo sapiens
caccagguuggagugcaguggu

SEQ ID NO: 5001 - RNA, 21 nt, Homo sapiens
uuuacuguggacccauugcuu

SEQ ID NO: 5002 - RNA, 22 nt, Homo sapiens
gagagugaaguuugcuaccugu

SEQ ID NO: 5003 - RNA, 22 nt, Homo sapiens
agcaaccuugaauagcccuuuc

SEQ ID NO: 5004 - RNA, 22 nt, Homo sapiens
auccccuugcagugaccggggc

SEQ ID NO: 5005 - RNA, 22 nt, Homo sapiens
auuaaguaaugguuccaauaau

SEQ ID NO: 5006 - RNA, 22 nt, Homo sapiens
uucauggaguugagaaggcuaa

SEQ ID NO: 5007 - RNA, 22 nt, Homo sapiens
aggugaaugcucacauucuaau

SEQ ID NO: 5008 - RNA, 19 nt, Homo sapiens
aauauugacaguggugucu

SEQ ID NO: 5009 - RNA, 22 nt, Homo sapiens
ucuguggucagcauccgccacu

SEQ ID NO: 5010 - RNA, 22 nt, Homo sapiens
acccagaagucauucaggaaca

SEQ ID NO: 5011 - RNA, 22 nt, Homo sapiens
ccagguuucuagaauaauuccu

SEQ ID NO: 5012 - RNA, 22 nt, Homo sapiens
agcuaacauuuuuccucuucca

SEQ ID NO: 5013 - RNA, 22 nt, Homo sapiens
ugugacucuggcacauggugag

SEQ ID NO: 5014 - RNA, 22 nt, Homo sapiens
aagugcuuuacacaugcaugau

SEQ ID NO: 5015 - RNA, 22 nt, Homo sapiens
uugaggaaugugauuucaaaua

SEQ ID NO: 5016 - RNA, 22 nt, Homo sapiens
ugucaugaaauauguuuuucua

SEQ ID NO: 5017 - RNA, 22 nt, Homo sapiens
gagguaugugggcagacauuua

SEQ ID NO: 5018 - RNA, 22 nt, Homo sapiens
ugguuaucauagcuaugcuacu

SEQ ID NO: 5019 - RNA, 22 nt, Homo sapiens
cugguaugugugacugcauuga

SEQ ID NO: 5020 - RNA, 22 nt, Homo sapiens
uuaauaccgucacauggcugaa

SEQ ID NO: 5021 - RNA, 22 nt, Homo sapiens
uccuguaaucccagcuaccaga

SEQ ID NO: 5022 - RNA, 22 nt, Homo sapiens
caaagugcuggaauuggccggg

SEQ ID NO: 5023 - RNA, 22 nt, Homo sapiens
ucuuugguuucugucucuguaa

SEQ ID NO: 5024 - RNA, 22 nt, Homo sapiens
uaggucuuuuaugaaauauauu

SEQ ID NO: 5025 - RNA, 22 nt, Homo sapiens
auggaauguggaaugguaagua

SEQ ID NO: 5026 - RNA, 22 nt, Homo sapiens
cuugccuaaucugcaugauuuu

SEQ ID NO: 5027 - RNA, 22 nt, Homo sapiens
uagcugcacuuacaagugagaa

SEQ ID NO: 5028 - RNA, 22 nt, Homo sapiens
uugugcaugaugcauacauggu

SEQ ID NO: 5029 - RNA, 22 nt, Homo sapiens
uacgugaauggacaaugccuug

SEQ ID NO: 5030 - RNA, 22 nt, Homo sapiens
cugcagucaucugaagauuuug

SEQ ID NO: 5031 - RNA, 22 nt, Homo sapiens
gauggcagugcagccccuggcu

SEQ ID NO: 5032 - RNA, 19 nt, Homo sapiens
ccuuugguuuccaugacau

SEQ ID NO: 5033 - RNA, 22 nt, Homo sapiens
ucacaguugauugaaacacagc

SEQ ID NO: 5034 - RNA, 22 nt, Homo sapiens
uuaagugcucaguuacucaguu

SEQ ID NO: 5035 - RNA, 22 nt, Homo sapiens
aaggcaagagaaaauuucgagu

SEQ ID NO: 5036 - RNA, 22 nt, Homo sapiens
guagaaagcauuucagauuugc

SEQ ID NO: 5037 - RNA, 22 nt, Homo sapiens
accacagugcuuccugcucacg

SEQ ID NO: 5038 - RNA, 22 nt, Homo sapiens
uuagauaguacugaaugguucu

SEQ ID NO: 5039 - RNA, 18 nt, Homo sapiens
ucauuggugagcaccucc

SEQ ID NO: 5040 - RNA, 22 nt, Homo sapiens
augagaaucauuucagcuugua

SEQ ID NO: 5041 - RNA, 22 nt, Homo sapiens
aaucacguagcaguagggagaa

SEQ ID NO: 5042 - RNA, 22 nt, Homo sapiens
uucuuugcuuggaagcggggga

SEQ ID NO: 5043 - RNA, 22 nt, Homo sapiens
aagaugcagucauacuggagua

SEQ ID NO: 5044 - RNA, 22 nt, Homo sapiens
guggguaaaucucuggggcucu

SEQ ID NO: 5045 - RNA, 22 nt, Homo sapiens
augaaacuggcuaauuuuugua

SEQ ID NO: 5046 - RNA, 22 nt, Homo sapiens
ugcuuaguguugacccucugcc

SEQ ID NO: 5047 - RNA, 22 nt, Homo sapiens
caaagugcugggacuggccggg

SEQ ID NO: 5048 - RNA, 22 nt, Homo sapiens
ugcccaguggacagaaagucau

SEQ ID NO: 5049 - RNA, 22 nt, Homo sapiens
ugccaguguugccuuucacuag

SEQ ID NO: 5050 - RNA, 21 nt, Homo sapiens
gcaaacauccuuugaugccag

SEQ ID NO: 5051 - RNA, 22 nt, Homo sapiens
aacaguaucuaacgagugauga

SEQ ID NO: 5052 - RNA, 22 nt, Homo sapiens
uguagauaucuaucaggucaau

SEQ ID NO: 5053 - RNA, 19 nt, Homo sapiens
cugaaacacagagagggcu

SEQ ID NO: 5054 - RNA, 22 nt, Homo sapiens
gccccaguacaggcuccuuaga

SEQ ID NO: 5055 - RNA, 22 nt, Homo sapiens
uuguaagaaucuagcucuuuau

SEQ ID NO: 5056 - RNA, 22 nt, Homo sapiens
uguucaauucccaccuaugagu

SEQ ID NO: 5057 - RNA, 22 nt, Homo sapiens
ucacugaggucugagcuuuaug

SEQ ID NO: 5058 - RNA, 21 nt, Homo sapiens
ucaggaccucuaguuagccag

SEQ ID NO: 5059 - RNA, 22 nt, Homo sapiens
aacagagcuggugacuccaggu

SEQ ID NO: 5060 - RNA, 22 nt, Homo sapiens
uacagguauagauguguguucu

SEQ ID NO: 5061 - RNA, 22 nt, Homo sapiens
uagguuaucaaauugguaggca

SEQ ID NO: 5062 - RNA, 21 nt, Homo sapiens
gaccuguaguaagcauucaca

SEQ ID NO: 5063 - RNA, 22 nt, Homo sapiens
ugacaagaaagcgucuucuuuu

SEQ ID NO: 5064 - RNA, 22 nt, Homo sapiens
uggcuacuguacuugagcuauu

SEQ ID NO: 5065 - RNA, 22 nt, Homo sapiens
ugacacuugcccuuagaaacau

SEQ ID NO: 5066 - RNA, 17 nt, Homo sapiens
ugugaucaucacccuug

SEQ ID NO: 5067 - RNA, 22 nt, Homo sapiens
uuggcccugcugaccauucccu

SEQ ID NO: 5068 - RNA, 21 nt, Homo sapiens
cugguccccuuuauguaugug

SEQ ID NO: 5069 - RNA, 18 nt, Homo sapiens
augaacucaucauuuuua

SEQ ID NO: 5070 - RNA, 22 nt, Homo sapiens
uuuugcaauauguuccugaaua

SEQ ID NO: 5071 - RNA, 22 nt, Homo sapiens
augugccauucucauggcgcuu

SEQ ID NO: 5072 - RNA, 22 nt, Homo sapiens
uggucaccugaauuaugcaugu

SEQ ID NO: 5073 - RNA, 22 nt, Homo sapiens
uugcauuagugugguacauuug

SEQ ID NO: 5074 - RNA, 22 nt, Homo sapiens
uuucacagcugucuuccgucuc

SEQ ID NO: 5075 - RNA, 22 nt, Homo sapiens
cuagaagguaagagcuggaugc

SEQ ID NO: 5076 - RNA, 22 nt, Homo sapiens
ccauugcacuccagccucggca

SEQ ID NO: 5077 - RNA, 22 nt, Homo sapiens
uggugcuuaaauaaggcuuuca

SEQ ID NO: 5078 - RNA, 22 nt, Homo sapiens
cauggucaccuuccaaguuauu

SEQ ID NO: 5079 - RNA, 22 nt, Homo sapiens
cuggaguaugaaccauguauca

SEQ ID NO: 5080 - RNA, 22 nt, Homo sapiens
cauggcacagagaauguguucu

SEQ ID NO: 5081 - RNA, 22 nt, Homo sapiens
ugaguuccuugugugaccuugc

SEQ ID NO: 5082 - RNA, 22 nt, Homo sapiens
ucuaagacuaagggcuagcuuc

SEQ ID NO: 5083 - RNA, 22 nt, Homo sapiens
uuggccccuuucauccacagcu

SEQ ID NO: 5084 - RNA, 22 nt, Homo sapiens
gggaauguagcaaaucugcaau

SEQ ID NO: 5085 - RNA, 22 nt, Homo sapiens
ggaguaugaaacccacuccaau

SEQ ID NO: 5086 - RNA, 22 nt, Homo sapiens
auuguacuccagccuguggagc

SEQ ID NO: 5087 - RNA, 22 nt, Homo sapiens
aggcaagcaucuugcucccuuc

SEQ ID NO: 5088 - RNA, 22 nt, Homo sapiens
augagaugaggaauggcccucc

SEQ ID NO: 5089 - RNA, 22 nt, Homo sapiens
ugggaacugaggugaaaagaca

SEQ ID NO: 5090 - RNA, 22 nt, Homo sapiens
cugagcucauuucuuuugcuac

SEQ ID NO: 5091 - RNA, 21 nt, Homo sapiens
uggaccccuuccuugcaccau

SEQ ID NO: 5092 - RNA, 22 nt, Homo sapiens
gggaaaaugucuauugaaugaa

SEQ ID NO: 5093 - RNA, 22 nt, Homo sapiens
uaacaguguagaggccuauugg

SEQ ID NO: 5094 - RNA, 22 nt, Homo sapiens
uuucauguuuuucugugaggca

SEQ ID NO: 5095 - RNA, 22 nt, Homo sapiens
uuuuugauuaauggguagacca

SEQ ID NO: 5096 - RNA, 22 nt, Homo sapiens
ugagcacagcgugugggagagc

SEQ ID NO: 5097 - RNA, 22 nt, Homo sapiens
ucacuauugacaacagugugga

SEQ ID NO: 5098 - RNA, 20 nt, Homo sapiens
acugauauguuccuguucuc

SEQ ID NO: 5099 - RNA, 22 nt, Homo sapiens
ugauggcacagugaguuccagg

SEQ ID NO: 5100 - RNA, 22 nt, Homo sapiens
gugauagguugucacugucacu

SEQ ID NO: 5101 - RNA, 22 nt, Homo sapiens
cagcacauuacaaguacuuggu

SEQ ID NO: 5102 - RNA, 22 nt, Homo sapiens
gagcuuguagugugaaugguau

SEQ ID NO: 5103 - RNA, 22 nt, Homo sapiens
gagguaucauuauguugcccag

SEQ ID NO: 5104 - RNA, 22 nt, Homo sapiens
aagcuguugguggauguaccau

SEQ ID NO: 5105 - RNA, 22 nt, Homo sapiens
cucaccuugugauccacccacc

SEQ ID NO: 5106 - RNA, 22 nt, Homo sapiens
aaucugggguuguuuggggagu

SEQ ID NO: 5107 - RNA, 22 nt, Homo sapiens
gcaaggaugagugcccaugaga

SEQ ID NO: 5108 - RNA, 22 nt, Homo sapiens
ugaguuuaucuaaagaccuggg

SEQ ID NO: 5109 - RNA, 22 nt, Homo sapiens
auagcaaugccccauucccagu

SEQ ID NO: 5110 - RNA, 22 nt, Homo sapiens
acaguacuuuuggauuugugaa

SEQ ID NO: 5111 - RNA, 22 nt, Homo sapiens
uaucccuguggacuucccaaca

SEQ ID NO: 5112 - RNA, 22 nt, Homo sapiens
ugccuacuuugcaucugucagg

SEQ ID NO: 5113 - RNA, 22 nt, Homo sapiens
aacuggccuccuugggaaauua

SEQ ID NO: 5114 - RNA, 22 nt, Homo sapiens
ugagagucauacaaauaaaaau

SEQ ID NO: 5115 - RNA, 22 nt, Homo sapiens
uggagaacauucauuugcaaga

SEQ ID NO: 5116 - RNA, 22 nt, Homo sapiens
uaaaagucaucacaacuggagu

SEQ ID NO: 5117 - RNA, 22 nt, Homo sapiens
ugggcggagacgugcagccgcc

SEQ ID NO: 5118 - RNA, 22 nt, Homo sapiens
ugagaacugccuguauuuaucu

SEQ ID NO: 5119 - RNA, 22 nt, Homo sapiens
cuugugcaugaccccagguggg

SEQ ID NO: 5120 - RNA, 22 nt, Homo sapiens
guucacagugguugccuuccag

SEQ ID NO: 5121 - RNA, 22 nt, Homo sapiens
uauuagguuggggcaaaaguaa

SEQ ID NO: 5122 - RNA, 22 nt, Homo sapiens
aggacacugauagucuuuggca

SEQ ID NO: 5123 - RNA, 22 nt, Homo sapiens
ugaucaaagugcuggaauuaca

SEQ ID NO: 5124 - RNA, 22 nt, Homo sapiens
uucaggcaccauggucauugau

SEQ ID NO: 5125 - RNA, 20 nt, Homo sapiens
ugaugcaaaucuuuaaaagu

SEQ ID NO: 5126 - RNA, 20 nt, Homo sapiens
agguucaaaucccaaucaug

SEQ ID NO: 5127 - RNA, 22 nt, Homo sapiens
uaucacagauauuaugggccaa

SEQ ID NO: 5128 - RNA, 22 nt, Homo sapiens
ugccugagccagguuuuaggag

SEQ ID NO: 5129 - RNA, 22 nt, Homo sapiens
uuuaugguuuucugggagauug

SEQ ID NO: 5130 - RNA, 22 nt, Homo sapiens
uuggaaacauuuaugguaacag

SEQ ID NO: 5131 - RNA, 22 nt, Homo sapiens
caccaggugcccagcacggcca

SEQ ID NO: 5132 - RNA, 22 nt, Homo sapiens
gccuagauccaaauauggugca

SEQ ID NO: 5133 - RNA, 22 nt, Homo sapiens
ugaagagucuaaaucugucuuc

SEQ ID NO: 5134 - RNA, 22 nt, Homo sapiens
gaaagcuaaugacuuuggguga

SEQ ID NO: 5135 - RNA, 22 nt, Homo sapiens
ucaaugcaaccuccaccucugg

SEQ ID NO: 5136 - RNA, 22 nt, Homo sapiens
uugcacuuccgccugggugaca

SEQ ID NO: 5137 - RNA, 22 nt, Homo sapiens
augugcauaugaagcacagaca

SEQ ID NO: 5138 - RNA, 22 nt, Homo sapiens
ugaguucuuuguagauucugug

SEQ ID NO: 5139 - RNA, 21 nt, Homo sapiens
aagcaugguguaucuuuccau

SEQ ID NO: 5140 - RNA, 22 nt, Homo sapiens
uugccuaggcuggagugcagua

SEQ ID NO: 5141 - RNA, 22 nt, Homo sapiens
uauggcguaugaauuauaucuc

SEQ ID NO: 5142 - RNA, 22 nt, Homo sapiens
guauaguaguacaaaaguuuuu

SEQ ID NO: 5143 - RNA, 16 nt, Homo sapiens
ugcuauguuggccagg

SEQ ID NO: 5144 - RNA, 22 nt, Homo sapiens
uggugagaaacuagauauuuuu

SEQ ID NO: 5145 - RNA, 21 nt, Homo sapiens
uguagcagcaugauuuauaau

SEQ ID NO: 5146 - RNA, 22 nt, Homo sapiens
uccacagugguggaauuguuca

SEQ ID NO: 5147 - RNA, 22 nt, Homo sapiens
aaucacagccagcuuccgcuau

SEQ ID NO: 5148 - RNA, 22 nt, Homo sapiens
uugcuuuguugucuggggaaua

SEQ ID NO: 5149 - RNA, 22 nt, Homo sapiens
uaaguggaagaugucaaucaua

SEQ ID NO: 5150 - RNA, 22 nt, Homo sapiens
guugccuaggcuggucuugaac

SEQ ID NO: 5151 - RNA, 22 nt, Homo sapiens
uauaggacuugguguaguuucu

SEQ ID NO: 5152 - RNA, 22 nt, Homo sapiens
ugagucaauggaggcucagagc

SEQ ID NO: 5153 - RNA, 22 nt, Homo sapiens
uauagcacugaccuuccaggac

SEQ ID NO: 5154 - RNA, 20 nt, Homo sapiens
ucugauugcaacugcaugag

SEQ ID NO: 5155 - RNA, 22 nt, Homo sapiens
aaguugcuuuagguaagucaau

SEQ ID NO: 5156 - RNA, 22 nt, Homo sapiens
guaaucucagcuacucgggagg

SEQ ID NO: 5157 - RNA, 22 nt, Homo sapiens
uucuauguuguuagacccacca

SEQ ID NO: 5158 - RNA, 22 nt, Homo sapiens
ugagauaaucaugugguuuuug

SEQ ID NO: 5159 - RNA, 22 nt, Homo sapiens
ugagaagugacgcagcaggguu

SEQ ID NO: 5160 - RNA, 23 nt, Homo sapiens
uuuaguccccuaugagcuggugu

SEQ ID NO: 5161 - RNA, 22 nt, Homo sapiens
acugguuguuuaacugaauuga

SEQ ID NO: 5162 - RNA, 22 nt, Homo sapiens
ggcaagaaccagggauuugcgu

SEQ ID NO: 5163 - RNA, 21 nt, Homo sapiens
uuucacugugaguuuuucugu

SEQ ID NO: 5164 - RNA, 22 nt, Homo sapiens
ggcagcuguguccuucguaagg

SEQ ID NO: 5165 - RNA, 22 nt, Homo sapiens
ucaccaguggcacuccagccug

SEQ ID NO: 5166 - RNA, 22 nt, Homo sapiens
auccucaguggcuuaaguauag

SEQ ID NO: 5167 - RNA, 22 nt, Homo sapiens
uuggcaauugcuaugauuugaa

SEQ ID NO: 5168 - RNA, 22 nt, Homo sapiens
gcuuuguuguugaugggaaauc

SEQ ID NO: 5169 - RNA, 22 nt, Homo sapiens
uauggguuucagagggugauag

SEQ ID NO: 5170 - RNA, 23 nt, Homo sapiens
uagcaacaguuggaggugaggua

SEQ ID NO: 5171 - RNA, 20 nt, Homo sapiens
acaaaugcauucugugacau

SEQ ID NO: 5172 - RNA, 22 nt, Homo sapiens
auacuguuuuacaucauugccu

SEQ ID NO: 5173 - RNA, 22 nt, Homo sapiens
uuuuguacgccuguguccauca

SEQ ID NO: 5174 - RNA, 22 nt, Homo sapiens
uuugagcauggaaauggcauga

SEQ ID NO: 5175 - RNA, 22 nt, Homo sapiens
uuacaaccucagcagugcaaag

SEQ ID NO: 5176 - RNA, 22 nt, Homo sapiens
uugagacgaagucucacucuug

SEQ ID NO: 5177 - RNA, 22 nt, Homo sapiens
uuuguagcuacaaagugagaug

SEQ ID NO: 5178 - RNA, 22 nt, Homo sapiens
cugcaaauacuugugggauuuu

SEQ ID NO: 5179 - RNA, 22 nt, Homo sapiens
uaccaguaaugggucaaaggca

SEQ ID NO: 5180 - RNA, 22 nt, Homo sapiens
aaggcaguggcagaagauguca

SEQ ID NO: 5181 - RNA, 22 nt, Homo sapiens
ugagcucagcuaguugaggugu

SEQ ID NO: 5182 - RNA, 22 nt, Homo sapiens
aaagugcugagaguucuaacuu

SEQ ID NO: 5183 - RNA, 22 nt, Homo sapiens
auaagguuagcucugagaaagu

SEQ ID NO: 5184 - RNA, 22 nt, Homo sapiens
acuggcuuaaggaugggccacu

SEQ ID NO: 5185 - RNA, 22 nt, Homo sapiens
uuggaauuuuacuucuguaaga

SEQ ID NO: 5186 - RNA, 22 nt, Homo sapiens
uaucucaguguacaggaugaua

SEQ ID NO: 5187 - RNA, 22 nt, Homo sapiens
gcugguauuacaggcaugagcc

SEQ ID NO: 5188 - RNA, 22 nt, Homo sapiens
gugauauguuaggaucuaaguc

SEQ ID NO: 5189 - RNA, 22 nt, Homo sapiens
caccaguuuuucagugauucaa

SEQ ID NO: 5190 - RNA, 22 nt, Homo sapiens
cauuccacuggauaaacaaggu

SEQ ID NO: 5191 - RNA, 22 nt, Homo sapiens
aauaguggcuuggacuaaauau

SEQ ID NO: 5192 - RNA, 22 nt, Homo sapiens
ucacugugguuggaaggcuuaa

SEQ ID NO: 5193 - RNA, 22 nt, Homo sapiens
gaaccagcagacuuugacaggu

SEQ ID NO: 5194 - RNA, 22 nt, Homo sapiens
ugugcacuggaccuugucuucu

SEQ ID NO: 5195 - RNA, 22 nt, Homo sapiens
cuauggauuuacuguauagggu

SEQ ID NO: 5196 - RNA, 22 nt, Homo sapiens
gugaaacuggguggugagagac

SEQ ID NO: 5197 - RNA, 23 nt, Homo sapiens
acaguggugugaucuuggcucag

SEQ ID NO: 5198 - RNA, 22 nt, Homo sapiens
uuccuacugugcaaaguugcaa

SEQ ID NO: 5199 - RNA, 22 nt, Homo sapiens
ucaaaucaucuuuuccaaagcu

SEQ ID NO: 5200 - RNA, 22 nt, Homo sapiens
cuacagcagcccaguccccgaa

SEQ ID NO: 5201 - RNA, 20 nt, Homo sapiens
uaugaaacaguguagagcaa

SEQ ID NO: 5202 - RNA, 22 nt, Homo sapiens
aucaagcuacacccuuuggaaa

SEQ ID NO: 5203 - RNA, 22 nt, Homo sapiens
cuacugcacaucaucugaguua

SEQ ID NO: 5204 - RNA, 20 nt, Homo sapiens
acacuggaguaucaaggccc

SEQ ID NO: 5205 - RNA, 22 nt, Homo sapiens
accugcacagccgaacauagac

SEQ ID NO: 5206 - RNA, 22 nt, Homo sapiens
gccccgggugaugcagccguca

SEQ ID NO: 5207 - RNA, 22 nt, Homo sapiens
uacguguauuguuuucacaaga

SEQ ID NO: 5208 - RNA, 22 nt, Homo sapiens
uagagcacagugauuagaccua

SEQ ID NO: 5209 - RNA, 22 nt, Homo sapiens
auggucccauucauucacguau

SEQ ID NO: 5210 - RNA, 22 nt, Homo sapiens
uacauacuguaugguucuguuu

SEQ ID NO: 5211 - RNA, 22 nt, Homo sapiens
gagugcaagguuuuucugagug

SEQ ID NO: 5212 - RNA, 22 nt, Homo sapiens
ucaggucauuccaggagggcca

SEQ ID NO: 5213 - RNA, 22 nt, Homo sapiens
auuccacuuacaugaaguaccu

SEQ ID NO: 5214 - RNA, 22 nt, Homo sapiens
gggaugaauuagguauguuuau

SEQ ID NO: 5215 - RNA, 22 nt, Homo sapiens
agcagcauuaguggaaucuugu

SEQ ID NO: 5216 - RNA, 22 nt, Homo sapiens
uuuagguagucaaagguuaguc

SEQ ID NO: 5217 - RNA, 22 nt, Homo sapiens
ugaugguuuuauuaauaggacc

SEQ ID NO: 5218 - RNA, 22 nt, Homo sapiens
acugcacuccagccucaugaca

SEQ ID NO: 5219 - RNA, 22 nt, Homo sapiens
uuaaggcagugucuaugccagu

SEQ ID NO: 5220 - RNA, 22 nt, Homo sapiens
uuugccaauauuuuacugagga

SEQ ID NO: 5221 - RNA, 23 nt, Homo sapiens
ucugauguuauaaaauucuuugg

SEQ ID NO: 5222 - RNA, 22 nt, Homo sapiens
auagaagcuauguauaggggcc

SEQ ID NO: 5223 - RNA, 22 nt, Homo sapiens
cuuggacaccucaugcccaccu

SEQ ID NO: 5224 - RNA, 22 nt, Homo sapiens
aauaagaaguggaagggaccgg

SEQ ID NO: 5225 - RNA, 22 nt, Homo sapiens
uugagcuauauacuucagacuu

SEQ ID NO: 5226 - RNA, 22 nt, Homo sapiens
uuaggugcauggaaguguuuuc

SEQ ID NO: 5227 - RNA, 22 nt, Homo sapiens
ugcauaucuucagccgggcacg

SEQ ID NO: 5228 - RNA, 22 nt, Homo sapiens
uucuaugguuuuuaugguguua

SEQ ID NO: 5229 - RNA, 22 nt, Homo sapiens
uucauggagccauccuuugauc

SEQ ID NO: 5230 - RNA, 22 nt, Homo sapiens
cagauggucuuaaggcagccuu

SEQ ID NO: 5231 - RNA, 22 nt, Homo sapiens
gcaugcauuuuccuaacuagaa

SEQ ID NO: 5232 - RNA, 22 nt, Homo sapiens
ucaaguaauacucccaucuugg

SEQ ID NO: 5233 - RNA, 20 nt, Homo sapiens
ucucauagagguagagaaua

SEQ ID NO: 5234 - RNA, 22 nt, Homo sapiens
auaucccaguguguaaacacug

SEQ ID NO: 5235 - RNA, 22 nt, Homo sapiens
gcccuuugugucuggcuggggu

SEQ ID NO: 5236 - RNA, 22 nt, Homo sapiens
acggaacugcuccauucuuugc

SEQ ID NO: 5237 - RNA, 22 nt, Homo sapiens
ugaauagacagucacugccucc

SEQ ID NO: 5238 - RNA, 22 nt, Homo sapiens
uguagggagagggaguugcacc

SEQ ID NO: 5239 - RNA, 22 nt, Homo sapiens
uggagagucauuuauaguauuu

SEQ ID NO: 5240 - RNA, 22 nt, Homo sapiens
uuucccagugguacaguuuaua

SEQ ID NO: 5241 - RNA, 22 nt, Homo sapiens
ugcuagaugcuguagggauuua

SEQ ID NO: 5242 - RNA, 22 nt, Homo sapiens
acagugcuuggcacacaguaau

SEQ ID NO: 5243 - RNA, 22 nt, Homo sapiens
ucuuuuguucuauucaggccuu

SEQ ID NO: 5244 - RNA, 22 nt, Homo sapiens
auaggagugugaacccuaucgu

SEQ ID NO: 5245 - RNA, 22 nt, Homo sapiens
gagcugaaguuuccauuuguac

SEQ ID NO: 5246 - RNA, 22 nt, Homo sapiens
ugugauugauuaaugugugcua

SEQ ID NO: 5247 - RNA, 22 nt, Homo sapiens
aaucacuaugccaugaaguaca

SEQ ID NO: 5248 - RNA, 22 nt, Homo sapiens
ugagaucuguaaagucugacau

SEQ ID NO: 5249 - RNA, 22 nt, Homo sapiens
ugcugguauuuggaccagccug

SEQ ID NO: 5250 - RNA, 22 nt, Homo sapiens
uuggcaaaugucacaaaucagg

SEQ ID NO: 5251 - RNA, 22 nt, Homo sapiens
cuaggcuguagagaaguucagu

SEQ ID NO: 5252 - RNA, 22 nt, Homo sapiens
ugguaugucuagauggggaagu

SEQ ID NO: 5253 - RNA, 18 nt, Homo sapiens
uugcaucauuuuguuguu

SEQ ID NO: 5254 - RNA, 22 nt, Homo sapiens
aauggcaucuacguuaaauguc

SEQ ID NO: 5255 - RNA, 22 nt, Homo sapiens
ugggcaaaacuaagagcugugg

SEQ ID NO: 5256 - RNA, 22 nt, Homo sapiens
guugaguuugaccugaacucug

SEQ ID NO: 5257 - RNA, 19 nt, Homo sapiens
aaagguaguaaccucugau

SEQ ID NO: 5258 - RNA, 22 nt, Homo sapiens
ugggauguagccuucuauuuuc

SEQ ID NO: 5259 - RNA, 22 nt, Homo sapiens
agcuccuuugcuuuuuccagga

SEQ ID NO: 5260 - RNA, 22 nt, Homo sapiens
ucuuugauuaugcagauggguu

SEQ ID NO: 5261 - RNA, 22 nt, Homo sapiens
uaaggcuagcaagaugagaaua

SEQ ID NO: 5262 - RNA, 22 nt, Homo sapiens
uauuccauuugggucaggauga

SEQ ID NO: 5263 - RNA, 22 nt, Homo sapiens
gucuugaaggcugaguaccugu

SEQ ID NO: 5264 - RNA, 22 nt, Homo sapiens
uaaguaucaguuuagcuaugau

SEQ ID NO: 5265 - RNA, 22 nt, Homo sapiens
cuagcacauuuaucuuuauaca

SEQ ID NO: 5266 - RNA, 22 nt, Homo sapiens
aaaugcauugagggaaaaggca

SEQ ID NO: 5267 - RNA, 22 nt, Homo sapiens
uuggaaggcuccuaaugaaugg

SEQ ID NO: 5268 - RNA, 22 nt, Homo sapiens
uaugaccuuguccccucucgcc

SEQ ID NO: 5269 - RNA, 22 nt, Homo sapiens
uuacauguuuauggggguacau

SEQ ID NO: 5270 - RNA, 22 nt, Homo sapiens
uccuucacucuacaucuuuguu

SEQ ID NO: 5271 - RNA, 22 nt, Homo sapiens
gauacaguaugcaugugguauu

SEQ ID NO: 5272 - RNA, 22 nt, Homo sapiens
uugcauagaggugaguauagua

SEQ ID NO: 5273 - RNA, 22 nt, Homo sapiens
uacuguguaguuagaccucaga

SEQ ID NO: 5274 - RNA, 22 nt, Homo sapiens
uagcauaauuuguagaaaauca

SEQ ID NO: 5275 - RNA, 22 nt, Homo sapiens
gauggcucugcaggugagggua

SEQ ID NO: 5276 - RNA, 22 nt, Homo sapiens
ugccuaguggaaggagagcaaa

SEQ ID NO: 5277 - RNA, 23 nt, Homo sapiens
gugcaguggcgagauuucggcuc

SEQ ID NO: 5278 - RNA, 22 nt, Homo sapiens
ucucuguuuauuuuugguguau

SEQ ID NO: 5279 - RNA, 22 nt, Homo sapiens
ugagcagugagugugcugcagg

SEQ ID NO: 5280 - RNA, 22 nt, Homo sapiens
acacaguauaugacaaugcuuu

SEQ ID NO: 5281 - RNA, 22 nt, Homo sapiens
cauuuugguuaaauagguagcu

SEQ ID NO: 5282 - RNA, 22 nt, Homo sapiens
cagggaauguuauuuaauagca

SEQ ID NO: 5283 - RNA, 22 nt, Homo sapiens
ccagugauuguauggugaaggu

SEQ ID NO: 5284 - RNA, 20 nt, Homo sapiens
ucauagcuuuuuccacuuua

SEQ ID NO: 5285 - RNA, 22 nt, Homo sapiens
acugcacuccagcuccagggug

SEQ ID NO: 5286 - RNA, 22 nt, Homo sapiens
uggaugccuaauaaaugcagac

SEQ ID NO: 5287 - RNA, 22 nt, Homo sapiens
ggcaugauggcugaggcuucug

SEQ ID NO: 5288 - RNA, 22 nt, Homo sapiens
uuaggcuuuucagacacuucau

SEQ ID NO: 5289 - RNA, 23 nt, Homo sapiens
auugauagugccuuugugcuaau

SEQ ID NO: 5290 - RNA, 22 nt, Homo sapiens
auuaacaucuagaguuuuggug

SEQ ID NO: 5291 - RNA, 22 nt, Homo sapiens
uggcaagcaggacuaaagcacc

SEQ ID NO: 5292 - RNA, 22 nt, Homo sapiens
gcuggcaagaugcugaugcaac

SEQ ID NO: 5293 - RNA, 22 nt, Homo sapiens
cuggcuaagugcuugagugugc

SEQ ID NO: 5294 - RNA, 21 nt, Homo sapiens
auacuugagacuggguaauuu

SEQ ID NO: 5295 - RNA, 22 nt, Homo sapiens
uaauccugucuugaccaucagg

SEQ ID NO: 5296 - RNA, 22 nt, Homo sapiens
uauaugcuaaacaagggguggg

SEQ ID NO: 5297 - RNA, 22 nt, Homo sapiens
agcucauugcaaccuccgccuc

SEQ ID NO: 5298 - RNA, 19 nt, Homo sapiens
uguugcacuccagcuuggg

SEQ ID NO: 5299 - RNA, 22 nt, Homo sapiens
cuugcauagaguuauugcccuu

SEQ ID NO: 5300 - RNA, 22 nt, Homo sapiens
agagugcuaaggaaguaauuua

SEQ ID NO: 5301 - RNA, 18 nt, Homo sapiens
ggcggguguuuuauucac

SEQ ID NO: 5302 - RNA, 21 nt, Homo sapiens
gugugcuugaauucagcuguc

SEQ ID NO: 5303 - RNA, 22 nt, Homo sapiens
uuaaguguaaguggugugggac

SEQ ID NO: 5304 - RNA, 22 nt, Homo sapiens
ugcaggguccauugucccaagu

SEQ ID NO: 5305 - RNA, 22 nt, Homo sapiens
gucugucuuuugucuuugaaau

SEQ ID NO: 5306 - RNA, 22 nt, Homo sapiens
ggguucccuucuggcucagggu

SEQ ID NO: 5307 - RNA, 22 nt, Homo sapiens
uagcaaguguuuaagcacuuuu

SEQ ID NO: 5308 - RNA, 21 nt, Homo sapiens
agcagcuuugguugaagcaga

SEQ ID NO: 5309 - RNA, 22 nt, Homo sapiens
ugucaguggacugugaaaggca

SEQ ID NO: 5310 - RNA, 22 nt, Homo sapiens
ucaacugcuugagaucacaaau

SEQ ID NO: 5311 - RNA, 22 nt, Homo sapiens
agagaacugauuggaugugggc

SEQ ID NO: 5312 - RNA, 16 nt, Homo sapiens
ucaccccuagagaucc

SEQ ID NO: 5313 - RNA, 22 nt, Homo sapiens
uggucaguugugccucaauucc

SEQ ID NO: 5314 - RNA, 22 nt, Homo sapiens
ugagauaguuguagauguacau

SEQ ID NO: 5315 - RNA, 23 nt, Homo sapiens
uuccaccauugacuaguuacaua

SEQ ID NO: 5316 - RNA, 19 nt, Homo sapiens
uggcacauguauacuuaug

SEQ ID NO: 5317 - RNA, 22 nt, Homo sapiens
cguauccuguuuagcucuccca

SEQ ID NO: 5318 - RNA, 22 nt, Homo sapiens
cagugcuuguuauuguucuauu

SEQ ID NO: 5319 - RNA, 22 nt, Homo sapiens
uuugcugagucugacuucaugg

SEQ ID NO: 5320 - RNA, 22 nt, Homo sapiens
uugagauggagucuugcgcugu

SEQ ID NO: 5321 - RNA, 22 nt, Homo sapiens
acuguauagauggaguugauuu

SEQ ID NO: 5322 - RNA, 22 nt, Homo sapiens
ccaucacgugcaguggccccac

SEQ ID NO: 5323 - RNA, 22 nt, Homo sapiens
cacauagcuagucaguagugaa

SEQ ID NO: 5324 - RNA, 22 nt, Homo sapiens
uuuguacuucauugguucuacu

SEQ ID NO: 5325 - RNA, 22 nt, Homo sapiens
uuguccccacccaaaugucauc

SEQ ID NO: 5326 - RNA, 23 nt, Homo sapiens
uugacuguggguacaaugugaua

SEQ ID NO: 5327 - RNA, 22 nt, Homo sapiens
uugagauggagucuuguucuuu

SEQ ID NO: 5328 - RNA, 22 nt, Homo sapiens
acuuuguguuacccagcaagga

SEQ ID NO: 5329 - RNA, 22 nt, Homo sapiens
gcaguucuguaguugaaauuua

SEQ ID NO: 5330 - RNA, 22 nt, Homo sapiens
uuaaguagcugggcaugguggu

SEQ ID NO: 5331 - RNA, 22 nt, Homo sapiens
cuguauguuucuaugaauguga

SEQ ID NO: 5332 - RNA, 22 nt, Homo sapiens
gcuccuuugaguagcuucugug

SEQ ID NO: 5333 - RNA, 22 nt, Homo sapiens
uugcuuagucaugaaucacuga

SEQ ID NO: 5334 - RNA, 22 nt, Homo sapiens
ggacuagagaugagauuuuuca

SEQ ID NO: 5335 - RNA, 22 nt, Homo sapiens
uugugaaaucuaggcagagguu

SEQ ID NO: 5336 - RNA, 22 nt, Homo sapiens
ugguccucugcuuccagaauuc

SEQ ID NO: 5337 - RNA, 22 nt, Homo sapiens
cugauguagguggucugugauc

SEQ ID NO: 5338 - RNA, 22 nt, Homo sapiens
ccuugcacuucccaggugaggc

SEQ ID NO: 5339 - RNA, 22 nt, Homo sapiens
ugaacuguaagguauaggugau

SEQ ID NO: 5340 - RNA, 22 nt, Homo sapiens
aaaugcaguugguggggauaug

SEQ ID NO: 5341 - RNA, 22 nt, Homo sapiens
uguggccccuagcuacuagaga

SEQ ID NO: 5342 - RNA, 22 nt, Homo sapiens
gugaucuguccuucauagccug

SEQ ID NO: 5343 - RNA, 22 nt, Homo sapiens
uggucauggaaauagaaugcac

SEQ ID NO: 5344 - RNA, 22 nt, Homo sapiens
auaucccagugaugauugauag

SEQ ID NO: 5345 - RNA, 22 nt, Homo sapiens
uugauaguguccucuuuggcag

SEQ ID NO: 5346 - RNA, 22 nt, Homo sapiens
aagagguagaagcuugccuucu

SEQ ID NO: 5347 - RNA, 22 nt, Homo sapiens
uugaaagucauggcacaggcaa

SEQ ID NO: 5348 - RNA, 22 nt, Homo sapiens
gaagguaguuuauagauguggu

SEQ ID NO: 5349 - RNA, 22 nt, Homo sapiens
ugacuaguuuugcuguuguuau

SEQ ID NO: 5350 - RNA, 22 nt, Homo sapiens
guggacugggagagauaguucc

SEQ ID NO: 5351 - RNA, 20 nt, Homo sapiens
gugagguagaggguuaccug

SEQ ID NO: 5352 - RNA, 22 nt, Homo sapiens
uccccugagucaccugcuucuc

SEQ ID NO: 5353 - RNA, 22 nt, Homo sapiens
gaaaguaauuaacgauuguugc

SEQ ID NO: 5354 - RNA, 22 nt, Homo sapiens
cauauaguaggugcucuguguu

SEQ ID NO: 5355 - RNA, 22 nt, Homo sapiens
auuaagugcuugcagaagucca

SEQ ID NO: 5356 - RNA, 22 nt, Homo sapiens
gggagguuguauguaugcgggg

SEQ ID NO: 5357 - RNA, 22 nt, Homo sapiens
ugaaguaggcauaaguuaagcu

SEQ ID NO: 5358 - RNA, 22 nt, Homo sapiens
gugauuauccacgucuuuguga

SEQ ID NO: 5359 - RNA, 22 nt, Homo sapiens
gagaaccuccagcaagguagua

SEQ ID NO: 5360 - RNA, 22 nt, Homo sapiens
ugagcacagagccugggguggc

SEQ ID NO: 5361 - RNA, 22 nt, Homo sapiens
ucaccuuacuugcuucugaacu

SEQ ID NO: 5362 - RNA, 22 nt, Homo sapiens
ugucaugguagcaaggacgagg

SEQ ID NO: 5363 - RNA, 22 nt, Homo sapiens
ugugacuaguggugaaugacgc

SEQ ID NO: 5364 - RNA, 22 nt, Homo sapiens
auugcacuccagcccgggugac

SEQ ID NO: 5365 - RNA, 22 nt, Homo sapiens
uuggaaaaauccaccuugaucu

SEQ ID NO: 5366 - RNA, 22 nt, Homo sapiens
guaaucucagcuacuugggagg

SEQ ID NO: 5367 - RNA, 19 nt, Homo sapiens
cuggcaaaugcuuuggcca

SEQ ID NO: 5368 - RNA, 22 nt, Homo sapiens
cugauacugagaccuuggguua

SEQ ID NO: 5369 - RNA, 22 nt, Homo sapiens
uugucucacuggaguuuaguaa

SEQ ID NO: 5370 - RNA, 22 nt, Homo sapiens
ugagaaccucugugugcccacu

SEQ ID NO: 5371 - RNA, 22 nt, Homo sapiens
uuccaugagaugcaucaaagcu

SEQ ID NO: 5372 - RNA, 22 nt, Homo sapiens
uucauguaauauauuucaggcc

SEQ ID NO: 5373 - RNA, 22 nt, Homo sapiens
agcaaccagaggagaugaggcu

SEQ ID NO: 5374 - RNA, 20 nt, Homo sapiens
uaagcauaguugucaggguc

SEQ ID NO: 5375 - RNA, 22 nt, Homo sapiens
ugagauggguaauuaaauggug

SEQ ID NO: 5376 - RNA, 22 nt, Homo sapiens
cagcugaugucgaaugcacucu

SEQ ID NO: 5377 - RNA, 22 nt, Homo sapiens
caaccaguagcugaguucaaaa

SEQ ID NO: 5378 - RNA, 22 nt, Homo sapiens
aaugggacugacgccucccaga

SEQ ID NO: 5379 - RNA, 22 nt, Homo sapiens
aauaauggcaccaaagcacaag

SEQ ID NO: 5380 - RNA, 22 nt, Homo sapiens
augucauagaagccugugaacc

SEQ ID NO: 5381 - RNA, 22 nt, Homo sapiens
uugcaggcaugagccaccgugc

SEQ ID NO: 5382 - RNA, 22 nt, Homo sapiens
ucauggggugcuuugcuagauu

SEQ ID NO: 5383 - RNA, 19 nt, Homo sapiens
uuaagugugauaucucagu

SEQ ID NO: 5384 - RNA, 22 nt, Homo sapiens
uuggaaauguguuugcauucag

SEQ ID NO: 5385 - RNA, 22 nt, Homo sapiens
guaugcacauauguguauguau

SEQ ID NO: 5386 - RNA, 22 nt, Homo sapiens
ugagguguuaacuuuacuuuua

SEQ ID NO: 5387 - RNA, 21 nt, Homo sapiens
cacauggaggcagagagugua

SEQ ID NO: 5388 - RNA, 22 nt, Homo sapiens
acugcacuccggccucgugaca

SEQ ID NO: 5389 - RNA, 22 nt, Homo sapiens
gcugcuguuucucuuucagcau

SEQ ID NO: 5390 - RNA, 22 nt, Homo sapiens
uaccacugccgagaaaacagau

SEQ ID NO: 5391 - RNA, 18 nt, Homo sapiens
uagcaugaugcugagugc

SEQ ID NO: 5392 - RNA, 22 nt, Homo sapiens
auguguucaucacagcacaauu

SEQ ID NO: 5393 - RNA, 19 nt, Homo sapiens
ggaaugcuauucaaccuuu

SEQ ID NO: 5394 - RNA, 22 nt, Homo sapiens
ugaauauagacagggguagaga

SEQ ID NO: 5395 - RNA, 22 nt, Homo sapiens
auggagagaauuauucucucag

SEQ ID NO: 5396 - RNA, 22 nt, Homo sapiens
uggaauguuuaucaaaacagua

SEQ ID NO: 5397 - RNA, 23 nt, Homo sapiens
aggagcuuagaaguugccauugc

SEQ ID NO: 5398 - RNA, 22 nt, Homo sapiens
guugcuuauuccuguaauccca

SEQ ID NO: 5399 - RNA, 22 nt, Homo sapiens
guggcuuguaggggucaaggga

SEQ ID NO: 5400 - RNA, 22 nt, Homo sapiens
auuagggcaggagcaaguacgg

SEQ ID NO: 5401 - RNA, 22 nt, Homo sapiens
gaugacacugggucaaaucuca

SEQ ID NO: 5402 - RNA, 22 nt, Homo sapiens
guuggaauguauugcuacuucu

SEQ ID NO: 5403 - RNA, 22 nt, Homo sapiens
aucuuuggugcaugauacuuug

SEQ ID NO: 5404 - RNA, 22 nt, Homo sapiens
ugagaucuuuuguggcugagaa

SEQ ID NO: 5405 - RNA, 22 nt, Homo sapiens
acggcacugguggaaguguagc

SEQ ID NO: 5406 - RNA, 22 nt, Homo sapiens
uaaguagaggaaucauuuugug

SEQ ID NO: 5407 - RNA, 22 nt, Homo sapiens
cuacucugugguguauuugcau

SEQ ID NO: 5408 - RNA, 22 nt, Homo sapiens
gacaguuucucaggcuuccuua

SEQ ID NO: 5409 - RNA, 22 nt, Homo sapiens
ucauguaauuuugugucuauga

SEQ ID NO: 5410 - RNA, 22 nt, Homo sapiens
cacccuuagaguuggaaguggg

SEQ ID NO: 5411 - RNA, 22 nt, Homo sapiens
uccugcauucugacuugcuuuc

SEQ ID NO: 5412 - RNA, 22 nt, Homo sapiens
uggcccccucccaaaucucaua

SEQ ID NO: 5413 - RNA, 22 nt, Homo sapiens
agucaagaugagauuugggugg

SEQ ID NO: 5414 - RNA, 22 nt, Homo sapiens
ugaugguuuuauaagggagagu

SEQ ID NO: 5415 - RNA, 22 nt, Homo sapiens
ugcaauagcuucaggagaaggg

SEQ ID NO: 5416 - RNA, 22 nt, Homo sapiens
aagguggugucagagagcuuau

SEQ ID NO: 5417 - RNA, 22 nt, Homo sapiens
uacaguaguaucuucauuuguu

SEQ ID NO: 5418 - RNA, 22 nt, Homo sapiens
uggaauuaauuaaaauauacug

SEQ ID NO: 5419 - RNA, 22 nt, Homo sapiens
augcaauggaaaggacaauuac

SEQ ID NO: 5420 - RNA, 22 nt, Homo sapiens
uugucaaugggugagugcagag

SEQ ID NO: 5421 - RNA, 23 nt, Homo sapiens
cuccaugagccguccagggccug

SEQ ID NO: 5422 - RNA, 22 nt, Homo sapiens
ucaccuagacucgaucauguag

SEQ ID NO: 5423 - RNA, 22 nt, Homo sapiens
ucuuuuugagucaguuucggua

SEQ ID NO: 5424 - RNA, 22 nt, Homo sapiens
uaaagcacuuuuuucugcaugg

SEQ ID NO: 5425 - RNA, 22 nt, Homo sapiens
caccgagugacaguagccauca

SEQ ID NO: 5426 - RNA, 22 nt, Homo sapiens
auacugucucuugcuccugccc

SEQ ID NO: 5427 - RNA, 22 nt, Homo sapiens
ugaaagacugaagaauaggcau

SEQ ID NO: 5428 - RNA, 22 nt, Homo sapiens
ucacauggaaaaguccaguaaa

SEQ ID NO: 5429 - RNA, 22 nt, Homo sapiens
aauugcauugaauuuguagcuu

SEQ ID NO: 5430 - RNA, 22 nt, Homo sapiens
ugagacauauuauacugcuuuu

SEQ ID NO: 5431 - RNA, 22 nt, Homo sapiens
ugugcacaauguacagguuagu

SEQ ID NO: 5432 - RNA, 19 nt, Homo sapiens
uccccgggucuagugcagc

SEQ ID NO: 5433 - RNA, 22 nt, Homo sapiens
uucucuggucagaggggagguu

SEQ ID NO: 5434 - RNA, 22 nt, Homo sapiens
cacugcaguggaagauuaagaa

SEQ ID NO: 5435 - RNA, 22 nt, Homo sapiens
ccuggaagaaaggugcuaaaua

SEQ ID NO: 5436 - RNA, 22 nt, Homo sapiens
guggaagguaaugcagcuuacu

SEQ ID NO: 5437 - RNA, 22 nt, Homo sapiens
cuauuagguuggugcaaaagua

SEQ ID NO: 5438 - RNA, 22 nt, Homo sapiens
uugcacucuccagccucggcaa

SEQ ID NO: 5439 - RNA, 23 nt, Homo sapiens
uugaauguuuccccucccaaauu

SEQ ID NO: 5440 - RNA, 22 nt, Homo sapiens
uuacugcucuuuugucaugagu

SEQ ID NO: 5441 - RNA, 22 nt, Homo sapiens
guauaugccucaguuauagcac

SEQ ID NO: 5442 - RNA, 22 nt, Homo sapiens
gggguaggcuacacugaguucc

SEQ ID NO: 5443 - RNA, 22 nt, Homo sapiens
aagggaaugcuuccaguuugug

SEQ ID NO: 5444 - RNA, 22 nt, Homo sapiens
uguauuuguuguuaaauggaga

SEQ ID NO: 5445 - RNA, 22 nt, Homo sapiens
ugaucuguccaccucagcuucc

SEQ ID NO: 5446 - RNA, 22 nt, Homo sapiens
agucaaaugcuuauguauaaag

SEQ ID NO: 5447 - RNA, 19 nt, Homo sapiens
uuaagguacuuagaugugu

SEQ ID NO: 5448 - RNA, 22 nt, Homo sapiens
uacagaauauuucugcccugag

SEQ ID NO: 5449 - RNA, 22 nt, Homo sapiens
aucuugcauuugcuaaaaugca

SEQ ID NO: 5450 - RNA, 22 nt, Homo sapiens
uuaaggcauucuuugucuucau

SEQ ID NO: 5451 - RNA, 22 nt, Homo sapiens
cacugcacuccagucugacgac

SEQ ID NO: 5452 - RNA, 22 nt, Homo sapiens
ugagaugauaucuuauuguaau

SEQ ID NO: 5453 - RNA, 22 nt, Homo sapiens
ucagagugcagggaguagcagc

SEQ ID NO: 5454 - RNA, 22 nt, Homo sapiens
auccacauucauggaccagucc

SEQ ID NO: 5455 - RNA, 22 nt, Homo sapiens
uuggaaaugguaaaggguuaau

SEQ ID NO: 5456 - RNA, 22 nt, Homo sapiens
gaggcaagaguaguuaaguuag

SEQ ID NO: 5457 - RNA, 22 nt, Homo sapiens
cuacugacacuacugcaaucau

SEQ ID NO: 5458 - RNA, 22 nt, Homo sapiens
ggaaaucaucauucucgguaua

SEQ ID NO: 5459 - RNA, 22 nt, Homo sapiens
gagauuaauacacaucaaaugc

SEQ ID NO: 5460 - RNA, 22 nt, Homo sapiens
cuagcuuuugauguaaagugag

SEQ ID NO: 5461 - RNA, 22 nt, Homo sapiens
gauaugucuauuagcuugauug

SEQ ID NO: 5462 - RNA, 22 nt, Homo sapiens
uaacugccuacugugcaaauau

SEQ ID NO: 5463 - RNA, 22 nt, Homo sapiens
gaaucccuugcauuaucccuuu

SEQ ID NO: 5464 - RNA, 22 nt, Homo sapiens
ucacuauagaaaacagugugga

SEQ ID NO: 5465 - RNA, 22 nt, Homo sapiens
ugaacugagacuagacuuguuc

SEQ ID NO: 5466 - RNA, 22 nt, Homo sapiens
aucauaucauuggugaacagug

SEQ ID NO: 5467 - RNA, 22 nt, Homo sapiens
uuuguacacgugggugaauugu

SEQ ID NO: 5468 - RNA, 22 nt, Homo sapiens
cuucaguucuguaaggacagca

SEQ ID NO: 5469 - RNA, 22 nt, Homo sapiens
uucaguucugcacugaucuuag

SEQ ID NO: 5470 - RNA, 23 nt, Homo sapiens
auugcccuugaaggcuaaacucu

SEQ ID NO: 5471 - RNA, 22 nt, Homo sapiens
guacaggugcaggaugggcagg

SEQ ID NO: 5472 - RNA, 22 nt, Homo sapiens
auauggguuuuauauuaggcuc

SEQ ID NO: 5473 - RNA, 20 nt, Homo sapiens
uggaagccuggugcuaucuu

SEQ ID NO: 5474 - RNA, 22 nt, Homo sapiens
cuucuugagacuuaggcuuugg

SEQ ID NO: 5475 - RNA, 22 nt, Homo sapiens
uacauaguaagcacuaugccaa

SEQ ID NO: 5476 - RNA, 22 nt, Homo sapiens
ucccagugaaaccccaccuuca

SEQ ID NO: 5477 - RNA, 22 nt, Homo sapiens
ugcaccaucuugcuucuguggu

SEQ ID NO: 5478 - RNA, 16 nt, Homo sapiens
uacaauguagaaaaca

SEQ ID NO: 5479 - RNA, 22 nt, Homo sapiens
auggacguagauucucaaggau

SEQ ID NO: 5480 - RNA, 22 nt, Homo sapiens
augcacauggcuaacuuuuuuc

SEQ ID NO: 5481 - RNA, 22 nt, Homo sapiens
auaauguuuauccagaggaguu

SEQ ID NO: 5482 - RNA, 22 nt, Homo sapiens
guucaucagggauacuggcuua

SEQ ID NO: 5483 - RNA, 22 nt, Homo sapiens
uggcaccugacuccgagaugca

SEQ ID NO: 5484 - RNA, 15 nt, Homo sapiens
ggguccucucccaaa

SEQ ID NO: 5485 - RNA, 22 nt, Homo sapiens
ugagaugugaucaccugaaggg

SEQ ID NO: 5486 - RNA, 22 nt, Homo sapiens
aacacuguuuccagucaugauc

SEQ ID NO: 5487 - RNA, 22 nt, Homo sapiens
aacuggcauauucugguugcgg

SEQ ID NO: 5488 - RNA, 22 nt, Homo sapiens
cuuuuacacuguuggugggaau

SEQ ID NO: 5489 - RNA, 22 nt, Homo sapiens
uugcauguacguacagagagag

SEQ ID NO: 5490 - RNA, 20 nt, Homo sapiens
uagacagcuagauuagauag

SEQ ID NO: 5491 - RNA, 22 nt, Homo sapiens
auaucacucccaauaucgcagg

SEQ ID NO: 5492 - RNA, 22 nt, Homo sapiens
uggaagauggaguuuuaucauu

SEQ ID NO: 5493 - RNA, 21 nt, Homo sapiens
ucuggccccuccaaaucucau

SEQ ID NO: 5494 - RNA, 22 nt, Homo sapiens
auauuggccuaaaauucucuuu

SEQ ID NO: 5495 - RNA, 22 nt, Homo sapiens
gagggcacugcuuuccuuucaa

SEQ ID NO: 5496 - RNA, 22 nt, Homo sapiens
ugauuuguccauguggcacgug

SEQ ID NO: 5497 - RNA, 22 nt, Homo sapiens
uauugcacuccucaugcauuug

SEQ ID NO: 5498 - RNA, 22 nt, Homo sapiens
guuccuuguagaugcuggauau

SEQ ID NO: 5499 - RNA, 22 nt, Homo sapiens
aguauuaguuuaugggugugga

SEQ ID NO: 5500 - RNA, 22 nt, Homo sapiens
uucucacaguacagggagcucu

SEQ ID NO: 5501 - RNA, 22 nt, Homo sapiens
caagugcuacagagaaaucuuu

SEQ ID NO: 5502 - RNA, 22 nt, Homo sapiens
aaguccccugacagaggggagg

SEQ ID NO: 5503 - RNA, 22 nt, Homo sapiens
ugacuucauuugguaauugggu

SEQ ID NO: 5504 - RNA, 22 nt, Homo sapiens
uuagcaauugauucucauaagc

SEQ ID NO: 5505 - RNA, 22 nt, Homo sapiens
agcuucauucugaauagguuga

SEQ ID NO: 5506 - RNA, 22 nt, Homo sapiens
aacccugagucaugagucuaga

SEQ ID NO: 5507 - RNA, 22 nt, Homo sapiens
uagcuucuccauagcuccaugu

SEQ ID NO: 5508 - RNA, 21 nt, Homo sapiens
augguacugucucuggagaua

SEQ ID NO: 5509 - RNA, 22 nt, Homo sapiens
ggcaagaaaaugcaauuacugu

SEQ ID NO: 5510 - RNA, 22 nt, Homo sapiens
ugaaaugccuugagauuuugac

SEQ ID NO: 5511 - RNA, 22 nt, Homo sapiens
uggcaagaaccacaauuacuuu

SEQ ID NO: 5512 - RNA, 22 nt, Homo sapiens
uguaacaguaguuacuauucuu

SEQ ID NO: 5513 - RNA, 20 nt, Homo sapiens
uauugccuaaauaccagaau

SEQ ID NO: 5514 - RNA, 22 nt, Homo sapiens
ucagaguaguuccuggcagaaa

SEQ ID NO: 5515 - RNA, 22 nt, Homo sapiens
cauuugguggcuacagaguaac

SEQ ID NO: 5516 - RNA, 22 nt, Homo sapiens
ucucacagaguugaacuuucuu

SEQ ID NO: 5517 - RNA, 22 nt, Homo sapiens
uaccagcauuucucuuuaagua

SEQ ID NO: 5518 - RNA, 22 nt, Homo sapiens
ugagagacaguuucgucggagg

SEQ ID NO: 5519 - RNA, 22 nt, Homo sapiens
augacauagcauggugccugcu

SEQ ID NO: 5520 - RNA, 22 nt, Homo sapiens
ggggcaaaaugccacgagucuc

SEQ ID NO: 5521 - RNA, 23 nt, Homo sapiens
uucggcaaaugcccuuuaggcag

SEQ ID NO: 5522 - RNA, 22 nt, Homo sapiens
agauauuuguuaggucugucag

SEQ ID NO: 5523 - RNA, 18 nt, Homo sapiens
agaugguguugcuucugu

SEQ ID NO: 5524 - RNA, 22 nt, Homo sapiens
ugagacggagucuugcuaaguu

SEQ ID NO: 5525 - RNA, 22 nt, Homo sapiens
ucugauggaguugccagggaga

SEQ ID NO: 5526 - RNA, 22 nt, Homo sapiens
aagugcuuacagggaacaugau

SEQ ID NO: 5527 - RNA, 22 nt, Homo sapiens
aucugcaaauaaugaagauugg

SEQ ID NO: 5528 - RNA, 22 nt, Homo sapiens
gcacugagagaagccccaagua

SEQ ID NO: 5529 - RNA, 22 nt, Homo sapiens
cuggcaucuaaauacuugaugu

SEQ ID NO: 5530 - RNA, 22 nt, Homo sapiens
gacauagcuagauaaccucaug

SEQ ID NO: 5531 - RNA, 22 nt, Homo sapiens
gcuuggugugcaagugguacua

SEQ ID NO: 5532 - RNA, 16 nt, Homo sapiens
agcagguuuuucugca

SEQ ID NO: 5533 - RNA, 22 nt, Homo sapiens
ucugccacugucauugugugau

SEQ ID NO: 5534 - RNA, 22 nt, Homo sapiens
ugcaagaggagacuguacucag

SEQ ID NO: 5535 - RNA, 22 nt, Homo sapiens
accacaggguaaaguuagauau

SEQ ID NO: 5536 - RNA, 22 nt, Homo sapiens
ugauauguagguggcaagcaua

SEQ ID NO: 5537 - RNA, 22 nt, Homo sapiens
uggcgagaaaccauaugcuuuc

SEQ ID NO: 5538 - RNA, 21 nt, Homo sapiens
ggcaagaaacacaaucaagua

SEQ ID NO: 5539 - RNA, 22 nt, Homo sapiens
aggaagugugcaauuaauuucu

SEQ ID NO: 5540 - RNA, 22 nt, Homo sapiens
ggcaguuucucaggcaggggua

SEQ ID NO: 5541 - RNA, 22 nt, Homo sapiens
uaacaggcuacucuugcauugc

SEQ ID NO: 5542 - RNA, 22 nt, Homo sapiens
acuaugagacgaaugcaucagu

SEQ ID NO: 5543 - RNA, 22 nt, Homo sapiens
aagcuggauuucgcauccuguu

SEQ ID NO: 5544 - RNA, 22 nt, Homo sapiens
ucacacucucaccaacauuugg

SEQ ID NO: 5545 - RNA, 22 nt, Homo sapiens
ucccuacugggguacugccuag

SEQ ID NO: 5546 - RNA, 22 nt, Homo sapiens
uuaaguuaggcuucagcagucu

SEQ ID NO: 5547 - RNA, 22 nt, Homo sapiens
ccuuggcacuacugacauugua

SEQ ID NO: 5548 - RNA, 22 nt, Homo sapiens
uaagguauuuacauuucuguuu

SEQ ID NO: 5549 - RNA, 21 nt, Homo sapiens
ugcuuuggucauacuucuucc

SEQ ID NO: 5550 - RNA, 22 nt, Homo sapiens
uaaugcuaucugggccaggggu

SEQ ID NO: 5551 - RNA, 22 nt, Homo sapiens
ugaucuguguauauugaaccag

SEQ ID NO: 5552 - RNA, 22 nt, Homo sapiens
cauacaguaggcacuauuugua

SEQ ID NO: 5553 - RNA, 22 nt, Homo sapiens
uuaagccacucaagagauagag

SEQ ID NO: 5554 - RNA, 16 nt, Homo sapiens
uuucccuuugguguuu

SEQ ID NO: 5555 - RNA, 22 nt, Homo sapiens
augagagcaacaccuucacuug

SEQ ID NO: 5556 - RNA, 22 nt, Homo sapiens
aggcaacgugcauuucuggugu

SEQ ID NO: 5557 - RNA, 22 nt, Homo sapiens
uugugcuacugaguuggggugg

SEQ ID NO: 5558 - RNA, 22 nt, Homo sapiens
agagcuguguuuuaacuuuuua

SEQ ID NO: 5559 - RNA, 22 nt, Homo sapiens
auauagcaaugaaagagaugaa

SEQ ID NO: 5560 - RNA, 22 nt, Homo sapiens
uacucaguaagugcuggcugcu

SEQ ID NO: 5561 - RNA, 22 nt, Homo sapiens
uuugugcuccuaugagaaucua

SEQ ID NO: 5562 - RNA, 22 nt, Homo sapiens
gggagugugcacacaugguaua

SEQ ID NO: 5563 - RNA, 22 nt, Homo sapiens
ucacauggaggugauaguugaa

SEQ ID NO: 5564 - RNA, 22 nt, Homo sapiens
augccuaagacccuguggggga

SEQ ID NO: 5565 - RNA, 22 nt, Homo sapiens
guucaguuuuaaagggaaauug

SEQ ID NO: 5566 - RNA, 22 nt, Homo sapiens
ugcaaguaauuccagcuacuga

SEQ ID NO: 5567 - RNA, 20 nt, Homo sapiens
ugacaguuaagggauagaag

SEQ ID NO: 5568 - RNA, 22 nt, Homo sapiens
uaaguuguagaacguuuucuua

SEQ ID NO: 5569 - RNA, 22 nt, Homo sapiens
gugagguacgugucaagaacca

SEQ ID NO: 5570 - RNA, 22 nt, Homo sapiens
aagugaaugugcuggaauagcu

SEQ ID NO: 5571 - RNA, 22 nt, Homo sapiens
auuaaguuaggauuuugagaua

SEQ ID NO: 5572 - RNA, 23 nt, Homo sapiens
uccuugguuggcgcccuaugugu

SEQ ID NO: 5573 - RNA, 22 nt, Homo sapiens
auggaagaauugucggggaugu

SEQ ID NO: 5574 - RNA, 22 nt, Homo sapiens
cugagaacaucauucagauauu

SEQ ID NO: 5575 - RNA, 22 nt, Homo sapiens
cuccauuuaucugaaauuuuau

SEQ ID NO: 5576 - RNA, 22 nt, Homo sapiens
uugugaucauugucaaauagug

SEQ ID NO: 5577 - RNA, 22 nt, Homo sapiens
agcagcaucgggaaguuggcca

SEQ ID NO: 5578 - RNA, 22 nt, Homo sapiens
uuguuaugggguggcuugaaag

SEQ ID NO: 5579 - RNA, 23 nt, Homo sapiens
aggaauggaaaaccaaguaucau

SEQ ID NO: 5580 - RNA, 21 nt, Homo sapiens
ucaucagucaaagacaauggu

SEQ ID NO: 5581 - RNA, 22 nt, Homo sapiens
ucacuguguauguauaugcagg

SEQ ID NO: 5582 - RNA, 22 nt, Homo sapiens
aacaucaaccaugaggguugga

SEQ ID NO: 5583 - RNA, 20 nt, Homo sapiens
aagacacuguccccacugga

SEQ ID NO: 5584 - RNA, 22 nt, Homo sapiens
agaucacagucuuugguuuuag

SEQ ID NO: 5585 - RNA, 22 nt, Homo sapiens
uagacccauuguucagagagug

SEQ ID NO: 5586 - RNA, 22 nt, Homo sapiens
uggaccccuucuccuauuaaaa

SEQ ID NO: 5587 - RNA, 22 nt, Homo sapiens
auaaaugcuuagaucuguauau

SEQ ID NO: 5588 - RNA, 22 nt, Homo sapiens
cugagaauguaaaugaagcuuu

SEQ ID NO: 5589 - RNA, 22 nt, Homo sapiens
uaaguacaugcuagauggaaug

SEQ ID NO: 5590 - RNA, 22 nt, Homo sapiens
auaguagagagggcaaaaugcu

SEQ ID NO: 5591 - RNA, 22 nt, Homo sapiens
aagugaauucauuguguuauau

SEQ ID NO: 5592 - RNA, 22 nt, Homo sapiens
agaauacugucuauucauggua

SEQ ID NO: 5593 - RNA, 19 nt, Homo sapiens
uggaacugauucaguucug

SEQ ID NO: 5594 - RNA, 22 nt, Homo sapiens
gagagaguacuugauauaauuu

SEQ ID NO: 5595 - RNA, 22 nt, Homo sapiens
aaacaccacgcggucccucgga

SEQ ID NO: 5596 - RNA, 22 nt, Homo sapiens
cugaggugauauauacauauuu

SEQ ID NO: 5597 - RNA, 22 nt, Homo sapiens
uguucaugaguucucauuuuua

SEQ ID NO: 5598 - RNA, 23 nt, Homo sapiens
ucaugguagcaccaacaauaacu

SEQ ID NO: 5599 - RNA, 22 nt, Homo sapiens
guggaaaucucugugugacuua

SEQ ID NO: 5600 - RNA, 21 nt, Homo sapiens
ugagauuaaguuguuuagaag

SEQ ID NO: 5601 - RNA, 22 nt, Homo sapiens
aauggccuuuuucauuauacug

SEQ ID NO: 5602 - RNA, 17 nt, Homo sapiens
uaaagccagucaaguca

SEQ ID NO: 5603 - RNA, 22 nt, Homo sapiens
gugaacaauguuuuauccuggg

SEQ ID NO: 5604 - RNA, 22 nt, Homo sapiens
ugcucaccugcugcucaccucc

SEQ ID NO: 5605 - RNA, 22 nt, Homo sapiens
uauggcucuauuuccuugucua

SEQ ID NO: 5606 - RNA, 22 nt, Homo sapiens
uauaucacaugcacucauuuuc

SEQ ID NO: 5607 - RNA, 22 nt, Homo sapiens
uaucauggaaugagguuggaca

SEQ ID NO: 5608 - RNA, 22 nt, Homo sapiens
uugaguuuaucuaaagaccugg

SEQ ID NO: 5609 - RNA, 22 nt, Homo sapiens
aggcacgguggcucacaccugu

SEQ ID NO: 5610 - RNA, 22 nt, Homo sapiens
uacagugcuuuuugguggagaa

SEQ ID NO: 5611 - RNA, 18 nt, Homo sapiens
aucagggugaagagagga

SEQ ID NO: 5612 - RNA, 22 nt, Homo sapiens
ucacuguugaugggcaugcagg

SEQ ID NO: 5613 - RNA, 22 nt, Homo sapiens
ggcacgguggcucacaccugua

SEQ ID NO: 5614 - RNA, 22 nt, Homo sapiens
gugcacaugguagguauugagu

SEQ ID NO: 5615 - RNA, 22 nt, Homo sapiens
ucuggcuucugacuuaggggac

SEQ ID NO: 5616 - RNA, 22 nt, Homo sapiens
ucuuugggauauucugaaaggg

SEQ ID NO: 5617 - RNA, 22 nt, Homo sapiens
gucucuugguuuagagcauuua

SEQ ID NO: 5618 - RNA, 22 nt, Homo sapiens
uaggugcacaguaaauauaugu

SEQ ID NO: 5619 - RNA, 22 nt, Homo sapiens
auugcacuccagccugggcaac

SEQ ID NO: 5620 - RNA, 22 nt, Homo sapiens
augaugucauuuuaauuucuaa

SEQ ID NO: 5621 - RNA, 22 nt, Homo sapiens
caggcuuuuccacacauggguu

SEQ ID NO: 5622 - RNA, 22 nt, Homo sapiens
uugcaguacuucuggcuuuaca

SEQ ID NO: 5623 - RNA, 22 nt, Homo sapiens
cuaggcacugauaguuguauuu

SEQ ID NO: 5624 - RNA, 22 nt, Homo sapiens
uuaggcaguuuauugauuuuca

SEQ ID NO: 5625 - RNA, 22 nt, Homo sapiens
ucuuuuggguauggagccauca

SEQ ID NO: 5626 - RNA, 22 nt, Homo sapiens
agggcaguguuaggacugucug

SEQ ID NO: 5627 - RNA, 22 nt, Homo sapiens
aauuggcagugcucuugccaca

SEQ ID NO: 5628 - RNA, 22 nt, Homo sapiens
augagcucauugggugacuggg

SEQ ID NO: 5629 - RNA, 22 nt, Homo sapiens
agcgacauugguugcuuugguu

SEQ ID NO: 5630 - RNA, 22 nt, Homo sapiens
uccagguuucaugcucuuuauu

SEQ ID NO: 5631 - RNA, 22 nt, Homo sapiens
cugcauuugaugacguauggug

SEQ ID NO: 5632 - RNA, 22 nt, Homo sapiens
acucagagauuagcacauguuu

SEQ ID NO: 5633 - RNA, 22 nt, Homo sapiens
uacaugugcacaacgugcaggu

SEQ ID NO: 5634 - RNA, 22 nt, Homo sapiens
gugagcacugaaagaaggcaag

SEQ ID NO: 5635 - RNA, 22 nt, Homo sapiens
uaucugguuauugcugcugauu

SEQ ID NO: 5636 - RNA, 22 nt, Homo sapiens
gaauagugcugcaguaaacaua

SEQ ID NO: 5637 - RNA, 22 nt, Homo sapiens
aucauagcucacugcagccucg

SEQ ID NO: 5638 - RNA, 22 nt, Homo sapiens
ugucagggaggcucggccgcac

SEQ ID NO: 5639 - RNA, 22 nt, Homo sapiens
ggcaaugaggcggaccagcagg

SEQ ID NO: 5640 - RNA, 22 nt, Homo sapiens
acacuuucuagacaagggaaua

SEQ ID NO: 5641 - RNA, 22 nt, Homo sapiens
agcuucauuguuaugaauguca

SEQ ID NO: 5642 - RNA, 22 nt, Homo sapiens
uggaacugauauugauggaaaa

SEQ ID NO: 5643 - RNA, 22 nt, Homo sapiens
gugaaguuuuugugaggccuaa

SEQ ID NO: 5644 - RNA, 22 nt, Homo sapiens
uggaagucaugcugcaagaaca

SEQ ID NO: 5645 - RNA, 22 nt, Homo sapiens
acugcacuccagccucggggac

SEQ ID NO: 5646 - RNA, 22 nt, Homo sapiens
uugaauguacuuguucucacua

SEQ ID NO: 5647 - RNA, 22 nt, Homo sapiens
uuccuugguucagggaaggucc

SEQ ID NO: 5648 - RNA, 22 nt, Homo sapiens
cacauugcaggaaaguucauua

SEQ ID NO: 5649 - RNA, 22 nt, Homo sapiens
ucugugaaaucauuuccuguaa

SEQ ID NO: 5650 - RNA, 19 nt, Homo sapiens
ugaccagggacagaaacca

SEQ ID NO: 5651 - RNA, 22 nt, Homo sapiens
ugcaccacugcuagccugggua

SEQ ID NO: 5652 - RNA, 21 nt, Homo sapiens
cacugcaucacaggacagcau

SEQ ID NO: 5653 - RNA, 21 nt, Homo sapiens
aggcuguuguuuugggaugga

SEQ ID NO: 5654 - RNA, 22 nt, Homo sapiens
agguagguugagaugggcauca

SEQ ID NO: 5655 - RNA, 22 nt, Homo sapiens
uugaguauuggacugguaucuu

SEQ ID NO: 5656 - RNA, 19 nt, Homo sapiens
uuuagaucuuuuaugcagc

SEQ ID NO: 5657 - RNA, 22 nt, Homo sapiens
ucuuugauuuuguuacuaagac

SEQ ID NO: 5658 - RNA, 22 nt, Homo sapiens
gugggaugaucgcuugagccca

SEQ ID NO: 5659 - RNA, 22 nt, Homo sapiens
uugcucaccugagaagaauaga

SEQ ID NO: 5660 - RNA, 18 nt, Homo sapiens
ucacaaccacagugcugu

SEQ ID NO: 5661 - RNA, 23 nt, Homo sapiens
ugggauguuuuuggaaacuucug

SEQ ID NO: 5662 - RNA, 22 nt, Homo sapiens
gugaaugaaugggugaauacau

SEQ ID NO: 5663 - RNA, 22 nt, Homo sapiens
agguccacuuacuacuccuguu

SEQ ID NO: 5664 - RNA, 22 nt, Homo sapiens
ugagauggaguuucgcccuugu

SEQ ID NO: 5665 - RNA, 22 nt, Homo sapiens
auaaaguagaggugaggugcau

SEQ ID NO: 5666 - RNA, 22 nt, Homo sapiens
uugaaagaugaacuggauugga

SEQ ID NO: 5667 - RNA, 22 nt, Homo sapiens
auggaacuggagaugguuauau

SEQ ID NO: 5668 - RNA, 22 nt, Homo sapiens
gaguuuguaaacuauucacuaa

SEQ ID NO: 5669 - RNA, 22 nt, Homo sapiens
ccaggguugcuuuagauucuga

SEQ ID NO: 5670 - RNA, 22 nt, Homo sapiens
uguuacagcagaauugaaagag

SEQ ID NO: 5671 - RNA, 18 nt, Homo sapiens
uagagcacaagcuuuggc

SEQ ID NO: 5672 - RNA, 22 nt, Homo sapiens
acugcacuccacccuuggcagc

SEQ ID NO: 5673 - RNA, 22 nt, Homo sapiens
uuggacagaugguuacauuuuu

SEQ ID NO: 5674 - RNA, 22 nt, Homo sapiens
aaguguaaguuaauguuuaggu

SEQ ID NO: 5675 - RNA, 22 nt, Homo sapiens
cugagacuggguaauguauaaa

SEQ ID NO: 5676 - RNA, 22 nt, Homo sapiens
auaugcacaguggaguacuauu

SEQ ID NO: 5677 - RNA, 22 nt, Homo sapiens
acgugccuuguuguucauauga

SEQ ID NO: 5678 - RNA, 22 nt, Homo sapiens
ugagauaaggaaauugaggcuc

SEQ ID NO: 5679 - RNA, 21 nt, Homo sapiens
aagugcucugggacucuaaau

SEQ ID NO: 5680 - RNA, 22 nt, Homo sapiens
uuuuacacuguugguuggaaug

SEQ ID NO: 5681 - RNA, 22 nt, Homo sapiens
augguauuuugugauaccuugu

SEQ ID NO: 5682 - RNA, 22 nt, Homo sapiens
auggacuuuuuguucagugucu

SEQ ID NO: 5683 - RNA, 23 nt, Homo sapiens
uaugacagaggaagggggagcug

SEQ ID NO: 5684 - RNA, 22 nt, Homo sapiens
uggcuguuguuacuaacaguuc

SEQ ID NO: 5685 - RNA, 22 nt, Homo sapiens
augagucacuuauuauuggggu

SEQ ID NO: 5686 - RNA, 22 nt, Homo sapiens
ugugggaggugcuaauguaaau

SEQ ID NO: 5687 - RNA, 22 nt, Homo sapiens
uauacugucuuuguaugccuag

SEQ ID NO: 5688 - RNA, 22 nt, Homo sapiens
uugagcaauccuccugccaugu

SEQ ID NO: 5689 - RNA, 22 nt, Homo sapiens
ggaucuauuucaugauaaccuu

SEQ ID NO: 5690 - RNA, 22 nt, Homo sapiens
acccugaagccaugaguggaac

SEQ ID NO: 5691 - RNA, 22 nt, Homo sapiens
ucacaguagggaacugacaaag

SEQ ID NO: 5692 - RNA, 22 nt, Homo sapiens
uacguuguuugagggcaggagu

SEQ ID NO: 5693 - RNA, 16 nt, Homo sapiens
uaagccccacgugcau

SEQ ID NO: 5694 - RNA, 22 nt, Homo sapiens
uauuccucuuuguugagguuau

SEQ ID NO: 5695 - RNA, 22 nt, Homo sapiens
ggacaguagugcuuucuaucau

SEQ ID NO: 5696 - RNA, 22 nt, Homo sapiens
guggggucaucucauuugugga

SEQ ID NO: 5697 - RNA, 22 nt, Homo sapiens
uuagugcugaguggaauguucu

SEQ ID NO: 5698 - RNA, 22 nt, Homo sapiens
aaggcagugugcacauaacacu

SEQ ID NO: 5699 - RNA, 22 nt, Homo sapiens
cucugguuucgcaggaaauaga

SEQ ID NO: 5700 - RNA, 22 nt, Homo sapiens
aagggagcugcauaaucuugug

SEQ ID NO: 5701 - RNA, 22 nt, Homo sapiens
agcuccuuucugcagguagguu

SEQ ID NO: 5702 - RNA, 22 nt, Homo sapiens
uacguuaucagguaugcaagag

SEQ ID NO: 5703 - RNA, 22 nt, Homo sapiens
guugcaauugauguaugucuga

SEQ ID NO: 5704 - RNA, 22 nt, Homo sapiens
auaaggcugguauagacauuca

SEQ ID NO: 5705 - RNA, 22 nt, Homo sapiens
uaggacacagauggagaaaagc

SEQ ID NO: 5706 - RNA, 23 nt, Homo sapiens
guaauacuagucauaguagcagg

SEQ ID NO: 5707 - RNA, 22 nt, Homo sapiens
gaggucaugucgggccccagga

SEQ ID NO: 5708 - RNA, 22 nt, Homo sapiens
ucacacugaaacuaggguguga

SEQ ID NO: 5709 - RNA, 22 nt, Homo sapiens
gaucagagugaaccuuguuaug

SEQ ID NO: 5710 - RNA, 22 nt, Homo sapiens
uguugcacacacugaaauacac

SEQ ID NO: 5711 - RNA, 22 nt, Homo sapiens
uuagcagcucuaauaacugcua

SEQ ID NO: 5712 - RNA, 21 nt, Homo sapiens
uacuggagauacagucugcaa

SEQ ID NO: 5713 - RNA, 22 nt, Homo sapiens
cucacagugacacgaaccccca

SEQ ID NO: 5714 - RNA, 22 nt, Homo sapiens
uaaguagugugcauguauguau

SEQ ID NO: 5715 - RNA, 23 nt, Homo sapiens
agauggcauuucaguucuuuagg

SEQ ID NO: 5716 - RNA, 22 nt, Homo sapiens
aggguaguaggcuugggauugg

SEQ ID NO: 5717 - RNA, 22 nt, Homo sapiens
auaguagcaugcacuggugcug

SEQ ID NO: 5718 - RNA, 22 nt, Homo sapiens
aaaguacugggauuggccgggu

SEQ ID NO: 5719 - RNA, 22 nt, Homo sapiens
agcaggauuguuacaauaguaa

SEQ ID NO: 5720 - RNA, 22 nt, Homo sapiens
uauggucuuugagaggugacug

SEQ ID NO: 5721 - RNA, 22 nt, Homo sapiens
auaggucaucaugggaguggga

SEQ ID NO: 5722 - RNA, 19 nt, Homo sapiens
uagcuagauuggguacuua

SEQ ID NO: 5723 - RNA, 22 nt, Homo sapiens
ugauggcaauggcauucauuuu

SEQ ID NO: 5724 - RNA, 22 nt, Homo sapiens
agugacaugggaucaaaucuga

SEQ ID NO: 5725 - RNA, 22 nt, Homo sapiens
ugacaaguaaacagucagcacc

SEQ ID NO: 5726 - RNA, 22 nt, Homo sapiens
cuccgggugcgucggcgcccug

SEQ ID NO: 5727 - RNA, 22 nt, Homo sapiens
ggucaggagaaugguaacugag

SEQ ID NO: 5728 - RNA, 22 nt, Homo sapiens
ugacagugugagauccugucuc

SEQ ID NO: 5729 - RNA, 22 nt, Homo sapiens
cauugcacuccagcccagguga

SEQ ID NO: 5730 - RNA, 22 nt, Homo sapiens
uggcuacugaccugcuaggggg

SEQ ID NO: 5731 - RNA, 22 nt, Homo sapiens
uuggccuccuggucauauccag

SEQ ID NO: 5732 - RNA, 18 nt, Homo sapiens
augaacucaucauuuuuu

SEQ ID NO: 5733 - RNA, 22 nt, Homo sapiens
cauugcacuccagccucggcaa

SEQ ID NO: 5734 - RNA, 22 nt, Homo sapiens
uauugcacuccagccuuggcaa

SEQ ID NO: 5735 - RNA, 22 nt, Homo sapiens
uuaaugaacuuuauuuuguaga

SEQ ID NO: 5736 - RNA, 22 nt, Homo sapiens
auauuagguuggugcaaaagua

SEQ ID NO: 5737 - RNA, 22 nt, Homo sapiens
gagaacugagugugcuggcgga

SEQ ID NO: 5738 - RNA, 22 nt, Homo sapiens
uuucagcguggggugcugaaga

SEQ ID NO: 5739 - RNA, 22 nt, Homo sapiens
ugucauguugagaaacuuggau

SEQ ID NO: 5740 - RNA, 18 nt, Homo sapiens
agaugcaugcucacuaca

SEQ ID NO: 5741 - RNA, 18 nt, Homo sapiens
ucaagcuauugucaugcc

SEQ ID NO: 5742 - RNA, 22 nt, Homo sapiens
ucauggggugagcuacaggcac

SEQ ID NO: 5743 - RNA, 22 nt, Homo sapiens
guaacccuguaggccuaaagua

SEQ ID NO: 5744 - RNA, 22 nt, Homo sapiens
uuuauguggagcacuugacaca

SEQ ID NO: 5745 - RNA, 22 nt, Homo sapiens
cauugcaguaagagugggcucu

SEQ ID NO: 5746 - RNA, 22 nt, Homo sapiens
uuugcaguguaguuggccagca

SEQ ID NO: 5747 - RNA, 20 nt, Homo sapiens
uaacuguggcuucuuuuggc

SEQ ID NO: 5748 - RNA, 22 nt, Homo sapiens
uagagaucuuauauuuuaugac

SEQ ID NO: 5749 - RNA, 22 nt, Homo sapiens
gcuaaggcagggcaaucauuug

SEQ ID NO: 5750 - RNA, 22 nt, Homo sapiens
agcaccauugcacuccagccug

SEQ ID NO: 5751 - RNA, 22 nt, Homo sapiens
agacuagagcagagcccucucu

SEQ ID NO: 5752 - RNA, 22 nt, Homo sapiens
uuguccuggagguucuugcaag

SEQ ID NO: 5753 - RNA, 22 nt, Homo sapiens
cagguagucaacgggucuugga

SEQ ID NO: 5754 - RNA, 22 nt, Homo sapiens
uuggacugggauggccgaggcu

SEQ ID NO: 5755 - RNA, 22 nt, Homo sapiens
ggcaccacagacgccaggcgug

SEQ ID NO: 5756 - RNA, 22 nt, Homo sapiens
gauuagaacagaagucagauua

SEQ ID NO: 5757 - RNA, 22 nt, Homo sapiens
auaucugcauugccauuuaugu

SEQ ID NO: 5758 - RNA, 22 nt, Homo sapiens
ucuuugauaagauccagaagaa

SEQ ID NO: 5759 - RNA, 22 nt, Homo sapiens
cucucugagccauggcugcccu

SEQ ID NO: 5760 - RNA, 22 nt, Homo sapiens
gugucccagugugcauacaggu

SEQ ID NO: 5761 - RNA, 22 nt, Homo sapiens
ugcaagaaucagccuaucauua

SEQ ID NO: 5762 - RNA, 22 nt, Homo sapiens
uggaagucuucauuauguauag

SEQ ID NO: 5763 - RNA, 22 nt, Homo sapiens
uccgcagugucccucagaguga

SEQ ID NO: 5764 - RNA, 22 nt, Homo sapiens
ggucuagagagagggguggacu

SEQ ID NO: 5765 - RNA, 22 nt, Homo sapiens
uaggcacuguguuuguaggagu

SEQ ID NO: 5766 - RNA, 16 nt, Homo sapiens
uuugcaagaucagaag

SEQ ID NO: 5767 - RNA, 22 nt, Homo sapiens
ugcauuguaggauguuuagcag

SEQ ID NO: 5768 - RNA, 22 nt, Homo sapiens
uugggccacuuuaguuuccuua

SEQ ID NO: 5769 - RNA, 22 nt, Homo sapiens
uguagguguacauacaugguua

SEQ ID NO: 5770 - RNA, 22 nt, Homo sapiens
cucuuugaugugaaccgugguu

SEQ ID NO: 5771 - RNA, 22 nt, Homo sapiens
cagugcauagaugugccacauu

SEQ ID NO: 5772 - RNA, 22 nt, Homo sapiens
cuagaauguauaaaaccaagcu

SEQ ID NO: 5773 - RNA, 17 nt, Homo sapiens
ucccuguuuuuucaguc

SEQ ID NO: 5774 - RNA, 22 nt, Homo sapiens
ugcacacucuguaugagaaucu

SEQ ID NO: 5775 - RNA, 22 nt, Homo sapiens
auuguacuccagccugggcgac

SEQ ID NO: 5776 - RNA, 22 nt, Homo sapiens
augguugguuaaaucuguguau

SEQ ID NO: 5777 - RNA, 22 nt, Homo sapiens
ccauggcaauggucagucuauu

SEQ ID NO: 5778 - RNA, 22 nt, Homo sapiens
ucucugauuaaacaagauagug

SEQ ID NO: 5779 - RNA, 22 nt, Homo sapiens
ugacuagugugauguaguaaau

SEQ ID NO: 5780 - RNA, 22 nt, Homo sapiens
uaggugaauguaguaagguguu

SEQ ID NO: 5781 - RNA, 22 nt, Homo sapiens
ugcaugcaucuuuuauaguagc

SEQ ID NO: 5782 - RNA, 22 nt, Homo sapiens
cugaaauguccaucgacugaug

SEQ ID NO: 5783 - RNA, 22 nt, Homo sapiens
gacuaaugaaagagugugauau

SEQ ID NO: 5784 - RNA, 22 nt, Homo sapiens
uagcuaaauucagcucuaggua

SEQ ID NO: 5785 - RNA, 22 nt, Homo sapiens
uuuggcccccagcucaggacau

SEQ ID NO: 5786 - RNA, 18 nt, Homo sapiens
aggagcauagugcuauga

SEQ ID NO: 5787 - RNA, 22 nt, Homo sapiens
auggaacuggagaucauuaugu

SEQ ID NO: 5788 - RNA, 22 nt, Homo sapiens
agagcuaguauuuacggagcau

SEQ ID NO: 5789 - RNA, 22 nt, Homo sapiens
uagugcuguaauucuaaugaaa

SEQ ID NO: 5790 - RNA, 22 nt, Homo sapiens
agaaacauucucuugccuccuu

SEQ ID NO: 5791 - RNA, 22 nt, Homo sapiens
cuaugagcuuuuuuaagccuca

SEQ ID NO: 5792 - RNA, 22 nt, Homo sapiens
ugagauguuuguuucagugccu

SEQ ID NO: 5793 - RNA, 22 nt, Homo sapiens
cuugucacuguuggcuuuagaa

SEQ ID NO: 5794 - RNA, 22 nt, Homo sapiens
uugaggaggcagucugcccauu

SEQ ID NO: 5795 - RNA, 22 nt, Homo sapiens
gaguagugcugcaguaaacaca

SEQ ID NO: 5796 - RNA, 22 nt, Homo sapiens
uugugcuccagagacgggcucg

SEQ ID NO: 5797 - RNA, 22 nt, Homo sapiens
uuuaaagcacggaguuuguggc

SEQ ID NO: 5798 - RNA, 22 nt, Homo sapiens
cucauggagaaccucugcuagg

SEQ ID NO: 5799 - RNA, 22 nt, Homo sapiens
uaaggcuugaucuuggugagau

SEQ ID NO: 5800 - RNA, 22 nt, Homo sapiens
uuauccagcgcuguuuuggaga

SEQ ID NO: 5801 - RNA, 22 nt, Homo sapiens
gugagaggaggcagcuuuuaca

SEQ ID NO: 5802 - RNA, 23 nt, Homo sapiens
aagagguaugacuaugaagugga

SEQ ID NO: 5803 - RNA, 18 nt, Homo sapiens
acagugucuuacaccugu

SEQ ID NO: 5804 - RNA, 22 nt, Homo sapiens
auagaagcugccaacguuucag

SEQ ID NO: 5805 - RNA, 22 nt, Homo sapiens
ucuggcuuuagcaugugggaag

SEQ ID NO: 5806 - RNA, 22 nt, Homo sapiens
ccacaguagucuugggaugggc

SEQ ID NO: 5807 - RNA, 22 nt, Homo sapiens
uugcuggugguucgagcaacac

SEQ ID NO: 5808 - RNA, 22 nt, Homo sapiens
ucacauuguguagccugcucac

SEQ ID NO: 5809 - RNA, 22 nt, Homo sapiens
auguggcuuuucaacuguguga

SEQ ID NO: 5810 - RNA, 22 nt, Homo sapiens
cuuugguuaauaggauauggca

SEQ ID NO: 5811 - RNA, 22 nt, Homo sapiens
uggaaauuaagucuuuccugag

SEQ ID NO: 5812 - RNA, 19 nt, Homo sapiens
ugcauugucugggaaaugg

SEQ ID NO: 5813 - RNA, 21 nt, Homo sapiens
uuuguguccccacccaaaucu

SEQ ID NO: 5814 - RNA, 22 nt, Homo sapiens
guuuggcuuucucucuauccug

SEQ ID NO: 5815 - RNA, 20 nt, Homo sapiens
aucguggccugaggagauac

SEQ ID NO: 5816 - RNA, 22 nt, Homo sapiens
gcaucaaugucuauaguguuug

SEQ ID NO: 5817 - RNA, 22 nt, Homo sapiens
uggauauguuuauuacccugaa

SEQ ID NO: 5818 - RNA, 16 nt, Homo sapiens
uguauugcuaaaaaga

SEQ ID NO: 5819 - RNA, 22 nt, Homo sapiens
uuacagcagugccccacuccca

SEQ ID NO: 5820 - RNA, 21 nt, Homo sapiens
uggucaguuuucucacuagga

SEQ ID NO: 5821 - RNA, 22 nt, Homo sapiens
guaucacguuguuuuggugaaa

SEQ ID NO: 5822 - RNA, 22 nt, Homo sapiens
uuuaagguauguggugaaaauu

SEQ ID NO: 5823 - RNA, 22 nt, Homo sapiens
uaguggucccccagucccagcu

SEQ ID NO: 5824 - RNA, 22 nt, Homo sapiens
aaucugucaguuuuguguuaau

SEQ ID NO: 5825 - RNA, 22 nt, Homo sapiens
ugagauggaguuucacuuuugu

SEQ ID NO: 5826 - RNA, 22 nt, Homo sapiens
aagagagcuaugugcauaauua

SEQ ID NO: 5827 - RNA, 22 nt, Homo sapiens
ugcaaguggauuuuuccccaga

SEQ ID NO: 5828 - RNA, 22 nt, Homo sapiens
auuugacacugagagccucagu

SEQ ID NO: 5829 - RNA, 22 nt, Homo sapiens
ugugaaacacgaaagucuaaaa

SEQ ID NO: 5830 - RNA, 22 nt, Homo sapiens
ucugggguuuccacuuuuacuu

SEQ ID NO: 5831 - RNA, 22 nt, Homo sapiens
ggaaggucaaagggaaagcaga

SEQ ID NO: 5832 - RNA, 22 nt, Homo sapiens
acaaagcgcuucucuuuagagu

SEQ ID NO: 5833 - RNA, 22 nt, Homo sapiens
cuacaguaugaaaccuuuacuc

SEQ ID NO: 5834 - RNA, 22 nt, Homo sapiens
gguguguaaauuacuuaucucu

SEQ ID NO: 5835 - RNA, 22 nt, Homo sapiens
augggguaggcuugcuguagua

SEQ ID NO: 5836 - RNA, 22 nt, Homo sapiens
uugcaccacugcguuccagccu

SEQ ID NO: 5837 - RNA, 22 nt, Homo sapiens
aaucugucuagacaaggagucu

SEQ ID NO: 5838 - RNA, 22 nt, Homo sapiens
ggaauguauuaaggcauugggc

SEQ ID NO: 5839 - RNA, 22 nt, Homo sapiens
uauccuagugggguuucaguca

SEQ ID NO: 5840 - RNA, 19 nt, Homo sapiens
uugcauauguugaaccagc

SEQ ID NO: 5841 - RNA, 22 nt, Homo sapiens
agacagcuggaguaucauagcu

SEQ ID NO: 5842 - RNA, 22 nt, Homo sapiens
ugcaccauugcacuccagccug

SEQ ID NO: 5843 - RNA, 21 nt, Homo sapiens
uuagccuguaagcacuuugca

SEQ ID NO: 5844 - RNA, 22 nt, Homo sapiens
uugucuccuagacgaccaggcg

SEQ ID NO: 5845 - RNA, 22 nt, Homo sapiens
guaagguuguauuucaagaaac

SEQ ID NO: 5846 - RNA, 22 nt, Homo sapiens
auuuggcaguauaaugcuuugg

SEQ ID NO: 5847 - RNA, 22 nt, Homo sapiens
agcacagugaaugguuuacuca

SEQ ID NO: 5848 - RNA, 22 nt, Homo sapiens
aggaauuuaauguaugauaaua

SEQ ID NO: 5849 - RNA, 22 nt, Homo sapiens
guaaucucagcuacgcgggagg

SEQ ID NO: 5850 - RNA, 22 nt, Homo sapiens
gauguguuuguuucuggaggag

SEQ ID NO: 5851 - RNA, 22 nt, Homo sapiens
acccuggagagugcuguaguaa

SEQ ID NO: 5852 - RNA, 22 nt, Homo sapiens
acuagagaugcauuuguaguuu

SEQ ID NO: 5853 - RNA, 22 nt, Homo sapiens
uuguguaguaccucucacauug

SEQ ID NO: 5854 - RNA, 22 nt, Homo sapiens
uauagcaaugugccacucucug

SEQ ID NO: 5855 - RNA, 22 nt, Homo sapiens
gcauggauguugauggcugcug

SEQ ID NO: 5856 - RNA, 22 nt, Homo sapiens
agugcauugagacuugugaguu

SEQ ID NO: 5857 - RNA, 22 nt, Homo sapiens
agauggucuucauaaguuuuaa

SEQ ID NO: 5858 - RNA, 20 nt, Homo sapiens
acugcacuccaaccuuugug

SEQ ID NO: 5859 - RNA, 22 nt, Homo sapiens
cugaggugggaggauuacuuga

SEQ ID NO: 5860 - RNA, 22 nt, Homo sapiens
gagaucacuucuguauucuaca

SEQ ID NO: 5861 - RNA, 20 nt, Homo sapiens
cucacagacagcuucuuucu

SEQ ID NO: 5862 - RNA, 22 nt, Homo sapiens
uugcacuccagucuggggggca

SEQ ID NO: 5863 - RNA, 22 nt, Homo sapiens
uugagcccuggaggcagaggcu

SEQ ID NO: 5864 - RNA, 22 nt, Homo sapiens
uugacguaggaggauguugaga

SEQ ID NO: 5865 - RNA, 22 nt, Homo sapiens
cuggagcauugguggauuuguu

SEQ ID NO: 5866 - RNA, 22 nt, Homo sapiens
augacgagaugguguuuggcuu

SEQ ID NO: 5867 - RNA, 22 nt, Homo sapiens
uaaaguucuuuuaugggccggg

SEQ ID NO: 5868 - RNA, 22 nt, Homo sapiens
aacaccuugcgugggcgucaau

SEQ ID NO: 5869 - RNA, 22 nt, Homo sapiens
gcaccccuuaccgggcuggguu

SEQ ID NO: 5870 - RNA, 22 nt, Homo sapiens
auaccuuuuaggggaacguucu

SEQ ID NO: 5871 - RNA, 22 nt, Homo sapiens
auggcuauucuucuuuugucag

SEQ ID NO: 5872 - RNA, 22 nt, Homo sapiens
uuuaaagcuccaagcaugucug

SEQ ID NO: 5873 - RNA, 22 nt, Homo sapiens
cauugcacugcuucuugggugu

SEQ ID NO: 5874 - RNA, 22 nt, Homo sapiens
acuuugguuuauagaauuuagg

SEQ ID NO: 5875 - RNA, 22 nt, Homo sapiens
uuugguuauauauauacacucu

SEQ ID NO: 5876 - RNA, 22 nt, Homo sapiens
uuaaagugcuguuuuugccggg

SEQ ID NO: 5877 - RNA, 22 nt, Homo sapiens
agaaagcgcuucccuuugcugg

SEQ ID NO: 5878 - RNA, 20 nt, Homo sapiens
acuggcacugguaggugugg

SEQ ID NO: 5879 - RNA, 22 nt, Homo sapiens
cuuuggugagggauaaauuuca

SEQ ID NO: 5880 - RNA, 20 nt, Homo sapiens
agaugcaugcacauaaacac

SEQ ID NO: 5881 - RNA, 22 nt, Homo sapiens
uggaauguuauggcuuuaaucu

SEQ ID NO: 5882 - RNA, 22 nt, Homo sapiens
uuuagcaauucauuuugugucu

SEQ ID NO: 5883 - RNA, 22 nt, Homo sapiens
uuuccaguuggaagaaggggga

SEQ ID NO: 5884 - RNA, 22 nt, Homo sapiens
uggcagaugagccgcgcuccaa

SEQ ID NO: 5885 - RNA, 22 nt, Homo sapiens
augacagcaucugugaaguugu

SEQ ID NO: 5886 - RNA, 22 nt, Homo sapiens
uuggcaaagugucuggcauuua

SEQ ID NO: 5887 - RNA, 22 nt, Homo sapiens
gucuuuugcuagccagagagcu

SEQ ID NO: 5888 - RNA, 22 nt, Homo sapiens
aaguacuguuuaaauugcagaa

SEQ ID NO: 5889 - RNA, 22 nt, Homo sapiens
uagcccagugagguugauuugg

SEQ ID NO: 5890 - RNA, 22 nt, Homo sapiens
gucauugguucuguuuauguga

SEQ ID NO: 5891 - RNA, 22 nt, Homo sapiens
gugugcaauuuugugggaggca

SEQ ID NO: 5892 - RNA, 22 nt, Homo sapiens
auagccaguagagagcuguuag

SEQ ID NO: 5893 - RNA, 22 nt, Homo sapiens
uguacaugggacaggaggagag

SEQ ID NO: 5894 - RNA, 22 nt, Homo sapiens
gguggugguauuucagaaaaug

SEQ ID NO: 5895 - RNA, 21 nt, Homo sapiens
ucucauuacugaugagccaga

SEQ ID NO: 5896 - RNA, 20 nt, Homo sapiens
caaauugcuuucuugguuuu

SEQ ID NO: 5897 - RNA, 22 nt, Homo sapiens
gagcuguuuuucacuagaccaa

SEQ ID NO: 5898 - RNA, 22 nt, Homo sapiens
ugacuugaggcucgcacaaguu

SEQ ID NO: 5899 - RNA, 22 nt, Homo sapiens
gaaucacaguuauuagagcagc

SEQ ID NO: 5900 - RNA, 22 nt, Homo sapiens
aucacuguccacucaucuuucu

SEQ ID NO: 5901 - RNA, 21 nt, Homo sapiens
cacugguguugcuauaucaaa

SEQ ID NO: 5902 - RNA, 22 nt, Homo sapiens
gccauugcacuccagccucggg

SEQ ID NO: 5903 - RNA, 22 nt, Homo sapiens
cagcuggugcugcaccaguggg

SEQ ID NO: 5904 - RNA, 22 nt, Homo sapiens
auagcagcaccucacucuacug

SEQ ID NO: 5905 - RNA, 22 nt, Homo sapiens
cuuuuacacuguuggcaggauu

SEQ ID NO: 5906 - RNA, 22 nt, Homo sapiens
ucuuggguuugccuugcugcug

SEQ ID NO: 5907 - RNA, 22 nt, Homo sapiens
aaguaauggaguuauuuuauga

SEQ ID NO: 5908 - RNA, 22 nt, Homo sapiens
auguauacauagauacgugugu

SEQ ID NO: 5909 - RNA, 22 nt, Homo sapiens
uugcugagucuuucuagguugc

SEQ ID NO: 5910 - RNA, 23 nt, Homo sapiens
ugccuagaccaucagccugaggu

SEQ ID NO: 5911 - RNA, 22 nt, Homo sapiens
auuagguuagugcaaaaguaau

SEQ ID NO: 5912 - RNA, 22 nt, Homo sapiens
cugggauggaggagaauuagag

SEQ ID NO: 5913 - RNA, 22 nt, Homo sapiens
aagcaguguggacuaaugggaa

SEQ ID NO: 5914 - RNA, 22 nt, Homo sapiens
uauauagcuaugucuguccauu

SEQ ID NO: 5915 - RNA, 22 nt, Homo sapiens
uaaguaauugugguuuuugcca

SEQ ID NO: 5916 - RNA, 22 nt, Homo sapiens
uuucaacuaauuuuuuggugag

SEQ ID NO: 5917 - RNA, 20 nt, Homo sapiens
uguagguguacaguaaggag

SEQ ID NO: 5918 - RNA, 22 nt, Homo sapiens
augugcaaaguuaagaucccag

SEQ ID NO: 5919 - RNA, 22 nt, Homo sapiens
guguccuaugaaacaggaucca

SEQ ID NO: 5920 - RNA, 22 nt, Homo sapiens
uccauuuguagguagugagaca

SEQ ID NO: 5921 - RNA, 22 nt, Homo sapiens
aagcugccuugcugaggagaaa

SEQ ID NO: 5922 - RNA, 22 nt, Homo sapiens
uguuaaggcagagauaauacau

SEQ ID NO: 5923 - RNA, 21 nt, Homo sapiens
ucuuggguugaauucucccag

SEQ ID NO: 5924 - RNA, 22 nt, Homo sapiens
ugagggaugccugguuuguuuu

SEQ ID NO: 5925 - RNA, 22 nt, Homo sapiens
auacaguaucuucuggcaagca

SEQ ID NO: 5926 - RNA, 22 nt, Homo sapiens
uuaggugguacacagccccagu

SEQ ID NO: 5927 - RNA, 22 nt, Homo sapiens
acaguguguguguucaccuaga

SEQ ID NO: 5928 - RNA, 22 nt, Homo sapiens
uuguuuagagacuggaauuaaa

SEQ ID NO: 5929 - RNA, 22 nt, Homo sapiens
gcugaaauguuuaauuugggag

SEQ ID NO: 5930 - RNA, 22 nt, Homo sapiens
ugaaaugcugucuaggggaaau

SEQ ID NO: 5931 - RNA, 22 nt, Homo sapiens
ucacaguuggccuggccuuuua

SEQ ID NO: 5932 - RNA, 22 nt, Homo sapiens
gauaguugugagaacucuuacu

SEQ ID NO: 5933 - RNA, 21 nt, Homo sapiens
aaucacaguuguucugccuuc

SEQ ID NO: 5934 - RNA, 22 nt, Homo sapiens
cgugaggaaaacagaggguguu

SEQ ID NO: 5935 - RNA, 22 nt, Homo sapiens
uucagcuacuuggaaacagcaa

SEQ ID NO: 5936 - RNA, 22 nt, Homo sapiens
gcagguauuagagagccugaaa

SEQ ID NO: 5937 - RNA, 22 nt, Homo sapiens
ugaguagucuagaguggaaugu

SEQ ID NO: 5938 - RNA, 22 nt, Homo sapiens
aucauccugucaggagcuguga

SEQ ID NO: 5939 - RNA, 22 nt, Homo sapiens
gaguagugcuguaauaaacaua

SEQ ID NO: 5940 - RNA, 22 nt, Homo sapiens
caguaaauaucugagcgagguc

SEQ ID NO: 5941 - RNA, 22 nt, Homo sapiens
uccacaguggugaggugcagca

SEQ ID NO: 5942 - RNA, 22 nt, Homo sapiens
ggcacgguggcucacgccugua

SEQ ID NO: 5943 - RNA, 22 nt, Homo sapiens
uuaaagugaucauaaggauagu

SEQ ID NO: 5944 - RNA, 22 nt, Homo sapiens
gugguaggaaagugcaaaugua

SEQ ID NO: 5945 - RNA, 22 nt, Homo sapiens
aaucaacauuguuuuaagucaa

SEQ ID NO: 5946 - RNA, 22 nt, Homo sapiens
uagcuaguauuuugcugaggau

SEQ ID NO: 5947 - RNA, 22 nt, Homo sapiens
ucagcagugugaaaacaaacua

SEQ ID NO: 5948 - RNA, 22 nt, Homo sapiens
uuuuggacuucaauuugacacu

SEQ ID NO: 5949 - RNA, 22 nt, Homo sapiens
gaaggcaugcugcauggccaga

SEQ ID NO: 5950 - RNA, 23 nt, Homo sapiens
ggaguguaaauuauuucaaccau

SEQ ID NO: 5951 - RNA, 22 nt, Homo sapiens
ucauuggauggaaugcucugua

SEQ ID NO: 5952 - RNA, 22 nt, Homo sapiens
cacuggcacuguguuuagaugg

SEQ ID NO: 5953 - RNA, 22 nt, Homo sapiens
ugaauagaaguuuacuccuuuu

SEQ ID NO: 5954 - RNA, 22 nt, Homo sapiens
uggaaguaaccaugaauggaau

SEQ ID NO: 5955 - RNA, 22 nt, Homo sapiens
uuggacucccuccccagcuuca

SEQ ID NO: 5956 - RNA, 22 nt, Homo sapiens
uggaguguguuaacuuuacaag

SEQ ID NO: 5957 - RNA, 22 nt, Homo sapiens
guaugugcauuguaaauuuuga

SEQ ID NO: 5958 - RNA, 22 nt, Homo sapiens
uagggaguguccuuucgggaaa

SEQ ID NO: 5959 - RNA, 22 nt, Homo sapiens
ccauugaacaugaaggaaugug

SEQ ID NO: 5960 - RNA, 18 nt, Homo sapiens
uugcaaauucuucccugu

SEQ ID NO: 5961 - RNA, 18 nt, Homo sapiens
uuauacuccccaggcaau

SEQ ID NO: 5962 - RNA, 22 nt, Homo sapiens
uggcuagaugagauguacugca

SEQ ID NO: 5963 - RNA, 22 nt, Homo sapiens
ugauauguguaaacaauguaua

SEQ ID NO: 5964 - RNA, 22 nt, Homo sapiens
aucagauguuuguauaggagua

SEQ ID NO: 5965 - RNA, 22 nt, Homo sapiens
uccccuuuguaagauggaaacg

SEQ ID NO: 5966 - RNA, 22 nt, Homo sapiens
ugagguaggugaagaaugcacg

SEQ ID NO: 5967 - RNA, 22 nt, Homo sapiens
ucagaucaugcuuaugauggga

SEQ ID NO: 5968 - RNA, 22 nt, Homo sapiens
uaugacuuuugaauacagaugg

SEQ ID NO: 5969 - RNA, 22 nt, Homo sapiens
cuauggcuguagucccugugua

SEQ ID NO: 5970 - RNA, 22 nt, Homo sapiens
aacaggcuccuaggggugcacc

SEQ ID NO: 5971 - RNA, 22 nt, Homo sapiens
uugaauagugacuuugauucug

SEQ ID NO: 5972 - RNA, 22 nt, Homo sapiens
aagcugguguguauuauucacu

SEQ ID NO: 5973 - RNA, 22 nt, Homo sapiens
cuucaugggagaaccacaggua

SEQ ID NO: 5974 - RNA, 22 nt, Homo sapiens
uacagugcauagaggcaugaua

SEQ ID NO: 5975 - RNA, 22 nt, Homo sapiens
cuuggauuauaauggaauauuu

SEQ ID NO: 5976 - RNA, 22 nt, Homo sapiens
uagggaguuuuggggugcagaa

SEQ ID NO: 5977 - RNA, 22 nt, Homo sapiens
cagaguuaguagccuuugacaa

SEQ ID NO: 5978 - RNA, 22 nt, Homo sapiens
aagccacuguaccugucucuua

SEQ ID NO: 5979 - RNA, 22 nt, Homo sapiens
ugagauuguucuaugucugguu

SEQ ID NO: 5980 - RNA, 22 nt, Homo sapiens
gcaguguucugggcaggaagaa

SEQ ID NO: 5981 - RNA, 22 nt, Homo sapiens
agguagugugaugcuccuguuu

SEQ ID NO: 5982 - RNA, 22 nt, Homo sapiens
uguguaaauacaagugcuugaa

SEQ ID NO: 5983 - RNA, 22 nt, Homo sapiens
ucacaugucagccguggggaag

SEQ ID NO: 5984 - RNA, 22 nt, Homo sapiens
auagcagugugaaaacagacua

SEQ ID NO: 5985 - RNA, 18 nt, Homo sapiens
uaacuggugugagauggu

SEQ ID NO: 5986 - RNA, 22 nt, Homo sapiens
uucauaguuuauacugauauuu

SEQ ID NO: 5987 - RNA, 22 nt, Homo sapiens
cugucuagagggcacaugaugc

SEQ ID NO: 5988 - RNA, 22 nt, Homo sapiens
uuuguacacuguuggugguuau

SEQ ID NO: 5989 - RNA, 22 nt, Homo sapiens
ugauaugucacuugaucauggu

SEQ ID NO: 5990 - RNA, 22 nt, Homo sapiens
uauugcaaauggugaucccagg

SEQ ID NO: 5991 - RNA, 16 nt, Homo sapiens
ggcauguaauaagcaa

SEQ ID NO: 5992 - RNA, 22 nt, Homo sapiens
aaaguggugugaguauguaucu

SEQ ID NO: 5993 - RNA, 22 nt, Homo sapiens
ucuuuagguguuauaguucaag

SEQ ID NO: 5994 - RNA, 22 nt, Homo sapiens
uugguaugaaaaggaauuagac

SEQ ID NO: 5995 - RNA, 22 nt, Homo sapiens
gaucagauggcuguuggugugu

SEQ ID NO: 5996 - RNA, 22 nt, Homo sapiens
uaaguaauuuguauuuuaccca

SEQ ID NO: 5997 - RNA, 19 nt, Homo sapiens
uuucaauguaaggauggag

SEQ ID NO: 5998 - RNA, 22 nt, Homo sapiens
ucccugguguuaguuuguucuu

SEQ ID NO: 5999 - RNA, 22 nt, Homo sapiens
accaguguuuaccaaguagcau

SEQ ID NO: 6000 - RNA, 22 nt, Homo sapiens
gagcugaucuuuucugauucca

SEQ ID NO: 6001 - RNA, 22 nt, Homo sapiens
gagcugaauugcugccauuugc

SEQ ID NO: 6002 - RNA, 22 nt, Homo sapiens
uuuacugucuucagucccucug

SEQ ID NO: 6003 - RNA, 22 nt, Homo sapiens
acugcacuccagccuggaccac

SEQ ID NO: 6004 - RNA, 17 nt, Homo sapiens
ugagcuaagauuacccc

SEQ ID NO: 6005 - RNA, 22 nt, Homo sapiens
cccaguguuacgugacagccug

SEQ ID NO: 6006 - RNA, 22 nt, Homo sapiens
uuugggacuguauuaaaugccu

SEQ ID NO: 6007 - RNA, 22 nt, Homo sapiens
uugaucugugucccugcccaau

SEQ ID NO: 6008 - RNA, 22 nt, Homo sapiens
gguaaacauaagagagcugacu

SEQ ID NO: 6009 - RNA, 22 nt, Homo sapiens
uuguaaagaucauaugcuguuc

SEQ ID NO: 6010 - RNA, 22 nt, Homo sapiens
gggaagugugguuucuuuacag

SEQ ID NO: 6011 - RNA, 22 nt, Homo sapiens
uauagcaguguaagaaucgagu

SEQ ID NO: 6012 - RNA, 22 nt, Homo sapiens
ugacaagcucccucugcaccuu

SEQ ID NO: 6013 - RNA, 22 nt, Homo sapiens
uagagguagccuacuacacacc

SEQ ID NO: 6014 - RNA, 22 nt, Homo sapiens
acagauagcacuaagggaucug

SEQ ID NO: 6015 - RNA, 22 nt, Homo sapiens
auuaauguaauuaguaaaguug

SEQ ID NO: 6016 - RNA, 22 nt, Homo sapiens
auggaggacaaugucaccuuca

SEQ ID NO: 6017 - RNA, 22 nt, Homo sapiens
gacagugugauacuuagucuca

SEQ ID NO: 6018 - RNA, 20 nt, Homo sapiens
ugagauuggugugguauaag

SEQ ID NO: 6019 - RNA, 22 nt, Homo sapiens
aggcaaaugccagcaaucacac

SEQ ID NO: 6020 - RNA, 22 nt, Homo sapiens
cuacuauguagagauauugaau

SEQ ID NO: 6021 - RNA, 22 nt, Homo sapiens
augacacugcagagauguccca

SEQ ID NO: 6022 - RNA, 22 nt, Homo sapiens
guccaugagaugaauccacaca

SEQ ID NO: 6023 - RNA, 22 nt, Homo sapiens
ccaguguauuuuugggaccugc

SEQ ID NO: 6024 - RNA, 22 nt, Homo sapiens
ucgcauggucuccaggcagcuc

SEQ ID NO: 6025 - RNA, 22 nt, Homo sapiens
cagcugcuuuggaaaauauuuu

SEQ ID NO: 6026 - RNA, 22 nt, Homo sapiens
cuauuugguuggugaaaaaagu

SEQ ID NO: 6027 - RNA, 22 nt, Homo sapiens
auggccuuuuuaucucaccaag

SEQ ID NO: 6028 - RNA, 22 nt, Homo sapiens
ccauuugguuauguaucgaaac

SEQ ID NO: 6029 - RNA, 16 nt, Homo sapiens
uuauugcauucuucuc

SEQ ID NO: 6030 - RNA, 20 nt, Homo sapiens
cuucacagaaguggaaucau

SEQ ID NO: 6031 - RNA, 22 nt, Homo sapiens
auugcacaucugcacuacagcc

SEQ ID NO: 6032 - RNA, 22 nt, Homo sapiens
cagguacuucugggcugagcag

SEQ ID NO: 6033 - RNA, 20 nt, Homo sapiens
uuauaacuuuuguucugggg

SEQ ID NO: 6034 - RNA, 22 nt, Homo sapiens
aggcagucucugccggcugagg

SEQ ID NO: 6035 - RNA, 22 nt, Homo sapiens
uugugcuugcuguguucuaugc

SEQ ID NO: 6036 - RNA, 22 nt, Homo sapiens
uaugagacugguuaauuuuugu

SEQ ID NO: 6037 - RNA, 22 nt, Homo sapiens
augggagugugguuagagaccu

SEQ ID NO: 6038 - RNA, 22 nt, Homo sapiens
ucuuucacuuagcaugauguuu

SEQ ID NO: 6039 - RNA, 22 nt, Homo sapiens
gucuuuguuauuaugaaucaac

SEQ ID NO: 6040 - RNA, 22 nt, Homo sapiens
caaugguacuagauaucuucag

SEQ ID NO: 6041 - RNA, 22 nt, Homo sapiens
cugaauguccaggcagagguuu

SEQ ID NO: 6042 - RNA, 18 nt, Homo sapiens
cugagucauuccuggguc

SEQ ID NO: 6043 - RNA, 22 nt, Homo sapiens
ccuuuguuaguuugcugagaau

SEQ ID NO: 6044 - RNA, 22 nt, Homo sapiens
ucugugguuguugcauggaaug

SEQ ID NO: 6045 - RNA, 22 nt, Homo sapiens
uuaguggaugcugaauaaagaa

SEQ ID NO: 6046 - RNA, 22 nt, Homo sapiens
uggagugaaaacacacuaaucu

SEQ ID NO: 6047 - RNA, 22 nt, Homo sapiens
uggauugagaagcuguggcuca

SEQ ID NO: 6048 - RNA, 22 nt, Homo sapiens
ucagugcaggaaucucuagcca

SEQ ID NO: 6049 - RNA, 22 nt, Homo sapiens
ugccauagagauuuguggaacu

SEQ ID NO: 6050 - RNA, 22 nt, Homo sapiens
cugugcaaacaagugaaccccu

SEQ ID NO: 6051 - RNA, 22 nt, Homo sapiens
cuagguuauacucugaaauggu

SEQ ID NO: 6052 - RNA, 22 nt, Homo sapiens
uuauguaaaucaaucuggaauc

SEQ ID NO: 6053 - RNA, 22 nt, Homo sapiens
guguccucgaguacacaucagg

SEQ ID NO: 6054 - RNA, 22 nt, Homo sapiens
uauugccugucuccaaaaauca

SEQ ID NO: 6055 - RNA, 22 nt, Homo sapiens
ucagcgcauggucgugcggcau

SEQ ID NO: 6056 - RNA, 22 nt, Homo sapiens
cugagguaauuuguugccagua

SEQ ID NO: 6057 - RNA, 17 nt, Homo sapiens
cacugggugcaagagga

SEQ ID NO: 6058 - RNA, 17 nt, Homo sapiens
uggcaugaggguguggg

SEQ ID NO: 6059 - RNA, 22 nt, Homo sapiens
ugcacaaccucacccccgcucu

SEQ ID NO: 6060 - RNA, 22 nt, Homo sapiens
guaaggcuucuggcccuuaacu

SEQ ID NO: 6061 - RNA, 19 nt, Homo sapiens
uuauacuguauuguuuagg

SEQ ID NO: 6062 - RNA, 22 nt, Homo sapiens
ggcaaaugaagauggagaggcu

SEQ ID NO: 6063 - RNA, 22 nt, Homo sapiens
uuaucccacuuucuguuccugu

SEQ ID NO: 6064 - RNA, 22 nt, Homo sapiens
ugcaccauugcauuccagccug

SEQ ID NO: 6065 - RNA, 22 nt, Homo sapiens
augaagaucaugaagacggcuu

SEQ ID NO: 6066 - RNA, 22 nt, Homo sapiens
auugaacuuacuaucuaaacua

SEQ ID NO: 6067 - RNA, 22 nt, Homo sapiens
augaucauggaaguuuuccugu

SEQ ID NO: 6068 - RNA, 22 nt, Homo sapiens
gauuccacuuacuuagcauucc

SEQ ID NO: 6069 - RNA, 22 nt, Homo sapiens
cccaguguuuauuuugagccaa

SEQ ID NO: 6070 - RNA, 22 nt, Homo sapiens
augaaaugcauguuaaguccgu

SEQ ID NO: 6071 - RNA, 21 nt, Homo sapiens
ugacagaaaauugaguuugcu

SEQ ID NO: 6072 - RNA, 22 nt, Homo sapiens
auuaaguugugccugaaaacuu

SEQ ID NO: 6073 - RNA, 22 nt, Homo sapiens
ugaaaugauuauaugguguuug

SEQ ID NO: 6074 - RNA, 22 nt, Homo sapiens
uuacugcauaauuccugggaag

SEQ ID NO: 6075 - RNA, 22 nt, Homo sapiens
uucagggagaaggcaaacguug

SEQ ID NO: 6076 - RNA, 18 nt, Homo sapiens
acugcacuccaccuuggg

SEQ ID NO: 6077 - RNA, 22 nt, Homo sapiens
ugacuagagggcuuuuguguag

SEQ ID NO: 6078 - RNA, 22 nt, Homo sapiens
uggguagaugaauccauuccaa

SEQ ID NO: 6079 - RNA, 22 nt, Homo sapiens
uggcaugucagguuucuggguu

SEQ ID NO: 6080 - RNA, 22 nt, Homo sapiens
gcuguauuguugaaggaaaugu

SEQ ID NO: 6081 - RNA, 22 nt, Homo sapiens
gucauauaggguuuaccuguau

SEQ ID NO: 6082 - RNA, 22 nt, Homo sapiens
caggcacgcuugggagacacac

SEQ ID NO: 6083 - RNA, 23 nt, Homo sapiens
cagcuggugauuuuaaguugaag

SEQ ID NO: 6084 - RNA, 21 nt, Homo sapiens
uauaccuagaagagggauugc

SEQ ID NO: 6085 - RNA, 22 nt, Homo sapiens
uuacccuuugcauuaccaacaa

SEQ ID NO: 6086 - RNA, 19 nt, Homo sapiens
ggaaugcaccaguccuugc

SEQ ID NO: 6087 - RNA, 22 nt, Homo sapiens
acacguguugaaauuuaauugc

SEQ ID NO: 6088 - RNA, 19 nt, Homo sapiens
aaccgggagugcacauguu

SEQ ID NO: 6089 - RNA, 22 nt, Homo sapiens
ugacauggagguggaggaagau

SEQ ID NO: 6090 - RNA, 22 nt, Homo sapiens
gccucaguuguggccagggauu

SEQ ID NO: 6091 - RNA, 22 nt, Homo sapiens
uguugcacuccagccuggguga

SEQ ID NO: 6092 - RNA, 22 nt, Homo sapiens
auugcacuccagccugcggaac

SEQ ID NO: 6093 - RNA, 22 nt, Homo sapiens
uagaauguaacuuccaugucau

SEQ ID NO: 6094 - RNA, 22 nt, Homo sapiens
uuacagugguugcuauugugaa

SEQ ID NO: 6095 - RNA, 22 nt, Homo sapiens
uccuucauuugucaacucuagu

SEQ ID NO: 6096 - RNA, 22 nt, Homo sapiens
gucuuggcaugugcagcuggga

SEQ ID NO: 6097 - RNA, 22 nt, Homo sapiens
accugagacuaggcauuuuaua

SEQ ID NO: 6098 - RNA, 22 nt, Homo sapiens
auggcuuuugaccugguaggau

SEQ ID NO: 6099 - RNA, 22 nt, Homo sapiens
cuugagcuugagauccuuucug

SEQ ID NO: 6100 - RNA, 22 nt, Homo sapiens
cuggcccaguucugcguuuugc

SEQ ID NO: 6101 - RNA, 22 nt, Homo sapiens
uaugcacuauagcauauguggu

SEQ ID NO: 6102 - RNA, 22 nt, Homo sapiens
gagugcaauggugcuaucucgg

SEQ ID NO: 6103 - RNA, 22 nt, Homo sapiens
aauccugucuugccauccaaua

SEQ ID NO: 6104 - RNA, 20 nt, Homo sapiens
gagauguugaucagggcuau

SEQ ID NO: 6105 - RNA, 22 nt, Homo sapiens
gaaugcuaaguuuccucccugu

SEQ ID NO: 6106 - RNA, 16 nt, Homo sapiens
aucucagaccugcuga

SEQ ID NO: 6107 - RNA, 22 nt, Homo sapiens
gagguaagaaagucaguccuuc

SEQ ID NO: 6108 - RNA, 22 nt, Homo sapiens
cacgugcuuucuuuucauuuag

SEQ ID NO: 6109 - RNA, 22 nt, Homo sapiens
ugacaguaucuacagcuucuua

SEQ ID NO: 6110 - RNA, 22 nt, Homo sapiens
uugagauguaagauguuaauau

SEQ ID NO: 6111 - RNA, 22 nt, Homo sapiens
uguaagcagcagagacuauccu

SEQ ID NO: 6112 - RNA, 22 nt, Homo sapiens
ugcugguggucccauaugauua

SEQ ID NO: 6113 - RNA, 22 nt, Homo sapiens
uaggcaguguucucacuuguaa

SEQ ID NO: 6114 - RNA, 22 nt, Homo sapiens
ggcaagcucaggccucaggugu

SEQ ID NO: 6115 - RNA, 22 nt, Homo sapiens
gagaacuggcugauucaaggac

SEQ ID NO: 6116 - RNA, 22 nt, Homo sapiens
auuuuuggauauagggaaggau

SEQ ID NO: 6117 - RNA, 22 nt, Homo sapiens
ccccauguucucucugcagcuc

SEQ ID NO: 6118 - RNA, 22 nt, Homo sapiens
uaggacauugcccuuguggaga

SEQ ID NO: 6119 - RNA, 22 nt, Homo sapiens
uauuacagaccauaucgccggg

SEQ ID NO: 6120 - RNA, 20 nt, Homo sapiens
ugauaaguugcacuuuccuu

SEQ ID NO: 6121 - RNA, 22 nt, Homo sapiens
ucacauaguuuucgggaccuug

SEQ ID NO: 6122 - RNA, 20 nt, Homo sapiens
uggaaucugaagaucucagu

SEQ ID NO: 6123 - RNA, 16 nt, Homo sapiens
uugaggcaugucucag

SEQ ID NO: 6124 - RNA, 22 nt, Homo sapiens
ugugcacauugugcagguugau

SEQ ID NO: 6125 - RNA, 22 nt, Homo sapiens
ugugacucugcauuuuggguuc

SEQ ID NO: 6126 - RNA, 22 nt, Homo sapiens
uuaucagcagcaugaaaauaga

SEQ ID NO: 6127 - RNA, 22 nt, Homo sapiens
gagacugagucuugcccuguca

SEQ ID NO: 6128 - RNA, 22 nt, Homo sapiens
aagugcacuguaagugcaggau

SEQ ID NO: 6129 - RNA, 18 nt, Homo sapiens
uaauaacugugaccuuga

SEQ ID NO: 6130 - RNA, 22 nt, Homo sapiens
cugccacugacaccucaaggac

SEQ ID NO: 6131 - RNA, 22 nt, Homo sapiens
uauuucaguugugcagguaguu

SEQ ID NO: 6132 - RNA, 22 nt, Homo sapiens
ugacagugaacagguuaccacu

SEQ ID NO: 6133 - RNA, 22 nt, Homo sapiens
ugcgccauugaacuccuccugg

SEQ ID NO: 6134 - RNA, 22 nt, Homo sapiens
ucaccuggagaagauggaucau

SEQ ID NO: 6135 - RNA, 22 nt, Homo sapiens
uugagauaggagcuguuguucu

SEQ ID NO: 6136 - RNA, 22 nt, Homo sapiens
auggagguguggggagugaguu

SEQ ID NO: 6137 - RNA, 22 nt, Homo sapiens
ugagaugcuccucuugcaaagc

SEQ ID NO: 6138 - RNA, 22 nt, Homo sapiens
ucugagcaauaaacaacauauu

SEQ ID NO: 6139 - RNA, 20 nt, Homo sapiens
gucuugcuccguugcccagg

SEQ ID NO: 6140 - RNA, 22 nt, Homo sapiens
uucaagauggccccagugagcc

SEQ ID NO: 6141 - RNA, 22 nt, Homo sapiens
ugcaauauccucuacuauaggu

SEQ ID NO: 6142 - RNA, 22 nt, Homo sapiens
uaagacuguguaauuuaugaag

SEQ ID NO: 6143 - RNA, 22 nt, Homo sapiens
cugugcuaggcaaugugguaga

SEQ ID NO: 6144 - RNA, 22 nt, Homo sapiens
uuggauggucuuuauauaguau

SEQ ID NO: 6145 - RNA, 22 nt, Homo sapiens
uuagauguuuagaagugggcca

SEQ ID NO: 6146 - RNA, 22 nt, Homo sapiens
uuccuagagauuagcaagcugc

SEQ ID NO: 6147 - RNA, 22 nt, Homo sapiens
uguauguaaagacaggauaaca

SEQ ID NO: 6148 - RNA, 22 nt, Homo sapiens
gggcauugugggcagagggcag

SEQ ID NO: 6149 - RNA, 16 nt, Homo sapiens
uaaagcuaaucacuuu

SEQ ID NO: 6150 - RNA, 22 nt, Homo sapiens
uuggaacuguucguauugaaau

SEQ ID NO: 6151 - RNA, 22 nt, Homo sapiens
ggacacguagaugccgacuagc

SEQ ID NO: 6152 - RNA, 22 nt, Homo sapiens
ugucauguuucuacugaccaaa

SEQ ID NO: 6153 - RNA, 22 nt, Homo sapiens
augaugcaguacuuugggaaca

SEQ ID NO: 6154 - RNA, 22 nt, Homo sapiens
uuccacaaugguugaacuaauu

SEQ ID NO: 6155 - RNA, 22 nt, Homo sapiens
uugcaaaucucuuguguuuggu

SEQ ID NO: 6156 - RNA, 22 nt, Homo sapiens
uauugcuuuuaacccaaucucu

SEQ ID NO: 6157 - RNA, 22 nt, Homo sapiens
uugugaauggugcugcaguaaa

SEQ ID NO: 6158 - RNA, 21 nt, Homo sapiens
ccugaugaccucugagaguua

SEQ ID NO: 6159 - RNA, 22 nt, Homo sapiens
auugcacucuagccuuggcgac

SEQ ID NO: 6160 - RNA, 22 nt, Homo sapiens
auggcguguggcuuggaggcug

SEQ ID NO: 6161 - RNA, 22 nt, Homo sapiens
aggacacugauguaugcugugg

SEQ ID NO: 6162 - RNA, 22 nt, Homo sapiens
cacugcgacguccgccucccgg

SEQ ID NO: 6163 - RNA, 22 nt, Homo sapiens
ggagggugagaucaauuuggga

SEQ ID NO: 6164 - RNA, 22 nt, Homo sapiens
uugagggaggccucaguuuaca

SEQ ID NO: 6165 - RNA, 22 nt, Homo sapiens
uuugacaaugugugcuuguauu

SEQ ID NO: 6166 - RNA, 22 nt, Homo sapiens
aagcuaccauuuguauauaaag

SEQ ID NO: 6167 - RNA, 22 nt, Homo sapiens
uucauaguguuuccuuccagug

SEQ ID NO: 6168 - RNA, 22 nt, Homo sapiens
cucagcuacuugagaggcuuag

SEQ ID NO: 6169 - RNA, 22 nt, Homo sapiens
ugccaugaaguaauggcaaaaa

SEQ ID NO: 6170 - RNA, 22 nt, Homo sapiens
uggugagaaaugagaugcuuuu

SEQ ID NO: 6171 - RNA, 22 nt, Homo sapiens
ucaucaggcucauucaagcuga

SEQ ID NO: 6172 - RNA, 22 nt, Homo sapiens
cauugcacuccacuccugaaca

SEQ ID NO: 6173 - RNA, 23 nt, Homo sapiens
augaacucaucauuuuuuauggc

SEQ ID NO: 6174 - RNA, 20 nt, Homo sapiens
uuguacuccugggcucaagc

SEQ ID NO: 6175 - RNA, 22 nt, Homo sapiens
uccauguagaagacaggggaga

SEQ ID NO: 6176 - RNA, 18 nt, Homo sapiens
cugccagugugcucuccg

SEQ ID NO: 6177 - RNA, 22 nt, Homo sapiens
guucagcaggggcuucaauggu

SEQ ID NO: 6178 - RNA, 22 nt, Homo sapiens
ccccuguaucucagcgucuuca

SEQ ID NO: 6179 - RNA, 22 nt, Homo sapiens
ggcagguaaggagugggagccu

SEQ ID NO: 6180 - RNA, 22 nt, Homo sapiens
agcuaaaucucauguugaauug

SEQ ID NO: 6181 - RNA, 22 nt, Homo sapiens
agcaccagaaucugaguuauuc

SEQ ID NO: 6182 - RNA, 22 nt, Homo sapiens
cgacuggccuagacuaguguuu

SEQ ID NO: 6183 - RNA, 21 nt, Homo sapiens
aggaagacuaugaucaauugg

SEQ ID NO: 6184 - RNA, 22 nt, Homo sapiens
aauggcacaccuagcccuaacc

SEQ ID NO: 6185 - RNA, 22 nt, Homo sapiens
augaaagguauguuuucuguga

SEQ ID NO: 6186 - RNA, 22 nt, Homo sapiens
uucacugugugacccugggcca

SEQ ID NO: 6187 - RNA, 22 nt, Homo sapiens
caauugguguuuauggggaagu

SEQ ID NO: 6188 - RNA, 22 nt, Homo sapiens
ugcauagcauauauuguagagu

SEQ ID NO: 6189 - RNA, 18 nt, Homo sapiens
uuaaggcaggacuuuaag

SEQ ID NO: 6190 - RNA, 22 nt, Homo sapiens
ugagauaauuuacuuguugagg

SEQ ID NO: 6191 - RNA, 22 nt, Homo sapiens
gcagcaucaaaucacacaagau

SEQ ID NO: 6192 - RNA, 22 nt, Homo sapiens
ccacccuuccacacccugggua

SEQ ID NO: 6193 - RNA, 22 nt, Homo sapiens
auaagaguaguacauaugagac

SEQ ID NO: 6194 - RNA, 22 nt, Homo sapiens
aaacagucuucuccugagggac

SEQ ID NO: 6195 - RNA, 22 nt, Homo sapiens
caggcauuguccaugcugaagg

SEQ ID NO: 6196 - RNA, 22 nt, Homo sapiens
aacuggccugagaugaaaagug

SEQ ID NO: 6197 - RNA, 22 nt, Homo sapiens
cuggauggugagauaaagaaaa

SEQ ID NO: 6198 - RNA, 22 nt, Homo sapiens
uucacacuagccacucugguag

SEQ ID NO: 6199 - RNA, 22 nt, Homo sapiens
uugagcucuucuagcaauucua

SEQ ID NO: 6200 - RNA, 22 nt, Homo sapiens
ugaagugaagacucacagaagg

SEQ ID NO: 6201 - RNA, 22 nt, Homo sapiens
ugagaucguugcgugagcgugu

SEQ ID NO: 6202 - RNA, 22 nt, Homo sapiens
ucacagaugaggcgagaggcag

SEQ ID NO: 6203 - RNA, 22 nt, Homo sapiens
cagcccuacacagacugacuca

SEQ ID NO: 6204 - RNA, 22 nt, Homo sapiens
uucaguacuucaaaaucuuuaa

SEQ ID NO: 6205 - RNA, 22 nt, Homo sapiens
cuauucacaauggugaagauau

SEQ ID NO: 6206 - RNA, 19 nt, Homo sapiens
uuguccccucuaaaucuca

SEQ ID NO: 6207 - RNA, 20 nt, Homo sapiens
uagucaugagauucuccaag

SEQ ID NO: 6208 - RNA, 22 nt, Homo sapiens
uaggacacucucuccaccagua

SEQ ID NO: 6209 - RNA, 22 nt, Homo sapiens
ucaguagcaugaaaacagacua

SEQ ID NO: 6210 - RNA, 19 nt, Homo sapiens
cuugugccugaagcuuggg

SEQ ID NO: 6211 - RNA, 22 nt, Homo sapiens
auugugauggucaaaggaaaua

SEQ ID NO: 6212 - RNA, 22 nt, Homo sapiens
uuugaagugugaugccuugaug

SEQ ID NO: 6213 - RNA, 22 nt, Homo sapiens
auugcaccccagccugggugac

SEQ ID NO: 6214 - RNA, 21 nt, Homo sapiens
uugugccaaacccuggaggga

SEQ ID NO: 6215 - RNA, 22 nt, Homo sapiens
acucuguaagcaagcuggggaa

SEQ ID NO: 6216 - RNA, 22 nt, Homo sapiens
ugaucucauuagcaccuuuagc

SEQ ID NO: 6217 - RNA, 22 nt, Homo sapiens
guaaucucagcuacucgggaga

SEQ ID NO: 6218 - RNA, 18 nt, Homo sapiens
cuugucaaaucuuuccuc

SEQ ID NO: 6219 - RNA, 22 nt, Homo sapiens
agaaugugaccuuauuuggaga

SEQ ID NO: 6220 - RNA, 22 nt, Homo sapiens
gugguauaaguaccuccuuuca

SEQ ID NO: 6221 - RNA, 22 nt, Homo sapiens
ucugcaagucuaaacuagccau

SEQ ID NO: 6222 - RNA, 22 nt, Homo sapiens
ggaguucaucaggugaggggua

SEQ ID NO: 6223 - RNA, 22 nt, Homo sapiens
augugugaaucccagaaccugu

SEQ ID NO: 6224 - RNA, 22 nt, Homo sapiens
ugccaugaagaucccugaaaug

SEQ ID NO: 6225 - RNA, 22 nt, Homo sapiens
cuaaaguucuucugagagaaca

SEQ ID NO: 6226 - RNA, 22 nt, Homo sapiens
uagguuguucuauuaucuuaca

SEQ ID NO: 6227 - RNA, 22 nt, Homo sapiens
ugacagugaauaagucucuuaa

SEQ ID NO: 6228 - RNA, 22 nt, Homo sapiens
uuucaggcagggagcuucagug

SEQ ID NO: 6229 - RNA, 18 nt, Homo sapiens
cugagcacugcuuuauga

SEQ ID NO: 6230 - RNA, 22 nt, Homo sapiens
agcaaaucuaugaauguauauu

SEQ ID NO: 6231 - RNA, 22 nt, Homo sapiens
ugacuauaggauaacaugcauu

SEQ ID NO: 6232 - RNA, 22 nt, Homo sapiens
ccagccgggugcaguggcucac

SEQ ID NO: 6233 - RNA, 22 nt, Homo sapiens
gugguuuuaucccagaaauuaa

SEQ ID NO: 6234 - RNA, 22 nt, Homo sapiens
ucacuaaagaaaauggcaugga

SEQ ID NO: 6235 - RNA, 20 nt, Homo sapiens
ugccaagaaaugaggguauu

SEQ ID NO: 6236 - RNA, 22 nt, Homo sapiens
uugcaugggagcugggugaagc

SEQ ID NO: 6237 - RNA, 18 nt, Homo sapiens
aaagugaugucauucuuu

SEQ ID NO: 6238 - RNA, 22 nt, Homo sapiens
uugugcuuaauaaaaaguggua

SEQ ID NO: 6239 - RNA, 22 nt, Homo sapiens
ugacuauaucucuguauaaacu

SEQ ID NO: 6240 - RNA, 22 nt, Homo sapiens
aggaagacugaaauugcuguuc

SEQ ID NO: 6241 - RNA, 22 nt, Homo sapiens
uauggguaguacaaaguguaua

SEQ ID NO: 6242 - RNA, 22 nt, Homo sapiens
uucacugcauuucagccugggc

SEQ ID NO: 6243 - RNA, 22 nt, Homo sapiens
guagaauguauguauaacgcaa

SEQ ID NO: 6244 - RNA, 19 nt, Homo sapiens
uuucauguuuuuggugaga

SEQ ID NO: 6245 - RNA, 22 nt, Homo sapiens
aggagaugaagcuuuaucuaaa

SEQ ID NO: 6246 - RNA, 22 nt, Homo sapiens
agcaccauuuauugaaaagaca

SEQ ID NO: 6247 - RNA, 20 nt, Homo sapiens
uauagcaauuuuuuucuccu

SEQ ID NO: 6248 - RNA, 18 nt, Homo sapiens
uagugcuguucucaugau

SEQ ID NO: 6249 - RNA, 22 nt, Homo sapiens
auggcaaugcgauggugacuga

SEQ ID NO: 6250 - RNA, 22 nt, Homo sapiens
uugaauagacagccagcuuuaa

SEQ ID NO: 6251 - RNA, 19 nt, Homo sapiens
agaaucuaaauuauuucug

SEQ ID NO: 6252 - RNA, 22 nt, Homo sapiens
uugacagaccuuggucauaucc

SEQ ID NO: 6253 - RNA, 22 nt, Homo sapiens
cuagcuuuuuaugacaaucuug

SEQ ID NO: 6254 - RNA, 22 nt, Homo sapiens
gauuccacuuucaaauucaaau

SEQ ID NO: 6255 - RNA, 22 nt, Homo sapiens
ggacacaucaugugaccaaggu

SEQ ID NO: 6256 - RNA, 22 nt, Homo sapiens
aucccuguaguaauauucuagc

SEQ ID NO: 6257 - RNA, 22 nt, Homo sapiens
gcugguguagagugcagaaagg

SEQ ID NO: 6258 - RNA, 22 nt, Homo sapiens
uggaaggucauuguucauuuga

SEQ ID NO: 6259 - RNA, 21 nt, Homo sapiens
ccugauguucacuuggccuuc

SEQ ID NO: 6260 - RNA, 22 nt, Homo sapiens
gcauggagaaggggacugauuc

SEQ ID NO: 6261 - RNA, 22 nt, Homo sapiens
uaugcuuguuuauuuaagaaac

SEQ ID NO: 6262 - RNA, 22 nt, Homo sapiens
ugaccuagaacucuaaugccug

SEQ ID NO: 6263 - RNA, 22 nt, Homo sapiens
augacagugagugagcucucac

SEQ ID NO: 6264 - RNA, 22 nt, Homo sapiens
aaagucuguuacagcuauuucu

SEQ ID NO: 6265 - RNA, 22 nt, Homo sapiens
ucacaguagccccucccaucau

SEQ ID NO: 6266 - RNA, 18 nt, Homo sapiens
ggcugguguuuuaguaua

SEQ ID NO: 6267 - RNA, 22 nt, Homo sapiens
guaauacuggacaggguaucag

SEQ ID NO: 6268 - RNA, 22 nt, Homo sapiens
ucauucacucccuugaaguuag

SEQ ID NO: 6269 - RNA, 22 nt, Homo sapiens
guaagacuuauuuucuuuauca

SEQ ID NO: 6270 - RNA, 20 nt, Homo sapiens
cagcuaccugggaaauuugg

SEQ ID NO: 6271 - RNA, 23 nt, Homo sapiens
ugaguaggcaguuuuccccucac

SEQ ID NO: 6272 - RNA, 22 nt, Homo sapiens
auacccaguaguggaauugcua

SEQ ID NO: 6273 - RNA, 22 nt, Homo sapiens
gacuaggagauauguuuucuuc

SEQ ID NO: 6274 - RNA, 18 nt, Homo sapiens
uuuuugaggcacagggga

SEQ ID NO: 6275 - RNA, 22 nt, Homo sapiens
augcuggugguucacaugcgca

SEQ ID NO: 6276 - RNA, 22 nt, Homo sapiens
ucagcaucacgugggcucccgu

SEQ ID NO: 6277 - RNA, 22 nt, Homo sapiens
guccugaagaccuuccucugga

SEQ ID NO: 6278 - RNA, 22 nt, Homo sapiens
cagagguaagcaagucagcauu

SEQ ID NO: 6279 - RNA, 22 nt, Homo sapiens
uaucuuggaguuugacaaccaa

SEQ ID NO: 6280 - RNA, 22 nt, Homo sapiens
uaugagcacauauguaucuaug

SEQ ID NO: 6281 - RNA, 22 nt, Homo sapiens
augagacauuaaaguguguuug

SEQ ID NO: 6282 - RNA, 22 nt, Homo sapiens
caucccugucgucaagucucug

SEQ ID NO: 6283 - RNA, 22 nt, Homo sapiens
aguuggugauugauugggucug

SEQ ID NO: 6284 - RNA, 22 nt, Homo sapiens
gcugacagugguuauacuuaga

SEQ ID NO: 6285 - RNA, 22 nt, Homo sapiens
cagaugguggucccacagccca

SEQ ID NO: 6286 - RNA, 22 nt, Homo sapiens
auagaauguauuaguaaauuug

SEQ ID NO: 6287 - RNA, 22 nt, Homo sapiens
uuauucagcaccugcuguguuc

SEQ ID NO: 6288 - RNA, 22 nt, Homo sapiens
cugcaguaaacuuucccauuca

SEQ ID NO: 6289 - RNA, 22 nt, Homo sapiens
gauggguuuuuugaagacagca

SEQ ID NO: 6290 - RNA, 22 nt, Homo sapiens
ggcuagagaauagugccacuaa

SEQ ID NO: 6291 - RNA, 22 nt, Homo sapiens
aaagggcuuuguaaacuucaag

SEQ ID NO: 6292 - RNA, 22 nt, Homo sapiens
uacaugugcaggucuguggggg

SEQ ID NO: 6293 - RNA, 22 nt, Homo sapiens
uggaguauuauguaauuucaau

SEQ ID NO: 6294 - RNA, 22 nt, Homo sapiens
uucaagcuacaguggcaggguu

SEQ ID NO: 6295 - RNA, 22 nt, Homo sapiens
gcaugcacuguauuuaaguauc

SEQ ID NO: 6296 - RNA, 20 nt, Homo sapiens
gucuuguagcucaaguuauu

SEQ ID NO: 6297 - RNA, 22 nt, Homo sapiens
aaagucuagaggaucaugugug

SEQ ID NO: 6298 - RNA, 21 nt, Homo sapiens
ucacuaguaaaaggugaacug

SEQ ID NO: 6299 - RNA, 22 nt, Homo sapiens
uauauguuuucauaaggcuaga

SEQ ID NO: 6300 - RNA, 22 nt, Homo sapiens
ggugaucauugucucuaguaug

SEQ ID NO: 6301 - RNA, 22 nt, Homo sapiens
uuguuugguuagaugggcaagu

SEQ ID NO: 6302 - RNA, 22 nt, Homo sapiens
uuugguaguuuguugggaccca

SEQ ID NO: 6303 - RNA, 22 nt, Homo sapiens
uugacaggaugcucagggccca

SEQ ID NO: 6304 - RNA, 22 nt, Homo sapiens
uacagcuaugugcaugcaugcu

SEQ ID NO: 6305 - RNA, 18 nt, Homo sapiens
auacaagcagcagagauu

SEQ ID NO: 6306 - RNA, 22 nt, Homo sapiens
ucucuuggugacuuaaaauguu

SEQ ID NO: 6307 - RNA, 22 nt, Homo sapiens
aaggcauucucaaacuaguucu

SEQ ID NO: 6308 - RNA, 22 nt, Homo sapiens
guugaacaauagauucauauca

SEQ ID NO: 6309 - RNA, 22 nt, Homo sapiens
auccuguaggcuaguagacagu

SEQ ID NO: 6310 - RNA, 22 nt, Homo sapiens
uagcacagugucauucuaggua

SEQ ID NO: 6311 - RNA, 22 nt, Homo sapiens
uucauguaauauuucacagcuu

SEQ ID NO: 6312 - RNA, 22 nt, Homo sapiens
auggcucuuauuauuugaggua

SEQ ID NO: 6313 - RNA, 22 nt, Homo sapiens
uacuacuuucugacaucuuuaa

SEQ ID NO: 6314 - RNA, 17 nt, Homo sapiens
ugacagaaacuuguugu

SEQ ID NO: 6315 - RNA, 22 nt, Homo sapiens
auaacauggaguuugucauuua

SEQ ID NO: 6316 - RNA, 22 nt, Homo sapiens
uauggacuuuaggauagcuuuu

SEQ ID NO: 6317 - RNA, 22 nt, Homo sapiens
uauggguguuauugcaugggag

SEQ ID NO: 6318 - RNA, 22 nt, Homo sapiens
cacagaauucauuggauuaccu

SEQ ID NO: 6319 - RNA, 22 nt, Homo sapiens
acagauagacauauauagcuca

SEQ ID NO: 6320 - RNA, 22 nt, Homo sapiens
aaugugcuuugaaaagagcuga

SEQ ID NO: 6321 - RNA, 22 nt, Homo sapiens
aagugcuuaggauagugugugg

SEQ ID NO: 6322 - RNA, 22 nt, Homo sapiens
gugugauggcgcacacagggug

SEQ ID NO: 6323 - RNA, 22 nt, Homo sapiens
aaggaguagaggaauagcaaug

SEQ ID NO: 6324 - RNA, 19 nt, Homo sapiens
ugagaucuuuacuggguuu

SEQ ID NO: 6325 - RNA, 22 nt, Homo sapiens
uagcugcuguauguacacggau

SEQ ID NO: 6326 - RNA, 22 nt, Homo sapiens
ugaaaagucuaagauuaagguu

SEQ ID NO: 6327 - RNA, 22 nt, Homo sapiens
agguacuuucccaaccauacug

SEQ ID NO: 6328 - RNA, 22 nt, Homo sapiens
agcaucauaccaaucugguccu

SEQ ID NO: 6329 - RNA, 22 nt, Homo sapiens
uugugguaaucugugacagcag

SEQ ID NO: 6330 - RNA, 22 nt, Homo sapiens
acgugguaguacaguauuuuaa

SEQ ID NO: 6331 - RNA, 22 nt, Homo sapiens
uuucugguuaauuucuaagagc

SEQ ID NO: 6332 - RNA, 22 nt, Homo sapiens
uugggcuuuuagguccuuaaca

SEQ ID NO: 6333 - RNA, 22 nt, Homo sapiens
ucgcauuucccucuguagcuuc

SEQ ID NO: 6334 - RNA, 22 nt, Homo sapiens
ucacaguguuaaaccuuucuuu

SEQ ID NO: 6335 - RNA, 22 nt, Homo sapiens
cauggcuuuuauaacaagaaau

SEQ ID NO: 6336 - RNA, 22 nt, Homo sapiens
gugagcaguguccuugggggca

SEQ ID NO: 6337 - RNA, 22 nt, Homo sapiens
uucagggcauuggaguuucuga

SEQ ID NO: 6338 - RNA, 22 nt, Homo sapiens
uggcgagcugaaauuauaaaag

SEQ ID NO: 6339 - RNA, 22 nt, Homo sapiens
uauugcacgccagccugagcaa

SEQ ID NO: 6340 - RNA, 22 nt, Homo sapiens
uugagguguauuguacagcaca

SEQ ID NO: 6341 - RNA, 22 nt, Homo sapiens
ucuuugguucuguuuauguaau

SEQ ID NO: 6342 - RNA, 22 nt, Homo sapiens
cuagcuccauauaaagcaggau

SEQ ID NO: 6343 - RNA, 19 nt, Homo sapiens
augauugucuauggaggaa

SEQ ID NO: 6344 - RNA, 22 nt, Homo sapiens
gccauggugucuuauuuuugug

SEQ ID NO: 6345 - RNA, 22 nt, Homo sapiens
aaagcagcaggugguuuucaau

SEQ ID NO: 6346 - RNA, 22 nt, Homo sapiens
uacccugaaggaaaguauguuu

SEQ ID NO: 6347 - RNA, 22 nt, Homo sapiens
uugugaauggugccucaguaaa

SEQ ID NO: 6348 - RNA, 21 nt, Homo sapiens
aucuugguauagucuuauugg

SEQ ID NO: 6349 - RNA, 20 nt, Homo sapiens
cucccugacaaauguggaaa

SEQ ID NO: 6350 - RNA, 22 nt, Homo sapiens
ugaggugagggguuaggugcua

SEQ ID NO: 6351 - RNA, 22 nt, Homo sapiens
uuggcuuggagaguugaaaugu

SEQ ID NO: 6352 - RNA, 22 nt, Homo sapiens
aauugcaucuguucuuugccag

SEQ ID NO: 6353 - RNA, 22 nt, Homo sapiens
auuccacuuccacuaguuucuc

SEQ ID NO: 6354 - RNA, 20 nt, Homo sapiens
acuaaaucucauuuuaugca

SEQ ID NO: 6355 - RNA, 22 nt, Homo sapiens
cuccaggugucauccaccuccu

SEQ ID NO: 6356 - RNA, 22 nt, Homo sapiens
uaucaugggggguguacacucc

SEQ ID NO: 6357 - RNA, 22 nt, Homo sapiens
uagagcacaagguagauuucua

SEQ ID NO: 6358 - RNA, 22 nt, Homo sapiens
aucaccuggaggugaucacuug

SEQ ID NO: 6359 - RNA, 22 nt, Homo sapiens
augugcaauguguacguagccc

SEQ ID NO: 6360 - RNA, 22 nt, Homo sapiens
agcggcuguuccccuggucuau

SEQ ID NO: 6361 - RNA, 22 nt, Homo sapiens
auaaagguaauaauaguugcau

SEQ ID NO: 6362 - RNA, 22 nt, Homo sapiens
uuugucauagcagcaggaaugg

SEQ ID NO: 6363 - RNA, 22 nt, Homo sapiens
uacugcuaccuccagcuucugg

SEQ ID NO: 6364 - RNA, 22 nt, Homo sapiens
acugcacuuauccuccaauguu

SEQ ID NO: 6365 - RNA, 22 nt, Homo sapiens
auggaagaaacgauuuucugga

SEQ ID NO: 6366 - RNA, 22 nt, Homo sapiens
uaaugcacucgaaucauggaau

SEQ ID NO: 6367 - RNA, 22 nt, Homo sapiens
gauacaccauuuucuagcuauu

SEQ ID NO: 6368 - RNA, 22 nt, Homo sapiens
uaaacacucacuucauagccau

SEQ ID NO: 6369 - RNA, 22 nt, Homo sapiens
aaugacagccagauucuucucu

SEQ ID NO: 6370 - RNA, 22 nt, Homo sapiens
gagaucaaugggauggaauuga

SEQ ID NO: 6371 - RNA, 22 nt, Homo sapiens
uuagagcacugaucugcucuuu

SEQ ID NO: 6372 - RNA, 22 nt, Homo sapiens
auagaucauugucauuuuagau

SEQ ID NO: 6373 - RNA, 22 nt, Homo sapiens
gagauacuugguuucuguuucu

SEQ ID NO: 6374 - RNA, 22 nt, Homo sapiens
ugagacauacuuacaggggaug

SEQ ID NO: 6375 - RNA, 22 nt, Homo sapiens
uuuaugagguagagugguuuau

SEQ ID NO: 6376 - RNA, 23 nt, Homo sapiens
ggaaacauccagucuuucaccau

SEQ ID NO: 6377 - RNA, 22 nt, Homo sapiens
uccauaguugcacucuggagcc

SEQ ID NO: 6378 - RNA, 22 nt, Homo sapiens
gugacgucauuguuccuggcuc

SEQ ID NO: 6379 - RNA, 21 nt, Homo sapiens
ugaugcaauccgcuaggucgc

SEQ ID NO: 6380 - RNA, 22 nt, Homo sapiens
ugucuuagagauaaagaaugaa

SEQ ID NO: 6381 - RNA, 22 nt, Homo sapiens
guaacagucucaacaguggucu

SEQ ID NO: 6382 - RNA, 18 nt, Homo sapiens
ccagugcaaggaaagccc

SEQ ID NO: 6383 - RNA, 22 nt, Homo sapiens
aaggcauggugacuauuuaggc

SEQ ID NO: 6384 - RNA, 22 nt, Homo sapiens
uuagcaccacacacuuuagagg

SEQ ID NO: 6385 - RNA, 22 nt, Homo sapiens
gugugaacaucauagaguguau

SEQ ID NO: 6386 - RNA, 22 nt, Homo sapiens
gauaucuuuuguauggugagcu

SEQ ID NO: 6387 - RNA, 22 nt, Homo sapiens
ugcauggucauacauggcaccc

SEQ ID NO: 6388 - RNA, 22 nt, Homo sapiens
gugcauaugcaugugcaugcac

SEQ ID NO: 6389 - RNA, 22 nt, Homo sapiens
uuggcaaguccccaccucucuc

SEQ ID NO: 6390 - RNA, 22 nt, Homo sapiens
uugguaagguggaugaugaaua

SEQ ID NO: 6391 - RNA, 22 nt, Homo sapiens
uuuggcauuuaaauaugcaugg

SEQ ID NO: 6392 - RNA, 22 nt, Homo sapiens
gugggguaggaggaguacuucc

SEQ ID NO: 6393 - RNA, 22 nt, Homo sapiens
ugccaucauuaauauuaggcau

SEQ ID NO: 6394 - RNA, 22 nt, Homo sapiens
uugguucucuuuauaugcugga

SEQ ID NO: 6395 - RNA, 22 nt, Homo sapiens
cacugcgaccucugccuaccgg

SEQ ID NO: 6396 - RNA, 22 nt, Homo sapiens
ugagacaugugaauauuuguac

SEQ ID NO: 6397 - RNA, 22 nt, Homo sapiens
uuggaaguguguauguauagcu

SEQ ID NO: 6398 - RNA, 22 nt, Homo sapiens
guggcaaguguuccaagaggcg

SEQ ID NO: 6399 - RNA, 22 nt, Homo sapiens
gugacuggacucugaagaaaau

SEQ ID NO: 6400 - RNA, 22 nt, Homo sapiens
gaguggugguucugaaacuuuu

SEQ ID NO: 6401 - RNA, 22 nt, Homo sapiens
auuguacuuauugccagaauuu

SEQ ID NO: 6402 - RNA, 22 nt, Homo sapiens
uuugauguugagacuauaaagc

SEQ ID NO: 6403 - RNA, 16 nt, Homo sapiens
ugccuuauuccagcuc

SEQ ID NO: 6404 - RNA, 22 nt, Homo sapiens
gugcauacucuggagacauugu

SEQ ID NO: 6405 - RNA, 22 nt, Homo sapiens
agagcaaugggugaauauuaaa

SEQ ID NO: 6406 - RNA, 22 nt, Homo sapiens
ucauugcacuccagccugggug

SEQ ID NO: 6407 - RNA, 22 nt, Homo sapiens
agacaagauggcuugagguuca

SEQ ID NO: 6408 - RNA, 22 nt, Homo sapiens
gagugcauugguggucaggugu

SEQ ID NO: 6409 - RNA, 21 nt, Homo sapiens
agcuaaauuggaaauuucugu

SEQ ID NO: 6410 - RNA, 22 nt, Homo sapiens
aaacccauauaccagcugugcu

SEQ ID NO: 6411 - RNA, 22 nt, Homo sapiens
aagugguagggucaggauugga

SEQ ID NO: 6412 - RNA, 22 nt, Homo sapiens
aagagguuguaccuaaaguguu

SEQ ID NO: 6413 - RNA, 22 nt, Homo sapiens
uuagcaauagccugcaucugca

SEQ ID NO: 6414 - RNA, 22 nt, Homo sapiens
gugagcauucaaggaaggagcu

SEQ ID NO: 6415 - RNA, 22 nt, Homo sapiens
agcagcuuugcauggccuguga

SEQ ID NO: 6416 - RNA, 22 nt, Homo sapiens
gucauugucaauugacaauugu

SEQ ID NO: 6417 - RNA, 20 nt, Homo sapiens
cuauugacauuuggggcuag

SEQ ID NO: 6418 - RNA, 22 nt, Homo sapiens
acaugcaucauuaggugguuua

SEQ ID NO: 6419 - RNA, 22 nt, Homo sapiens
uugagcacaggaguuugagacc

SEQ ID NO: 6420 - RNA, 22 nt, Homo sapiens
agcacaguuaaaugaggcuucu

SEQ ID NO: 6421 - RNA, 22 nt, Homo sapiens
gagaucacuguuuauauucucu

SEQ ID NO: 6422 - RNA, 22 nt, Homo sapiens
uucccagagccugggagugagg

SEQ ID NO: 6423 - RNA, 22 nt, Homo sapiens
acugcacuccagccugcugggu

SEQ ID NO: 6424 - RNA, 22 nt, Homo sapiens
gcuaaaugcaugaggcgaugug

SEQ ID NO: 6425 - RNA, 22 nt, Homo sapiens
auggaaggagaggaaugaauga

SEQ ID NO: 6426 - RNA, 22 nt, Homo sapiens
gagauuauuuaaaaggugauuu

SEQ ID NO: 6427 - RNA, 22 nt, Homo sapiens
uguugcaccugccuugcuuuag

SEQ ID NO: 6428 - RNA, 22 nt, Homo sapiens
uuaaaguaauugaaauggccuu

SEQ ID NO: 6429 - RNA, 22 nt, Homo sapiens
ucagaacugaacaaaccagucu

SEQ ID NO: 6430 - RNA, 22 nt, Homo sapiens
guugugcuuaagccuauugauu

SEQ ID NO: 6431 - RNA, 22 nt, Homo sapiens
uagguaguuuucccguauccaa

SEQ ID NO: 6432 - RNA, 21 nt, Homo sapiens
ugcuauguuguccaggcuggc

SEQ ID NO: 6433 - RNA, 22 nt, Homo sapiens
auauggucccuguuaccucauu

SEQ ID NO: 6434 - RNA, 22 nt, Homo sapiens
auaauacugggaagaugagcau

SEQ ID NO: 6435 - RNA, 22 nt, Homo sapiens
aaagugccugacucauaguuag

SEQ ID NO: 6436 - RNA, 22 nt, Homo sapiens
cuaucacuguuuugaugcccgg

SEQ ID NO: 6437 - RNA, 19 nt, Homo sapiens
augugguuagcaugacugc

SEQ ID NO: 6438 - RNA, 23 nt, Homo sapiens
ugacaagagcgagacuuggucuc

SEQ ID NO: 6439 - RNA, 22 nt, Homo sapiens
uacagcacugugcauagugguu

SEQ ID NO: 6440 - RNA, 22 nt, Homo sapiens
aguagcaauggcucugagcuau

SEQ ID NO: 6441 - RNA, 22 nt, Homo sapiens
gaacuuucuacauuaccucuuu

SEQ ID NO: 6442 - RNA, 22 nt, Homo sapiens
uagaauggaaggcauguuugcc

SEQ ID NO: 6443 - RNA, 20 nt, Homo sapiens
gagcaucacaggccucugcu

SEQ ID NO: 6444 - RNA, 22 nt, Homo sapiens
gugaaucauaugccagucaugc

SEQ ID NO: 6445 - RNA, 22 nt, Homo sapiens
ugugucuccugaaaauucacau

SEQ ID NO: 6446 - RNA, 22 nt, Homo sapiens
ucauaugucauaguaugaucuu

SEQ ID NO: 6447 - RNA, 22 nt, Homo sapiens
ggagucugaacuggacaaugac

SEQ ID NO: 6448 - RNA, 22 nt, Homo sapiens
uucaagugaacaaaaugaggag

SEQ ID NO: 6449 - RNA, 22 nt, Homo sapiens
acaugacauugggguggggaua

SEQ ID NO: 6450 - RNA, 22 nt, Homo sapiens
cuuggcacucuguggaguuagg

SEQ ID NO: 6451 - RNA, 22 nt, Homo sapiens
cuuuaugagguuggauggaucu

SEQ ID NO: 6452 - RNA, 22 nt, Homo sapiens
aauggcauugguccuuuuggau

SEQ ID NO: 6453 - RNA, 22 nt, Homo sapiens
gagaugugguucaaggguguuu

SEQ ID NO: 6454 - RNA, 22 nt, Homo sapiens
gcaccguggaguauggggagga

SEQ ID NO: 6455 - RNA, 22 nt, Homo sapiens
cuuggcuccgacuccccuccaa

SEQ ID NO: 6456 - RNA, 22 nt, Homo sapiens
auuguacuagguccuagggcuu

SEQ ID NO: 6457 - RNA, 22 nt, Homo sapiens
agaguaguaggaugaauggacu

SEQ ID NO: 6458 - RNA, 22 nt, Homo sapiens
cagcuguguuauaaacuaccau

SEQ ID NO: 6459 - RNA, 22 nt, Homo sapiens
gucacugugaggaggggccagg

SEQ ID NO: 6460 - RNA, 20 nt, Homo sapiens
ucaaagacauggcugucaga

SEQ ID NO: 6461 - RNA, 22 nt, Homo sapiens
gugagauccucucuuauauggg

SEQ ID NO: 6462 - RNA, 22 nt, Homo sapiens
ucauacuguugugaaacaaaac

SEQ ID NO: 6463 - RNA, 19 nt, Homo sapiens
cuuaggugaccaguuccca

SEQ ID NO: 6464 - RNA, 22 nt, Homo sapiens
aucagauuccacauuuuaucag

SEQ ID NO: 6465 - RNA, 22 nt, Homo sapiens
ugacaagagaccccuccgcagg

SEQ ID NO: 6466 - RNA, 18 nt, Homo sapiens
uguagcaccuuucuugug

SEQ ID NO: 6467 - RNA, 21 nt, Homo sapiens
ugcccaguggcuuggggucag

SEQ ID NO: 6468 - RNA, 23 nt, Homo sapiens
uugcaaagccugaaacucuucag

SEQ ID NO: 6469 - RNA, 22 nt, Homo sapiens
uugauaugaauggcuguuugug

SEQ ID NO: 6470 - RNA, 22 nt, Homo sapiens
aacugccucugacauaggcagg

SEQ ID NO: 6471 - RNA, 22 nt, Homo sapiens
ucagaguggagucugcagccuu

SEQ ID NO: 6472 - RNA, 22 nt, Homo sapiens
uucaucagggguauuggccaau

SEQ ID NO: 6473 - RNA, 22 nt, Homo sapiens
agugcaauggugccaucauagc

SEQ ID NO: 6474 - RNA, 22 nt, Homo sapiens
agucaagugguuucugaguugg

SEQ ID NO: 6475 - RNA, 22 nt, Homo sapiens
auuguguuugaaugaggcucca

SEQ ID NO: 6476 - RNA, 22 nt, Homo sapiens
uugggcauugggcuaaacuccc

SEQ ID NO: 6477 - RNA, 22 nt, Homo sapiens
augcauaugucuuuauaguggc

SEQ ID NO: 6478 - RNA, 22 nt, Homo sapiens
augauucugaucuagagcuugg

SEQ ID NO: 6479 - RNA, 22 nt, Homo sapiens
aaagugcugagucuaggcgggg

SEQ ID NO: 6480 - RNA, 22 nt, Homo sapiens
ugauccccucacauuauuauau

SEQ ID NO: 6481 - RNA, 22 nt, Homo sapiens
agguagcauagcgggaauauca

SEQ ID NO: 6482 - RNA, 22 nt, Homo sapiens
cgaguguaguaggccauaugaa

SEQ ID NO: 6483 - RNA, 22 nt, Homo sapiens
auccuacaguccauucuuugug

SEQ ID NO: 6484 - RNA, 22 nt, Homo sapiens
ccaucacaggccucagugggaa

SEQ ID NO: 6485 - RNA, 21 nt, Homo sapiens
ccuugagaacaucaauuugcu

SEQ ID NO: 6486 - RNA, 21 nt, Homo sapiens
uggaccccuuccuuacaucau

SEQ ID NO: 6487 - RNA, 22 nt, Homo sapiens
uggggucguaggugcccgccag

SEQ ID NO: 6488 - RNA, 19 nt, Homo sapiens
agugggcuagaaaucaggg

SEQ ID NO: 6489 - RNA, 22 nt, Homo sapiens
uugagucguuaccuauaacaga

SEQ ID NO: 6490 - RNA, 22 nt, Homo sapiens
uggagagugagggccuccuuaa

SEQ ID NO: 6491 - RNA, 22 nt, Homo sapiens
auggaucuuucugcuuuugaau

SEQ ID NO: 6492 - RNA, 22 nt, Homo sapiens
caccacuacaccccaggcuggg

SEQ ID NO: 6493 - RNA, 22 nt, Homo sapiens
cauggcccuggguccauaggaa

SEQ ID NO: 6494 - RNA, 22 nt, Homo sapiens
uuacagauggauggcagcuggc

SEQ ID NO: 6495 - RNA, 22 nt, Homo sapiens
gauuuguauuaaaagugugacg

SEQ ID NO: 6496 - RNA, 22 nt, Homo sapiens
gacacugucuucugcucuuaaa

SEQ ID NO: 6497 - RNA, 22 nt, Homo sapiens
gagguuauuggggugcuugugu

SEQ ID NO: 6498 - RNA, 22 nt, Homo sapiens
uaccugagaaagaaagcccucg

SEQ ID NO: 6499 - RNA, 21 nt, Homo sapiens
cugguguuagcacuucuuccc

SEQ ID NO: 6500 - RNA, 22 nt, Homo sapiens
ggaagugcuguguggaagucug

SEQ ID NO: 6501 - RNA, 22 nt, Homo sapiens
guucacacuugcaaccccagca

SEQ ID NO: 6502 - RNA, 22 nt, Homo sapiens
augaccuuguccucagugucau

SEQ ID NO: 6503 - RNA, 22 nt, Homo sapiens
cuggaaaguagacaaucuaaaa

SEQ ID NO: 6504 - RNA, 22 nt, Homo sapiens
aucuacuugcugggucucugga

SEQ ID NO: 6505 - RNA, 22 nt, Homo sapiens
uaguaggacaggauuucaguua

SEQ ID NO: 6506 - RNA, 22 nt, Homo sapiens
ugagaacuaaaaugugguauau

SEQ ID NO: 6507 - RNA, 20 nt, Homo sapiens
agcuggguguguuggugcau

SEQ ID NO: 6508 - RNA, 22 nt, Homo sapiens
ugaauguccugacgcugcaguu

SEQ ID NO: 6509 - RNA, 22 nt, Homo sapiens
gucuuugcauguauguucauga

SEQ ID NO: 6510 - RNA, 22 nt, Homo sapiens
ugcaaauguuaggugucauuau

SEQ ID NO: 6511 - RNA, 22 nt, Homo sapiens
caccugagcgggaugcucgccu

SEQ ID NO: 6512 - RNA, 22 nt, Homo sapiens
uugugguuuuagcacuguggau

SEQ ID NO: 6513 - RNA, 22 nt, Homo sapiens
caaaguaauugugguuuugcca

SEQ ID NO: 6514 - RNA, 22 nt, Homo sapiens
gagugcaauggcaugaucuugg

SEQ ID NO: 6515 - RNA, 22 nt, Homo sapiens
ugauuggagaugaauuucguuu

SEQ ID NO: 6516 - RNA, 22 nt, Homo sapiens
uuggacaagauugcagagaauu

SEQ ID NO: 6517 - RNA, 22 nt, Homo sapiens
aucacagauauggguuuaaauc

SEQ ID NO: 6518 - RNA, 22 nt, Homo sapiens
caacaguaaagcauuuuuaagu

SEQ ID NO: 6519 - RNA, 22 nt, Homo sapiens
gugagaagaaaaauauggcugu

SEQ ID NO: 6520 - RNA, 20 nt, Homo sapiens
uucuacagucacaggaagau

SEQ ID NO: 6521 - RNA, 22 nt, Homo sapiens
uuuugcaggcauuggaaguuua

SEQ ID NO: 6522 - RNA, 22 nt, Homo sapiens
cuaauccugugguagcacucaa

SEQ ID NO: 6523 - RNA, 22 nt, Homo sapiens
cuccccuuuaguuucuuaauaa

SEQ ID NO: 6524 - RNA, 20 nt, Homo sapiens
acccucuaggaugauuucuu

SEQ ID NO: 6525 - RNA, 22 nt, Homo sapiens
agcuggauguggaugacccugu

SEQ ID NO: 6526 - RNA, 22 nt, Homo sapiens
auugcagaaaugacagagcgcc

SEQ ID NO: 6527 - RNA, 22 nt, Homo sapiens
uauauguucugugucccuuucg

SEQ ID NO: 6528 - RNA, 22 nt, Homo sapiens
gacuauguuaccuuacacauca

SEQ ID NO: 6529 - RNA, 22 nt, Homo sapiens
augaaagucaauccccaagugu

SEQ ID NO: 6530 - RNA, 22 nt, Homo sapiens
uaucauugccucaaucuguauu

SEQ ID NO: 6531 - RNA, 22 nt, Homo sapiens
gggcagaugucuggacaccuca

SEQ ID NO: 6532 - RNA, 22 nt, Homo sapiens
uaacaggcaaggucacaccuug

SEQ ID NO: 6533 - RNA, 22 nt, Homo sapiens
uacacgugcacaacgugcacgu

SEQ ID NO: 6534 - RNA, 22 nt, Homo sapiens
auguauacaugcaggucacagg

SEQ ID NO: 6535 - RNA, 22 nt, Homo sapiens
agagauacauucugagaagugc

SEQ ID NO: 6536 - RNA, 22 nt, Homo sapiens
cugugcauucuuaaaucaggaa

SEQ ID NO: 6537 - RNA, 22 nt, Homo sapiens
ugccagaugcaguguucaacaa

SEQ ID NO: 6538 - RNA, 22 nt, Homo sapiens
cacaaugucuaagauguuucua

SEQ ID NO: 6539 - RNA, 22 nt, Homo sapiens
ugcuauguaacacauuaccuuu

SEQ ID NO: 6540 - RNA, 22 nt, Homo sapiens
uaucacagugcuggaguauucc

SEQ ID NO: 6541 - RNA, 22 nt, Homo sapiens
auggcacugauggaaguaccuu

SEQ ID NO: 6542 - RNA, 22 nt, Homo sapiens
uauugguugcuaauuggcgcca

SEQ ID NO: 6543 - RNA, 22 nt, Homo sapiens
gagcaguugagagugcuggcca

SEQ ID NO: 6544 - RNA, 22 nt, Homo sapiens
uucaaaggauuuagauuagcua

SEQ ID NO: 6545 - RNA, 22 nt, Homo sapiens
agagucacaugaggcccuucau

SEQ ID NO: 6546 - RNA, 22 nt, Homo sapiens
gugaaugcauuaagaaggggga

SEQ ID NO: 6547 - RNA, 22 nt, Homo sapiens
ugagauguggcuagagagguug

SEQ ID NO: 6548 - RNA, 22 nt, Homo sapiens
guauggguuuuguuucuucugg

SEQ ID NO: 6549 - RNA, 22 nt, Homo sapiens
uaaggcccggccuuuccaagca

SEQ ID NO: 6550 - RNA, 21 nt, Homo sapiens
uguaacugcaaaccucagauu

SEQ ID NO: 6551 - RNA, 22 nt, Homo sapiens
ucaggcaccuuccucuuaucug

SEQ ID NO: 6552 - RNA, 22 nt, Homo sapiens
ugcaaagucgaaacugcaguuu

SEQ ID NO: 6553 - RNA, 22 nt, Homo sapiens
ucuggcaagagccgagggcagu

SEQ ID NO: 6554 - RNA, 22 nt, Homo sapiens
augcauauuuuaccuagaagag

SEQ ID NO: 6555 - RNA, 20 nt, Homo sapiens
ugagauaguaauccccuaca

SEQ ID NO: 6556 - RNA, 22 nt, Homo sapiens
gguaggcacuggugggaagaga

SEQ ID NO: 6557 - RNA, 22 nt, Homo sapiens
uucccuuucugaaaaucucauu

SEQ ID NO: 6558 - RNA, 23 nt, Homo sapiens
cuuugguaggaaauuugaauuau

SEQ ID NO: 6559 - RNA, 22 nt, Homo sapiens
ucacgugguucauaaggcagaa

SEQ ID NO: 6560 - RNA, 22 nt, Homo sapiens
caaaugacaucauuucauucaa

SEQ ID NO: 6561 - RNA, 22 nt, Homo sapiens
augugacuggaucauggggacg

SEQ ID NO: 6562 - RNA, 22 nt, Homo sapiens
ggcagcgugcacuuucgccacu

SEQ ID NO: 6563 - RNA, 22 nt, Homo sapiens
auggaacauaacuauuugggga

SEQ ID NO: 6564 - RNA, 20 nt, Homo sapiens
auucaaguaugccuugagaa

SEQ ID NO: 6565 - RNA, 20 nt, Homo sapiens
guuaaggcagcauuacucuu

SEQ ID NO: 6566 - RNA, 22 nt, Homo sapiens
uauuaguuguaugauucccaag

SEQ ID NO: 6567 - RNA, 22 nt, Homo sapiens
uacccuuuaguauaaaaucaga

SEQ ID NO: 6568 - RNA, 22 nt, Homo sapiens
agagaacuguuuacacguuaau

SEQ ID NO: 6569 - RNA, 22 nt, Homo sapiens
acugcacuccagcccaggugac

SEQ ID NO: 6570 - RNA, 22 nt, Homo sapiens
auuuaacuggucuaggggccca

SEQ ID NO: 6571 - RNA, 22 nt, Homo sapiens
auggcugugaaaugguaggugg

SEQ ID NO: 6572 - RNA, 22 nt, Homo sapiens
gugaaauacauaaucccaagug

SEQ ID NO: 6573 - RNA, 22 nt, Homo sapiens
uggaagacucaagguggugaau

SEQ ID NO: 6574 - RNA, 22 nt, Homo sapiens
uugggcauugcuauaaauucuu

SEQ ID NO: 6575 - RNA, 16 nt, Homo sapiens
ucaucacagucucugg

SEQ ID NO: 6576 - RNA, 22 nt, Homo sapiens
gugguuuuaauauucagucuag

SEQ ID NO: 6577 - RNA, 22 nt, Homo sapiens
ucucaguuuucaagcugucgau

SEQ ID NO: 6578 - RNA, 22 nt, Homo sapiens
uuuuaagcuacaagagacauau

SEQ ID NO: 6579 - RNA, 22 nt, Homo sapiens
uauggccugaauuagaaaagug

SEQ ID NO: 6580 - RNA, 21 nt, Homo sapiens
uggauugagaaccccaggagg

SEQ ID NO: 6581 - RNA, 22 nt, Homo sapiens
uucuucaguuacaacaaggggg

SEQ ID NO: 6582 - RNA, 22 nt, Homo sapiens
cauugcacuccagcucugggcg

SEQ ID NO: 6583 - RNA, 22 nt, Homo sapiens
gagguagguuugguuacaaaag

SEQ ID NO: 6584 - RNA, 22 nt, Homo sapiens
aaagugcuucucuuuggugggu

SEQ ID NO: 6585 - RNA, 22 nt, Homo sapiens
cccuguguuguucaaggaucug

SEQ ID NO: 6586 - RNA, 22 nt, Homo sapiens
ucaaaugauucuccugccucag

SEQ ID NO: 6587 - RNA, 23 nt, Homo sapiens
augacacuccugugcgcacccug

SEQ ID NO: 6588 - RNA, 22 nt, Homo sapiens
acuguacugucuggggcagucu

SEQ ID NO: 6589 - RNA, 22 nt, Homo sapiens
ucacugagcuagaucacuugac

SEQ ID NO: 6590 - RNA, 22 nt, Homo sapiens
guagguaaguacuucuggugag

SEQ ID NO: 6591 - RNA, 22 nt, Homo sapiens
uagauucauuuuagcaaaaguu

SEQ ID NO: 6592 - RNA, 22 nt, Homo sapiens
ugagagaugaacucugauaugu

SEQ ID NO: 6593 - RNA, 22 nt, Homo sapiens
auacuguacugaaguacccauu

SEQ ID NO: 6594 - RNA, 22 nt, Homo sapiens
ugucaguggucuggaugcagcc

SEQ ID NO: 6595 - RNA, 22 nt, Homo sapiens
agauucauccaaguuguugcau

SEQ ID NO: 6596 - RNA, 22 nt, Homo sapiens
auugcacuccagcuuaggcgac

SEQ ID NO: 6597 - RNA, 22 nt, Homo sapiens
uacuuuguuauagcagcaggaa

SEQ ID NO: 6598 - RNA, 22 nt, Homo sapiens
ucguggccugugaguccucccc

SEQ ID NO: 6599 - RNA, 22 nt, Homo sapiens
guaggcacugaguguuuuacag

SEQ ID NO: 6600 - RNA, 21 nt, Homo sapiens
ugcauaucucuaaugaccagu

SEQ ID NO: 6601 - RNA, 22 nt, Homo sapiens
gugacaguggagacuuacuuca

SEQ ID NO: 6602 - RNA, 22 nt, Homo sapiens
acaauggaauggaguggaaagu

SEQ ID NO: 6603 - RNA, 22 nt, Homo sapiens
uuacccuuuaacccuuuaaagu

SEQ ID NO: 6604 - RNA, 22 nt, Homo sapiens
gacugaguaagcagaagcaauu

SEQ ID NO: 6605 - RNA, 22 nt, Homo sapiens
aaggaacuggaauauuuugaac

SEQ ID NO: 6606 - RNA, 22 nt, Homo sapiens
uguugcacucuagccugggcaa

SEQ ID NO: 6607 - RNA, 22 nt, Homo sapiens
agaauguaacucuaugaaggca

SEQ ID NO: 6608 - RNA, 22 nt, Homo sapiens
ugagacggagucucgcucucua

SEQ ID NO: 6609 - RNA, 22 nt, Homo sapiens
uucuggccuccauuuuucuccu

SEQ ID NO: 6610 - RNA, 22 nt, Homo sapiens
auagagugcuucaucaguagua

SEQ ID NO: 6611 - RNA, 22 nt, Homo sapiens
auaucacagguguuuaccugau

SEQ ID NO: 6612 - RNA, 19 nt, Homo sapiens
ugugacugguugucucgcu

SEQ ID NO: 6613 - RNA, 22 nt, Homo sapiens
cuuggcuucuuuauguggcuau

SEQ ID NO: 6614 - RNA, 22 nt, Homo sapiens
accauugcacuccagcccaggc

SEQ ID NO: 6615 - RNA, 22 nt, Homo sapiens
acacuacuggguauauguguuu

SEQ ID NO: 6616 - RNA, 22 nt, Homo sapiens
cuaucucauugguuuuugaaag

SEQ ID NO: 6617 - RNA, 22 nt, Homo sapiens
ugaauagaaguggcaggaguag

SEQ ID NO: 6618 - RNA, 22 nt, Homo sapiens
uagaaugucagcuucuugaggg

SEQ ID NO: 6619 - RNA, 20 nt, Homo sapiens
guaaacucucagcauagaug

SEQ ID NO: 6620 - RNA, 22 nt, Homo sapiens
augacagagauaugugaauuuu

SEQ ID NO: 6621 - RNA, 22 nt, Homo sapiens
ugucacauccaagaaggugcag

SEQ ID NO: 6622 - RNA, 22 nt, Homo sapiens
uccacaauggcugaacuagauu

SEQ ID NO: 6623 - RNA, 22 nt, Homo sapiens
gccauugcacucuagccugagc

SEQ ID NO: 6624 - RNA, 22 nt, Homo sapiens
gugguuuuuaaaguaccugugg

SEQ ID NO: 6625 - RNA, 22 nt, Homo sapiens
gauugcaauuuaggugagagag

SEQ ID NO: 6626 - RNA, 22 nt, Homo sapiens
uccaguuguucucgaagcuccu

SEQ ID NO: 6627 - RNA, 19 nt, Homo sapiens
aaaguguuuuaaagaggau

SEQ ID NO: 6628 - RNA, 22 nt, Homo sapiens
ucaacacaguuaaauggggaaa

SEQ ID NO: 6629 - RNA, 21 nt, Homo sapiens
aguagcacugugucuuacaaa

SEQ ID NO: 6630 - RNA, 22 nt, Homo sapiens
ugucaccuugcucauccucgga

SEQ ID NO: 6631 - RNA, 22 nt, Homo sapiens
agugagcuguuuuuacuuucug

SEQ ID NO: 6632 - RNA, 22 nt, Homo sapiens
uggcuccguuguacaggcugga

SEQ ID NO: 6633 - RNA, 22 nt, Homo sapiens
cuugugauugcacggcugccug

SEQ ID NO: 6634 - RNA, 22 nt, Homo sapiens
uccccugagaccccucagcacu

SEQ ID NO: 6635 - RNA, 22 nt, Homo sapiens
uugcgcuuuuccuauguugccc

SEQ ID NO: 6636 - RNA, 22 nt, Homo sapiens
aucaccauguguacauuagacc

SEQ ID NO: 6637 - RNA, 22 nt, Homo sapiens
ucuuugagugcccugagucccu

SEQ ID NO: 6638 - RNA, 22 nt, Homo sapiens
guauuagguuggggcaaaagua

SEQ ID NO: 6639 - RNA, 22 nt, Homo sapiens
auagugcugcauuaaacauacg

SEQ ID NO: 6640 - RNA, 22 nt, Homo sapiens
aaaugcagauucugcuuagguu

SEQ ID NO: 6641 - RNA, 22 nt, Homo sapiens
caagugcuugaugaaugaucaa

SEQ ID NO: 6642 - RNA, 22 nt, Homo sapiens
uagcagcuuuauugagguaaau

SEQ ID NO: 6643 - RNA, 22 nt, Homo sapiens
auagcagugugaaaacagacug

SEQ ID NO: 6644 - RNA, 22 nt, Homo sapiens
uagcacaucuucuuggccugca

SEQ ID NO: 6645 - RNA, 22 nt, Homo sapiens
uucccuuucugccuugaaucuu

SEQ ID NO: 6646 - RNA, 22 nt, Homo sapiens
gugaccagaugggcaggggugu

SEQ ID NO: 6647 - RNA, 18 nt, Homo sapiens
uggccaauggcaaacaga

SEQ ID NO: 6648 - RNA, 22 nt, Homo sapiens
gugaaaagaugagcaccauaca

SEQ ID NO: 6649 - RNA, 22 nt, Homo sapiens
aaugccuagugugugacaggug

SEQ ID NO: 6650 - RNA, 22 nt, Homo sapiens
auuguguagucuuacugcuugc

SEQ ID NO: 6651 - RNA, 19 nt, Homo sapiens
ucuuugguacgugcuuuga

SEQ ID NO: 6652 - RNA, 20 nt, Homo sapiens
gaucaguuuggaguaagugc

SEQ ID NO: 6653 - RNA, 22 nt, Homo sapiens
uuugguccaguguucagguccu

SEQ ID NO: 6654 - RNA, 22 nt, Homo sapiens
aauugcaccaucuagaucaaga

SEQ ID NO: 6655 - RNA, 22 nt, Homo sapiens
acaccauugcauuccagccugg

SEQ ID NO: 6656 - RNA, 22 nt, Homo sapiens
aagugcuggccuacucaaucga

SEQ ID NO: 6657 - RNA, 23 nt, Homo sapiens
uugaaaagucaguagccucugau

SEQ ID NO: 6658 - RNA, 22 nt, Homo sapiens
auugcucuuagaaauauuucuu

SEQ ID NO: 6659 - RNA, 22 nt, Homo sapiens
uggcuuuuccuugaaucugccu

SEQ ID NO: 6660 - RNA, 22 nt, Homo sapiens
ugggcauggaguggccuuaugu

SEQ ID NO: 6661 - RNA, 19 nt, Homo sapiens
uuucccugcagaccuacua

SEQ ID NO: 6662 - RNA, 22 nt, Homo sapiens
cugagaaugaugauuuccaguu

SEQ ID NO: 6663 - RNA, 22 nt, Homo sapiens
auugcucacacaaagccuguuu

SEQ ID NO: 6664 - RNA, 20 nt, Homo sapiens
uuuugaacuuggcaaccugu

SEQ ID NO: 6665 - RNA, 22 nt, Homo sapiens
uuacagucuuaggcagugcuuu

SEQ ID NO: 6666 - RNA, 22 nt, Homo sapiens
guauuugauuauagcaugcuua

SEQ ID NO: 6667 - RNA, 22 nt, Homo sapiens
cugagaguugaugaaauauggu

SEQ ID NO: 6668 - RNA, 22 nt, Homo sapiens
ggaaagcuagguguggguguac

SEQ ID NO: 6669 - RNA, 20 nt, Homo sapiens
gaaacaucuauccucuccuu

SEQ ID NO: 6670 - RNA, 22 nt, Homo sapiens
cggucacagugauucaaggguc

SEQ ID NO: 6671 - RNA, 17 nt, Homo sapiens
uauugaccuuuguaugu

SEQ ID NO: 6672 - RNA, 21 nt, Homo sapiens
ugagaugcaaucaccagggag

SEQ ID NO: 6673 - RNA, 22 nt, Homo sapiens
uuguauguugaaugaugguaua

SEQ ID NO: 6674 - RNA, 22 nt, Homo sapiens
augagaucaaauuuaagcuguu

SEQ ID NO: 6675 - RNA, 22 nt, Homo sapiens
uuagcagugugaaaaaagacua

SEQ ID NO: 6676 - RNA, 22 nt, Homo sapiens
uccauagacauuuuaagguagu

SEQ ID NO: 6677 - RNA, 19 nt, Homo sapiens
ccucaaguacuaauauguu

SEQ ID NO: 6678 - RNA, 22 nt, Homo sapiens
gccaagauugguuuaauauucc

SEQ ID NO: 6679 - RNA, 22 nt, Homo sapiens
ccauacugucaaauagauuucc

SEQ ID NO: 6680 - RNA, 21 nt, Homo sapiens
auguaaugaagaagccacugg

SEQ ID NO: 6681 - RNA, 22 nt, Homo sapiens
acugugcuguuuuaauuauuga

SEQ ID NO: 6682 - RNA, 21 nt, Homo sapiens
cagguagugucugaagccaga

SEQ ID NO: 6683 - RNA, 22 nt, Homo sapiens
aucucauuccuucugggcugau

SEQ ID NO: 6684 - RNA, 22 nt, Homo sapiens
ugaauguuugcuuacuuccaua

SEQ ID NO: 6685 - RNA, 22 nt, Homo sapiens
ugugacaaauuuaguggacugu

SEQ ID NO: 6686 - RNA, 22 nt, Homo sapiens
agacacugaaauguauugaaga

SEQ ID NO: 6687 - RNA, 22 nt, Homo sapiens
augugacugauggagaauaugu

SEQ ID NO: 6688 - RNA, 22 nt, Homo sapiens
uaguuguugcagguaggaugua

SEQ ID NO: 6689 - RNA, 22 nt, Homo sapiens
aauggcucuguuggcccaagac

SEQ ID NO: 6690 - RNA, 22 nt, Homo sapiens
aauaaaguaggaggugaggaaa

SEQ ID NO: 6691 - RNA, 22 nt, Homo sapiens
auugcacucugaucugcacucc

SEQ ID NO: 6692 - RNA, 22 nt, Homo sapiens
uccaguuauccuguggggagga

SEQ ID NO: 6693 - RNA, 22 nt, Homo sapiens
ucaguacuuuggagcucacaua

SEQ ID NO: 6694 - RNA, 22 nt, Homo sapiens
ugaggugaggguaucaaaugcu

SEQ ID NO: 6695 - RNA, 22 nt, Homo sapiens
gggguauguaagugagugagug

SEQ ID NO: 6696 - RNA, 22 nt, Homo sapiens
uaaagcuaugagaacaccguag

SEQ ID NO: 6697 - RNA, 22 nt, Homo sapiens
cauugcaugcauauggcuuggu

SEQ ID NO: 6698 - RNA, 22 nt, Homo sapiens
cagguacaugcaugugugugca

SEQ ID NO: 6699 - RNA, 22 nt, Homo sapiens
gugcacaugcgugcgcacauau

SEQ ID NO: 6700 - RNA, 22 nt, Homo sapiens
ccucauggagaacaucugcuag

SEQ ID NO: 6701 - RNA, 22 nt, Homo sapiens
ugagauaacuaaaaacauuuug

SEQ ID NO: 6702 - RNA, 22 nt, Homo sapiens
uaacagucuccucaagguguug

SEQ ID NO: 6703 - RNA, 22 nt, Homo sapiens
ugugaacugagcauuaacuaca

SEQ ID NO: 6704 - RNA, 22 nt, Homo sapiens
ugugggugguaaaauacaauga

SEQ ID NO: 6705 - RNA, 22 nt, Homo sapiens
ccuucauccuccagcaggcuag

SEQ ID NO: 6706 - RNA, 22 nt, Homo sapiens
guagggcaggcugagaaauaua

SEQ ID NO: 6707 - RNA, 22 nt, Homo sapiens
uucacgguguucacgggggucc

SEQ ID NO: 6708 - RNA, 22 nt, Homo sapiens
uuguacaggaguguaagcuuca

SEQ ID NO: 6709 - RNA, 22 nt, Homo sapiens
uaugauuuuugggagaggucaa

SEQ ID NO: 6710 - RNA, 22 nt, Homo sapiens
aaauggauuaaguucacuugcu

SEQ ID NO: 6711 - RNA, 22 nt, Homo sapiens
ucccuggagcaagagaagaagg

SEQ ID NO: 6712 - RNA, 22 nt, Homo sapiens
guggcaugaaagcagauaccac

SEQ ID NO: 6713 - RNA, 22 nt, Homo sapiens
uaccaugcagguguauguuugu

SEQ ID NO: 6714 - RNA, 22 nt, Homo sapiens
ugagauaaagcauguacugugu

SEQ ID NO: 6715 - RNA, 22 nt, Homo sapiens
gugguacccucaggcccuuuuc

SEQ ID NO: 6716 - RNA, 23 nt, Homo sapiens
uaucucaaugcacagagaggaaa

SEQ ID NO: 6717 - RNA, 22 nt, Homo sapiens
ucagugcaggaauuuccuuaga

SEQ ID NO: 6718 - RNA, 22 nt, Homo sapiens
cauugcacuccagccuuggcaa

SEQ ID NO: 6719 - RNA, 22 nt, Homo sapiens
ugcagugugaaagagccugaca

SEQ ID NO: 6720 - RNA, 22 nt, Homo sapiens
ugcugguaguuuaugacuaauu

SEQ ID NO: 6721 - RNA, 23 nt, Homo sapiens
uuguucccuuccacucagucucc

SEQ ID NO: 6722 - RNA, 22 nt, Homo sapiens
cuucugauugaaaauggaguag

SEQ ID NO: 6723 - RNA, 22 nt, Homo sapiens
uuccaugugggcuugucaagua

SEQ ID NO: 6724 - RNA, 22 nt, Homo sapiens
gauaacagauaaugucaguuau

SEQ ID NO: 6725 - RNA, 23 nt, Homo sapiens
uaucacacuuucucugugccaca

SEQ ID NO: 6726 - RNA, 22 nt, Homo sapiens
cuuugguggagucuuuagguuc

SEQ ID NO: 6727 - RNA, 19 nt, Homo sapiens
uucagcagugucugcucuu

SEQ ID NO: 6728 - RNA, 22 nt, Homo sapiens
ugucaguuuuaacuagggaaua

SEQ ID NO: 6729 - RNA, 22 nt, Homo sapiens
auagugcugcaaucaacauaca

SEQ ID NO: 6730 - RNA, 22 nt, Homo sapiens
gacaguuuggugaggaagacga

SEQ ID NO: 6731 - RNA, 22 nt, Homo sapiens
guccagagaagucauuacuuca

SEQ ID NO: 6732 - RNA, 23 nt, Homo sapiens
accugauguuucuguggggagcc

SEQ ID NO: 6733 - RNA, 22 nt, Homo sapiens
ugauacuggcuucauagaauga

SEQ ID NO: 6734 - RNA, 22 nt, Homo sapiens
aaagugcaguauuugggcagga

SEQ ID NO: 6735 - RNA, 22 nt, Homo sapiens
gugcauguccacuaguccauau

SEQ ID NO: 6736 - RNA, 22 nt, Homo sapiens
cucacaugcucaccugguguuc

SEQ ID NO: 6737 - RNA, 22 nt, Homo sapiens
uuugaggaaaggcauaaguagg

SEQ ID NO: 6738 - RNA, 18 nt, Homo sapiens
ggaagauuggcuaugugc

SEQ ID NO: 6739 - RNA, 20 nt, Homo sapiens
ugauauuuucugagcaggaa

SEQ ID NO: 6740 - RNA, 22 nt, Homo sapiens
uugagauggagucucacuccuu

SEQ ID NO: 6741 - RNA, 22 nt, Homo sapiens
ucaaaugauucagaagccaccu

SEQ ID NO: 6742 - RNA, 22 nt, Homo sapiens
acuggguuaauuugaagguuga

SEQ ID NO: 6743 - RNA, 22 nt, Homo sapiens
aacucacauucuuucuugguac

SEQ ID NO: 6744 - RNA, 22 nt, Homo sapiens
ugugagaaaugcagaaucucag

SEQ ID NO: 6745 - RNA, 22 nt, Homo sapiens
ugagaaugaugauugguaaacc

SEQ ID NO: 6746 - RNA, 22 nt, Homo sapiens
uuuaacauuggaugagaucguc

SEQ ID NO: 6747 - RNA, 22 nt, Homo sapiens
cuagagagaagcugugugaccu

SEQ ID NO: 6748 - RNA, 22 nt, Homo sapiens
cagcuguuguugggguauagga

SEQ ID NO: 6749 - RNA, 22 nt, Homo sapiens
ccuuuuugaguugccagaguuc

SEQ ID NO: 6750 - RNA, 22 nt, Homo sapiens
ccuugguaauguguuuuauucu

SEQ ID NO: 6751 - RNA, 22 nt, Homo sapiens
uaaguacuuuacagacauuauc

SEQ ID NO: 6752 - RNA, 22 nt, Homo sapiens
gagaugauuugccccauguauu

SEQ ID NO: 6753 - RNA, 22 nt, Homo sapiens
ucaaguagugacucgaguuauu

SEQ ID NO: 6754 - RNA, 22 nt, Homo sapiens
cauugcacuccagccuaggcaa

SEQ ID NO: 6755 - RNA, 22 nt, Homo sapiens
acagccauuccagccaaauacu

SEQ ID NO: 6756 - RNA, 19 nt, Homo sapiens
caauacuucuuggcauaca

SEQ ID NO: 6757 - RNA, 22 nt, Homo sapiens
uaugucacuugguuuggugcua

SEQ ID NO: 6758 - RNA, 20 nt, Homo sapiens
ggagagugacauaauucugg

SEQ ID NO: 6759 - RNA, 22 nt, Homo sapiens
cuacagaguaucuaaagaggua

SEQ ID NO: 6760 - RNA, 22 nt, Homo sapiens
gugaguaaagguucauugaauu

SEQ ID NO: 6761 - RNA, 22 nt, Homo sapiens
cuaugguaggggcuggaggaag

SEQ ID NO: 6762 - RNA, 22 nt, Homo sapiens
uuuggcaugggcuauuugcuuu

SEQ ID NO: 6763 - RNA, 22 nt, Homo sapiens
uucaagauggcaccagugagug

SEQ ID NO: 6764 - RNA, 22 nt, Homo sapiens
ugauaugaucgcccuagcuuga

SEQ ID NO: 6765 - RNA, 22 nt, Homo sapiens
aaagcuagagaagcugcuguca

SEQ ID NO: 6766 - RNA, 22 nt, Homo sapiens
ucuaugguuuauuuccaagugu

SEQ ID NO: 6767 - RNA, 22 nt, Homo sapiens
aggcaggugaaagauaguuuua

SEQ ID NO: 6768 - RNA, 23 nt, Homo sapiens
gggauuguaaaauaugagggcag

SEQ ID NO: 6769 - RNA, 22 nt, Homo sapiens
uaaugcaucagugguaguucuu

SEQ ID NO: 6770 - RNA, 22 nt, Homo sapiens
ucagaguagcugucugaggugc

SEQ ID NO: 6771 - RNA, 22 nt, Homo sapiens
gaugguggucuacccuuucccu

SEQ ID NO: 6772 - RNA, 22 nt, Homo sapiens
gaugcagcuaggauuugugaca

SEQ ID NO: 6773 - RNA, 20 nt, Homo sapiens
acugcacuccagccuuccag

SEQ ID NO: 6774 - RNA, 22 nt, Homo sapiens
gucaguuucacucagcuggaac

SEQ ID NO: 6775 - RNA, 18 nt, Homo sapiens
uccauugcagcauuauuu

SEQ ID NO: 6776 - RNA, 22 nt, Homo sapiens
ucauaggucacuguaaccucgu

SEQ ID NO: 6777 - RNA, 22 nt, Homo sapiens
uucccaguggaacauguaguca

SEQ ID NO: 6778 - RNA, 22 nt, Homo sapiens
ucuuuguguaggucaaucuggc

SEQ ID NO: 6779 - RNA, 22 nt, Homo sapiens
cuaugagucugcagaucuauua

SEQ ID NO: 6780 - RNA, 22 nt, Homo sapiens
aggcuuuauuacagggucucag

SEQ ID NO: 6781 - RNA, 22 nt, Homo sapiens
uuccuuguuuauuuacaggagg

SEQ ID NO: 6782 - RNA, 22 nt, Homo sapiens
gaccugagagguacauguauuu

SEQ ID NO: 6783 - RNA, 22 nt, Homo sapiens
ucagaacugauacuagaacuuu

SEQ ID NO: 6784 - RNA, 21 nt, Homo sapiens
uguauacauggaagaaugguc

SEQ ID NO: 6785 - RNA, 22 nt, Homo sapiens
guuauguuauguuauguuaugu

SEQ ID NO: 6786 - RNA, 22 nt, Homo sapiens
auugucacccgggcaguaagca

SEQ ID NO: 6787 - RNA, 18 nt, Homo sapiens
ugaguucauuagacuucc

SEQ ID NO: 6788 - RNA, 22 nt, Homo sapiens
ggaauguuaaagacuacacuga

SEQ ID NO: 6789 - RNA, 22 nt, Homo sapiens
ucaguggagcuacaauucuggg

SEQ ID NO: 6790 - RNA, 22 nt, Homo sapiens
agucacagguucuugggauuag

SEQ ID NO: 6791 - RNA, 21 nt, Homo sapiens
acccccacaccuccuuaguuc

SEQ ID NO: 6792 - RNA, 22 nt, Homo sapiens
uaagguguagacuggucacaag

SEQ ID NO: 6793 - RNA, 22 nt, Homo sapiens
ugcaccauuacacuccaggcug

SEQ ID NO: 6794 - RNA, 17 nt, Homo sapiens
gcacuggcguaucccac

SEQ ID NO: 6795 - RNA, 22 nt, Homo sapiens
guggaauggaaugauuguguau

SEQ ID NO: 6796 - RNA, 22 nt, Homo sapiens
uugauccucugagaaucuaucg

SEQ ID NO: 6797 - RNA, 22 nt, Homo sapiens
ugguaaguuuaacaugcauccc

SEQ ID NO: 6798 - RNA, 22 nt, Homo sapiens
acuccauuuccagagcagcccc

SEQ ID NO: 6799 - RNA, 22 nt, Homo sapiens
acccuguugagcaacuggccau

SEQ ID NO: 6800 - RNA, 17 nt, Homo sapiens
guugaguuugagucaag

SEQ ID NO: 6801 - RNA, 22 nt, Homo sapiens
cuacaguguauuuauggagggu

SEQ ID NO: 6802 - RNA, 22 nt, Homo sapiens
gcaguagugugaucuuggcuca

SEQ ID NO: 6803 - RNA, 22 nt, Homo sapiens
uuuugcacauugauuugguauc

SEQ ID NO: 6804 - RNA, 22 nt, Homo sapiens
guggaaucuagagaggcaguag

SEQ ID NO: 6805 - RNA, 22 nt, Homo sapiens
uuggauuguuucuagauugggg

SEQ ID NO: 6806 - RNA, 22 nt, Homo sapiens
ugagucgagauugcgccacugu

SEQ ID NO: 6807 - RNA, 21 nt, Homo sapiens
uauagcagcacgauuuauaau

SEQ ID NO: 6808 - RNA, 20 nt, Homo sapiens
uagguuuucacagaauugcc

SEQ ID NO: 6809 - RNA, 22 nt, Homo sapiens
ugacuggaaacaguguuauuug

SEQ ID NO: 6810 - RNA, 22 nt, Homo sapiens
uucguuuguaauccuuacagca

SEQ ID NO: 6811 - RNA, 22 nt, Homo sapiens
ucuguggucagaguccuuggcc

SEQ ID NO: 6812 - RNA, 22 nt, Homo sapiens
ugaaugugauggguuucaugug

SEQ ID NO: 6813 - RNA, 21 nt, Homo sapiens
uagcucagugguguugccaua

SEQ ID NO: 6814 - RNA, 22 nt, Homo sapiens
cuguaacagaauaaauuuguuu

SEQ ID NO: 6815 - RNA, 21 nt, Homo sapiens
uucaccauggcuccacacucu

SEQ ID NO: 6816 - RNA, 22 nt, Homo sapiens
aagagcucauccauaguuguca

SEQ ID NO: 6817 - RNA, 22 nt, Homo sapiens
acucuguugucuggccuuccug

SEQ ID NO: 6818 - RNA, 22 nt, Homo sapiens
uagcaguaucccaccaucuggu

SEQ ID NO: 6819 - RNA, 19 nt, Homo sapiens
uggcuagagcagauauccu

SEQ ID NO: 6820 - RNA, 22 nt, Homo sapiens
ugugccacuguucuguaaagug

SEQ ID NO: 6821 - RNA, 22 nt, Homo sapiens
uaguagugucccugacuaucac

SEQ ID NO: 6822 - RNA, 22 nt, Homo sapiens
caagaggcuguguauaaagcca

SEQ ID NO: 6823 - RNA, 22 nt, Homo sapiens
uagcccauuuguuuagggaaag

SEQ ID NO: 6824 - RNA, 22 nt, Homo sapiens
agucauggaucacaguagccuc

SEQ ID NO: 6825 - RNA, 22 nt, Homo sapiens
ugagaucaagauguuagggacu

SEQ ID NO: 6826 - RNA, 22 nt, Homo sapiens
auaagugcuuguugaauaauag

SEQ ID NO: 6827 - RNA, 22 nt, Homo sapiens
agauacaucuaugugucugugu

SEQ ID NO: 6828 - RNA, 22 nt, Homo sapiens
ucuuugguaauggaugucugau

SEQ ID NO: 6829 - RNA, 20 nt, Homo sapiens
gcauaugucuuuauggcagc

SEQ ID NO: 6830 - RNA, 22 nt, Homo sapiens
cauugcaauccagccugggcaa

SEQ ID NO: 6831 - RNA, 22 nt, Homo sapiens
auuacuuugcaccaaccuaaua

SEQ ID NO: 6832 - RNA, 22 nt, Homo sapiens
augaagacaucgucugggauua

SEQ ID NO: 6833 - RNA, 22 nt, Homo sapiens
uggcaagugggaccuaguuaaa

SEQ ID NO: 6834 - RNA, 22 nt, Homo sapiens
caaggugcugagacaggagccc

SEQ ID NO: 6835 - RNA, 22 nt, Homo sapiens
cacugcacucuucuucugggca

SEQ ID NO: 6836 - RNA, 22 nt, Homo sapiens
augaagaucucugccuuguguc

SEQ ID NO: 6837 - RNA, 22 nt, Homo sapiens
ugaggucuuuauuuagugcuca

SEQ ID NO: 6838 - RNA, 22 nt, Homo sapiens
ucccguuauuaaccccugccuu

SEQ ID NO: 6839 - RNA, 22 nt, Homo sapiens
acugagacugagaauguuucuu

SEQ ID NO: 6840 - RNA, 22 nt, Homo sapiens
auaugcauacauguaugcagga

SEQ ID NO: 6841 - RNA, 22 nt, Homo sapiens
uauacagcaaguuacugugcug

SEQ ID NO: 6842 - RNA, 19 nt, Homo sapiens
uacaguacacaacaccuuu

SEQ ID NO: 6843 - RNA, 22 nt, Homo sapiens
ugacaucugcuugugcccagga

SEQ ID NO: 6844 - RNA, 22 nt, Homo sapiens
auguuauguuaaugauaaugga

SEQ ID NO: 6845 - RNA, 22 nt, Homo sapiens
uagcucagcccagcuaagcuca

SEQ ID NO: 6846 - RNA, 20 nt, Homo sapiens
ugaggucugagaaagaauga

SEQ ID NO: 6847 - RNA, 22 nt, Homo sapiens
ggaaagauguaauauuaucuaa

SEQ ID NO: 6848 - RNA, 20 nt, Homo sapiens
cugugguagggaccaggaau

SEQ ID NO: 6849 - RNA, 22 nt, Homo sapiens
ugucuaguuuugaaguauagca

SEQ ID NO: 6850 - RNA, 22 nt, Homo sapiens
auagguaguugaggagauuuca

SEQ ID NO: 6851 - RNA, 22 nt, Homo sapiens
gcagucaucugaaggcuuaacu

SEQ ID NO: 6852 - RNA, 22 nt, Homo sapiens
auguggcauuucucauucauuu

SEQ ID NO: 6853 - RNA, 22 nt, Homo sapiens
uaaguauagguaacagaagcaa

SEQ ID NO: 6854 - RNA, 22 nt, Homo sapiens
gacccuuagaaugugaucuuau

SEQ ID NO: 6855 - RNA, 22 nt, Homo sapiens
uauccugaagcuuuauuuaagu

SEQ ID NO: 6856 - RNA, 22 nt, Homo sapiens
uggcuuuguaagguuucauuuu

SEQ ID NO: 6857 - RNA, 22 nt, Homo sapiens
augugcuuuuggugagagauuu

SEQ ID NO: 6858 - RNA, 22 nt, Homo sapiens
guaguuuaucagaaagaauagg

SEQ ID NO: 6859 - RNA, 22 nt, Homo sapiens
auuguacuccagccugggcuaa

SEQ ID NO: 6860 - RNA, 22 nt, Homo sapiens
ucuaaugcucugagaacagugc

SEQ ID NO: 6861 - RNA, 22 nt, Homo sapiens
ccagaguucuaggcauuggaaa

SEQ ID NO: 6862 - RNA, 22 nt, Homo sapiens
cuucaaguaauucugauggcua

SEQ ID NO: 6863 - RNA, 22 nt, Homo sapiens
gucacagaaaaagauaugccaa

SEQ ID NO: 6864 - RNA, 22 nt, Homo sapiens
uugaggugggaggaucacuuga

SEQ ID NO: 6865 - RNA, 22 nt, Homo sapiens
cauugcacuccaccuuggguaa

SEQ ID NO: 6866 - RNA, 22 nt, Homo sapiens
aacaccguagaaacacaaggga

SEQ ID NO: 6867 - RNA, 22 nt, Homo sapiens
ugaaacacacagagaagggaga

SEQ ID NO: 6868 - RNA, 22 nt, Homo sapiens
ugauauguaugugaccuagaaa

SEQ ID NO: 6869 - RNA, 22 nt, Homo sapiens
ucauaaaguuguuuuaauggga

SEQ ID NO: 6870 - RNA, 22 nt, Homo sapiens
gaguaacagcauaaauuuguga

SEQ ID NO: 6871 - RNA, 22 nt, Homo sapiens
auguaguagauauuuauggaaa

SEQ ID NO: 6872 - RNA, 23 nt, Homo sapiens
caugaacuaguuugcagccauga

SEQ ID NO: 6873 - RNA, 22 nt, Homo sapiens
ucccuguguuccuuuugaauug

SEQ ID NO: 6874 - RNA, 22 nt, Homo sapiens
cuguacucaucccauaugcacu

SEQ ID NO: 6875 - RNA, 22 nt, Homo sapiens
ccaguuuucaagauaaugguuu

SEQ ID NO: 6876 - RNA, 22 nt, Homo sapiens
uggaagacaaguguuagcaugg

SEQ ID NO: 6877 - RNA, 22 nt, Homo sapiens
cuucccguuauugcccuugggu

SEQ ID NO: 6878 - RNA, 22 nt, Homo sapiens
gcaauggaaucccuugaucaau

SEQ ID NO: 6879 - RNA, 22 nt, Homo sapiens
uucuauugguaauauuuucugu

SEQ ID NO: 6880 - RNA, 22 nt, Homo sapiens
uuuaaggcacuucaugguuuca

SEQ ID NO: 6881 - RNA, 22 nt, Homo sapiens
agcaucaugcaguugcuauuca

SEQ ID NO: 6882 - RNA, 22 nt, Homo sapiens
guucucacuggacugugaaaau

SEQ ID NO: 6883 - RNA, 22 nt, Homo sapiens
ugacccuguggcagcgucuaag

SEQ ID NO: 6884 - RNA, 22 nt, Homo sapiens
aaugugcuguucagaggagucc

SEQ ID NO: 6885 - RNA, 23 nt, Homo sapiens
ugauguccacuuagggucuaggu

SEQ ID NO: 6886 - RNA, 22 nt, Homo sapiens
ugagauauauauauuugagaca

SEQ ID NO: 6887 - RNA, 22 nt, Homo sapiens
auuacauagucaaggugucuca

SEQ ID NO: 6888 - RNA, 22 nt, Homo sapiens
augugcaugcuguucugccaga

SEQ ID NO: 6889 - RNA, 22 nt, Homo sapiens
cuggugugugacuuuucauuau

SEQ ID NO: 6890 - RNA, 20 nt, Homo sapiens
ggcaagguagcauuucuucu

SEQ ID NO: 6891 - RNA, 22 nt, Homo sapiens
uuuccaguuggaaagccuguuu

SEQ ID NO: 6892 - RNA, 18 nt, Homo sapiens
aauggcucuggguucuaa

SEQ ID NO: 6893 - RNA, 21 nt, Homo sapiens
uaaagcuuagcuauaguggcu

SEQ ID NO: 6894 - RNA, 22 nt, Homo sapiens
ugcgguagugcaaucauggcuc

SEQ ID NO: 6895 - RNA, 22 nt, Homo sapiens
cauggcuuguauaagauucuca

SEQ ID NO: 6896 - RNA, 22 nt, Homo sapiens
guggcaugaaagcaucugugau

SEQ ID NO: 6897 - RNA, 18 nt, Homo sapiens
gacuuggaguuuacagug

SEQ ID NO: 6898 - RNA, 22 nt, Homo sapiens
gggguuuuaccuucguauucuu

SEQ ID NO: 6899 - RNA, 22 nt, Homo sapiens
auagcacaugugcaaauggcug

SEQ ID NO: 6900 - RNA, 20 nt, Homo sapiens
agacagcugcagcccacauc

SEQ ID NO: 6901 - RNA, 22 nt, Homo sapiens
uaaugcaucaugguuggcaaac

SEQ ID NO: 6902 - RNA, 22 nt, Homo sapiens
aaaggcaucauuaguaccaagu

SEQ ID NO: 6903 - RNA, 22 nt, Homo sapiens
cuguagacauuaggccugcacu

SEQ ID NO: 6904 - RNA, 22 nt, Homo sapiens
ccacugugguaucugauacugg

SEQ ID NO: 6905 - RNA, 22 nt, Homo sapiens
uuuuggcacuuugucugauucu

SEQ ID NO: 6906 - RNA, 22 nt, Homo sapiens
aaagguaguacuucuagaaggg

SEQ ID NO: 6907 - RNA, 22 nt, Homo sapiens
ucaaagacacacaaggagaagg

SEQ ID NO: 6908 - RNA, 22 nt, Homo sapiens
acugcauaaauauguguaauau

SEQ ID NO: 6909 - RNA, 22 nt, Homo sapiens
gcuggcuuucuccugaucucag

SEQ ID NO: 6910 - RNA, 22 nt, Homo sapiens
uugauagaucagggauuugauu

SEQ ID NO: 6911 - RNA, 22 nt, Homo sapiens
uugggucaguuccuugacuccu

SEQ ID NO: 6912 - RNA, 22 nt, Homo sapiens
uauggccccuacaugugcaaaa

SEQ ID NO: 6913 - RNA, 22 nt, Homo sapiens
aucacguguguuuaugcuacgc

SEQ ID NO: 6914 - RNA, 21 nt, Homo sapiens
uuuugugcaugugcagccugc

SEQ ID NO: 6915 - RNA, 22 nt, Homo sapiens
ugaaucaugcugcuauaaagac

SEQ ID NO: 6916 - RNA, 22 nt, Homo sapiens
auucacuuuuauagacaggucu

SEQ ID NO: 6917 - RNA, 22 nt, Homo sapiens
uaguaaacagcucugccacaau

SEQ ID NO: 6918 - RNA, 22 nt, Homo sapiens
uuaacaguugcaugagacugag

SEQ ID NO: 6919 - RNA, 19 nt, Homo sapiens
cuaugaccaugugauuuuu

SEQ ID NO: 6920 - RNA, 22 nt, Homo sapiens
aggcuuuuggagguggcuuucu

SEQ ID NO: 6921 - RNA, 22 nt, Homo sapiens
ucccuagagaagugauuuuuga

SEQ ID NO: 6922 - RNA, 22 nt, Homo sapiens
uaacacagagcuccuaaucccu

SEQ ID NO: 6923 - RNA, 22 nt, Homo sapiens
gugaagaugugcaucagaucca

SEQ ID NO: 6924 - RNA, 22 nt, Homo sapiens
cuaaaguagccaggacugcagg

SEQ ID NO: 6925 - RNA, 22 nt, Homo sapiens
ucucauagaggcagagaguaaa

SEQ ID NO: 6926 - RNA, 22 nt, Homo sapiens
gucauccaggcuggagugaagc

SEQ ID NO: 6927 - RNA, 22 nt, Homo sapiens
aaguccaugaagucuugugggu

SEQ ID NO: 6928 - RNA, 19 nt, Homo sapiens
auaaaugccuacaagggug

SEQ ID NO: 6929 - RNA, 22 nt, Homo sapiens
agguaguguuauuugcagcuga

SEQ ID NO: 6930 - RNA, 22 nt, Homo sapiens
aagcaucacuggaggcagccau

SEQ ID NO: 6931 - RNA, 22 nt, Homo sapiens
gagcuggacuucuuaccuuuuc

SEQ ID NO: 6932 - RNA, 22 nt, Homo sapiens
guacagugcucacaaugagagc

SEQ ID NO: 6933 - RNA, 22 nt, Homo sapiens
uuggguaguauagaagcaacaa

SEQ ID NO: 6934 - RNA, 22 nt, Homo sapiens
uaaggcuucuuggaauacugca

SEQ ID NO: 6935 - RNA, 22 nt, Homo sapiens
uauugcuaacaucccuuaugua

SEQ ID NO: 6936 - RNA, 22 nt, Homo sapiens
acaguacuguuguuugcugcca

SEQ ID NO: 6937 - RNA, 22 nt, Homo sapiens
auacaugugccauggugguuug

SEQ ID NO: 6938 - RNA, 22 nt, Homo sapiens
ucacauuguuauguaaauguuu

SEQ ID NO: 6939 - RNA, 22 nt, Homo sapiens
uggaaucaucaacgaaugaaau

SEQ ID NO: 6940 - RNA, 22 nt, Homo sapiens
aagcugccaggcaugguggcug

SEQ ID NO: 6941 - RNA, 22 nt, Homo sapiens
gucucacagcuagcugcuuuau

SEQ ID NO: 6942 - RNA, 22 nt, Homo sapiens
ugcauaggagcagggucuaugu

SEQ ID NO: 6943 - RNA, 22 nt, Homo sapiens
auaaaugcauugagaacugcug

SEQ ID NO: 6944 - RNA, 22 nt, Homo sapiens
guuuacagucgacuugggaaua

SEQ ID NO: 6945 - RNA, 22 nt, Homo sapiens
ucuuuugugagucagccucucc

SEQ ID NO: 6946 - RNA, 22 nt, Homo sapiens
ucagucuuuuaccauuaaguau

SEQ ID NO: 6947 - RNA, 22 nt, Homo sapiens
auggcacagaguagaugcucaa

SEQ ID NO: 6948 - RNA, 16 nt, Homo sapiens
acaaagcuggcuaucu

SEQ ID NO: 6949 - RNA, 22 nt, Homo sapiens
acaggugaaguauuacacuaag

SEQ ID NO: 6950 - RNA, 22 nt, Homo sapiens
gcagcacaugacuguauguaua

SEQ ID NO: 6951 - RNA, 22 nt, Homo sapiens
uucucaauggcaacuuguugcu

SEQ ID NO: 6952 - RNA, 22 nt, Homo sapiens
auggcugugagaucgacuuauu

SEQ ID NO: 6953 - RNA, 22 nt, Homo sapiens
uggagguaggugauauguagca

SEQ ID NO: 6954 - RNA, 22 nt, Homo sapiens
auagcaagaugauugauccauu

SEQ ID NO: 6955 - RNA, 22 nt, Homo sapiens
uugacugggccagacagagauc

SEQ ID NO: 6956 - RNA, 21 nt, Homo sapiens
ucuggcuuucauuccccuucu

SEQ ID NO: 6957 - RNA, 22 nt, Homo sapiens
aauagcacugcuaugguuugaa

SEQ ID NO: 6958 - RNA, 22 nt, Homo sapiens
uugaccuauguuucuucaucug

SEQ ID NO: 6959 - RNA, 19 nt, Homo sapiens
uacauaguauuuaguggca

SEQ ID NO: 6960 - RNA, 17 nt, Homo sapiens
aaggugcuucgaccucc

SEQ ID NO: 6961 - RNA, 17 nt, Homo sapiens
gcugcauucauguagaa

SEQ ID NO: 6962 - RNA, 22 nt, Homo sapiens
ugauuagagcccaagcuuugaa

SEQ ID NO: 6963 - RNA, 22 nt, Homo sapiens
ugagcugagaucaugcuauugu

SEQ ID NO: 6964 - RNA, 21 nt, Homo sapiens
uggaacgcaaaugagaugaau

SEQ ID NO: 6965 - RNA, 22 nt, Homo sapiens
ggucuuggagaauuguccuggg

SEQ ID NO: 6966 - RNA, 22 nt, Homo sapiens
ugauggcauuuggaguugggac

SEQ ID NO: 6967 - RNA, 22 nt, Homo sapiens
guggaagucuuugguauuggua

SEQ ID NO: 6968 - RNA, 22 nt, Homo sapiens
gcugauguuuucagguaauucu

SEQ ID NO: 6969 - RNA, 22 nt, Homo sapiens
ugugccacuccagcucuagcuu

SEQ ID NO: 6970 - RNA, 22 nt, Homo sapiens
uaugaucacuacagcagggaug

SEQ ID NO: 6971 - RNA, 23 nt, Homo sapiens
ugaauguaucgaaugugggaaag

SEQ ID NO: 6972 - RNA, 22 nt, Homo sapiens
caucacuguugguacaaguaau

SEQ ID NO: 6973 - RNA, 19 nt, Homo sapiens
agagacucauuguagcauu

SEQ ID NO: 6974 - RNA, 22 nt, Homo sapiens
agcccagagacuguguaaauuu

SEQ ID NO: 6975 - RNA, 22 nt, Homo sapiens
ugucaguuucaguguuagccuu

SEQ ID NO: 6976 - RNA, 21 nt, Homo sapiens
uugacagugacagguaaaguu

SEQ ID NO: 6977 - RNA, 16 nt, Homo sapiens
ugagaacaugugauau

SEQ ID NO: 6978 - RNA, 19 nt, Homo sapiens
cugcaagguaauaggucag

SEQ ID NO: 6979 - RNA, 22 nt, Homo sapiens
cagagaacugaguuauuuucuu

SEQ ID NO: 6980 - RNA, 22 nt, Homo sapiens
uagcugauguuugucuaguagc

SEQ ID NO: 6981 - RNA, 22 nt, Homo sapiens
ugucuacugaugauguaguuaa

SEQ ID NO: 6982 - RNA, 22 nt, Homo sapiens
guacauagucacacauauacau

SEQ ID NO: 6983 - RNA, 22 nt, Homo sapiens
uaggacaaugguacagcagaaa

SEQ ID NO: 6984 - RNA, 23 nt, Homo sapiens
aagguaagcuagaaagauguaga

SEQ ID NO: 6985 - RNA, 22 nt, Homo sapiens
gcacugggccacauuuauuuuc

SEQ ID NO: 6986 - RNA, 22 nt, Homo sapiens
ugacagcaucaggauuggagag

SEQ ID NO: 6987 - RNA, 22 nt, Homo sapiens
aacuggcauguuuuaaggcuua

SEQ ID NO: 6988 - RNA, 22 nt, Homo sapiens
augaauagaguuaauugaguac

SEQ ID NO: 6989 - RNA, 22 nt, Homo sapiens
ugauguguuuuguaguucaacu

SEQ ID NO: 6990 - RNA, 22 nt, Homo sapiens
cuaagggaggaagcugugcagg

SEQ ID NO: 6991 - RNA, 22 nt, Homo sapiens
uuggccuuuucaaugccucuuu

SEQ ID NO: 6992 - RNA, 22 nt, Homo sapiens
uugcacagugcuuucuuugccc

SEQ ID NO: 6993 - RNA, 22 nt, Homo sapiens
uugauauuacucaguaacagau

SEQ ID NO: 6994 - RNA, 22 nt, Homo sapiens
cuuuacacauccuaaccagugu

SEQ ID NO: 6995 - RNA, 23 nt, Homo sapiens
cuuuguacagcuugacuacuggg

SEQ ID NO: 6996 - RNA, 22 nt, Homo sapiens
uuaaggugaaguucucagaugc

SEQ ID NO: 6997 - RNA, 22 nt, Homo sapiens
gcuuuugcaggaaaggaagaau

SEQ ID NO: 6998 - RNA, 22 nt, Homo sapiens
gcaagugucugagguuuuguau

SEQ ID NO: 6999 - RNA, 22 nt, Homo sapiens
augauguguucuguguucccau

SEQ ID NO: 7000 - RNA, 22 nt, Homo sapiens
aucacuggucaugagagaagua

SEQ ID NO: 7001 - RNA, 17 nt, Homo sapiens
uuucagaguggaagugu

SEQ ID NO: 7002 - RNA, 22 nt, Homo sapiens
cuggcaaaaagagggcaauaau

SEQ ID NO: 7003 - RNA, 22 nt, Homo sapiens
cuugacacugcaguuuuccugg

SEQ ID NO: 7004 - RNA, 22 nt, Homo sapiens
auuagguacugugguuuccaga

SEQ ID NO: 7005 - RNA, 22 nt, Homo sapiens
uuuaggcaauauauucaugucu

SEQ ID NO: 7006 - RNA, 22 nt, Homo sapiens
ucgacacugaccuaguucagca

SEQ ID NO: 7007 - RNA, 22 nt, Homo sapiens
uggaacaccaggcuggcguggc

SEQ ID NO: 7008 - RNA, 22 nt, Homo sapiens
agcaccaauaaucagaguucuu

SEQ ID NO: 7009 - RNA, 22 nt, Homo sapiens
ucaugcaaugagucaggaggca

SEQ ID NO: 7010 - RNA, 22 nt, Homo sapiens
agguuaugauuguagagcgagg

SEQ ID NO: 7011 - RNA, 22 nt, Homo sapiens
gacugcagugcagcuguuaggc

SEQ ID NO: 7012 - RNA, 22 nt, Homo sapiens
aagcugcauuuucuagaugcuu

SEQ ID NO: 7013 - RNA, 22 nt, Homo sapiens
ugagcauauuuaagguaugcua

SEQ ID NO: 7014 - RNA, 22 nt, Homo sapiens
gucagugucuuugcagcucaga

SEQ ID NO: 7015 - RNA, 22 nt, Homo sapiens
uguauguuguaagacuuagacc

SEQ ID NO: 7016 - RNA, 22 nt, Homo sapiens
gccauugcacuccagccuagcg

SEQ ID NO: 7017 - RNA, 22 nt, Homo sapiens
caugcacugagagggucucggc

SEQ ID NO: 7018 - RNA, 22 nt, Homo sapiens
cugagcaauauagugagaucuu

SEQ ID NO: 7019 - RNA, 22 nt, Homo sapiens
uuuugcucuucauagguccugu

SEQ ID NO: 7020 - RNA, 22 nt, Homo sapiens
aaggaguagacaacauggcgcc

SEQ ID NO: 7021 - RNA, 20 nt, Homo sapiens
uauuacagaguaauggugga

SEQ ID NO: 7022 - RNA, 22 nt, Homo sapiens
ugcuguuguuugaugaaguaau

SEQ ID NO: 7023 - RNA, 22 nt, Homo sapiens
ucacaguaacuuuguugcuuuu

SEQ ID NO: 7024 - RNA, 22 nt, Homo sapiens
ugcaaucauuuggaggagaaga

SEQ ID NO: 7025 - RNA, 22 nt, Homo sapiens
uaucaccuugcaguggaugcua

SEQ ID NO: 7026 - RNA, 22 nt, Homo sapiens
cugagauggagucucgcauugu

SEQ ID NO: 7027 - RNA, 22 nt, Homo sapiens
auagcagaccaccucucccacu

SEQ ID NO: 7028 - RNA, 20 nt, Homo sapiens
ugcagcacugggaaugcagu

SEQ ID NO: 7029 - RNA, 18 nt, Homo sapiens
ugugauggauauguuaau

SEQ ID NO: 7030 - RNA, 19 nt, Homo sapiens
auaguguaggaaaacagcu

SEQ ID NO: 7031 - RNA, 22 nt, Homo sapiens
uggaagguaaguuuugagcauu

SEQ ID NO: 7032 - RNA, 22 nt, Homo sapiens
auggcaucgucaccuuuucagu

SEQ ID NO: 7033 - RNA, 22 nt, Homo sapiens
guuugugguuaaagccuuucau

SEQ ID NO: 7034 - RNA, 22 nt, Homo sapiens
ugagacggagucucacucuguu

SEQ ID NO: 7035 - RNA, 15 nt, Homo sapiens
agaguagagacgccc

SEQ ID NO: 7036 - RNA, 22 nt, Homo sapiens
uuguagcaaauauauuuuggaa

SEQ ID NO: 7037 - RNA, 22 nt, Homo sapiens
aaucacauugaaucugcuaccu

SEQ ID NO: 7038 - RNA, 22 nt, Homo sapiens
caaaccuguaggggccaagagg

SEQ ID NO: 7039 - RNA, 22 nt, Homo sapiens
aaacauugaccucauccuggca

SEQ ID NO: 7040 - RNA, 22 nt, Homo sapiens
gcuggugaaggcugaaaagugg

SEQ ID NO: 7041 - RNA, 22 nt, Homo sapiens
guuaaugcuggaauaaguuaag

SEQ ID NO: 7042 - RNA, 22 nt, Homo sapiens
ugaguuagguaauaauaaauau

SEQ ID NO: 7043 - RNA, 19 nt, Homo sapiens
augccacagugaggucaga

SEQ ID NO: 7044 - RNA, 22 nt, Homo sapiens
uguucuugaguugggaguacaa

SEQ ID NO: 7045 - RNA, 22 nt, Homo sapiens
uuugauguccaccucagcccac

SEQ ID NO: 7046 - RNA, 22 nt, Homo sapiens
gagauuauuagauguucugcuu

SEQ ID NO: 7047 - RNA, 20 nt, Homo sapiens
ucuugaacuuagucaacagg

SEQ ID NO: 7048 - RNA, 22 nt, Homo sapiens
ggcaguguuauuauauuuuugg

SEQ ID NO: 7049 - RNA, 17 nt, Homo sapiens
agcuggaauuacgggag

SEQ ID NO: 7050 - RNA, 22 nt, Homo sapiens
auggcacuccagccugggcaac

SEQ ID NO: 7051 - RNA, 18 nt, Homo sapiens
uuuguacuuuuucuaaug

SEQ ID NO: 7052 - RNA, 19 nt, Homo sapiens
ugagagcacaacugaacaa

SEQ ID NO: 7053 - RNA, 23 nt, Homo sapiens
auugcagucuugaacuccugggc

SEQ ID NO: 7054 - RNA, 22 nt, Homo sapiens
aagaugauguucuuuuucuuag

SEQ ID NO: 7055 - RNA, 22 nt, Homo sapiens
ucacugggagcauuugagccuu

SEQ ID NO: 7056 - RNA, 22 nt, Homo sapiens
gucugguuccugggagauuucu

SEQ ID NO: 7057 - RNA, 22 nt, Homo sapiens
ugugacugguugucccgcuuuc

SEQ ID NO: 7058 - RNA, 22 nt, Homo sapiens
agcaguguggccuuagacccgg

SEQ ID NO: 7059 - RNA, 22 nt, Homo sapiens
gcaguguggguagagggcaaga

SEQ ID NO: 7060 - RNA, 23 nt, Homo sapiens
uuggucucccaaaguguugagau

SEQ ID NO: 7061 - RNA, 22 nt, Homo sapiens
gcugcuguggcagauuggauuc

SEQ ID NO: 7062 - RNA, 22 nt, Homo sapiens
ugcagcauguaggcacguuauu

SEQ ID NO: 7063 - RNA, 22 nt, Homo sapiens
auugcauugugaucuucccaga

SEQ ID NO: 7064 - RNA, 19 nt, Homo sapiens
auacacguguauacauaca

SEQ ID NO: 7065 - RNA, 22 nt, Homo sapiens
ucacaugaagauuuuaguauac

SEQ ID NO: 7066 - RNA, 22 nt, Homo sapiens
uaaagcacaaguaaagaauacu

SEQ ID NO: 7067 - RNA, 22 nt, Homo sapiens
uugagauggaguuucaauauug

SEQ ID NO: 7068 - RNA, 22 nt, Homo sapiens
uguuauguuguuugagaaaguc

SEQ ID NO: 7069 - RNA, 22 nt, Homo sapiens
aguuccauuuauucucgucucu

SEQ ID NO: 7070 - RNA, 22 nt, Homo sapiens
caucgcacuccagccugggcaa

SEQ ID NO: 7071 - RNA, 22 nt, Homo sapiens
cauuacacuccagccuggguga

SEQ ID NO: 7072 - RNA, 22 nt, Homo sapiens
cugggguaggacuggcuuuuga

SEQ ID NO: 7073 - RNA, 22 nt, Homo sapiens
auguauggagauauuuuugguu

SEQ ID NO: 7074 - RNA, 22 nt, Homo sapiens
uugcaagauguuaacauuggag

SEQ ID NO: 7075 - RNA, 22 nt, Homo sapiens
uugucacccucucuuggugucu

SEQ ID NO: 7076 - RNA, 21 nt, Homo sapiens
uauggcuuagucaguguuucc

SEQ ID NO: 7077 - RNA, 22 nt, Homo sapiens
uuauuagguuaaccuauagcua

SEQ ID NO: 7078 - RNA, 22 nt, Homo sapiens
aggcaagugauagcugcguaau

SEQ ID NO: 7079 - RNA, 22 nt, Homo sapiens
acaugccucccugguccgcugu

SEQ ID NO: 7080 - RNA, 22 nt, Homo sapiens
uucagagugguaugaagugaug

SEQ ID NO: 7081 - RNA, 17 nt, Homo sapiens
cugaccucauuguguac

SEQ ID NO: 7082 - RNA, 22 nt, Homo sapiens
gucacugagauugguauuaaug

SEQ ID NO: 7083 - RNA, 22 nt, Homo sapiens
augagcuauggagacagggcca

SEQ ID NO: 7084 - RNA, 22 nt, Homo sapiens
guugcacagucuuuccuggacu

SEQ ID NO: 7085 - RNA, 22 nt, Homo sapiens
augcauauuccugggccucacu

SEQ ID NO: 7086 - RNA, 22 nt, Homo sapiens
cuaggugauccacugcucucuu

SEQ ID NO: 7087 - RNA, 22 nt, Homo sapiens
ucuuuagugacaguugugcaag

SEQ ID NO: 7088 - RNA, 18 nt, Homo sapiens
aaguauagagagcccuua

SEQ ID NO: 7089 - RNA, 22 nt, Homo sapiens
uguaaacauguauguguuuaug

SEQ ID NO: 7090 - RNA, 22 nt, Homo sapiens
uagaaaguagggaagguaggau

SEQ ID NO: 7091 - RNA, 22 nt, Homo sapiens
uauaugcacucagguguaugug

SEQ ID NO: 7092 - RNA, 22 nt, Homo sapiens
ugagaugugugcauucaacuca

SEQ ID NO: 7093 - RNA, 20 nt, Homo sapiens
uaguggaaaucagguccucu

SEQ ID NO: 7094 - RNA, 22 nt, Homo sapiens
cucaaaguacuuugguuauugu

SEQ ID NO: 7095 - RNA, 22 nt, Homo sapiens
agcuuguuuucccauaacuaga

SEQ ID NO: 7096 - RNA, 22 nt, Homo sapiens
auguaguaugaagaagaugcuu

SEQ ID NO: 7097 - RNA, 22 nt, Homo sapiens
ccugagguagaguuuauauuga

SEQ ID NO: 7098 - RNA, 23 nt, Homo sapiens
uuaagugcuuuucugaaacucuu

SEQ ID NO: 7099 - RNA, 22 nt, Homo sapiens
agugcuuguacaaaccccgagg

SEQ ID NO: 7100 - RNA, 22 nt, Homo sapiens
auauuacagagaggaccuggga

SEQ ID NO: 7101 - RNA, 22 nt, Homo sapiens
ugagacgucuucucuucuucaa

SEQ ID NO: 7102 - RNA, 22 nt, Homo sapiens
acccuguaguuagaaacuuuca

SEQ ID NO: 7103 - RNA, 22 nt, Homo sapiens
uuuccuguagggggcaaggccu

SEQ ID NO: 7104 - RNA, 22 nt, Homo sapiens
ucugagucaucacaaaugaugc

SEQ ID NO: 7105 - RNA, 20 nt, Homo sapiens
augagguguaugacacugaa

SEQ ID NO: 7106 - RNA, 22 nt, Homo sapiens
guggcagcacauauagguuguu

SEQ ID NO: 7107 - RNA, 22 nt, Homo sapiens
uucacaguguguacaccagggg

SEQ ID NO: 7108 - RNA, 22 nt, Homo sapiens
ggagaugaaaugagcuacuuaa

SEQ ID NO: 7109 - RNA, 20 nt, Homo sapiens
agcagccacagauuccucag

SEQ ID NO: 7110 - RNA, 22 nt, Homo sapiens
uagguaaguaugugugaugggg

SEQ ID NO: 7111 - RNA, 22 nt, Homo sapiens
ucugacacagugauuaguaaau

SEQ ID NO: 7112 - RNA, 22 nt, Homo sapiens
cucaguguuaaggccaccucug

SEQ ID NO: 7113 - RNA, 23 nt, Homo sapiens
cuguggauaugaguuguaaaugg

SEQ ID NO: 7114 - RNA, 20 nt, Homo sapiens
cuuuggugagucaacuccuu

SEQ ID NO: 7115 - RNA, 22 nt, Homo sapiens
aggcaagagugacuacgugaaa

SEQ ID NO: 7116 - RNA, 22 nt, Homo sapiens
guaacguaaugucaaaaucuau

SEQ ID NO: 7117 - RNA, 21 nt, Homo sapiens
agccugugggucauaguugcc

SEQ ID NO: 7118 - RNA, 20 nt, Homo sapiens
ucuugguuggaggucuuuua

SEQ ID NO: 7119 - RNA, 22 nt, Homo sapiens
gauauguuucuucaauaccuag

SEQ ID NO: 7120 - RNA, 22 nt, Homo sapiens
ugugaauguaaccuuauuugga

SEQ ID NO: 7121 - RNA, 22 nt, Homo sapiens
uugagauggaguuucgcucuug

SEQ ID NO: 7122 - RNA, 22 nt, Homo sapiens
uugagacggaguuuugcucuug

SEQ ID NO: 7123 - RNA, 22 nt, Homo sapiens
aggagguaggaauugugcuagg

SEQ ID NO: 7124 - RNA, 22 nt, Homo sapiens
gugaggugguacaauauuaacu

SEQ ID NO: 7125 - RNA, 22 nt, Homo sapiens
ugguccccaauacuucuauaga

SEQ ID NO: 7126 - RNA, 22 nt, Homo sapiens
ucagugccucaguuuuuaaaga

SEQ ID NO: 7127 - RNA, 22 nt, Homo sapiens
uccauguaguugagcggcuuug

SEQ ID NO: 7128 - RNA, 22 nt, Homo sapiens
uccagcuuuuucuaauucugug

SEQ ID NO: 7129 - RNA, 22 nt, Homo sapiens
acaucaggcuugugaugauuac

SEQ ID NO: 7130 - RNA, 22 nt, Homo sapiens
agcagugugagaauggacuaau

SEQ ID NO: 7131 - RNA, 22 nt, Homo sapiens
aagcuggcauucaugagauuac

SEQ ID NO: 7132 - RNA, 22 nt, Homo sapiens
auugcuucugauuuuaaaugag

SEQ ID NO: 7133 - RNA, 22 nt, Homo sapiens
ucgugccacugcacuccagccu

SEQ ID NO: 7134 - RNA, 22 nt, Homo sapiens
ugcgauuauuaugucacuuccu

SEQ ID NO: 7135 - RNA, 22 nt, Homo sapiens
ggaagccuggaaaaaauuguga

SEQ ID NO: 7136 - RNA, 22 nt, Homo sapiens
ucuguaguuaacagcuucagcu

SEQ ID NO: 7137 - RNA, 22 nt, Homo sapiens
uuaaacucaucacccagguagu

SEQ ID NO: 7138 - RNA, 22 nt, Homo sapiens
acacugcugaguaaauaauuuu

SEQ ID NO: 7139 - RNA, 22 nt, Homo sapiens
gagacauguuugcuuaucugag

SEQ ID NO: 7140 - RNA, 22 nt, Homo sapiens
agagaacuggcuucaccauucu

SEQ ID NO: 7141 - RNA, 22 nt, Homo sapiens
gucuguuuggggaccuguggcc

SEQ ID NO: 7142 - RNA, 22 nt, Homo sapiens
cuagcagacaugggcugaacca

SEQ ID NO: 7143 - RNA, 22 nt, Homo sapiens
cugguaagaaggucuaagucaa

SEQ ID NO: 7144 - RNA, 22 nt, Homo sapiens
ugagguaagauguucauuuuuc

SEQ ID NO: 7145 - RNA, 22 nt, Homo sapiens
uuagcagcaccccacucuacug

SEQ ID NO: 7146 - RNA, 22 nt, Homo sapiens
ucacuggucuaaguggaggggg

SEQ ID NO: 7147 - RNA, 22 nt, Homo sapiens
ucuauggauaaaaugcccucau

SEQ ID NO: 7148 - RNA, 23 nt, Homo sapiens
auccacauucuaguccuuuaugc

SEQ ID NO: 7149 - RNA, 22 nt, Homo sapiens
uggaauguauaucguuuuuugu

SEQ ID NO: 7150 - RNA, 20 nt, Homo sapiens
uguacacaguguacccacau

SEQ ID NO: 7151 - RNA, 22 nt, Homo sapiens
uagcagcagugguguauuuaga

SEQ ID NO: 7152 - RNA, 22 nt, Homo sapiens
ucauucauuugcucacuccaca

SEQ ID NO: 7153 - RNA, 23 nt, Homo sapiens
gagugcaaugacaugaucucgga

SEQ ID NO: 7154 - RNA, 22 nt, Homo sapiens
gagcuccuccccuuggcuuuca

SEQ ID NO: 7155 - RNA, 21 nt, Homo sapiens
agucauaggaguacauaaugc

SEQ ID NO: 7156 - RNA, 22 nt, Homo sapiens
guaugcaagugauaugacauau

SEQ ID NO: 7157 - RNA, 22 nt, Homo sapiens
uuugcaguuuauuccuggggcu

SEQ ID NO: 7158 - RNA, 22 nt, Homo sapiens
uagcugagacuacaguaggugc

SEQ ID NO: 7159 - RNA, 22 nt, Homo sapiens
guaugucuuuauagcagugugg

SEQ ID NO: 7160 - RNA, 22 nt, Homo sapiens
auuguacuccagccuaggcaac

SEQ ID NO: 7161 - RNA, 22 nt, Homo sapiens
aucacagcccuccucuuggaug

SEQ ID NO: 7162 - RNA, 22 nt, Homo sapiens
gaugacuaagaauuuuauaauu

SEQ ID NO: 7163 - RNA, 22 nt, Homo sapiens
agggagcaaaguggucuuucuc

SEQ ID NO: 7164 - RNA, 22 nt, Homo sapiens
auauaguguuuuuugguacgcu

SEQ ID NO: 7165 - RNA, 22 nt, Homo sapiens
guuggcuuuuuaaggaaauugc

SEQ ID NO: 7166 - RNA, 22 nt, Homo sapiens
gucaaguaaauguuaugguuau

SEQ ID NO: 7167 - RNA, 22 nt, Homo sapiens
uggaaugucuauguuuuugauu

SEQ ID NO: 7168 - RNA, 22 nt, Homo sapiens
augauaacagccaggcacggug

SEQ ID NO: 7169 - RNA, 21 nt, Homo sapiens
ugagauuauauuaacauggua

SEQ ID NO: 7170 - RNA, 22 nt, Homo sapiens
aagagaugaagguccugacugu

SEQ ID NO: 7171 - RNA, 22 nt, Homo sapiens
cagugcaugacuguauauuauc

SEQ ID NO: 7172 - RNA, 22 nt, Homo sapiens
aggaaucuaagguaucagguua

SEQ ID NO: 7173 - RNA, 22 nt, Homo sapiens
aguagguguugguagagguuuc

SEQ ID NO: 7174 - RNA, 22 nt, Homo sapiens
uuuuuggaggagguuagaucau

SEQ ID NO: 7175 - RNA, 22 nt, Homo sapiens
aguaucacaagguguacaccca

SEQ ID NO: 7176 - RNA, 22 nt, Homo sapiens
ucaaacauccccaccagggacu

SEQ ID NO: 7177 - RNA, 22 nt, Homo sapiens
agcuggauguauguuaagugaa

SEQ ID NO: 7178 - RNA, 22 nt, Homo sapiens
augacauugaaaagcaagugga

SEQ ID NO: 7179 - RNA, 22 nt, Homo sapiens
uauggcuuucuacuugaguucu

SEQ ID NO: 7180 - RNA, 18 nt, Homo sapiens
cuaagacacuuggcagag

SEQ ID NO: 7181 - RNA, 22 nt, Homo sapiens
gacuagaaauuauuuagugagc

SEQ ID NO: 7182 - RNA, 22 nt, Homo sapiens
uugccaacauggugaacuccca

SEQ ID NO: 7183 - RNA, 22 nt, Homo sapiens
augccagggagaauuguucaag

SEQ ID NO: 7184 - RNA, 20 nt, Homo sapiens
uagcaggugucaggugauau

SEQ ID NO: 7185 - RNA, 22 nt, Homo sapiens
ugagaucauguguggaccccag

SEQ ID NO: 7186 - RNA, 22 nt, Homo sapiens
ugacuugauacauguuuuugaa

SEQ ID NO: 7187 - RNA, 22 nt, Homo sapiens
uaaguaaaugaaagguugauuu

SEQ ID NO: 7188 - RNA, 22 nt, Homo sapiens
caggucaucugaguuuaguucu

SEQ ID NO: 7189 - RNA, 22 nt, Homo sapiens
aagggaauguugugguugguuu

SEQ ID NO: 7190 - RNA, 22 nt, Homo sapiens
auuggcauauccacgacaaugc

SEQ ID NO: 7191 - RNA, 22 nt, Homo sapiens
guugaaaucaucacuuggcaug

SEQ ID NO: 7192 - RNA, 22 nt, Homo sapiens
guggacaugaauuuuggaggca

SEQ ID NO: 7193 - RNA, 22 nt, Homo sapiens
acuggcaauggcagaaauaguu

SEQ ID NO: 7194 - RNA, 21 nt, Homo sapiens
uggcaaaaugggcaguggguu

SEQ ID NO: 7195 - RNA, 22 nt, Homo sapiens
uggcaagaacugcaauugcuuu

SEQ ID NO: 7196 - RNA, 22 nt, Homo sapiens
acugcacucuagcauggguaau

SEQ ID NO: 7197 - RNA, 18 nt, Homo sapiens
gagcaccuuuuuugcaga

SEQ ID NO: 7198 - RNA, 22 nt, Homo sapiens
uuagcagcaugaaaauggacug

SEQ ID NO: 7199 - RNA, 22 nt, Homo sapiens
ugucaacauuuaucaaguuauu

SEQ ID NO: 7200 - RNA, 22 nt, Homo sapiens
cucucuguuugucuguuauugg

SEQ ID NO: 7201 - RNA, 22 nt, Homo sapiens
uuuguaauccuauuccaaagga

SEQ ID NO: 7202 - RNA, 22 nt, Homo sapiens
uggaaacuuauguucuucugug

SEQ ID NO: 7203 - RNA, 22 nt, Homo sapiens
ugagauccaugcuauuugggcu

SEQ ID NO: 7204 - RNA, 22 nt, Homo sapiens
ugaugacccugcaguucucaag

SEQ ID NO: 7205 - RNA, 22 nt, Homo sapiens
uucuugaggcaugccgcuggga

SEQ ID NO: 7206 - RNA, 22 nt, Homo sapiens
aauaucacaguuggguguacac

SEQ ID NO: 7207 - RNA, 20 nt, Homo sapiens
aacaguguguaaguuuccuu

SEQ ID NO: 7208 - RNA, 22 nt, Homo sapiens
uuucauagccuucuaaugaguu

SEQ ID NO: 7209 - RNA, 22 nt, Homo sapiens
gcgguagcauagacugcaggac

SEQ ID NO: 7210 - RNA, 22 nt, Homo sapiens
uugcaaacaucuuguuucacau

SEQ ID NO: 7211 - RNA, 22 nt, Homo sapiens
ucuuuaguaauuucuguaaggc

SEQ ID NO: 7212 - RNA, 22 nt, Homo sapiens
ugagacaaaguuguuggauguu

SEQ ID NO: 7213 - RNA, 22 nt, Homo sapiens
uucuaugguuuaauaguuuggg

SEQ ID NO: 7214 - RNA, 22 nt, Homo sapiens
ugagaacucaugggucugcugg

SEQ ID NO: 7215 - RNA, 22 nt, Homo sapiens
uguuauguucuacuuuuaggug

SEQ ID NO: 7216 - RNA, 20 nt, Homo sapiens
aucaaagacuuagaggggga

SEQ ID NO: 7217 - RNA, 22 nt, Homo sapiens
ucacaguauggggggugguuau

SEQ ID NO: 7218 - RNA, 22 nt, Homo sapiens
ucuggccuacaaguaauuuuau

SEQ ID NO: 7219 - RNA, 22 nt, Homo sapiens
cuuuuggcuuagaauugucuug

SEQ ID NO: 7220 - RNA, 22 nt, Homo sapiens
ucaucucaguuucuugccguac

SEQ ID NO: 7221 - RNA, 22 nt, Homo sapiens
ggagaugugccugcucugcucu

SEQ ID NO: 7222 - RNA, 22 nt, Homo sapiens
caucacaguacuaaucgucaua

SEQ ID NO: 7223 - RNA, 22 nt, Homo sapiens
ggugagcacagaaugcccugag

SEQ ID NO: 7224 - RNA, 22 nt, Homo sapiens
uugaggguggcauauauugauu

SEQ ID NO: 7225 - RNA, 22 nt, Homo sapiens
uucaagugguucagaagucuga

SEQ ID NO: 7226 - RNA, 22 nt, Homo sapiens
ucuuggccaugaauggcaaggc

SEQ ID NO: 7227 - RNA, 22 nt, Homo sapiens
cugagguaauuuuccagauaau

SEQ ID NO: 7228 - RNA, 16 nt, Homo sapiens
uuucuauguuuuacua

SEQ ID NO: 7229 - RNA, 22 nt, Homo sapiens
uuuaggcaugcaguucuauuua

SEQ ID NO: 7230 - RNA, 21 nt, Homo sapiens
aguucacauggcuccuguguu

SEQ ID NO: 7231 - RNA, 20 nt, Homo sapiens
guugaugcugaaguugcuua

SEQ ID NO: 7232 - RNA, 22 nt, Homo sapiens
aaugguguuuccguuaagcuga

SEQ ID NO: 7233 - RNA, 18 nt, Homo sapiens
uuucauugagugugauau

SEQ ID NO: 7234 - RNA, 22 nt, Homo sapiens
uucacacugggccuacucugug

SEQ ID NO: 7235 - RNA, 22 nt, Homo sapiens
agaucauaugcaguaaugaacu

SEQ ID NO: 7236 - RNA, 22 nt, Homo sapiens
uucccguugcugugcuccugcc

SEQ ID NO: 7237 - RNA, 22 nt, Homo sapiens
ugucaguuucuugagauggaac

SEQ ID NO: 7238 - RNA, 22 nt, Homo sapiens
cugggaugugacuguugccccc

SEQ ID NO: 7239 - RNA, 18 nt, Homo sapiens
uggcuacugaacuagaug

SEQ ID NO: 7240 - RNA, 22 nt, Homo sapiens
gggaucauuuuucauccuacag

SEQ ID NO: 7241 - RNA, 22 nt, Homo sapiens
agucaagauggcaagguaaggc

SEQ ID NO: 7242 - RNA, 21 nt, Homo sapiens
acuuucuguggcaguccauuc

SEQ ID NO: 7243 - RNA, 22 nt, Homo sapiens
cagugacacugaaaaguucggg

SEQ ID NO: 7244 - RNA, 22 nt, Homo sapiens
auuggcaauggcaaagcagagu

SEQ ID NO: 7245 - RNA, 22 nt, Homo sapiens
gucucugguugcuuuuguacca

SEQ ID NO: 7246 - RNA, 19 nt, Homo sapiens
aauaaugccagaugucugu

SEQ ID NO: 7247 - RNA, 18 nt, Homo sapiens
acaguguguaaggguucu

SEQ ID NO: 7248 - RNA, 21 nt, Homo sapiens
agugagucauuuggaaagcaa

SEQ ID NO: 7249 - RNA, 22 nt, Homo sapiens
gacuagagcugaucauguuacu

SEQ ID NO: 7250 - RNA, 22 nt, Homo sapiens
ggcagagucuugcaucuuuaga

SEQ ID NO: 7251 - RNA, 22 nt, Homo sapiens
acaguacaugauaaauaaggua

SEQ ID NO: 7252 - RNA, 22 nt, Homo sapiens
ugggguaggccugguuaugugc

SEQ ID NO: 7253 - RNA, 22 nt, Homo sapiens
uuuggcaauuugacuguauagg

SEQ ID NO: 7254 - RNA, 22 nt, Homo sapiens
aauucugugagauggugcagau

SEQ ID NO: 7255 - RNA, 20 nt, Homo sapiens
ugccaagaugacuauagcuc

SEQ ID NO: 7256 - RNA, 22 nt, Homo sapiens
uaacaccuugcucugucaauaa

SEQ ID NO: 7257 - RNA, 22 nt, Homo sapiens
ugcaaaugcugcuauuucucuu

SEQ ID NO: 7258 - RNA, 22 nt, Homo sapiens
guacacaacaugcagguuuguu

SEQ ID NO: 7259 - RNA, 22 nt, Homo sapiens
acccugucaaaauagaccaauc

SEQ ID NO: 7260 - RNA, 22 nt, Homo sapiens
uucugugguuucauuuaccugu

SEQ ID NO: 7261 - RNA, 21 nt, Homo sapiens
cauccccugccauuguggucu

SEQ ID NO: 7262 - RNA, 22 nt, Homo sapiens
uagguuguccaucucuagaagc

SEQ ID NO: 7263 - RNA, 22 nt, Homo sapiens
agucauagaguuugcccuucuc

SEQ ID NO: 7264 - RNA, 22 nt, Homo sapiens
uauagcuuaaaguuuagauccu

SEQ ID NO: 7265 - RNA, 22 nt, Homo sapiens
ugccugauacccucugucucuc

SEQ ID NO: 7266 - RNA, 22 nt, Homo sapiens
ugggaucagucuggaauauuga

SEQ ID NO: 7267 - RNA, 22 nt, Homo sapiens
uuuugcaguuacagagagugag

SEQ ID NO: 7268 - RNA, 22 nt, Homo sapiens
gcugcguguagaguucucacug

SEQ ID NO: 7269 - RNA, 21 nt, Homo sapiens
uucaucagccagaaaucaagc

SEQ ID NO: 7270 - RNA, 22 nt, Homo sapiens
augauaugagaaaggaucaaca

SEQ ID NO: 7271 - RNA, 22 nt, Homo sapiens
auugccacaucucagaggcaga

SEQ ID NO: 7272 - RNA, 22 nt, Homo sapiens
ugacuuaugcaacucugaugug

SEQ ID NO: 7273 - RNA, 22 nt, Homo sapiens
acgaagacuauucaaaagguua

SEQ ID NO: 7274 - RNA, 22 nt, Homo sapiens
augugcuagguacuguuuagca

SEQ ID NO: 7275 - RNA, 22 nt, Homo sapiens
ugcagauucguuuugaggggua

SEQ ID NO: 7276 - RNA, 19 nt, Homo sapiens
uguaccagcaagucuuuuc

SEQ ID NO: 7277 - RNA, 22 nt, Homo sapiens
cucucaguguggaggccagaaa

SEQ ID NO: 7278 - RNA, 22 nt, Homo sapiens
uugagauguauguauauaaugu

SEQ ID NO: 7279 - RNA, 21 nt, Homo sapiens
uagagagcaauaccuccagag

SEQ ID NO: 7280 - RNA, 22 nt, Homo sapiens
uccggcuuuuuuuauguugaag

SEQ ID NO: 7281 - RNA, 22 nt, Homo sapiens
augacaguguggauuauuguaa

SEQ ID NO: 7282 - RNA, 22 nt, Homo sapiens
gaugaugcuagguguuagggcu

SEQ ID NO: 7283 - RNA, 22 nt, Homo sapiens
uaggagcacagcagcauguggg

SEQ ID NO: 7284 - RNA, 22 nt, Homo sapiens
gugcacaucgugcagguuuguu

SEQ ID NO: 7285 - RNA, 22 nt, Homo sapiens
gauagcagccauucuuuuuauu

SEQ ID NO: 7286 - RNA, 19 nt, Homo sapiens
auggauacauuuucugcua

SEQ ID NO: 7287 - RNA, 22 nt, Homo sapiens
ucacucagaccuggugauaugc

SEQ ID NO: 7288 - RNA, 22 nt, Homo sapiens
gacuggguuaguuugaaagacu

SEQ ID NO: 7289 - RNA, 22 nt, Homo sapiens
agcuguguugucugaagucaga

SEQ ID NO: 7290 - RNA, 20 nt, Homo sapiens
gggaaucguaauagaauauu

SEQ ID NO: 7291 - RNA, 22 nt, Homo sapiens
ugcuagagaaauauauuugggg

SEQ ID NO: 7292 - RNA, 22 nt, Homo sapiens
gaguuuguacuaauuuguugua

SEQ ID NO: 7293 - RNA, 22 nt, Homo sapiens
gugaucucagcucacuggaacc

SEQ ID NO: 7294 - RNA, 22 nt, Homo sapiens
uuugagcuugacucagcuggag

SEQ ID NO: 7295 - RNA, 22 nt, Homo sapiens
augucauagauaaggaagugga

SEQ ID NO: 7296 - RNA, 19 nt, Homo sapiens
uacaugcagcaggcacgca

SEQ ID NO: 7297 - RNA, 22 nt, Homo sapiens
caggcaaggugaaguguacugg

SEQ ID NO: 7298 - RNA, 19 nt, Homo sapiens
uggguaguuuucuggcugg

SEQ ID NO: 7299 - RNA, 22 nt, Homo sapiens
uaaagcauguaauuagguuaga

SEQ ID NO: 7300 - RNA, 22 nt, Homo sapiens
auaugcauguacccacacaggc

SEQ ID NO: 7301 - RNA, 21 nt, Homo sapiens
cucauauugcuuuuccauggu

SEQ ID NO: 7302 - RNA, 22 nt, Homo sapiens
aaagugcacuuggaagagggcc

SEQ ID NO: 7303 - RNA, 22 nt, Homo sapiens
gugauugugaaaacauuaagaa

SEQ ID NO: 7304 - RNA, 22 nt, Homo sapiens
uagguaggacguaguccuuuug

SEQ ID NO: 7305 - RNA, 19 nt, Homo sapiens
gcuuuguggggaaggagcc

SEQ ID NO: 7306 - RNA, 22 nt, Homo sapiens
ugucaugagucuccuccaucuu

SEQ ID NO: 7307 - RNA, 22 nt, Homo sapiens
aggauaguaaugauagagaggc

SEQ ID NO: 7308 - RNA, 22 nt, Homo sapiens
uagaacauuccaggugauguug

SEQ ID NO: 7309 - RNA, 21 nt, Homo sapiens
cagagaucaucucuguuuuaa

SEQ ID NO: 7310 - RNA, 22 nt, Homo sapiens
uuguguccccacccaaaucuca

SEQ ID NO: 7311 - RNA, 22 nt, Homo sapiens
uuuaucuguuuaaaacuguuca

SEQ ID NO: 7312 - RNA, 22 nt, Homo sapiens
uaucaccuugguagucuugggg

SEQ ID NO: 7313 - RNA, 22 nt, Homo sapiens
ugucauguaaagaguaaauggu

SEQ ID NO: 7314 - RNA, 21 nt, Homo sapiens
uaaaugucauacaaagcaaug

SEQ ID NO: 7315 - RNA, 22 nt, Homo sapiens
agucaaggaggccuuucagaug

SEQ ID NO: 7316 - RNA, 22 nt, Homo sapiens
uucagguacugggggaguaugg

SEQ ID NO: 7317 - RNA, 22 nt, Homo sapiens
acagcacugccaagugacccau

SEQ ID NO: 7318 - RNA, 22 nt, Homo sapiens
uuguagaucuucaguugcuaca

SEQ ID NO: 7319 - RNA, 22 nt, Homo sapiens
gugagcuagaccacuuggcucc

SEQ ID NO: 7320 - RNA, 22 nt, Homo sapiens
gauggaauuaaaaucagaauca

SEQ ID NO: 7321 - RNA, 22 nt, Homo sapiens
guggcuuuaaguacgauugagg

SEQ ID NO: 7322 - RNA, 22 nt, Homo sapiens
uggacuguaauuuuauaggcau

SEQ ID NO: 7323 - RNA, 22 nt, Homo sapiens
ucccugaguaucuaauguguuu

SEQ ID NO: 7324 - RNA, 22 nt, Homo sapiens
aucgcauaaucucuaaaaagca

SEQ ID NO: 7325 - RNA, 22 nt, Homo sapiens
ugauauguaacuacuccuuaua

SEQ ID NO: 7326 - RNA, 22 nt, Homo sapiens
ucugccuacugagcacacagug

SEQ ID NO: 7327 - RNA, 22 nt, Homo sapiens
ugccaguauuuuauugagcauu

SEQ ID NO: 7328 - RNA, 22 nt, Homo sapiens
auggcauggugaagucuuugga

SEQ ID NO: 7329 - RNA, 22 nt, Homo sapiens
gugagucagucuguguagggcu

SEQ ID NO: 7330 - RNA, 22 nt, Homo sapiens
uaugcaugucucuguacacgug

SEQ ID NO: 7331 - RNA, 22 nt, Homo sapiens
auuguaguuugcuauggcaaua

SEQ ID NO: 7332 - RNA, 22 nt, Homo sapiens
auaguacuauugcaguguuaua

SEQ ID NO: 7333 - RNA, 22 nt, Homo sapiens
ugcgccauugaacuccaggcug

SEQ ID NO: 7334 - RNA, 19 nt, Homo sapiens
ugccaagaaagucagcuua

SEQ ID NO: 7335 - RNA, 22 nt, Homo sapiens
gagauguuuuguuaucaaagga

SEQ ID NO: 7336 - RNA, 22 nt, Homo sapiens
auguuuagagagggugucaaau

SEQ ID NO: 7337 - RNA, 22 nt, Homo sapiens
auagcagcagcuaguagugaua

SEQ ID NO: 7338 - RNA, 22 nt, Homo sapiens
augguuugugcuccuauaagaa

SEQ ID NO: 7339 - RNA, 22 nt, Homo sapiens
ugccaguauuuuauuaagaauu

SEQ ID NO: 7340 - RNA, 22 nt, Homo sapiens
cacugcacuccagcuuugguga

SEQ ID NO: 7341 - RNA, 22 nt, Homo sapiens
uuaggucaucgcuguccuucag

SEQ ID NO: 7342 - RNA, 22 nt, Homo sapiens
augugcuuuuuaaacagaugcu

SEQ ID NO: 7343 - RNA, 22 nt, Homo sapiens
uauuuggugaaugaaugcaugu

SEQ ID NO: 7344 - RNA, 22 nt, Homo sapiens
ugacucgaggcgccuccagucc

SEQ ID NO: 7345 - RNA, 22 nt, Homo sapiens
ugagaucuucgcucuucacaga

SEQ ID NO: 7346 - RNA, 22 nt, Homo sapiens
guuggaauuaaaaggcaaguau

SEQ ID NO: 7347 - RNA, 22 nt, Homo sapiens
ggcucagugggguccugguucu

SEQ ID NO: 7348 - RNA, 22 nt, Homo sapiens
cagcagguuuuuaucaguuaag

SEQ ID NO: 7349 - RNA, 20 nt, Homo sapiens
uagcacaucuggcuguagag

SEQ ID NO: 7350 - RNA, 22 nt, Homo sapiens
uggcuuuuguuauuuggaagcu

SEQ ID NO: 7351 - RNA, 22 nt, Homo sapiens
ccugagacugauugacucacaa

SEQ ID NO: 7352 - RNA, 22 nt, Homo sapiens
ccaccuguacuuaagucacuuu

SEQ ID NO: 7353 - RNA, 21 nt, Homo sapiens
aaaugugcuuuaguacccuca

SEQ ID NO: 7354 - RNA, 22 nt, Homo sapiens
ucuuauggagaaaggugguugg

SEQ ID NO: 7355 - RNA, 22 nt, Homo sapiens
uacaccauuugauucuuuaagc

SEQ ID NO: 7356 - RNA, 22 nt, Homo sapiens
uugagcacugucugugugcagu

SEQ ID NO: 7357 - RNA, 22 nt, Homo sapiens
uggacacuggagauucgucagu

SEQ ID NO: 7358 - RNA, 22 nt, Homo sapiens
acacuguaacucuuugagggca

SEQ ID NO: 7359 - RNA, 21 nt, Homo sapiens
ggcaagugugagguuuggggu

SEQ ID NO: 7360 - RNA, 22 nt, Homo sapiens
uaucacacuggaagaaguuaag

SEQ ID NO: 7361 - RNA, 22 nt, Homo sapiens
guuagaugaagaccaagggcaa

SEQ ID NO: 7362 - RNA, 22 nt, Homo sapiens
gagcaaugauugagccacugua

SEQ ID NO: 7363 - RNA, 22 nt, Homo sapiens
gugcauaucugugguuggcuga

SEQ ID NO: 7364 - RNA, 22 nt, Homo sapiens
gagugguucuauauguaauugg

SEQ ID NO: 7365 - RNA, 22 nt, Homo sapiens
aauauguccuugaaauggugcu

SEQ ID NO: 7366 - RNA, 20 nt, Homo sapiens
uuauugcggcaucauucaug

SEQ ID NO: 7367 - RNA, 22 nt, Homo sapiens
aauuaguuggcugccuaugauu

SEQ ID NO: 7368 - RNA, 22 nt, Homo sapiens
gagguagagacuauguauuaga

SEQ ID NO: 7369 - RNA, 22 nt, Homo sapiens
uguccaaaucagagguaccaaa

SEQ ID NO: 7370 - RNA, 22 nt, Homo sapiens
cuuuggucaauugcugugggga

SEQ ID NO: 7371 - RNA, 22 nt, Homo sapiens
uggacaagauagguucuauauu

SEQ ID NO: 7372 - RNA, 22 nt, Homo sapiens
auauuagcacuaaugucacgau

SEQ ID NO: 7373 - RNA, 22 nt, Homo sapiens
cuggagucugacugacacaagg

SEQ ID NO: 7374 - RNA, 22 nt, Homo sapiens
augacuaaaggguuuauguuga

SEQ ID NO: 7375 - RNA, 22 nt, Homo sapiens
ugagagcugcauucuugaaagc

SEQ ID NO: 7376 - RNA, 19 nt, Homo sapiens
cuauugcacauagcugaag

SEQ ID NO: 7377 - RNA, 22 nt, Homo sapiens
agcuacaucuugcucugggaug

SEQ ID NO: 7378 - RNA, 22 nt, Homo sapiens
auuuagcaauggagguagugua

SEQ ID NO: 7379 - RNA, 18 nt, Homo sapiens
cagugcaauacaggagag

SEQ ID NO: 7380 - RNA, 22 nt, Homo sapiens
ggcaagaggagauucugcuccc

SEQ ID NO: 7381 - RNA, 22 nt, Homo sapiens
uauacaugugggcaucaggaga

SEQ ID NO: 7382 - RNA, 22 nt, Homo sapiens
aaaugcauaucaagauugcccu

SEQ ID NO: 7383 - RNA, 22 nt, Homo sapiens
ucaguaguuuuuuuacuaggug

SEQ ID NO: 7384 - RNA, 22 nt, Homo sapiens
guacaugcauaguuuauuucug

SEQ ID NO: 7385 - RNA, 22 nt, Homo sapiens
gugaccucuguugcugucacua

SEQ ID NO: 7386 - RNA, 22 nt, Homo sapiens
ucugccuacugguuggaggaac

SEQ ID NO: 7387 - RNA, 22 nt, Homo sapiens
cacacugucuuucagaaugguu

SEQ ID NO: 7388 - RNA, 18 nt, Homo sapiens
uucauauguugaaccaga

SEQ ID NO: 7389 - RNA, 22 nt, Homo sapiens
cucauggagaacaucugcuagg

SEQ ID NO: 7390 - RNA, 22 nt, Homo sapiens
ugagaucaacugagucagagca

SEQ ID NO: 7391 - RNA, 22 nt, Homo sapiens
ugagacugagucuugcucuugu

SEQ ID NO: 7392 - RNA, 22 nt, Homo sapiens
uucuuagucaaguuguauuuca

SEQ ID NO: 7393 - RNA, 23 nt, Homo sapiens
ugacagaccuucuggaagaaguc

SEQ ID NO: 7394 - RNA, 22 nt, Homo sapiens
uuacaggacuaagcagcuuugc

SEQ ID NO: 7395 - RNA, 22 nt, Homo sapiens
ucaaagugagcuccuucucacu

SEQ ID NO: 7396 - RNA, 22 nt, Homo sapiens
cugcuauauugguucaggcuug

SEQ ID NO: 7397 - RNA, 22 nt, Homo sapiens
cuucacuuuguuaaacuccaau

SEQ ID NO: 7398 - RNA, 22 nt, Homo sapiens
uauuccuuuugcauuuccacau

SEQ ID NO: 7399 - RNA, 22 nt, Homo sapiens
caaagcuauagcaccagaggga

SEQ ID NO: 7400 - RNA, 22 nt, Homo sapiens
uccagguuuggcuuuauaacuu

SEQ ID NO: 7401 - RNA, 22 nt, Homo sapiens
cauuguccuccuggggcuauuu

SEQ ID NO: 7402 - RNA, 22 nt, Homo sapiens
aaugacagugcuaaagaacccu

SEQ ID NO: 7403 - RNA, 22 nt, Homo sapiens
uucaggcuccgugccagcuccg

SEQ ID NO: 7404 - RNA, 22 nt, Homo sapiens
auacagugaauaucuggggcag

SEQ ID NO: 7405 - RNA, 22 nt, Homo sapiens
cagcucauugcagucucgaccu

SEQ ID NO: 7406 - RNA, 22 nt, Homo sapiens
uacuacagccugagcgacugag

SEQ ID NO: 7407 - RNA, 22 nt, Homo sapiens
uaaagcuacagagcggaaaauu

SEQ ID NO: 7408 - RNA, 22 nt, Homo sapiens
gucuugcacuuaccuaagaacu

SEQ ID NO: 7409 - RNA, 22 nt, Homo sapiens
aaugucaugaguccaaccagaa

SEQ ID NO: 7410 - RNA, 22 nt, Homo sapiens
uuaaggaguagugucugguauu

SEQ ID NO: 7411 - RNA, 22 nt, Homo sapiens
ugagcauauugugauaccuaaa

SEQ ID NO: 7412 - RNA, 22 nt, Homo sapiens
auagcacacuauagcuucaaac

SEQ ID NO: 7413 - RNA, 22 nt, Homo sapiens
cucauggagauagagaauagaa

SEQ ID NO: 7414 - RNA, 22 nt, Homo sapiens
ugauauguggcuauugagauug

SEQ ID NO: 7415 - RNA, 22 nt, Homo sapiens
uacauguauacaggguuuacuu

SEQ ID NO: 7416 - RNA, 19 nt, Homo sapiens
augaccauggggugguuuu

SEQ ID NO: 7417 - RNA, 22 nt, Homo sapiens
ccccauuugaacuccuucaacu

SEQ ID NO: 7418 - RNA, 22 nt, Homo sapiens
ucagaccauuucauuacagacu

SEQ ID NO: 7419 - RNA, 22 nt, Homo sapiens
auggcuguuucugcaaugucua

SEQ ID NO: 7420 - RNA, 22 nt, Homo sapiens
ugcugguuuaaaaugcaaauuc

SEQ ID NO: 7421 - RNA, 21 nt, Homo sapiens
uucacaagggaaguagggggc

SEQ ID NO: 7422 - RNA, 22 nt, Homo sapiens
gcccacuguuaaauuuguuuua

SEQ ID NO: 7423 - RNA, 22 nt, Homo sapiens
ugggaacaugaagguuaaagag

SEQ ID NO: 7424 - RNA, 22 nt, Homo sapiens
uuuaaagcaugacgagaagaag

SEQ ID NO: 7425 - RNA, 22 nt, Homo sapiens
uacugcacuccagccucgguga

SEQ ID NO: 7426 - RNA, 22 nt, Homo sapiens
augaggugggagaaucacuuga

SEQ ID NO: 7427 - RNA, 22 nt, Homo sapiens
agcauagugccuugaaaacaau

SEQ ID NO: 7428 - RNA, 22 nt, Homo sapiens
uaauccuggcacuuugggaggc

SEQ ID NO: 7429 - RNA, 22 nt, Homo sapiens
uugggcaaguggcaugaccaug

SEQ ID NO: 7430 - RNA, 17 nt, Homo sapiens
ggaaugaauuccagccc

SEQ ID NO: 7431 - RNA, 18 nt, Homo sapiens
uagcucuuguugguccau

SEQ ID NO: 7432 - RNA, 21 nt, Homo sapiens
ggcaagagaauacaacauaaa

SEQ ID NO: 7433 - RNA, 22 nt, Homo sapiens
gaggucuuacauuuuaauauuu

SEQ ID NO: 7434 - RNA, 22 nt, Homo sapiens
auggcaguguaugauuauauua

SEQ ID NO: 7435 - RNA, 22 nt, Homo sapiens
ugagauguuccaaugacuauua

SEQ ID NO: 7436 - RNA, 22 nt, Homo sapiens
uauuugcacucccaucauggug

SEQ ID NO: 7437 - RNA, 22 nt, Homo sapiens
ugauguauuauuaagaccuggc

SEQ ID NO: 7438 - RNA, 22 nt, Homo sapiens
uagugaaugucacuggcuguug

SEQ ID NO: 7439 - RNA, 22 nt, Homo sapiens
cugaggguagaaggaucacuug

SEQ ID NO: 7440 - RNA, 21 nt, Homo sapiens
ucacauggccagaguaggaac

SEQ ID NO: 7441 - RNA, 22 nt, Homo sapiens
uucacaugacagggugaagcau

SEQ ID NO: 7442 - RNA, 22 nt, Homo sapiens
aguugcaagucuugaguaaaga

SEQ ID NO: 7443 - RNA, 22 nt, Homo sapiens
cccuaagacagugaggggugca

SEQ ID NO: 7444 - RNA, 22 nt, Homo sapiens
uggaaauaaaugugccaagauc

SEQ ID NO: 7445 - RNA, 19 nt, Homo sapiens
uuuuguacucugugacuug

SEQ ID NO: 7446 - RNA, 20 nt, Homo sapiens
guaacagcacuuucccaaag

SEQ ID NO: 7447 - RNA, 23 nt, Homo sapiens
ugagccaugggacuccaagggag

SEQ ID NO: 7448 - RNA, 22 nt, Homo sapiens
cugaccucugucaaagacaccc

SEQ ID NO: 7449 - RNA, 22 nt, Homo sapiens
auucaagugaugugauucuucu

SEQ ID NO: 7450 - RNA, 22 nt, Homo sapiens
ugauauauugaaugaugaaaca

SEQ ID NO: 7451 - RNA, 22 nt, Homo sapiens
gugcuuauccccauucuggagg

SEQ ID NO: 7452 - RNA, 22 nt, Homo sapiens
ucuuuggaggcgaucuguuuga

SEQ ID NO: 7453 - RNA, 22 nt, Homo sapiens
uggaaucuuaggugaaggcuuu

SEQ ID NO: 7454 - RNA, 22 nt, Homo sapiens
uagauuaucucaccacucgagu

SEQ ID NO: 7455 - RNA, 22 nt, Homo sapiens
ugaggucauguucugucagguu

SEQ ID NO: 7456 - RNA, 21 nt, Homo sapiens
aacagugcuuaguagauguuc

SEQ ID NO: 7457 - RNA, 22 nt, Homo sapiens
ucugguuccugcauucauucaa

SEQ ID NO: 7458 - RNA, 22 nt, Homo sapiens
ccggcuguguggagaggccccu

SEQ ID NO: 7459 - RNA, 22 nt, Homo sapiens
acacuguuuuaguuauuauagc

SEQ ID NO: 7460 - RNA, 22 nt, Homo sapiens
caguggaugauguuuucugugg

SEQ ID NO: 7461 - RNA, 21 nt, Homo sapiens
cucugguuugcauuggauuau

SEQ ID NO: 7462 - RNA, 22 nt, Homo sapiens
uauuugauugacuuuagcagga

SEQ ID NO: 7463 - RNA, 22 nt, Homo sapiens
uaucacacuguuggauuugauu

SEQ ID NO: 7464 - RNA, 22 nt, Homo sapiens
ucaguauaugaaucuggggcag

SEQ ID NO: 7465 - RNA, 22 nt, Homo sapiens
auagugcugcaauaaccauggg

SEQ ID NO: 7466 - RNA, 22 nt, Homo sapiens
ugucucaguucccuucucugga

SEQ ID NO: 7467 - RNA, 22 nt, Homo sapiens
ccccggguucugucugcccuug

SEQ ID NO: 7468 - RNA, 22 nt, Homo sapiens
uauuagguugguggaaaaguaa

SEQ ID NO: 7469 - RNA, 18 nt, Homo sapiens
augugcaauuuuguauuu

SEQ ID NO: 7470 - RNA, 22 nt, Homo sapiens
gugagaacugugucuuauaaac

SEQ ID NO: 7471 - RNA, 22 nt, Homo sapiens
gaagauaucuaguaccauuguc

SEQ ID NO: 7472 - RNA, 22 nt, Homo sapiens
uauugguuacuguugaucgcca

SEQ ID NO: 7473 - RNA, 22 nt, Homo sapiens
caccccuaccugagucaggagu

SEQ ID NO: 7474 - RNA, 22 nt, Homo sapiens
uuaauccugccuuauuucagua

SEQ ID NO: 7475 - RNA, 22 nt, Homo sapiens
ggcaacaugaugaaaugccauc

SEQ ID NO: 7476 - RNA, 22 nt, Homo sapiens
uggcuaagaugcacacuucacu

SEQ ID NO: 7477 - RNA, 22 nt, Homo sapiens
agagcauugaguuaaugguuca

SEQ ID NO: 7478 - RNA, 22 nt, Homo sapiens
acuacaugugaugucaguauau

SEQ ID NO: 7479 - RNA, 22 nt, Homo sapiens
gucagugcuuuaguucaggaug

SEQ ID NO: 7480 - RNA, 17 nt, Homo sapiens
ccagugaucccuuuugu

SEQ ID NO: 7481 - RNA, 22 nt, Homo sapiens
aguggugucugaguggccaggg

SEQ ID NO: 7482 - RNA, 22 nt, Homo sapiens
uucccagugccaggcacuggga

SEQ ID NO: 7483 - RNA, 22 nt, Homo sapiens
ugaguauguaggaugugucuua

SEQ ID NO: 7484 - RNA, 22 nt, Homo sapiens
uaucacagcauugucuauaaua

SEQ ID NO: 7485 - RNA, 22 nt, Homo sapiens
agcccauguggcugaggcuucu

SEQ ID NO: 7486 - RNA, 20 nt, Homo sapiens
gcauaugucuuuauagcaga

SEQ ID NO: 7487 - RNA, 17 nt, Homo sapiens
gcauauguugaaccagc

SEQ ID NO: 7488 - RNA, 22 nt, Homo sapiens
ugaagcuaugacuauugagcau

SEQ ID NO: 7489 - RNA, 22 nt, Homo sapiens
ucauauugcgguucauugacuu

SEQ ID NO: 7490 - RNA, 22 nt, Homo sapiens
uccugagagcagacccucuaua

SEQ ID NO: 7491 - RNA, 22 nt, Homo sapiens
acugcacuccagcccgggugac

SEQ ID NO: 7492 - RNA, 22 nt, Homo sapiens
acucauugcucauaccuuaucu

SEQ ID NO: 7493 - RNA, 17 nt, Homo sapiens
cugugaugaucuugucu

SEQ ID NO: 7494 - RNA, 22 nt, Homo sapiens
cccgggcugaaaucagauuugu

SEQ ID NO: 7495 - RNA, 22 nt, Homo sapiens
aaggcaauuuguugugaggauu

SEQ ID NO: 7496 - RNA, 22 nt, Homo sapiens
ggucacauugcuagcauggguu

SEQ ID NO: 7497 - RNA, 22 nt, Homo sapiens
aaugcauaauuuguaugaggua

SEQ ID NO: 7498 - RNA, 22 nt, Homo sapiens
aaggcaacgugaguuguugauu

SEQ ID NO: 7499 - RNA, 22 nt, Homo sapiens
ucuuaggugaugauugauguga

SEQ ID NO: 7500 - RNA, 22 nt, Homo sapiens
gacaguguggcgauuccucaag

SEQ ID NO: 7501 - RNA, 22 nt, Homo sapiens
ucuccauuguccagaugaggaa

SEQ ID NO: 7502 - RNA, 22 nt, Homo sapiens
aauacucuauaagggaagcugu

SEQ ID NO: 7503 - RNA, 22 nt, Homo sapiens
uuuugccggcauguugggcuuc

SEQ ID NO: 7504 - RNA, 22 nt, Homo sapiens
auuugguaauauuuaaggacuu

SEQ ID NO: 7505 - RNA, 21 nt, Homo sapiens
uggaccccuuucuuacaccgu

SEQ ID NO: 7506 - RNA, 22 nt, Homo sapiens
ggcaagugucagcagcaacacc

SEQ ID NO: 7507 - RNA, 22 nt, Homo sapiens
ugacugguguuuaaugagucaa

SEQ ID NO: 7508 - RNA, 18 nt, Homo sapiens
ugcauauguugaaccagc

SEQ ID NO: 7509 - RNA, 19 nt, Homo sapiens
ugcaaauucuaaaaacuga

SEQ ID NO: 7510 - RNA, 22 nt, Homo sapiens
aggugguauuucaaaguggcag

SEQ ID NO: 7511 - RNA, 22 nt, Homo sapiens
uagcacccucuccuaguccugc

SEQ ID NO: 7512 - RNA, 22 nt, Homo sapiens
auggauauuuuuugaacauaga

SEQ ID NO: 7513 - RNA, 22 nt, Homo sapiens
aauugugcuuguaggccaggca

SEQ ID NO: 7514 - RNA, 22 nt, Homo sapiens
caaaggugcuuuccagguccaa

SEQ ID NO: 7515 - RNA, 20 nt, Homo sapiens
uagagagauauggggguucc

SEQ ID NO: 7516 - RNA, 22 nt, Homo sapiens
agcuugucuuauacuacuucau

SEQ ID NO: 7517 - RNA, 22 nt, Homo sapiens
ucaugguuuuauaacccucuug

SEQ ID NO: 7518 - RNA, 22 nt, Homo sapiens
uggcaaaauggaauauguuggg

SEQ ID NO: 7519 - RNA, 22 nt, Homo sapiens
cuggcucuguuagaagaaccag

SEQ ID NO: 7520 - RNA, 22 nt, Homo sapiens
uuuaugucuguacaucgggcgg

SEQ ID NO: 7521 - RNA, 22 nt, Homo sapiens
ugauaugaaucaaucacucuuc

SEQ ID NO: 7522 - RNA, 22 nt, Homo sapiens
uuggacuucucaaggcaauaaa

SEQ ID NO: 7523 - RNA, 22 nt, Homo sapiens
ccugguguuuugauggucgggu

SEQ ID NO: 7524 - RNA, 22 nt, Homo sapiens
uaugcacacacguguuuaugug

SEQ ID NO: 7525 - RNA, 22 nt, Homo sapiens
ggucagaaagacaggcauucag

SEQ ID NO: 7526 - RNA, 22 nt, Homo sapiens
ugacuagacuugcaagguugca

SEQ ID NO: 7527 - RNA, 22 nt, Homo sapiens
uuaaaguguuugcagacaggug

SEQ ID NO: 7528 - RNA, 22 nt, Homo sapiens
agaaugugaacaucuugaaagu

SEQ ID NO: 7529 - RNA, 23 nt, Homo sapiens
uuugcacuugcuccuucuauggc

SEQ ID NO: 7530 - RNA, 23 nt, Homo sapiens
auucaaguagugagagugguuau

SEQ ID NO: 7531 - RNA, 22 nt, Homo sapiens
aggugcugagcagagaauccug

SEQ ID NO: 7532 - RNA, 22 nt, Homo sapiens
gaguuguuuuaaggcacugacu

SEQ ID NO: 7533 - RNA, 22 nt, Homo sapiens
guaagugguagagcugggcuau

SEQ ID NO: 7534 - RNA, 22 nt, Homo sapiens
cugucuggaggccugcaaauaa

SEQ ID NO: 7535 - RNA, 22 nt, Homo sapiens
uaacccagugucugugaugggu

SEQ ID NO: 7536 - RNA, 22 nt, Homo sapiens
ccaguuuuuggcaaugaugaau

SEQ ID NO: 7537 - RNA, 22 nt, Homo sapiens
cgugaauguuuuggucuuucac

SEQ ID NO: 7538 - RNA, 22 nt, Homo sapiens
uucaccaguuuugucacgaaug

SEQ ID NO: 7539 - RNA, 22 nt, Homo sapiens
uugaaagucuaggcuuacagua

SEQ ID NO: 7540 - RNA, 22 nt, Homo sapiens
guggaguacugagggucacuua

SEQ ID NO: 7541 - RNA, 22 nt, Homo sapiens
uguuacacugugcacuaaauuu

SEQ ID NO: 7542 - RNA, 22 nt, Homo sapiens
uuguguccccacucaaauuaca

SEQ ID NO: 7543 - RNA, 22 nt, Homo sapiens
cuucuugagggccugcugggaa

SEQ ID NO: 7544 - RNA, 23 nt, Homo sapiens
uggcgagacagaaaacuuuuaga

SEQ ID NO: 7545 - RNA, 22 nt, Homo sapiens
uuugcacuuuaauauaauguga

SEQ ID NO: 7546 - RNA, 21 nt, Homo sapiens
ucauauguaucuuugugccuc

SEQ ID NO: 7547 - RNA, 22 nt, Homo sapiens
aacagacugucacauaaaauug

SEQ ID NO: 7548 - RNA, 22 nt, Homo sapiens
uggaaauuaacagggauugucc

SEQ ID NO: 7549 - RNA, 22 nt, Homo sapiens
auacaucugccauguuggugug

SEQ ID NO: 7550 - RNA, 22 nt, Homo sapiens
uaguauguuuauagcauugagu

SEQ ID NO: 7551 - RNA, 23 nt, Homo sapiens
gaaguaauaaauggauucuuaac

SEQ ID NO: 7552 - RNA, 22 nt, Homo sapiens
gaggcagucuguccauucucag

SEQ ID NO: 7553 - RNA, 22 nt, Homo sapiens
ucaguccccucgcugagucuac

SEQ ID NO: 7554 - RNA, 22 nt, Homo sapiens
ucauccauacaguuagcaaagg

SEQ ID NO: 7555 - RNA, 22 nt, Homo sapiens
auaauacuuuuauuuugaggaa

SEQ ID NO: 7556 - RNA, 22 nt, Homo sapiens
cugauuguagagccccagggcu

SEQ ID NO: 7557 - RNA, 22 nt, Homo sapiens
aguguuuuucaugggauacuuu

SEQ ID NO: 7558 - RNA, 22 nt, Homo sapiens
uuuucaguggccauaguggaga

SEQ ID NO: 7559 - RNA, 22 nt, Homo sapiens
uuaaggcuccuguuggcuuuua

SEQ ID NO: 7560 - RNA, 22 nt, Homo sapiens
gagaaugagauuaugguuacau

SEQ ID NO: 7561 - RNA, 18 nt, Homo sapiens
gacuccauuucagccaga

SEQ ID NO: 7562 - RNA, 22 nt, Homo sapiens
uuuguccugccaugguuuauuu

SEQ ID NO: 7563 - RNA, 20 nt, Homo sapiens
uuuugcacuccuacuaaggu

SEQ ID NO: 7564 - RNA, 22 nt, Homo sapiens
uuggcuguguuuauaugcugga

SEQ ID NO: 7565 - RNA, 22 nt, Homo sapiens
auugucauuuauaacuguguag

SEQ ID NO: 7566 - RNA, 22 nt, Homo sapiens
ggagucugacuuauaggaaccu

SEQ ID NO: 7567 - RNA, 21 nt, Homo sapiens
ugauaugguagaagagagaca

SEQ ID NO: 7568 - RNA, 22 nt, Homo sapiens
cuguuagguuaaggaauggcaa

SEQ ID NO: 7569 - RNA, 22 nt, Homo sapiens
uccuuggucauggaagagacag

SEQ ID NO: 7570 - RNA, 22 nt, Homo sapiens
ugagaauguagggcucucccag

SEQ ID NO: 7571 - RNA, 22 nt, Homo sapiens
uaugacuuguuuucuggucugc

SEQ ID NO: 7572 - RNA, 22 nt, Homo sapiens
gucaccauugagucauuuccuc

SEQ ID NO: 7573 - RNA, 22 nt, Homo sapiens
cuucaugucuucaauggggggg

SEQ ID NO: 7574 - RNA, 19 nt, Homo sapiens
ucaauucugucaauggcuu

SEQ ID NO: 7575 - RNA, 22 nt, Homo sapiens
gauugguugaaaguagaauacu

SEQ ID NO: 7576 - RNA, 22 nt, Homo sapiens
cugucucagugaauugguuuua

SEQ ID NO: 7577 - RNA, 22 nt, Homo sapiens
uuccagugggacgagaugugga

SEQ ID NO: 7578 - RNA, 22 nt, Homo sapiens
ugguacugucucuauuuuguag

SEQ ID NO: 7579 - RNA, 22 nt, Homo sapiens
agaauguauauucuguaguugu

SEQ ID NO: 7580 - RNA, 22 nt, Homo sapiens
uuccaagugggaaacaaaaaug

SEQ ID NO: 7581 - RNA, 19 nt, Homo sapiens
uagggcacgaggcagaguc

SEQ ID NO: 7582 - RNA, 22 nt, Homo sapiens
gcacgugcucauuugaggucuu

SEQ ID NO: 7583 - RNA, 22 nt, Homo sapiens
agccaguauuuccacagagugg

SEQ ID NO: 7584 - RNA, 18 nt, Homo sapiens
uaggaacauugauuggag

SEQ ID NO: 7585 - RNA, 18 nt, Homo sapiens
uuugccacuucccagaaa

SEQ ID NO: 7586 - RNA, 22 nt, Homo sapiens
ucugugcauuuucuuuuagacu

SEQ ID NO: 7587 - RNA, 22 nt, Homo sapiens
ugcauauguugagaugcauauu

SEQ ID NO: 7588 - RNA, 22 nt, Homo sapiens
gcuucauggaggcugggcgcag

SEQ ID NO: 7589 - RNA, 22 nt, Homo sapiens
gagcucauuaaaaauguagaau

SEQ ID NO: 7590 - RNA, 22 nt, Homo sapiens
guuagaucauguuuggauaucu

SEQ ID NO: 7591 - RNA, 22 nt, Homo sapiens
uuuaguccucugaaaaucuaua

SEQ ID NO: 7592 - RNA, 22 nt, Homo sapiens
uuuaaagcuaaaauauguuuau

SEQ ID NO: 7593 - RNA, 22 nt, Homo sapiens
ucuuaguuggaaugggauaagg

SEQ ID NO: 7594 - RNA, 22 nt, Homo sapiens
acugcauuugucugucucaauu

SEQ ID NO: 7595 - RNA, 19 nt, Homo sapiens
uggcuagaggccaggcguu

SEQ ID NO: 7596 - RNA, 22 nt, Homo sapiens
aucaagcugcuuguuugaaucu

SEQ ID NO: 7597 - RNA, 22 nt, Homo sapiens
uagauaguaaagccauuagcuu

SEQ ID NO: 7598 - RNA, 22 nt, Homo sapiens
guacaaguaagaaaauugccca

SEQ ID NO: 7599 - RNA, 22 nt, Homo sapiens
ggccggguggccauggcugccc

SEQ ID NO: 7600 - RNA, 22 nt, Homo sapiens
cuuuuacacugcuggugggaau

SEQ ID NO: 7601 - RNA, 22 nt, Homo sapiens
uugagaucuuuuaggccuuugu

SEQ ID NO: 7602 - RNA, 22 nt, Homo sapiens
uucucuguggauugggugagag

SEQ ID NO: 7603 - RNA, 20 nt, Homo sapiens
uucuauggugaugaguccug

SEQ ID NO: 7604 - RNA, 22 nt, Homo sapiens
ucagaguggccucucuugaaga

SEQ ID NO: 7605 - RNA, 22 nt, Homo sapiens
ugcaaaugucaaggguuagugu

SEQ ID NO: 7606 - RNA, 22 nt, Homo sapiens
gugccuuuucugagcaaugagc

SEQ ID NO: 7607 - RNA, 22 nt, Homo sapiens
agugccuacuugaauuguagug

SEQ ID NO: 7608 - RNA, 22 nt, Homo sapiens
cacauguuuuagcauggcuguu

SEQ ID NO: 7609 - RNA, 22 nt, Homo sapiens
gagcagacaugaggaccgcugg

SEQ ID NO: 7610 - RNA, 22 nt, Homo sapiens
cuagauuguuuccauaaugaca

SEQ ID NO: 7611 - RNA, 22 nt, Homo sapiens
agcuguuuuugugggcauguga

SEQ ID NO: 7612 - RNA, 22 nt, Homo sapiens
uggagguaggacgaagaacucu

SEQ ID NO: 7613 - RNA, 22 nt, Homo sapiens
auauguaguauggaaacauugu

SEQ ID NO: 7614 - RNA, 22 nt, Homo sapiens
uuugcaauagguuguggggagg

SEQ ID NO: 7615 - RNA, 22 nt, Homo sapiens
gguccgccugccuuggccuccc

SEQ ID NO: 7616 - RNA, 22 nt, Homo sapiens
uauugacuuuuuuguuaggagg

SEQ ID NO: 7617 - RNA, 22 nt, Homo sapiens
aaaugcugcuuuggccucuucu

SEQ ID NO: 7618 - RNA, 22 nt, Homo sapiens
uugguaaaaugaccacagacau

SEQ ID NO: 7619 - RNA, 22 nt, Homo sapiens
ugauaacauuucuucugguaca

SEQ ID NO: 7620 - RNA, 22 nt, Homo sapiens
uggcggagacauggacuucaga

SEQ ID NO: 7621 - RNA, 22 nt, Homo sapiens
ugagaucugauaggccuggguu

SEQ ID NO: 7622 - RNA, 22 nt, Homo sapiens
uggaagacauuuuggaccuugg

SEQ ID NO: 7623 - RNA, 22 nt, Homo sapiens
uaaugcuugguuguuuggaaaa

SEQ ID NO: 7624 - RNA, 22 nt, Homo sapiens
accuuuacaacuuguuagagua

SEQ ID NO: 7625 - RNA, 22 nt, Homo sapiens
augagagcugacuuuaaggcaa

SEQ ID NO: 7626 - RNA, 22 nt, Homo sapiens
uguugguuaaaucagguuuuaa

SEQ ID NO: 7627 - RNA, 22 nt, Homo sapiens
gugaccucauuacggggccugc

SEQ ID NO: 7628 - RNA, 22 nt, Homo sapiens
uuuccuguaggaaggaaauaga

SEQ ID NO: 7629 - RNA, 22 nt, Homo sapiens
ugagacugagucuugcucuauu

SEQ ID NO: 7630 - RNA, 22 nt, Homo sapiens
cuucuugcuguguccucacaug

SEQ ID NO: 7631 - RNA, 22 nt, Homo sapiens
ugauguccaguucauagaaacu

SEQ ID NO: 7632 - RNA, 22 nt, Homo sapiens
aaggugguuuucucuuggaguc

SEQ ID NO: 7633 - RNA, 22 nt, Homo sapiens
uugaagacuaccuaccauacuu

SEQ ID NO: 7634 - RNA, 22 nt, Homo sapiens
aagucauggagaagguggaggu

SEQ ID NO: 7635 - RNA, 22 nt, Homo sapiens
uccuuugguuauaggcaccucu

SEQ ID NO: 7636 - RNA, 22 nt, Homo sapiens
cugauaugaugggugauuuuca

SEQ ID NO: 7637 - RNA, 22 nt, Homo sapiens
uauaagguuaggaaaaauuucu

SEQ ID NO: 7638 - RNA, 22 nt, Homo sapiens
uugcaaguggagcuuccagggc

SEQ ID NO: 7639 - RNA, 22 nt, Homo sapiens
acccugugaauauuuaaacuuc

SEQ ID NO: 7640 - RNA, 22 nt, Homo sapiens
ugacugucuagauagagcuugg

SEQ ID NO: 7641 - RNA, 22 nt, Homo sapiens
ugguuguuuuaaaugucgucug

SEQ ID NO: 7642 - RNA, 22 nt, Homo sapiens
aguccauuugaugaugauucca

SEQ ID NO: 7643 - RNA, 22 nt, Homo sapiens
caauugcacucuuagguguaca

SEQ ID NO: 7644 - RNA, 22 nt, Homo sapiens
uauuugguuggugcaaaaguaa

SEQ ID NO: 7645 - RNA, 22 nt, Homo sapiens
uauuagguuggugcaaaaguua

SEQ ID NO: 7646 - RNA, 22 nt, Homo sapiens
ugugaguguguacuaguuauca

SEQ ID NO: 7647 - RNA, 22 nt, Homo sapiens
guuuguaacucuagugacuaga

SEQ ID NO: 7648 - RNA, 20 nt, Homo sapiens
uaugaccugucuuuucucuc

SEQ ID NO: 7649 - RNA, 22 nt, Homo sapiens
cuaaaugcacugucaaaggaag

SEQ ID NO: 7650 - RNA, 22 nt, Homo sapiens
ucacaucucagguuucuugaca

SEQ ID NO: 7651 - RNA, 22 nt, Homo sapiens
augagaccagcagaaaaccugu

SEQ ID NO: 7652 - RNA, 22 nt, Homo sapiens
ugcaggauguucaguaauuucc

SEQ ID NO: 7653 - RNA, 22 nt, Homo sapiens
uggaaaauuaggggagguuaua

SEQ ID NO: 7654 - RNA, 22 nt, Homo sapiens
ucaugugaggauaacaauagug

SEQ ID NO: 7655 - RNA, 22 nt, Homo sapiens
agagagguggguggagccccca

SEQ ID NO: 7656 - RNA, 21 nt, Homo sapiens
caucacauuacucaaaguccu

SEQ ID NO: 7657 - RNA, 21 nt, Homo sapiens
gagcuaggugaggcuguaaug

SEQ ID NO: 7658 - RNA, 20 nt, Homo sapiens
uuggaaaugugaauugggag

SEQ ID NO: 7659 - RNA, 22 nt, Homo sapiens
acuguacuccauccugggugac

SEQ ID NO: 7660 - RNA, 22 nt, Homo sapiens
caaaugaucugcuggccucagc

SEQ ID NO: 7661 - RNA, 22 nt, Homo sapiens
auaauagcugaucauuuagaag

SEQ ID NO: 7662 - RNA, 18 nt, Homo sapiens
uaacagucucucaggauc

SEQ ID NO: 7663 - RNA, 22 nt, Homo sapiens
uaccaucauuauacguagaaau

SEQ ID NO: 7664 - RNA, 23 nt, Homo sapiens
ggauggaaaguuuugagggccac

SEQ ID NO: 7665 - RNA, 22 nt, Homo sapiens
ucaaccggugagagcuuccucc

SEQ ID NO: 7666 - RNA, 21 nt, Homo sapiens
ccuugguuaucuucccauuca

SEQ ID NO: 7667 - RNA, 22 nt, Homo sapiens
auagcagcuugucagggcagac

SEQ ID NO: 7668 - RNA, 22 nt, Homo sapiens
guuggaguuaagcaguaaugaa

SEQ ID NO: 7669 - RNA, 22 nt, Homo sapiens
uucaaaguguugguuuugggcu

SEQ ID NO: 7670 - RNA, 22 nt, Homo sapiens
gcaggcaugacauuucacucuu

SEQ ID NO: 7671 - RNA, 23 nt, Homo sapiens
uuggccuccuugugucuagggcu

SEQ ID NO: 7672 - RNA, 22 nt, Homo sapiens
acggcaguguggugcggucagg

SEQ ID NO: 7673 - RNA, 22 nt, Homo sapiens
uuuagcagcaaagagcuguguu

SEQ ID NO: 7674 - RNA, 22 nt, Homo sapiens
gugaauagggaauaaugggauc

SEQ ID NO: 7675 - RNA, 22 nt, Homo sapiens
auauugacuuucucuuagauca

SEQ ID NO: 7676 - RNA, 22 nt, Homo sapiens
ucagaucaguuccacaagaacu

SEQ ID NO: 7677 - RNA, 22 nt, Homo sapiens
uuauggauuuauauucuguagu

SEQ ID NO: 7678 - RNA, 22 nt, Homo sapiens
uucccuuucuuaaagaguuagg

SEQ ID NO: 7679 - RNA, 22 nt, Homo sapiens
uaggaaguuucuugauuacuua

SEQ ID NO: 7680 - RNA, 22 nt, Homo sapiens
uuuccaguuuggaggaugcauu

SEQ ID NO: 7681 - RNA, 22 nt, Homo sapiens
acacaugugcguagacucuuua

SEQ ID NO: 7682 - RNA, 22 nt, Homo sapiens
aaggugcucucuuauguagaaa

SEQ ID NO: 7683 - RNA, 22 nt, Homo sapiens
cucagugguugauuuauuuauc

SEQ ID NO: 7684 - RNA, 22 nt, Homo sapiens
cggugcaaauguaauugcaguu

SEQ ID NO: 7685 - RNA, 22 nt, Homo sapiens
acccgguuagggggcaguggau

SEQ ID NO: 7686 - RNA, 22 nt, Homo sapiens
uuuuugugguauauugcaacaa

SEQ ID NO: 7687 - RNA, 22 nt, Homo sapiens
ccagugguucccuguggccuga

SEQ ID NO: 7688 - RNA, 22 nt, Homo sapiens
ucacuguggaacucaaaaagcu

SEQ ID NO: 7689 - RNA, 22 nt, Homo sapiens
ugagugaaugugaaggcuaggg

SEQ ID NO: 7690 - RNA, 22 nt, Homo sapiens
cuugacaucugucaguuccuca

SEQ ID NO: 7691 - RNA, 18 nt, Homo sapiens
acuggauguaaagggucc

SEQ ID NO: 7692 - RNA, 22 nt, Homo sapiens
uggccaguuuuuaauugggucu

SEQ ID NO: 7693 - RNA, 22 nt, Homo sapiens
uuagcacauuuccagcacaugg

SEQ ID NO: 7694 - RNA, 22 nt, Homo sapiens
acaguuaugugagggccaccag

SEQ ID NO: 7695 - RNA, 22 nt, Homo sapiens
uagcacaugucagguaauuugc

SEQ ID NO: 7696 - RNA, 22 nt, Homo sapiens
acacaguaaauauugucuccuc

SEQ ID NO: 7697 - RNA, 22 nt, Homo sapiens
uggcauggaacuacuuugaaac

SEQ ID NO: 7698 - RNA, 22 nt, Homo sapiens
gagacugaguuuugcucuuguu

SEQ ID NO: 7699 - RNA, 20 nt, Homo sapiens
acagcacugguuucaagcaa

SEQ ID NO: 7700 - RNA, 22 nt, Homo sapiens
aauuaguugaaagucugcuuuu

SEQ ID NO: 7701 - RNA, 22 nt, Homo sapiens
uugagagagaacauuuguuaca

SEQ ID NO: 7702 - RNA, 22 nt, Homo sapiens
uugaauaguggugaaaguuuga

SEQ ID NO: 7703 - RNA, 22 nt, Homo sapiens
cuagucacauuuucaucaaaua

SEQ ID NO: 7704 - RNA, 22 nt, Homo sapiens
uaugcacacucucccaggaggg

SEQ ID NO: 7705 - RNA, 22 nt, Homo sapiens
uuucacaguguucucccccaga

SEQ ID NO: 7706 - RNA, 22 nt, Homo sapiens
ggcaagauagauaucaguguca

SEQ ID NO: 7707 - RNA, 22 nt, Homo sapiens
uuggcaagcuguuaauuauaaa

SEQ ID NO: 7708 - RNA, 22 nt, Homo sapiens
ugaugguuuuaaaaagaggagu

SEQ ID NO: 7709 - RNA, 22 nt, Homo sapiens
cucacggcccugcgcacuggca

SEQ ID NO: 7710 - RNA, 22 nt, Homo sapiens
uugacugugguaauggaagcug

SEQ ID NO: 7711 - RNA, 22 nt, Homo sapiens
augugacuuuuuccugugccuu

SEQ ID NO: 7712 - RNA, 22 nt, Homo sapiens
gugugguauuauaacuagguau

SEQ ID NO: 7713 - RNA, 22 nt, Homo sapiens
ugagcuaggucuugcucuguca

SEQ ID NO: 7714 - RNA, 22 nt, Homo sapiens
acaagcacaaaugcauagaugg

SEQ ID NO: 7715 - RNA, 22 nt, Homo sapiens
uuggacuucuaacugacaugga

SEQ ID NO: 7716 - RNA, 22 nt, Homo sapiens
uauugacauuacagugggucuu

SEQ ID NO: 7717 - RNA, 22 nt, Homo sapiens
aaggagcuuaagugacuuguac

SEQ ID NO: 7718 - RNA, 19 nt, Homo sapiens
accuguagaaaguacaaca

SEQ ID NO: 7719 - RNA, 22 nt, Homo sapiens
ggggcauugugacauaucucug

SEQ ID NO: 7720 - RNA, 22 nt, Homo sapiens
auugcacuccagccuugacaca

SEQ ID NO: 7721 - RNA, 21 nt, Homo sapiens
guccaaaacaguguccaaugc

SEQ ID NO: 7722 - RNA, 20 nt, Homo sapiens
uaugacaaagccuagugagu

SEQ ID NO: 7723 - RNA, 20 nt, Homo sapiens
uugagaucuguaucugguuu

SEQ ID NO: 7724 - RNA, 22 nt, Homo sapiens
gaucugagaaagugucauaaca

SEQ ID NO: 7725 - RNA, 22 nt, Homo sapiens
uagcaguaaagaaugugauguu

SEQ ID NO: 7726 - RNA, 22 nt, Homo sapiens
gccaguguuuuauugagaauuu

SEQ ID NO: 7727 - RNA, 22 nt, Homo sapiens
aggcaagugggagacagcauuu

SEQ ID NO: 7728 - RNA, 22 nt, Homo sapiens
cugagguauaucccauuagaag

SEQ ID NO: 7729 - RNA, 22 nt, Homo sapiens
uugagauggagucucgcucugu

SEQ ID NO: 7730 - RNA, 22 nt, Homo sapiens
ucagcacauucaaggccugccu

SEQ ID NO: 7731 - RNA, 23 nt, Homo sapiens
uuauggcuuuuauuauguugagg

SEQ ID NO: 7732 - RNA, 22 nt, Homo sapiens
uuaauguaucuaucacaucaca

SEQ ID NO: 7733 - RNA, 22 nt, Homo sapiens
caccaaccucaguagcaucugu

SEQ ID NO: 7734 - RNA, 22 nt, Homo sapiens
uacaguaggauuuucagggucu

SEQ ID NO: 7735 - RNA, 22 nt, Homo sapiens
uaaagcuagagcuggaguggca

SEQ ID NO: 7736 - RNA, 22 nt, Homo sapiens
ugagauggguucugguccccug

SEQ ID NO: 7737 - RNA, 22 nt, Homo sapiens
agcuccaugauaguaugucugu

SEQ ID NO: 7738 - RNA, 22 nt, Homo sapiens
guaugguacuuuaugguuagug

SEQ ID NO: 7739 - RNA, 22 nt, Homo sapiens
aaacugccuuccuuguaggugc

SEQ ID NO: 7740 - RNA, 22 nt, Homo sapiens
aaucugauguuaucagcuuaag

SEQ ID NO: 7741 - RNA, 22 nt, Homo sapiens
cugaauguucuauagaagccgc

SEQ ID NO: 7742 - RNA, 22 nt, Homo sapiens
cacugcaauuacuuuugcacca

SEQ ID NO: 7743 - RNA, 22 nt, Homo sapiens
ucuggcuuauuucacuuagcau

SEQ ID NO: 7744 - RNA, 22 nt, Homo sapiens
ugcaaagaaauuuuggugacca

SEQ ID NO: 7745 - RNA, 22 nt, Homo sapiens
auacaugugccaugcuggugug

SEQ ID NO: 7746 - RNA, 21 nt, Homo sapiens
ugcuuacugaauguuaauuuc

SEQ ID NO: 7747 - RNA, 22 nt, Homo sapiens
uagguaguaaauugauagagga

SEQ ID NO: 7748 - RNA, 22 nt, Homo sapiens
aaaugcuuucuuggaccauuug

SEQ ID NO: 7749 - RNA, 22 nt, Homo sapiens
uuggagagagaggacucccggc

SEQ ID NO: 7750 - RNA, 22 nt, Homo sapiens
guaugguugaagugacaagcca

SEQ ID NO: 7751 - RNA, 22 nt, Homo sapiens
uguagacagcacguaguugagu

SEQ ID NO: 7752 - RNA, 22 nt, Homo sapiens
uucuagcaauggcagagugucu

SEQ ID NO: 7753 - RNA, 22 nt, Homo sapiens
guuguggcuugugauuaagcac

SEQ ID NO: 7754 - RNA, 17 nt, Homo sapiens
ccaguuuucccucagug

SEQ ID NO: 7755 - RNA, 22 nt, Homo sapiens
ugagaccaacagauuccaguuc

SEQ ID NO: 7756 - RNA, 18 nt, Homo sapiens
ugcagcuuugugauuggc

SEQ ID NO: 7757 - RNA, 22 nt, Homo sapiens
ugggaagcugcugaacuacagu

SEQ ID NO: 7758 - RNA, 22 nt, Homo sapiens
gauguaggugcauuugcacgug

SEQ ID NO: 7759 - RNA, 22 nt, Homo sapiens
auggaaacauaagaguauagau

SEQ ID NO: 7760 - RNA, 22 nt, Homo sapiens
augugguaggcccaugagucau

SEQ ID NO: 7761 - RNA, 22 nt, Homo sapiens
ugagcugagauuaagcugcugc

SEQ ID NO: 7762 - RNA, 22 nt, Homo sapiens
gcacagaugaggagaggucuca

SEQ ID NO: 7763 - RNA, 22 nt, Homo sapiens
gugguguuugagcugccaggga

SEQ ID NO: 7764 - RNA, 20 nt, Homo sapiens
ugaacugguuacuuucuguc

SEQ ID NO: 7765 - RNA, 19 nt, Homo sapiens
ugagaaccucuacagaguc

SEQ ID NO: 7766 - RNA, 19 nt, Homo sapiens
ggucauggagguuguguga

SEQ ID NO: 7767 - RNA, 22 nt, Homo sapiens
cggcaguggguaagccaagcuu

SEQ ID NO: 7768 - RNA, 22 nt, Homo sapiens
cuguuauguuugauggaugaau

SEQ ID NO: 7769 - RNA, 22 nt, Homo sapiens
cuaggugcaugagccguacagu

SEQ ID NO: 7770 - RNA, 19 nt, Homo sapiens
uggcaaugucagcagagau

SEQ ID NO: 7771 - RNA, 22 nt, Homo sapiens
ccagugaacugcaagguuuuuc

SEQ ID NO: 7772 - RNA, 22 nt, Homo sapiens
aggcaacaugguaaaacccugu

SEQ ID NO: 7773 - RNA, 22 nt, Homo sapiens
ugccuacugguuguucugggca

SEQ ID NO: 7774 - RNA, 22 nt, Homo sapiens
aaucucaacacuuugggaggcu

SEQ ID NO: 7775 - RNA, 22 nt, Homo sapiens
gugcaaugaguguggcaaagcc

SEQ ID NO: 7776 - RNA, 22 nt, Homo sapiens
uauggguuuuucauaaauaggu

SEQ ID NO: 7777 - RNA, 22 nt, Homo sapiens
uuuaauagcagggacuuccggg

SEQ ID NO: 7778 - RNA, 22 nt, Homo sapiens
cugagagaugagaccucucacu

SEQ ID NO: 7779 - RNA, 22 nt, Homo sapiens
caccgguuaaucuguuuuuucu

SEQ ID NO: 7780 - RNA, 22 nt, Homo sapiens
ugaugcuacuaccugggcugaa

SEQ ID NO: 7781 - RNA, 21 nt, Homo sapiens
uaaaacuguaacuuuguccug

SEQ ID NO: 7782 - RNA, 22 nt, Homo sapiens
ucguuggcuacuuguucauuuc

SEQ ID NO: 7783 - RNA, 22 nt, Homo sapiens
ugccuucuguuaaacgaggaug

SEQ ID NO: 7784 - RNA, 22 nt, Homo sapiens
ugggcuagaugcuuugggguca

SEQ ID NO: 7785 - RNA, 22 nt, Homo sapiens
uaucucagagaaucagauuuac

SEQ ID NO: 7786 - RNA, 22 nt, Homo sapiens
gacugcauuugccccaucgaau

SEQ ID NO: 7787 - RNA, 22 nt, Homo sapiens
uguuucuacugucucuguagua

SEQ ID NO: 7788 - RNA, 22 nt, Homo sapiens
uucuacuucauuaggaggauug

SEQ ID NO: 7789 - RNA, 22 nt, Homo sapiens
ugauacugugcauuagaggcua

SEQ ID NO: 7790 - RNA, 22 nt, Homo sapiens
augagcuguuuggaagacacuu

SEQ ID NO: 7791 - RNA, 22 nt, Homo sapiens
uuagggaggagucccucuuuuu

SEQ ID NO: 7792 - RNA, 22 nt, Homo sapiens
uuuagcacugugauugacaaaa

SEQ ID NO: 7793 - RNA, 22 nt, Homo sapiens
gggcauaucacuugaggucagg

SEQ ID NO: 7794 - RNA, 22 nt, Homo sapiens
aaaucccuugcucucucagacc

SEQ ID NO: 7795 - RNA, 22 nt, Homo sapiens
cugacucagacacauguauaug

SEQ ID NO: 7796 - RNA, 18 nt, Homo sapiens
cuggaugucgaguguguu

SEQ ID NO: 7797 - RNA, 19 nt, Homo sapiens
guaaucucaguacuuuggu

SEQ ID NO: 7798 - RNA, 18 nt, Homo sapiens
acugcacuccauccuagg

SEQ ID NO: 7799 - RNA, 22 nt, Homo sapiens
ugcaccaauucuaaacaguucu

SEQ ID NO: 7800 - RNA, 22 nt, Homo sapiens
ugagcugagaaaugcagcagcu

SEQ ID NO: 7801 - RNA, 22 nt, Homo sapiens
uguagauaucauuagugcugug

SEQ ID NO: 7802 - RNA, 23 nt, Homo sapiens
uuugugucccucuagaauucaug

SEQ ID NO: 7803 - RNA, 22 nt, Homo sapiens
uuugucacucuuggagguuguu

SEQ ID NO: 7804 - RNA, 22 nt, Homo sapiens
acaucacuguuugauugauuga

SEQ ID NO: 7805 - RNA, 22 nt, Homo sapiens
uggccagugucuauugguuucc

SEQ ID NO: 7806 - RNA, 22 nt, Homo sapiens
ucacagccuaguuuuauacauu

SEQ ID NO: 7807 - RNA, 23 nt, Homo sapiens
cagugcaugacuguauaugcaaa

SEQ ID NO: 7808 - RNA, 22 nt, Homo sapiens
cacccgugacgcugucugaaau

SEQ ID NO: 7809 - RNA, 22 nt, Homo sapiens
ucuguguugaugcucauuaauu

SEQ ID NO: 7810 - RNA, 18 nt, Homo sapiens
cuaauacuauucaacaag

SEQ ID NO: 7811 - RNA, 20 nt, Homo sapiens
accgggugaaacccuaucuc

SEQ ID NO: 7812 - RNA, 22 nt, Homo sapiens
uuugguuuuuguuaucacucau

SEQ ID NO: 7813 - RNA, 22 nt, Homo sapiens
auggaguguucugaauccuuug

SEQ ID NO: 7814 - RNA, 22 nt, Homo sapiens
uugcaaaguugccaaggaagga

SEQ ID NO: 7815 - RNA, 22 nt, Homo sapiens
gcacauggccacuaggaauaaa

SEQ ID NO: 7816 - RNA, 22 nt, Homo sapiens
ugaggcacucccuagcggggug

SEQ ID NO: 7817 - RNA, 22 nt, Homo sapiens
ucacagcggucgaacuaauuug

SEQ ID NO: 7818 - RNA, 22 nt, Homo sapiens
gguaauguaacugguauucugu

SEQ ID NO: 7819 - RNA, 21 nt, Homo sapiens
ugcagccauucagcccuaugc

SEQ ID NO: 7820 - RNA, 22 nt, Homo sapiens
augcaaaucuuaaguaugugug

SEQ ID NO: 7821 - RNA, 22 nt, Homo sapiens
cacagugaaugucaucauugcc

SEQ ID NO: 7822 - RNA, 22 nt, Homo sapiens
auaggagcagaaaccguauuuu

SEQ ID NO: 7823 - RNA, 22 nt, Homo sapiens
ugaauguaagaugucugcuggu

SEQ ID NO: 7824 - RNA, 22 nt, Homo sapiens
augagggagggcaccugaccuu

SEQ ID NO: 7825 - RNA, 22 nt, Homo sapiens
gugcacaacguguagguuuguu

SEQ ID NO: 7826 - RNA, 22 nt, Homo sapiens
uaacaguauaugugguaucuau

SEQ ID NO: 7827 - RNA, 22 nt, Homo sapiens
uuggaaaccucugcagguguuu

SEQ ID NO: 7828 - RNA, 22 nt, Homo sapiens
uaagugcaacauaaguguuaaa

SEQ ID NO: 7829 - RNA, 22 nt, Homo sapiens
uggauggugauuggaucaugga

SEQ ID NO: 7830 - RNA, 22 nt, Homo sapiens
aaugcaagauguuaauuauagg

SEQ ID NO: 7831 - RNA, 22 nt, Homo sapiens
ugugccuucuaagaaggagucu

SEQ ID NO: 7832 - RNA, 22 nt, Homo sapiens
caugugcaugagcacauacgug

SEQ ID NO: 7833 - RNA, 21 nt, Homo sapiens
aucagagacccaggcuuccuc

SEQ ID NO: 7834 - RNA, 22 nt, Homo sapiens
ugacagguuggaauuaugggag

SEQ ID NO: 7835 - RNA, 22 nt, Homo sapiens
ucacuggagauagcaaucuggu

SEQ ID NO: 7836 - RNA, 21 nt, Homo sapiens
uuuuggucauucaggaagaaa

SEQ ID NO: 7837 - RNA, 22 nt, Homo sapiens
auucuauaguccuaggauuggg

SEQ ID NO: 7838 - RNA, 22 nt, Homo sapiens
uuccacaauggcugaacuaguu

SEQ ID NO: 7839 - RNA, 22 nt, Homo sapiens
ggcaaaaucgcaauuacuuuug

SEQ ID NO: 7840 - RNA, 22 nt, Homo sapiens
uaacauugucuugcuuaguuuu

SEQ ID NO: 7841 - RNA, 22 nt, Homo sapiens
uaucaagaugacaaacuuugcu

SEQ ID NO: 7842 - RNA, 22 nt, Homo sapiens
gaguauuuuacaucguguaauu

SEQ ID NO: 7843 - RNA, 22 nt, Homo sapiens
auagcagcaccccacuaccuca

SEQ ID NO: 7844 - RNA, 20 nt, Homo sapiens
cuuaaugcagcauuucucag

SEQ ID NO: 7845 - RNA, 22 nt, Homo sapiens
ugaguucauggucauuugucac

SEQ ID NO: 7846 - RNA, 22 nt, Homo sapiens
aauuacucgugucuuuacugcu

SEQ ID NO: 7847 - RNA, 21 nt, Homo sapiens
aauaaagcaaccuuaugccau

SEQ ID NO: 7848 - RNA, 22 nt, Homo sapiens
auuaagagcacauguucugggu

SEQ ID NO: 7849 - RNA, 22 nt, Homo sapiens
ugagauggaguuucgcuuuugu

SEQ ID NO: 7850 - RNA, 22 nt, Homo sapiens
uucacagagagaacucaaacca

SEQ ID NO: 7851 - RNA, 22 nt, Homo sapiens
ugagguaucauugcccaggcug

SEQ ID NO: 7852 - RNA, 22 nt, Homo sapiens
cagauaguuguagguguguggc

SEQ ID NO: 7853 - RNA, 22 nt, Homo sapiens
gagaagugcgucguuugaugau

SEQ ID NO: 7854 - RNA, 22 nt, Homo sapiens
ugacuaggaggcuggaggauga

SEQ ID NO: 7855 - RNA, 22 nt, Homo sapiens
cuugguacucugugucccagcu

SEQ ID NO: 7856 - RNA, 22 nt, Homo sapiens
aucagugcauaguauuuaauga

SEQ ID NO: 7857 - RNA, 22 nt, Homo sapiens
ugaaagacacagaaguugccca

SEQ ID NO: 7858 - RNA, 22 nt, Homo sapiens
ucagagcaaagacacuuuauca

SEQ ID NO: 7859 - RNA, 23 nt, Homo sapiens
ugagcaauauucuacuauugagu

SEQ ID NO: 7860 - RNA, 22 nt, Homo sapiens
augcuauguagaugagggccca

SEQ ID NO: 7861 - RNA, 22 nt, Homo sapiens
uuggauagugcaaugccuccag

SEQ ID NO: 7862 - RNA, 22 nt, Homo sapiens
ugauuugucugcaggaauagug

SEQ ID NO: 7863 - RNA, 22 nt, Homo sapiens
gacucuguagacaaucacaucu

SEQ ID NO: 7864 - RNA, 22 nt, Homo sapiens
gauggcuacugauuaaauauag

SEQ ID NO: 7865 - RNA, 22 nt, Homo sapiens
aaagcuaagguagcauuggaga

SEQ ID NO: 7866 - RNA, 22 nt, Homo sapiens
cuaagugaguauaauuuuaaga

SEQ ID NO: 7867 - RNA, 22 nt, Homo sapiens
ugagaugaguucucgcucuguc

SEQ ID NO: 7868 - RNA, 22 nt, Homo sapiens
cuuccaguggcagccgggcaug

SEQ ID NO: 7869 - RNA, 22 nt, Homo sapiens
uagcagguggugaccacauuuu

SEQ ID NO: 7870 - RNA, 22 nt, Homo sapiens
aucagugauugauuuaaagacg

SEQ ID NO: 7871 - RNA, 22 nt, Homo sapiens
auagcagugugaaaauugacug

SEQ ID NO: 7872 - RNA, 20 nt, Homo sapiens
ucuaccuguagguaauuggu

SEQ ID NO: 7873 - RNA, 22 nt, Homo sapiens
augaggugaguaaauaaaugaa

SEQ ID NO: 7874 - RNA, 22 nt, Homo sapiens
cuuuggagaaaaguucuugggc

SEQ ID NO: 7875 - RNA, 22 nt, Homo sapiens
ggcaagaucuuggcucacugaa

SEQ ID NO: 7876 - RNA, 22 nt, Homo sapiens
gagcaucaguggccucaucuca

SEQ ID NO: 7877 - RNA, 22 nt, Homo sapiens
ucaaagucuucucaaguaacau

SEQ ID NO: 7878 - RNA, 22 nt, Homo sapiens
cugguaugcuucauaugcaaac

SEQ ID NO: 7879 - RNA, 22 nt, Homo sapiens
ucaaaugguccacgugaacauu

SEQ ID NO: 7880 - RNA, 22 nt, Homo sapiens
ggaauuaaggcaauugaaagcu

SEQ ID NO: 7881 - RNA, 22 nt, Homo sapiens
uguccaaauugaaucaucuggu

SEQ ID NO: 7882 - RNA, 22 nt, Homo sapiens
auggcuuuuccugucuugcaug

SEQ ID NO: 7883 - RNA, 16 nt, Homo sapiens
guacacaguaaguaug

SEQ ID NO: 7884 - RNA, 18 nt, Homo sapiens
ugcuuagucauuuucaau

SEQ ID NO: 7885 - RNA, 22 nt, Homo sapiens
auuaaucaggcaaugcuugcua

SEQ ID NO: 7886 - RNA, 22 nt, Homo sapiens
aaggcaagaaugcgugcuuuca

SEQ ID NO: 7887 - RNA, 22 nt, Homo sapiens
uugugaauggugccgcgauaaa

SEQ ID NO: 7888 - RNA, 22 nt, Homo sapiens
uugugaagaugugaagcaagca

SEQ ID NO: 7889 - RNA, 22 nt, Homo sapiens
acccuggauucguggccuugaa

SEQ ID NO: 7890 - RNA, 22 nt, Homo sapiens
uagcacaguucacccucgauuu

SEQ ID NO: 7891 - RNA, 22 nt, Homo sapiens
guguaaaacaauuagaggauuu

SEQ ID NO: 7892 - RNA, 22 nt, Homo sapiens
ucucuugguugaacaguuugga

SEQ ID NO: 7893 - RNA, 22 nt, Homo sapiens
ugacagcuguugaggcauuuau

SEQ ID NO: 7894 - RNA, 22 nt, Homo sapiens
uuuagcaaugcuguggggaagu

SEQ ID NO: 7895 - RNA, 22 nt, Homo sapiens
augguacucucuugucugcaaa

SEQ ID NO: 7896 - RNA, 22 nt, Homo sapiens
uuugagcaagaggugacauuau

SEQ ID NO: 7897 - RNA, 22 nt, Homo sapiens
ucagaucacuggcgcuggcgga

SEQ ID NO: 7898 - RNA, 22 nt, Homo sapiens
acuuuuguuauacagugugaua

SEQ ID NO: 7899 - RNA, 22 nt, Homo sapiens
uagcacuaucuauugcaugcaa

SEQ ID NO: 7900 - RNA, 22 nt, Homo sapiens
uucccauuguuggccagcaugu

SEQ ID NO: 7901 - RNA, 22 nt, Homo sapiens
uccaguuguuauuuuuauaaag

SEQ ID NO: 7902 - RNA, 22 nt, Homo sapiens
ucugagguaggugcauggauac

SEQ ID NO: 7903 - RNA, 22 nt, Homo sapiens
cacacugucuucaauggguggu

SEQ ID NO: 7904 - RNA, 22 nt, Homo sapiens
acccuauagaggcaauaggcac

SEQ ID NO: 7905 - RNA, 19 nt, Homo sapiens
agcaguguggagauuucuc

SEQ ID NO: 7906 - RNA, 22 nt, Homo sapiens
ucugcauauucuagggcaccaa

SEQ ID NO: 7907 - RNA, 22 nt, Homo sapiens
ugggaugaauacaaugggauca

SEQ ID NO: 7908 - RNA, 22 nt, Homo sapiens
uacaugugccauguugguuugc

SEQ ID NO: 7909 - RNA, 22 nt, Homo sapiens
uacucaauugcagucaccuggc

SEQ ID NO: 7910 - RNA, 18 nt, Homo sapiens
aguuguuuuauccugccc

SEQ ID NO: 7911 - RNA, 22 nt, Homo sapiens
cuguaaaguaagagguaaguua

SEQ ID NO: 7912 - RNA, 20 nt, Homo sapiens
uauugcacuccagucugggc

SEQ ID NO: 7913 - RNA, 20 nt, Homo sapiens
ucacaagccaagaucacguc

SEQ ID NO: 7914 - RNA, 22 nt, Homo sapiens
uaaggcacauaggccuggaaac

SEQ ID NO: 7915 - RNA, 22 nt, Homo sapiens
ugagacugagucucccucuguc

SEQ ID NO: 7916 - RNA, 22 nt, Homo sapiens
guaaagacacaugcacacguau

SEQ ID NO: 7917 - RNA, 22 nt, Homo sapiens
acucagagaacauucccagucu

SEQ ID NO: 7918 - RNA, 23 nt, Homo sapiens
uucaaaggaugcuuuauggaauu

SEQ ID NO: 7919 - RNA, 22 nt, Homo sapiens
cuuuugugauucuucaguuacu

SEQ ID NO: 7920 - RNA, 22 nt, Homo sapiens
uugagcacaggaguuuugagac

SEQ ID NO: 7921 - RNA, 22 nt, Homo sapiens
uacaaaguaacaguuccuguau

SEQ ID NO: 7922 - RNA, 20 nt, Homo sapiens
ucacuauggagcucuuucuu

SEQ ID NO: 7923 - RNA, 22 nt, Homo sapiens
auguugcuugaaggcauuuugu

SEQ ID NO: 7924 - RNA, 23 nt, Homo sapiens
acacaguaaacuaaaagcuagcu

SEQ ID NO: 7925 - RNA, 22 nt, Homo sapiens
acuguacuacagccugggugac

SEQ ID NO: 7926 - RNA, 20 nt, Homo sapiens
ucccaguaggagaaggaagg

SEQ ID NO: 7927 - RNA, 18 nt, Homo sapiens
guuagguaguaugaugcu

SEQ ID NO: 7928 - RNA, 22 nt, Homo sapiens
agcauuaguugugaagccuuua

SEQ ID NO: 7929 - RNA, 21 nt, Homo sapiens
augggguagaagagaaggcuu

SEQ ID NO: 7930 - RNA, 22 nt, Homo sapiens
gucagugccugucccaggcuuu

SEQ ID NO: 7931 - RNA, 22 nt, Homo sapiens
auagugcugcaauaaacacacg

SEQ ID NO: 7932 - RNA, 23 nt, Homo sapiens
augagguaucugagcccagaaau

SEQ ID NO: 7933 - RNA, 22 nt, Homo sapiens
caggcagugggagacaaaacug

SEQ ID NO: 7934 - RNA, 17 nt, Homo sapiens
uggugcuugaaaguugc

SEQ ID NO: 7935 - RNA, 22 nt, Homo sapiens
ugugaucaugugugccuuaguc

SEQ ID NO: 7936 - RNA, 22 nt, Homo sapiens
uuccaguggacuacuucauccu

SEQ ID NO: 7937 - RNA, 19 nt, Homo sapiens
uagcacagggucccagacu

SEQ ID NO: 7938 - RNA, 22 nt, Homo sapiens
ggagaauugcuuggacccggga

SEQ ID NO: 7939 - RNA, 22 nt, Homo sapiens
agcagcaccaaacagacuaaga

SEQ ID NO: 7940 - RNA, 22 nt, Homo sapiens
uucuggcuaugggauacuaaau

SEQ ID NO: 7941 - RNA, 22 nt, Homo sapiens
gagaucaucuaaucuggccucu

SEQ ID NO: 7942 - RNA, 22 nt, Homo sapiens
ugaaugguaaagaaaagcacug

SEQ ID NO: 7943 - RNA, 20 nt, Homo sapiens
aggacuacagaggguaggau

SEQ ID NO: 7944 - RNA, 22 nt, Homo sapiens
uugguuccuuagccuaggacua

SEQ ID NO: 7945 - RNA, 22 nt, Homo sapiens
ugauaagugagauagcaaguga

SEQ ID NO: 7946 - RNA, 22 nt, Homo sapiens
uacugcacuccagcuuaggaga

SEQ ID NO: 7947 - RNA, 22 nt, Homo sapiens
ggcaaguauguuuuaggaugcu

SEQ ID NO: 7948 - RNA, 22 nt, Homo sapiens
uuugacucacagccuggcugcc

SEQ ID NO: 7949 - RNA, 22 nt, Homo sapiens
uaugaugcuguuuagaaucucu

SEQ ID NO: 7950 - RNA, 22 nt, Homo sapiens
ugaauuguuucauucuuuacau

SEQ ID NO: 7951 - RNA, 22 nt, Homo sapiens
ucaaagugcuauggcucagguu

SEQ ID NO: 7952 - RNA, 22 nt, Homo sapiens
augcuacugaccccuacuuaca

SEQ ID NO: 7953 - RNA, 22 nt, Homo sapiens
uugcaagauguucaugggcugu

SEQ ID NO: 7954 - RNA, 22 nt, Homo sapiens
cccugagagcagggucuuucuc

SEQ ID NO: 7955 - RNA, 22 nt, Homo sapiens
gccauggaggauuuauagaggc

SEQ ID NO: 7956 - RNA, 22 nt, Homo sapiens
augcuaucauucaggauuuguu

SEQ ID NO: 7957 - RNA, 22 nt, Homo sapiens
ugcccuuugucagaugaguagg

SEQ ID NO: 7958 - RNA, 22 nt, Homo sapiens
uacuagaaccuuauucagagug

SEQ ID NO: 7959 - RNA, 20 nt, Homo sapiens
uuuggcacugagugguauaa

SEQ ID NO: 7960 - RNA, 22 nt, Homo sapiens
cuaugcauuuuggaggagggaa

SEQ ID NO: 7961 - RNA, 22 nt, Homo sapiens
ccuggcaagagacugaagauag

SEQ ID NO: 7962 - RNA, 23 nt, Homo sapiens
ucugcggguguggacccuagugc

SEQ ID NO: 7963 - RNA, 22 nt, Homo sapiens
ucaaauuccaagucuagguagg

SEQ ID NO: 7964 - RNA, 22 nt, Homo sapiens
agugcaguggcucaaaaugccu

SEQ ID NO: 7965 - RNA, 19 nt, Homo sapiens
ucagaugcauuagggguua

SEQ ID NO: 7966 - RNA, 22 nt, Homo sapiens
aagugcuucuuuccucgagaag

SEQ ID NO: 7967 - RNA, 21 nt, Homo sapiens
ugguugauccuccuagugccu

SEQ ID NO: 7968 - RNA, 22 nt, Homo sapiens
acaaaguaggcagugggcugga

SEQ ID NO: 7969 - RNA, 22 nt, Homo sapiens
uggccuuuuccaagaacuacua

SEQ ID NO: 7970 - RNA, 22 nt, Homo sapiens
cuaaggaaggacugaaaggaca

SEQ ID NO: 7971 - RNA, 22 nt, Homo sapiens
uugguuccauuuuaccagcucu

SEQ ID NO: 7972 - RNA, 22 nt, Homo sapiens
acauugcagauguguuuaaugu

SEQ ID NO: 7973 - RNA, 22 nt, Homo sapiens
uggcuauuucgucaugcucccc

SEQ ID NO: 7974 - RNA, 22 nt, Homo sapiens
augcauggcagagucaggguac

SEQ ID NO: 7975 - RNA, 22 nt, Homo sapiens
aaaugcagauuccuaggcccca

SEQ ID NO: 7976 - RNA, 22 nt, Homo sapiens
caugacacauguuuaccuaugu

SEQ ID NO: 7977 - RNA, 22 nt, Homo sapiens
cucacuaguaaggcuguuuagu

SEQ ID NO: 7978 - RNA, 22 nt, Homo sapiens
agcagcauuaugauauaucuua

SEQ ID NO: 7979 - RNA, 22 nt, Homo sapiens
uuugccuguagacacuuacccu

SEQ ID NO: 7980 - RNA, 22 nt, Homo sapiens
ucuuaggugggccaucacccca

SEQ ID NO: 7981 - RNA, 22 nt, Homo sapiens
aucacugggagcagccauuaau

SEQ ID NO: 7982 - RNA, 22 nt, Homo sapiens
uugcacauggcaggugcucaau

SEQ ID NO: 7983 - RNA, 22 nt, Homo sapiens
caccuguagucccagcugaggc

SEQ ID NO: 7984 - RNA, 22 nt, Homo sapiens
ucacuaggcuggagugcagugg

SEQ ID NO: 7985 - RNA, 22 nt, Homo sapiens
uuuuugaguagcuggagagcag

SEQ ID NO: 7986 - RNA, 22 nt, Homo sapiens
agagaccuguaaaguucaggca

SEQ ID NO: 7987 - RNA, 22 nt, Homo sapiens
gugucaugaagguuuuaugcag

SEQ ID NO: 7988 - RNA, 22 nt, Homo sapiens
aguggcacaauuuugacucccc

SEQ ID NO: 7989 - RNA, 22 nt, Homo sapiens
ucucugagaccacuccaaacuc

SEQ ID NO: 7990 - RNA, 22 nt, Homo sapiens
auugugcuaaaguaauaaguca

SEQ ID NO: 7991 - RNA, 22 nt, Homo sapiens
ugaauucaucucacagaguuaa

SEQ ID NO: 7992 - RNA, 22 nt, Homo sapiens
agcaggacaauaugggaucagg

SEQ ID NO: 7993 - RNA, 22 nt, Homo sapiens
cugcagaucuuggggcuugcca

SEQ ID NO: 7994 - RNA, 20 nt, Homo sapiens
acaguagaagggauuucaaa

SEQ ID NO: 7995 - RNA, 22 nt, Homo sapiens
auagugcuguauuaaacauacg

SEQ ID NO: 7996 - RNA, 22 nt, Homo sapiens
aaccuucauuccuuucccugcc

SEQ ID NO: 7997 - RNA, 22 nt, Homo sapiens
uuaauacucuucuaaguagucc

SEQ ID NO: 7998 - RNA, 22 nt, Homo sapiens
aucaaacugcaaggcagcagca

SEQ ID NO: 7999 - RNA, 22 nt, Homo sapiens
uugacuccagagugaguaaaug

SEQ ID NO: 8000 - RNA, 22 nt, Homo sapiens
aucuuuggauacuugauauagu

SEQ ID NO: 8001 - RNA, 18 nt, Homo sapiens
ugaaacacauuuuuuccu

SEQ ID NO: 8002 - RNA, 20 nt, Homo sapiens
augaagugaaguuagggaac

SEQ ID NO: 8003 - RNA, 22 nt, Homo sapiens
uugaucuguguuagaagcuaag

SEQ ID NO: 8004 - RNA, 20 nt, Homo sapiens
auaugcagacacauacauac

SEQ ID NO: 8005 - RNA, 22 nt, Homo sapiens
ccaguucaaugauauggaaacu

SEQ ID NO: 8006 - RNA, 22 nt, Homo sapiens
ggggaauguuaaagaauuugca

SEQ ID NO: 8007 - RNA, 22 nt, Homo sapiens
auucaaggacuggauugcggga

SEQ ID NO: 8008 - RNA, 22 nt, Homo sapiens
uugacaguugggcagggaaguu

SEQ ID NO: 8009 - RNA, 22 nt, Homo sapiens
guccaaagugggagaggugggg

SEQ ID NO: 8010 - RNA, 22 nt, Homo sapiens
gggaugauuaugguucacuaca

SEQ ID NO: 8011 - RNA, 22 nt, Homo sapiens
guggcuaaagauuuggaaucug

SEQ ID NO: 8012 - RNA, 22 nt, Homo sapiens
gcaaaugcuacaccauuuugua

SEQ ID NO: 8013 - RNA, 22 nt, Homo sapiens
acacucucucauuacuuguuug

SEQ ID NO: 8014 - RNA, 22 nt, Homo sapiens
auguaugagaguuccagcugau

SEQ ID NO: 8015 - RNA, 22 nt, Homo sapiens
aaucauggaguauuuguccuug

SEQ ID NO: 8016 - RNA, 22 nt, Homo sapiens
uuacaaguggcaucucucugga

SEQ ID NO: 8017 - RNA, 22 nt, Homo sapiens
aucacagcuacuccucugucuu

SEQ ID NO: 8018 - RNA, 22 nt, Homo sapiens
uacuguacugcaguucugcaaa

SEQ ID NO: 8019 - RNA, 22 nt, Homo sapiens
ucuugcaguucccaaauucaca

SEQ ID NO: 8020 - RNA, 22 nt, Homo sapiens
uuuggcuuaagauugacugcaa

SEQ ID NO: 8021 - RNA, 20 nt, Homo sapiens
uuuggcaauaggguuuuugu

SEQ ID NO: 8022 - RNA, 22 nt, Homo sapiens
ugacauggaaguagguauacau

SEQ ID NO: 8023 - RNA, 22 nt, Homo sapiens
uuuguacugagccaagauggua

SEQ ID NO: 8024 - RNA, 22 nt, Homo sapiens
agccgguguccacgaagaagag

SEQ ID NO: 8025 - RNA, 22 nt, Homo sapiens
ccucccuuuguugcaagggaaa

SEQ ID NO: 8026 - RNA, 21 nt, Homo sapiens
ucacugagguuaaauaggguu

SEQ ID NO: 8027 - RNA, 22 nt, Homo sapiens
gacagagcaagacccuauuuaa

SEQ ID NO: 8028 - RNA, 21 nt, Homo sapiens
ugacauguugguuugcugcac

SEQ ID NO: 8029 - RNA, 22 nt, Homo sapiens
ggaucgauuccaaauguagauc

SEQ ID NO: 8030 - RNA, 22 nt, Homo sapiens
uguaugagagugaaagcauuuc

SEQ ID NO: 8031 - RNA, 22 nt, Homo sapiens
gggaacaugagaaugugaauga

SEQ ID NO: 8032 - RNA, 22 nt, Homo sapiens
uuacuugagaugaguuggacaa

SEQ ID NO: 8033 - RNA, 22 nt, Homo sapiens
uagugguaguuauggauuugcu

SEQ ID NO: 8034 - RNA, 22 nt, Homo sapiens
auugcugagacauugcuaaucu

SEQ ID NO: 8035 - RNA, 22 nt, Homo sapiens
agcaucauguuuucgagguuca

SEQ ID NO: 8036 - RNA, 19 nt, Homo sapiens
augagucugcaagaaccag

SEQ ID NO: 8037 - RNA, 22 nt, Homo sapiens
uucugcuugaucuaguguguug

SEQ ID NO: 8038 - RNA, 22 nt, Homo sapiens
augugcaaauuuccaaacucuu

SEQ ID NO: 8039 - RNA, 22 nt, Homo sapiens
agagaucauuuuguuucaaauc

SEQ ID NO: 8040 - RNA, 22 nt, Homo sapiens
gcauggaguggaaauucuuggg

SEQ ID NO: 8041 - RNA, 22 nt, Homo sapiens
ugagaucagaaggauuucucug

SEQ ID NO: 8042 - RNA, 18 nt, Homo sapiens
accuucauuccuuugccu

SEQ ID NO: 8043 - RNA, 22 nt, Homo sapiens
cacugcacuccagccuaagagg

SEQ ID NO: 8044 - RNA, 22 nt, Homo sapiens
augaacucaucaucuagguuuu

SEQ ID NO: 8045 - RNA, 22 nt, Homo sapiens
uaugcagacauuguuccaacca

SEQ ID NO: 8046 - RNA, 20 nt, Homo sapiens
acagcauagccuuuuaaagc

SEQ ID NO: 8047 - RNA, 20 nt, Homo sapiens
ucauagggugguggcagugg

SEQ ID NO: 8048 - RNA, 22 nt, Homo sapiens
uguuagguuggugcaaaaguga

SEQ ID NO: 8049 - RNA, 22 nt, Homo sapiens
gucacuguggagaagaaagugg

SEQ ID NO: 8050 - RNA, 19 nt, Homo sapiens
uucauacagugagagcagc

SEQ ID NO: 8051 - RNA, 22 nt, Homo sapiens
uaggcagccagcuguggauuga

SEQ ID NO: 8052 - RNA, 22 nt, Homo sapiens
uugaggccugauaacacacuga

SEQ ID NO: 8053 - RNA, 22 nt, Homo sapiens
acuggacuuaaugaugaauugu

SEQ ID NO: 8054 - RNA, 22 nt, Homo sapiens
acugcacuccagccuuugcgau

SEQ ID NO: 8055 - RNA, 22 nt, Homo sapiens
caugguacugccacagaagagu

SEQ ID NO: 8056 - RNA, 22 nt, Homo sapiens
uauggcuuuuaacugucguaug

SEQ ID NO: 8057 - RNA, 22 nt, Homo sapiens
ggugagauaucugcugauguuu

SEQ ID NO: 8058 - RNA, 20 nt, Homo sapiens
acuuuuugaugaggucguuu

SEQ ID NO: 8059 - RNA, 22 nt, Homo sapiens
uuaaaaguauaggccuggcaua

SEQ ID NO: 8060 - RNA, 22 nt, Homo sapiens
agugcaguggugccaucauaac

SEQ ID NO: 8061 - RNA, 22 nt, Homo sapiens
ugagagaugaacuauucuugaa

SEQ ID NO: 8062 - RNA, 22 nt, Homo sapiens
agagugaagcuuuuuauauucu

SEQ ID NO: 8063 - RNA, 22 nt, Homo sapiens
ugagguugguauuacugucucu

SEQ ID NO: 8064 - RNA, 21 nt, Homo sapiens
gauaugacauggguaaaacca

SEQ ID NO: 8065 - RNA, 22 nt, Homo sapiens
caguuguuuuaugacauaagau

SEQ ID NO: 8066 - RNA, 22 nt, Homo sapiens
cugugcauguuguccaauucuu

SEQ ID NO: 8067 - RNA, 22 nt, Homo sapiens
augguguccuguuuccccagga

SEQ ID NO: 8068 - RNA, 22 nt, Homo sapiens
gagacggagucuugcucuguug

SEQ ID NO: 8069 - RNA, 22 nt, Homo sapiens
gagacggagucucgcucugucg

SEQ ID NO: 8070 - RNA, 22 nt, Homo sapiens
augguagacucucgggucaugg

SEQ ID NO: 8071 - RNA, 22 nt, Homo sapiens
uuugugcuaaugcuagauuacu

SEQ ID NO: 8072 - RNA, 22 nt, Homo sapiens
ugagguguuauccagaguucuu

SEQ ID NO: 8073 - RNA, 20 nt, Homo sapiens
uaaggcacugugcuuuuagg

SEQ ID NO: 8074 - RNA, 19 nt, Homo sapiens
uaucaaguaugcacuguac

SEQ ID NO: 8075 - RNA, 22 nt, Homo sapiens
ugcaaauguuauuuugguuucu

SEQ ID NO: 8076 - RNA, 21 nt, Homo sapiens
auugagcacaugaaacauggc

SEQ ID NO: 8077 - RNA, 22 nt, Homo sapiens
gguggcuuuuugugauggcuga

SEQ ID NO: 8078 - RNA, 22 nt, Homo sapiens
ugacuagcgauccccuuucuag

SEQ ID NO: 8079 - RNA, 22 nt, Homo sapiens
ggcagcgugguggauugaaaau

SEQ ID NO: 8080 - RNA, 22 nt, Homo sapiens
cucugcuuaaugucccacuuga

SEQ ID NO: 8081 - RNA, 22 nt, Homo sapiens
aaugugcacuauuagggugaua

SEQ ID NO: 8082 - RNA, 22 nt, Homo sapiens
uucaugcaucuguagugguuaa

SEQ ID NO: 8083 - RNA, 22 nt, Homo sapiens
uaugugcuuuguuaaacagaug

SEQ ID NO: 8084 - RNA, 22 nt, Homo sapiens
cugucuguuucaaaagugguua

SEQ ID NO: 8085 - RNA, 22 nt, Homo sapiens
gucauggaacaacuuaaaguca

SEQ ID NO: 8086 - RNA, 20 nt, Homo sapiens
uucagugcagguaacaaucc

SEQ ID NO: 8087 - RNA, 22 nt, Homo sapiens
caaugguuuuuuaguauaagua

SEQ ID NO: 8088 - RNA, 22 nt, Homo sapiens
uuggucaucucccuccuuuuag

SEQ ID NO: 8089 - RNA, 22 nt, Homo sapiens
gaugauguuacucuuuuuccuu

SEQ ID NO: 8090 - RNA, 22 nt, Homo sapiens
ggccagaugcgguggcucacac

SEQ ID NO: 8091 - RNA, 22 nt, Homo sapiens
aacuggucuuaugcaagcacua

SEQ ID NO: 8092 - RNA, 22 nt, Homo sapiens
cugaggugggaguuuuucucau

SEQ ID NO: 8093 - RNA, 22 nt, Homo sapiens
cuucucagugcucaucuuauuu

SEQ ID NO: 8094 - RNA, 22 nt, Homo sapiens
gucugcaugucauaugauagua

SEQ ID NO: 8095 - RNA, 22 nt, Homo sapiens
aaaugcugucugugagccucau

SEQ ID NO: 8096 - RNA, 22 nt, Homo sapiens
uucaagucaacaagcacuugag

SEQ ID NO: 8097 - RNA, 22 nt, Homo sapiens
augagcaaagagaugagacccu

SEQ ID NO: 8098 - RNA, 22 nt, Homo sapiens
uuguaguguuuauucugucaac

SEQ ID NO: 8099 - RNA, 22 nt, Homo sapiens
uuauuugguugcugacuuggaa

SEQ ID NO: 8100 - RNA, 21 nt, Homo sapiens
auggugagaaaguagugucaa

SEQ ID NO: 8101 - RNA, 22 nt, Homo sapiens
aggugcuaucugguuuuauagu

SEQ ID NO: 8102 - RNA, 20 nt, Homo sapiens
caucaccuggcaggauuugu

SEQ ID NO: 8103 - RNA, 22 nt, Homo sapiens
uugagaugaaguuuugcucuuu

SEQ ID NO: 8104 - RNA, 22 nt, Homo sapiens
uugagaugaagucuugcucucu

SEQ ID NO: 8105 - RNA, 22 nt, Homo sapiens
auacaagcaguccaacuccaua

SEQ ID NO: 8106 - RNA, 22 nt, Homo sapiens
cuggucaagagcaaaggccagg

SEQ ID NO: 8107 - RNA, 22 nt, Homo sapiens
gucauggacaguuugcuaauug

SEQ ID NO: 8108 - RNA, 22 nt, Homo sapiens
cccuagaucucagcgccuucau

SEQ ID NO: 8109 - RNA, 22 nt, Homo sapiens
ugagugaacgcugagaccaaau

SEQ ID NO: 8110 - RNA, 22 nt, Homo sapiens
auacagguauacaaugcauaau

SEQ ID NO: 8111 - RNA, 20 nt, Homo sapiens
augaaggcaggugugaguuu

SEQ ID NO: 8112 - RNA, 22 nt, Homo sapiens
gcaaggacucccugggucauuc

SEQ ID NO: 8113 - RNA, 22 nt, Homo sapiens
gcagaauugguuucuucuaagg

SEQ ID NO: 8114 - RNA, 22 nt, Homo sapiens
gacuagggaaaauuauuuuguu

SEQ ID NO: 8115 - RNA, 21 nt, Homo sapiens
ugacuacuggucucuuggguc

SEQ ID NO: 8116 - RNA, 22 nt, Homo sapiens
cuuuugugauucuucaguugcu

SEQ ID NO: 8117 - RNA, 22 nt, Homo sapiens
ucccugacagggucugagcuuu

SEQ ID NO: 8118 - RNA, 22 nt, Homo sapiens
uuugucccucucaccaacgggg

SEQ ID NO: 8119 - RNA, 22 nt, Homo sapiens
ucaugacacagcauacugacuu

SEQ ID NO: 8120 - RNA, 22 nt, Homo sapiens
uuuguacacuguugguaggauu

SEQ ID NO: 8121 - RNA, 22 nt, Homo sapiens
aagaguuaguaaaauuuccucu

SEQ ID NO: 8122 - RNA, 22 nt, Homo sapiens
agagagcuuuaacuacccauuu

SEQ ID NO: 8123 - RNA, 23 nt, Homo sapiens
ggcaagaucucagcucacugcaa

SEQ ID NO: 8124 - RNA, 22 nt, Homo sapiens
cugggcaaugcggcuggauaga

SEQ ID NO: 8125 - RNA, 20 nt, Homo sapiens
uagccggguguugugucaug

SEQ ID NO: 8126 - RNA, 22 nt, Homo sapiens
uugcacucugaagaccuacugu

SEQ ID NO: 8127 - RNA, 22 nt, Homo sapiens
cuaaagauagugacaugauuug

SEQ ID NO: 8128 - RNA, 22 nt, Homo sapiens
uuuccaguuguucuagaaagcu

SEQ ID NO: 8129 - RNA, 22 nt, Homo sapiens
uaccuaguaggugguuuuucag

SEQ ID NO: 8130 - RNA, 19 nt, Homo sapiens
gaucuguugaucaaugugu

SEQ ID NO: 8131 - RNA, 22 nt, Homo sapiens
uaauagcaguguuacuaggacu

SEQ ID NO: 8132 - RNA, 22 nt, Homo sapiens
aucuuugauuagacugauggau

SEQ ID NO: 8133 - RNA, 22 nt, Homo sapiens
uggucagaaaauuacuugauau

SEQ ID NO: 8134 - RNA, 22 nt, Homo sapiens
uggcaguuuuugccuucaauac

SEQ ID NO: 8135 - RNA, 22 nt, Homo sapiens
gugaaaugaaucuggaaauauu

SEQ ID NO: 8136 - RNA, 22 nt, Homo sapiens
ugacauugggagugaagugaag

SEQ ID NO: 8137 - RNA, 22 nt, Homo sapiens
acccaguguucagacuaccugu

SEQ ID NO: 8138 - RNA, 22 nt, Homo sapiens
ugguauggaguaauuaguaagc

SEQ ID NO: 8139 - RNA, 22 nt, Homo sapiens
uuuugguauacacaaggguccu

SEQ ID NO: 8140 - RNA, 19 nt, Homo sapiens
augagcaauaguuuuaauc

SEQ ID NO: 8141 - RNA, 22 nt, Homo sapiens
aacugcacuaggacagguuuuu

SEQ ID NO: 8142 - RNA, 22 nt, Homo sapiens
gucccugaggaacauccagggc

SEQ ID NO: 8143 - RNA, 22 nt, Homo sapiens
uuucauggaauauagucauuuu

SEQ ID NO: 8144 - RNA, 22 nt, Homo sapiens
auuugguuauucaguuguucag

SEQ ID NO: 8145 - RNA, 22 nt, Homo sapiens
guaucaucauguuggccaggcu

SEQ ID NO: 8146 - RNA, 22 nt, Homo sapiens
ggcuuuggucacacaggggcaa

SEQ ID NO: 8147 - RNA, 22 nt, Homo sapiens
auugaacaugccauauguacca

SEQ ID NO: 8148 - RNA, 22 nt, Homo sapiens
ugaccacagaaagugagggagc

SEQ ID NO: 8149 - RNA, 22 nt, Homo sapiens
uugagauggugccacuguacuc

SEQ ID NO: 8150 - RNA, 22 nt, Homo sapiens
auagugcugccauaaacauacg

SEQ ID NO: 8151 - RNA, 22 nt, Homo sapiens
ccauugcacucuggccuaggug

SEQ ID NO: 8152 - RNA, 22 nt, Homo sapiens
uuauggcaaugccccacuccua

SEQ ID NO: 8153 - RNA, 22 nt, Homo sapiens
acccuuugucaaucaguacuaa

SEQ ID NO: 8154 - RNA, 22 nt, Homo sapiens
guggcuauucaccuuuaugaaa

SEQ ID NO: 8155 - RNA, 22 nt, Homo sapiens
uuuuugguugguaggcuauuaa

SEQ ID NO: 8156 - RNA, 22 nt, Homo sapiens
ugcaccacacuccauccugggc

SEQ ID NO: 8157 - RNA, 22 nt, Homo sapiens
uaguucauuauguguugcucag

SEQ ID NO: 8158 - RNA, 22 nt, Homo sapiens
gagaucauguacuagaacaccu

SEQ ID NO: 8159 - RNA, 23 nt, Homo sapiens
uugggcaaaucacugagggcaga

SEQ ID NO: 8160 - RNA, 22 nt, Homo sapiens
ugggaucauucaaugacgaaau

SEQ ID NO: 8161 - RNA, 22 nt, Homo sapiens
gugggcaaagcuaguguguaga

SEQ ID NO: 8162 - RNA, 22 nt, Homo sapiens
uuagcagugucccacuccuugg

SEQ ID NO: 8163 - RNA, 22 nt, Homo sapiens
augaauucaucugguuuuggga

SEQ ID NO: 8164 - RNA, 22 nt, Homo sapiens
uugagugaaggcuguguucuug

SEQ ID NO: 8165 - RNA, 22 nt, Homo sapiens
gcauugcacuuggcauagacug

SEQ ID NO: 8166 - RNA, 22 nt, Homo sapiens
uggacugagauuucagcugcca

SEQ ID NO: 8167 - RNA, 22 nt, Homo sapiens
acccuguugucagaauguggau

SEQ ID NO: 8168 - RNA, 22 nt, Homo sapiens
aucccuuucugauacuuucccu

SEQ ID NO: 8169 - RNA, 22 nt, Homo sapiens
ugggaugaaaauagcuucuucc

SEQ ID NO: 8170 - RNA, 22 nt, Homo sapiens
ugagaaugacugggcaugcugc

SEQ ID NO: 8171 - RNA, 23 nt, Homo sapiens
ggaguguauuggcacgaucucag

SEQ ID NO: 8172 - RNA, 22 nt, Homo sapiens
uggaguguaaauuaguucagcc

SEQ ID NO: 8173 - RNA, 22 nt, Homo sapiens
ugucauagauugcuuggaaaaa

SEQ ID NO: 8174 - RNA, 22 nt, Homo sapiens
uuauaacucugcagccugguau

SEQ ID NO: 8175 - RNA, 20 nt, Homo sapiens
gcagcaccauauuucuaaga

SEQ ID NO: 8176 - RNA, 23 nt, Homo sapiens
ugagaucuacagaucucagaucu

SEQ ID NO: 8177 - RNA, 20 nt, Homo sapiens
gcaacauggccagagugaau

SEQ ID NO: 8178 - RNA, 22 nt, Homo sapiens
aagggaauguuguagcugguuu

SEQ ID NO: 8179 - RNA, 22 nt, Homo sapiens
gagacugagucuugcuuuguca

SEQ ID NO: 8180 - RNA, 18 nt, Homo sapiens
uguaaacuaccucaaccu

SEQ ID NO: 8181 - RNA, 18 nt, Homo sapiens
uaucauguagggaaguug

SEQ ID NO: 8182 - RNA, 22 nt, Homo sapiens
ugaagcuuguuucuguaccuuu

SEQ ID NO: 8183 - RNA, 22 nt, Homo sapiens
cuuuggccauagcuaaaugauu

SEQ ID NO: 8184 - RNA, 21 nt, Homo sapiens
uagagcaacacacgcccucuc

SEQ ID NO: 8185 - RNA, 20 nt, Homo sapiens
agagcaaagccgcaccccua

SEQ ID NO: 8186 - RNA, 22 nt, Homo sapiens
guguuauuuugcugggaaugau

SEQ ID NO: 8187 - RNA, 22 nt, Homo sapiens
caugacacuggcauguuucuuu

SEQ ID NO: 8188 - RNA, 19 nt, Homo sapiens
cucaaagugguauuuggag

SEQ ID NO: 8189 - RNA, 22 nt, Homo sapiens
auagcagaacagugucucacug

SEQ ID NO: 8190 - RNA, 22 nt, Homo sapiens
agcaucauuugauguucccgag

SEQ ID NO: 8191 - RNA, 22 nt, Homo sapiens
uggaagcauagcagcgugugug

SEQ ID NO: 8192 - RNA, 22 nt, Homo sapiens
auaggaguacaaacccuauugg

SEQ ID NO: 8193 - RNA, 22 nt, Homo sapiens
gucuggcacagggaaaguacaa

SEQ ID NO: 8194 - RNA, 22 nt, Homo sapiens
acccgugcucacugccucugcc

SEQ ID NO: 8195 - RNA, 22 nt, Homo sapiens
aaugugcacuuggagccuugcu

SEQ ID NO: 8196 - RNA, 22 nt, Homo sapiens
ugguucaguugcacaggcuguu

SEQ ID NO: 8197 - RNA, 22 nt, Homo sapiens
agcagcuuugaucugaaugauu

SEQ ID NO: 8198 - RNA, 21 nt, Homo sapiens
cuaaggaaagcuaugaacccu

SEQ ID NO: 8199 - RNA, 22 nt, Homo sapiens
cauugguuggacaguucucucu

SEQ ID NO: 8200 - RNA, 22 nt, Homo sapiens
auggccuuucuggcacauuucc

SEQ ID NO: 8201 - RNA, 22 nt, Homo sapiens
ucugucuuugucaggaccagag

SEQ ID NO: 8202 - RNA, 22 nt, Homo sapiens
uugcaacauguauucuggugau

SEQ ID NO: 8203 - RNA, 22 nt, Homo sapiens
cccugaagaaagccuaggacau

SEQ ID NO: 8204 - RNA, 22 nt, Homo sapiens
ugccaagaacauuuucuguuuu

SEQ ID NO: 8205 - RNA, 22 nt, Homo sapiens
ggagugugauucaguauaauau

SEQ ID NO: 8206 - RNA, 22 nt, Homo sapiens
gugcacaaucgugcauuccuug

SEQ ID NO: 8207 - RNA, 22 nt, Homo sapiens
uuaugcuguuuucuggagauuu

SEQ ID NO: 8208 - RNA, 22 nt, Homo sapiens
cuugguuacauuuuccuagaaa

SEQ ID NO: 8209 - RNA, 20 nt, Homo sapiens
uucaucaggauauuggucua

SEQ ID NO: 8210 - RNA, 21 nt, Homo sapiens
uguuaacaugcagauuacugg

SEQ ID NO: 8211 - RNA, 19 nt, Homo sapiens
uaggugguuuuccccucac

SEQ ID NO: 8212 - RNA, 22 nt, Homo sapiens
uaugggcuuuguuuuguacuag

SEQ ID NO: 8213 - RNA, 22 nt, Homo sapiens
ugaaagcuacagucuccuagga

SEQ ID NO: 8214 - RNA, 22 nt, Homo sapiens
auggaaaugaagggcuggcccu

SEQ ID NO: 8215 - RNA, 22 nt, Homo sapiens
caaagugcugggaugggccagg

SEQ ID NO: 8216 - RNA, 22 nt, Homo sapiens
uacugcauuccaaucugggcga

SEQ ID NO: 8217 - RNA, 22 nt, Homo sapiens
ucuggccccucccaaaucucau

SEQ ID NO: 8218 - RNA, 22 nt, Homo sapiens
agcacgauggggucacgaugag

SEQ ID NO: 8219 - RNA, 22 nt, Homo sapiens
ucccuuucuggaguuucccaag

SEQ ID NO: 8220 - RNA, 22 nt, Homo sapiens
ugugaaugaagaaugcuaaccu

SEQ ID NO: 8221 - RNA, 22 nt, Homo sapiens
cugauaguucucuuuagaguuu

SEQ ID NO: 8222 - RNA, 22 nt, Homo sapiens
ugacuagagacagaaacuaaaa

SEQ ID NO: 8223 - RNA, 22 nt, Homo sapiens
uuugacacugggagugugggug

SEQ ID NO: 8224 - RNA, 22 nt, Homo sapiens
uuugcugagucauuccaugcug

SEQ ID NO: 8225 - RNA, 19 nt, Homo sapiens
aacuggugugagaugauau

SEQ ID NO: 8226 - RNA, 22 nt, Homo sapiens
uugcagugguuucacuggcaaa

SEQ ID NO: 8227 - RNA, 22 nt, Homo sapiens
auauuguuggcugcuggcugau

SEQ ID NO: 8228 - RNA, 22 nt, Homo sapiens
auuuguccugccuuuuccuccu

SEQ ID NO: 8229 - RNA, 22 nt, Homo sapiens
uuaaauacagcaugguguuucu

SEQ ID NO: 8230 - RNA, 22 nt, Homo sapiens
ugaauacuucguucaaagauaa

SEQ ID NO: 8231 - RNA, 22 nt, Homo sapiens
acaccaugucuguuucugguuu

SEQ ID NO: 8232 - RNA, 22 nt, Homo sapiens
guuugcagaucaugaagaaccc

SEQ ID NO: 8233 - RNA, 22 nt, Homo sapiens
auaauugcaacacagggcuuug

SEQ ID NO: 8234 - RNA, 17 nt, Homo sapiens
ucaaaugcucccaguga

SEQ ID NO: 8235 - RNA, 22 nt, Homo sapiens
uauagagguagguuaauuggaa

SEQ ID NO: 8236 - RNA, 23 nt, Homo sapiens
guaguuugaugcaauccacuugu

SEQ ID NO: 8237 - RNA, 22 nt, Homo sapiens
aacaguguuuuggguuuucugg

SEQ ID NO: 8238 - RNA, 22 nt, Homo sapiens
acacaguguuuauugugguuag

SEQ ID NO: 8239 - RNA, 22 nt, Homo sapiens
ugaugaugaaugaucuuuuaca

SEQ ID NO: 8240 - RNA, 22 nt, Homo sapiens
aaguaaauauccgguaguccca

SEQ ID NO: 8241 - RNA, 22 nt, Homo sapiens
uaauacauucaaggugguaguu

SEQ ID NO: 8242 - RNA, 23 nt, Homo sapiens
uagguuauuugguaaauauaugu

SEQ ID NO: 8243 - RNA, 18 nt, Homo sapiens
aaauucugucccuucuuc

SEQ ID NO: 8244 - RNA, 22 nt, Homo sapiens
gugcaguuugaaaguagaaaca

SEQ ID NO: 8245 - RNA, 22 nt, Homo sapiens
agugaaaugucaccuuuuagga

SEQ ID NO: 8246 - RNA, 20 nt, Homo sapiens
cugcuccccuacaaaucuca

SEQ ID NO: 8247 - RNA, 22 nt, Homo sapiens
cacaguguucauagccaucagg

SEQ ID NO: 8248 - RNA, 22 nt, Homo sapiens
uauaagacuagcagcugaauug

SEQ ID NO: 8249 - RNA, 22 nt, Homo sapiens
uaaagcugaaaugauuaugaca

SEQ ID NO: 8250 - RNA, 22 nt, Homo sapiens
uuacacguaauaguaagccugg

SEQ ID NO: 8251 - RNA, 22 nt, Homo sapiens
auugaggcauguaccaaugguc

SEQ ID NO: 8252 - RNA, 22 nt, Homo sapiens
agcacauuaguaucuaagaaca

SEQ ID NO: 8253 - RNA, 22 nt, Homo sapiens
uaccuaguaggagggaggugga

SEQ ID NO: 8254 - RNA, 22 nt, Homo sapiens
ccagugucugacagacacggcg

SEQ ID NO: 8255 - RNA, 22 nt, Homo sapiens
uggacaagugcccuccaccuca

SEQ ID NO: 8256 - RNA, 22 nt, Homo sapiens
gguagacucuguaagugaucau

SEQ ID NO: 8257 - RNA, 21 nt, Homo sapiens
cuugucuugcuuagaauagac

SEQ ID NO: 8258 - RNA, 22 nt, Homo sapiens
ugucagaaucugagacgacaac

SEQ ID NO: 8259 - RNA, 22 nt, Homo sapiens
acaugcauggcaugcauuguac

SEQ ID NO: 8260 - RNA, 22 nt, Homo sapiens
cauagguugggcguuugauuuu

SEQ ID NO: 8261 - RNA, 22 nt, Homo sapiens
ugcaagcacacccagggauugu

SEQ ID NO: 8262 - RNA, 22 nt, Homo sapiens
ugguaguuucuguaucucacag

SEQ ID NO: 8263 - RNA, 22 nt, Homo sapiens
ugaggcaaggcugaaugaaggc

SEQ ID NO: 8264 - RNA, 22 nt, Homo sapiens
uugugcacauguacccuagaac

SEQ ID NO: 8265 - RNA, 22 nt, Homo sapiens
cuggucguuauuuaucuucuca

SEQ ID NO: 8266 - RNA, 21 nt, Homo sapiens
cuuaagccacuaaguuuugga

SEQ ID NO: 8267 - RNA, 22 nt, Homo sapiens
agcagcacaucccuuucuggcc

SEQ ID NO: 8268 - RNA, 22 nt, Homo sapiens
ugugaucaaccugcagggcugg

SEQ ID NO: 8269 - RNA, 17 nt, Homo sapiens
uuuaaugcuaggacucu

SEQ ID NO: 8270 - RNA, 22 nt, Homo sapiens
acaagugaauacaggauucucu

SEQ ID NO: 8271 - RNA, 22 nt, Homo sapiens
agccucauucuacauguuaaug

SEQ ID NO: 8272 - RNA, 22 nt, Homo sapiens
ucaugugagcacagagcaagau

SEQ ID NO: 8273 - RNA, 22 nt, Homo sapiens
ugacauguauaucuuacgcuau

SEQ ID NO: 8274 - RNA, 22 nt, Homo sapiens
uugcauagugcugagguucggg

SEQ ID NO: 8275 - RNA, 22 nt, Homo sapiens
auagucaaaucucauuaccccc

SEQ ID NO: 8276 - RNA, 22 nt, Homo sapiens
gucacugagcaauagaaaguuu

SEQ ID NO: 8277 - RNA, 22 nt, Homo sapiens
ggcagaauugcugaggaugcua

SEQ ID NO: 8278 - RNA, 21 nt, Homo sapiens
gagugcaaauaaagagagggc

SEQ ID NO: 8279 - RNA, 22 nt, Homo sapiens
cuugcacauuacagaucugcau

SEQ ID NO: 8280 - RNA, 22 nt, Homo sapiens
auuguucuuguguccuuuuccu

SEQ ID NO: 8281 - RNA, 22 nt, Homo sapiens
uuuccagguggccaacauuuua

SEQ ID NO: 8282 - RNA, 22 nt, Homo sapiens
cugaaucauugguuaugaguac

SEQ ID NO: 8283 - RNA, 22 nt, Homo sapiens
gaccuuguagaaucucaugauu

SEQ ID NO: 8284 - RNA, 20 nt, Homo sapiens
uuagaguaguaugauuuaua

SEQ ID NO: 8285 - RNA, 22 nt, Homo sapiens
augacugaguagcauuccauua

SEQ ID NO: 8286 - RNA, 19 nt, Homo sapiens
ucccaagaugcucauacau

SEQ ID NO: 8287 - RNA, 22 nt, Homo sapiens
uuggcauugaguuucaaaucau

SEQ ID NO: 8288 - RNA, 22 nt, Homo sapiens
uugugaagaaaccagaaaaguu

SEQ ID NO: 8289 - RNA, 20 nt, Homo sapiens
ugaaacacauggacuggggu

SEQ ID NO: 8290 - RNA, 22 nt, Homo sapiens
uggacagagagaccggcauuuu

SEQ ID NO: 8291 - RNA, 22 nt, Homo sapiens
uuugagcaugcagauugccagg

SEQ ID NO: 8292 - RNA, 22 nt, Homo sapiens
gacccucuagagggaagcgcuu

SEQ ID NO: 8293 - RNA, 22 nt, Homo sapiens
ugcauuguuuuugguucccagg

SEQ ID NO: 8294 - RNA, 22 nt, Homo sapiens
gugaacuguuugaggaagagaa

SEQ ID NO: 8295 - RNA, 22 nt, Homo sapiens
guccaguuguuuucugagguug

SEQ ID NO: 8296 - RNA, 22 nt, Homo sapiens
aauggguaguacugugguaaca

SEQ ID NO: 8297 - RNA, 22 nt, Homo sapiens
ucacauguguaaauugguguaa

SEQ ID NO: 8298 - RNA, 22 nt, Homo sapiens
guguaugguaggaugacggagu

SEQ ID NO: 8299 - RNA, 22 nt, Homo sapiens
uagauuaucuguaugugcucuu

SEQ ID NO: 8300 - RNA, 20 nt, Homo sapiens
cucagugcacccccauaaaa

SEQ ID NO: 8301 - RNA, 22 nt, Homo sapiens
gaugauguuugauaaauaauaa

SEQ ID NO: 8302 - RNA, 22 nt, Homo sapiens
uacuggguguucugagaaaaua

SEQ ID NO: 8303 - RNA, 22 nt, Homo sapiens
cauggauuuuuuugaauggcag

SEQ ID NO: 8304 - RNA, 22 nt, Homo sapiens
agucaguguguauugauggcac

SEQ ID NO: 8305 - RNA, 22 nt, Homo sapiens
ugagaccuuucauuucucagug

SEQ ID NO: 8306 - RNA, 23 nt, Homo sapiens
uuugugacacucuccaucuccag

SEQ ID NO: 8307 - RNA, 22 nt, Homo sapiens
gaguagugcugcaauaaacaua

SEQ ID NO: 8308 - RNA, 22 nt, Homo sapiens
cuuuuguggaucuucuguugcu

SEQ ID NO: 8309 - RNA, 22 nt, Homo sapiens
agcuacguuggggaaguucuca

SEQ ID NO: 8310 - RNA, 18 nt, Homo sapiens
auggcagaacaauuuaca

SEQ ID NO: 8311 - RNA, 22 nt, Homo sapiens
cuaauacguaguauauccauga

SEQ ID NO: 8312 - RNA, 22 nt, Homo sapiens
uuagugaaugggugugauuugu

SEQ ID NO: 8313 - RNA, 22 nt, Homo sapiens
uuaugacuuucagcuaggggau

SEQ ID NO: 8314 - RNA, 22 nt, Homo sapiens
gcagugacaugugccaguuuau

SEQ ID NO: 8315 - RNA, 22 nt, Homo sapiens
gaauggaacugacuauagcuga

SEQ ID NO: 8316 - RNA, 22 nt, Homo sapiens
auugaacacagaguagcuuucc

SEQ ID NO: 8317 - RNA, 23 nt, Homo sapiens
gugcaugagucuuuauaguagca

SEQ ID NO: 8318 - RNA, 22 nt, Homo sapiens
caaaugcuucuauggacugucu

SEQ ID NO: 8319 - RNA, 22 nt, Homo sapiens
acccuguaacauacaagugguu

SEQ ID NO: 8320 - RNA, 22 nt, Homo sapiens
cuggguacccuuuaaacaggaa

SEQ ID NO: 8321 - RNA, 22 nt, Homo sapiens
uugagaucugugcuuuugcguu

SEQ ID NO: 8322 - RNA, 22 nt, Homo sapiens
gagguagguacaauugccacca

SEQ ID NO: 8323 - RNA, 22 nt, Homo sapiens
gugcaaauuccagcucaacucc

SEQ ID NO: 8324 - RNA, 22 nt, Homo sapiens
ucuguguuuagacccaggguag

SEQ ID NO: 8325 - RNA, 22 nt, Homo sapiens
ggucaguuuucuccaggaucca

SEQ ID NO: 8326 - RNA, 22 nt, Homo sapiens
uaaugcauacagaagguguuuu

SEQ ID NO: 8327 - RNA, 22 nt, Homo sapiens
agagugcaauggcaccaucucg

SEQ ID NO: 8328 - RNA, 22 nt, Homo sapiens
gagauauuauuucccuuucaca

SEQ ID NO: 8329 - RNA, 22 nt, Homo sapiens
aacagugcuucauucacacauu

SEQ ID NO: 8330 - RNA, 22 nt, Homo sapiens
caaguacugggcuauggauauu

SEQ ID NO: 8331 - RNA, 22 nt, Homo sapiens
guaaccuauaguuaccaauagu

SEQ ID NO: 8332 - RNA, 22 nt, Homo sapiens
aucagaguggguuuuaaaagug

SEQ ID NO: 8333 - RNA, 22 nt, Homo sapiens
ucuuugccuaacccaaggucau

SEQ ID NO: 8334 - RNA, 22 nt, Homo sapiens
gagguguagucaugccaagauc

SEQ ID NO: 8335 - RNA, 22 nt, Homo sapiens
cugccuagauguuguagggggu

SEQ ID NO: 8336 - RNA, 22 nt, Homo sapiens
agcaccaugggcugaguaagug

SEQ ID NO: 8337 - RNA, 22 nt, Homo sapiens
acuuaguauggggcuuuugaga

SEQ ID NO: 8338 - RNA, 19 nt, Homo sapiens
uggcacauguauacauaug

SEQ ID NO: 8339 - RNA, 22 nt, Homo sapiens
auuggcuuuauacauaagaaua

SEQ ID NO: 8340 - RNA, 17 nt, Homo sapiens
augaacucaucauuuuu

SEQ ID NO: 8341 - RNA, 22 nt, Homo sapiens
accccguagagucugcagcuac

SEQ ID NO: 8342 - RNA, 22 nt, Homo sapiens
ugugacagcacgguucaacugc

SEQ ID NO: 8343 - RNA, 22 nt, Homo sapiens
uggcauaugguauuugauaucu

SEQ ID NO: 8344 - RNA, 22 nt, Homo sapiens
cuugcacuguuguaagggacuu

SEQ ID NO: 8345 - RNA, 22 nt, Homo sapiens
gagacugagucucacucuguca

SEQ ID NO: 8346 - RNA, 22 nt, Homo sapiens
guaccuguauguucauuucaca

SEQ ID NO: 8347 - RNA, 22 nt, Homo sapiens
ucugacagugugaauauugacu

SEQ ID NO: 8348 - RNA, 22 nt, Homo sapiens
ugucaaagagacaucugcacuc

SEQ ID NO: 8349 - RNA, 22 nt, Homo sapiens
uuuggcuuugagaagcagugga

SEQ ID NO: 8350 - RNA, 22 nt, Homo sapiens
acgagguuaggaguuaaaggcu

SEQ ID NO: 8351 - RNA, 22 nt, Homo sapiens
ugaauguacacgcguacuuguu

SEQ ID NO: 8352 - RNA, 22 nt, Homo sapiens
uugugccugguacauggagaaa

SEQ ID NO: 8353 - RNA, 22 nt, Homo sapiens
guauugacauuuuuaaggaacu

SEQ ID NO: 8354 - RNA, 22 nt, Homo sapiens
uggccuguaacccucucauagg

SEQ ID NO: 8355 - RNA, 23 nt, Homo sapiens
aggaaguaacuaucuuuucuguc

SEQ ID NO: 8356 - RNA, 22 nt, Homo sapiens
ugagaacuaaugaagaauuuau

SEQ ID NO: 8357 - RNA, 20 nt, Homo sapiens
uggaaauuaaccuuucaggu

SEQ ID NO: 8358 - RNA, 22 nt, Homo sapiens
ugucaguuucccuccucuuccu

SEQ ID NO: 8359 - RNA, 22 nt, Homo sapiens
auggaagcauaguauucuauug

SEQ ID NO: 8360 - RNA, 22 nt, Homo sapiens
ugugaaacauggauagaacugg

SEQ ID NO: 8361 - RNA, 22 nt, Homo sapiens
uggaaguaaucaugagguagca

SEQ ID NO: 8362 - RNA, 22 nt, Homo sapiens
uggcuuucuggggcuucuguuc

SEQ ID NO: 8363 - RNA, 22 nt, Homo sapiens
uuaggagacuggauaucucuuu

SEQ ID NO: 8364 - RNA, 22 nt, Homo sapiens
uugucaacaugaaacuguguuu

SEQ ID NO: 8365 - RNA, 20 nt, Homo sapiens
gugugcauuucagauuuugg

SEQ ID NO: 8366 - RNA, 22 nt, Homo sapiens
aauaaagcauggcuacuccaua

SEQ ID NO: 8367 - RNA, 23 nt, Homo sapiens
uguaaagcuaugaauuauucuuu

SEQ ID NO: 8368 - RNA, 22 nt, Homo sapiens
aggaagacauauagaacuaaaa

SEQ ID NO: 8369 - RNA, 21 nt, Homo sapiens
uggcaacgaggugugcauuau

SEQ ID NO: 8370 - RNA, 19 nt, Homo sapiens
cuuugguugagcguguugg

SEQ ID NO: 8371 - RNA, 22 nt, Homo sapiens
uugcacuccagcucgggugaca

SEQ ID NO: 8372 - RNA, 22 nt, Homo sapiens
ucuuuugggccucuugucagac

SEQ ID NO: 8373 - RNA, 18 nt, Homo sapiens
ugauaucaucacaauuga

SEQ ID NO: 8374 - RNA, 22 nt, Homo sapiens
ugaugacacugauuucuucaau

SEQ ID NO: 8375 - RNA, 22 nt, Homo sapiens
uuugguugcauucacauauuuc

SEQ ID NO: 8376 - RNA, 22 nt, Homo sapiens
gauguagaaagagugggcugga

SEQ ID NO: 8377 - RNA, 22 nt, Homo sapiens
agcaccaauaacaguuucuagc

SEQ ID NO: 8378 - RNA, 22 nt, Homo sapiens
uguucuggagaggcaggccaca

SEQ ID NO: 8379 - RNA, 22 nt, Homo sapiens
gugauacugcuuauuaauuuaa

SEQ ID NO: 8380 - RNA, 22 nt, Homo sapiens
aagcuuucaacuguuugccauu

SEQ ID NO: 8381 - RNA, 22 nt, Homo sapiens
aggcuguguggauaauauuggg

SEQ ID NO: 8382 - RNA, 22 nt, Homo sapiens
uagauucaucuguuccuuuuga

SEQ ID NO: 8383 - RNA, 22 nt, Homo sapiens
aacccugacacaagcagaauuu

SEQ ID NO: 8384 - RNA, 22 nt, Homo sapiens
gagaucaguuaaugaagugagc

SEQ ID NO: 8385 - RNA, 22 nt, Homo sapiens
agaaagugcuucccuuugguga

SEQ ID NO: 8386 - RNA, 22 nt, Homo sapiens
guggaauacuaugaugguggau

SEQ ID NO: 8387 - RNA, 22 nt, Homo sapiens
cugaaaguuauucaggggcaag

SEQ ID NO: 8388 - RNA, 19 nt, Homo sapiens
caacccugcagagaaagga

SEQ ID NO: 8389 - RNA, 22 nt, Homo sapiens
uaaggcccauucuaugaagcag

SEQ ID NO: 8390 - RNA, 22 nt, Homo sapiens
aucacuguaaguuuacacuuug

SEQ ID NO: 8391 - RNA, 22 nt, Homo sapiens
auggcaauaugaugcacuguuu

SEQ ID NO: 8392 - RNA, 22 nt, Homo sapiens
auagccuguaggccuuaaggug

SEQ ID NO: 8393 - RNA, 22 nt, Homo sapiens
gauaugugauaagaguuaucuu

SEQ ID NO: 8394 - RNA, 22 nt, Homo sapiens
uggguaaaucuguuuggggcuc

SEQ ID NO: 8395 - RNA, 22 nt, Homo sapiens
uuguacccuuucuaugaggcca

SEQ ID NO: 8396 - RNA, 20 nt, Homo sapiens
ggaauagucuacacucugac

SEQ ID NO: 8397 - RNA, 19 nt, Homo sapiens
augcaaugucacaggcugc

SEQ ID NO: 8398 - RNA, 22 nt, Homo sapiens
gagauucaucuagguccagaga

SEQ ID NO: 8399 - RNA, 22 nt, Homo sapiens
ugaguaguauucuaugguaugu

SEQ ID NO: 8400 - RNA, 22 nt, Homo sapiens
aauacugagaugugagguacua

SEQ ID NO: 8401 - RNA, 20 nt, Homo sapiens
ucuuucgguuaccaggcagu

SEQ ID NO: 8402 - RNA, 22 nt, Homo sapiens
ugaguagcuaagacgauaggca

SEQ ID NO: 8403 - RNA, 22 nt, Homo sapiens
ggaguaggaaggaaauguuaaa

SEQ ID NO: 8404 - RNA, 22 nt, Homo sapiens
uuaguaguagugcuguaauuuu

SEQ ID NO: 8405 - RNA, 22 nt, Homo sapiens
aaugccacugugccugccaagg

SEQ ID NO: 8406 - RNA, 22 nt, Homo sapiens
uuccuuguagcaaaugcgauga

SEQ ID NO: 8407 - RNA, 22 nt, Homo sapiens
ccaguguuuggauuagggaugc

SEQ ID NO: 8408 - RNA, 22 nt, Homo sapiens
aaggcaagauacugguugcuga

SEQ ID NO: 8409 - RNA, 22 nt, Homo sapiens
agagguuuugcacugguucuuu

SEQ ID NO: 8410 - RNA, 18 nt, Homo sapiens
gacaguguggugauuccu

SEQ ID NO: 8411 - RNA, 20 nt, Homo sapiens
uuaaaucuagugcagacuca

SEQ ID NO: 8412 - RNA, 22 nt, Homo sapiens
uucagcaguggccaguggaaau

SEQ ID NO: 8413 - RNA, 20 nt, Homo sapiens
ugcaaguugccuuuggaggc

SEQ ID NO: 8414 - RNA, 22 nt, Homo sapiens
guagugcaguuugagaaucagu

SEQ ID NO: 8415 - RNA, 22 nt, Homo sapiens
aucacacucaccuucuguccuu

SEQ ID NO: 8416 - RNA, 19 nt, Homo sapiens
uacaggacugagcugaggu

SEQ ID NO: 8417 - RNA, 22 nt, Homo sapiens
uaacagucaagguuugaccagg

SEQ ID NO: 8418 - RNA, 20 nt, Homo sapiens
uuaagugcuuucugcuuaga

SEQ ID NO: 8419 - RNA, 22 nt, Homo sapiens
cgugaggaguauuuuuaggugc

SEQ ID NO: 8420 - RNA, 22 nt, Homo sapiens
gacuggcuguuuucuuuauuau

SEQ ID NO: 8421 - RNA, 19 nt, Homo sapiens
ucacacuguggcuucuuua

SEQ ID NO: 8422 - RNA, 22 nt, Homo sapiens
ucacuuggugaacacauuaugu

SEQ ID NO: 8423 - RNA, 21 nt, Homo sapiens
ugaauauuuggguugugucca

SEQ ID NO: 8424 - RNA, 22 nt, Homo sapiens
augugcacaugcuuacauguga

SEQ ID NO: 8425 - RNA, 22 nt, Homo sapiens
ugccuagagagaaccauaacug

SEQ ID NO: 8426 - RNA, 22 nt, Homo sapiens
aauaucacaggguguacacuca

SEQ ID NO: 8427 - RNA, 22 nt, Homo sapiens
uuacauaguguguggguucggg

SEQ ID NO: 8428 - RNA, 22 nt, Homo sapiens
uaugagagcugguagguagaga

SEQ ID NO: 8429 - RNA, 23 nt, Homo sapiens
agugccuaguauauaggaggcgc

SEQ ID NO: 8430 - RNA, 22 nt, Homo sapiens
uuugucuccuaagacucugugg

SEQ ID NO: 8431 - RNA, 22 nt, Homo sapiens
cuuugcaaaacauugagaccuc

SEQ ID NO: 8432 - RNA, 22 nt, Homo sapiens
gagacucuuagauuggaaaucu

SEQ ID NO: 8433 - RNA, 22 nt, Homo sapiens
cugacugaggaucaguucauca

SEQ ID NO: 8434 - RNA, 22 nt, Homo sapiens
gcaagauguuaccauuagggaa

SEQ ID NO: 8435 - RNA, 20 nt, Homo sapiens
augaauguccuugauggcau

SEQ ID NO: 8436 - RNA, 22 nt, Homo sapiens
cagcucuuguuaaaacuaacua

SEQ ID NO: 8437 - RNA, 22 nt, Homo sapiens
ucaguggauuauuaaagucacc

SEQ ID NO: 8438 - RNA, 22 nt, Homo sapiens
auuggguuaaaggauaugaaca

SEQ ID NO: 8439 - RNA, 22 nt, Homo sapiens
ugggcaguauggucauuuucgu

SEQ ID NO: 8440 - RNA, 21 nt, Homo sapiens
uuguccccacccaaaucucau

SEQ ID NO: 8441 - RNA, 22 nt, Homo sapiens
uugaaggaacgcuguucccuug

SEQ ID NO: 8442 - RNA, 22 nt, Homo sapiens
uaugugcaaauuaauugcuaga

SEQ ID NO: 8443 - RNA, 20 nt, Homo sapiens
uucccucagccuugagggua

SEQ ID NO: 8444 - RNA, 19 nt, Homo sapiens
uugagaugugaacucacac

SEQ ID NO: 8445 - RNA, 22 nt, Homo sapiens
uggacagacaagguuauagauc

SEQ ID NO: 8446 - RNA, 22 nt, Homo sapiens
uugcacugagauuuugcuuaca

SEQ ID NO: 8447 - RNA, 22 nt, Homo sapiens
ugucauggcauuuguaaacugc

SEQ ID NO: 8448 - RNA, 22 nt, Homo sapiens
uguacaaaacaagaugggggua

SEQ ID NO: 8449 - RNA, 21 nt, Homo sapiens
agagucaucucuaucuguacc

SEQ ID NO: 8450 - RNA, 22 nt, Homo sapiens
cauugcaacuucugccucccag

SEQ ID NO: 8451 - RNA, 22 nt, Homo sapiens
ugccaaaaugggcuuuauaccg

SEQ ID NO: 8452 - RNA, 22 nt, Homo sapiens
auagcuguugaauggaauauuc

SEQ ID NO: 8453 - RNA, 22 nt, Homo sapiens
uuuuggcuagaaauauaccucc

SEQ ID NO: 8454 - RNA, 22 nt, Homo sapiens
uaucugcacauacacuuauagc

SEQ ID NO: 8455 - RNA, 22 nt, Homo sapiens
gccuaguguuaauguguguuca

SEQ ID NO: 8456 - RNA, 22 nt, Homo sapiens
augacauugaugcucuggcugg

SEQ ID NO: 8457 - RNA, 22 nt, Homo sapiens
ucacaugggugcaauauaauca

SEQ ID NO: 8458 - RNA, 22 nt, Homo sapiens
uugugcuuuugagcugagauga

SEQ ID NO: 8459 - RNA, 20 nt, Homo sapiens
ugacaaggugcaaagaauca

SEQ ID NO: 8460 - RNA, 22 nt, Homo sapiens
ugacuaaaacugaguuucauua

SEQ ID NO: 8461 - RNA, 22 nt, Homo sapiens
agucagugcauaagaaugaagu

SEQ ID NO: 8462 - RNA, 22 nt, Homo sapiens
augaguuccuuccuugccuagg

SEQ ID NO: 8463 - RNA, 18 nt, Homo sapiens
gggcaaguugccuggcuu

SEQ ID NO: 8464 - RNA, 22 nt, Homo sapiens
guaaucucaccuacuugggagg

SEQ ID NO: 8465 - RNA, 22 nt, Homo sapiens
auuugucaauacacuucuucca

SEQ ID NO: 8466 - RNA, 20 nt, Homo sapiens
auagcaccagacagcccuag

SEQ ID NO: 8467 - RNA, 22 nt, Homo sapiens
ucaagcaauucugcugccucag

SEQ ID NO: 8468 - RNA, 22 nt, Homo sapiens
ugcauggagcucucuuuggacu

SEQ ID NO: 8469 - RNA, 22 nt, Homo sapiens
cuagaguacuuaccacagcaug

SEQ ID NO: 8470 - RNA, 22 nt, Homo sapiens
gcaugaugaauaauaucacaag

SEQ ID NO: 8471 - RNA, 22 nt, Homo sapiens
acccggagagcaggcgagaagg

SEQ ID NO: 8472 - RNA, 22 nt, Homo sapiens
ugaacacaucuccugguaccug

SEQ ID NO: 8473 - RNA, 22 nt, Homo sapiens
ugaacucauccuuucuuauggc

SEQ ID NO: 8474 - RNA, 22 nt, Homo sapiens
ggccugaugaaauguuagagua

SEQ ID NO: 8475 - RNA, 22 nt, Homo sapiens
ugugaauggugcuuccuagaug

SEQ ID NO: 8476 - RNA, 22 nt, Homo sapiens
ugaguauguuuaaugugacaau

SEQ ID NO: 8477 - RNA, 20 nt, Homo sapiens
cauuacacuccaaccugggu

SEQ ID NO: 8478 - RNA, 22 nt, Homo sapiens
uugauguccaucucuagguaaa

SEQ ID NO: 8479 - RNA, 22 nt, Homo sapiens
ucuguguuugguuggcaauuuc

SEQ ID NO: 8480 - RNA, 22 nt, Homo sapiens
uuaagugguagguggugcccaa

SEQ ID NO: 8481 - RNA, 22 nt, Homo sapiens
agcuucauuccaacuuccuucu

SEQ ID NO: 8482 - RNA, 22 nt, Homo sapiens
uugcacuauaggaaaauguguc

SEQ ID NO: 8483 - RNA, 22 nt, Homo sapiens
ucugugcauuguaggauguuua

SEQ ID NO: 8484 - RNA, 22 nt, Homo sapiens
uucaguaaauguucuuacuaua

SEQ ID NO: 8485 - RNA, 22 nt, Homo sapiens
auggagugagaauggagguucc

SEQ ID NO: 8486 - RNA, 23 nt, Homo sapiens
ucacacuuaagagaaaugcagcu

SEQ ID NO: 8487 - RNA, 22 nt, Homo sapiens
guaaguagcuuuagauauaaau

SEQ ID NO: 8488 - RNA, 22 nt, Homo sapiens
uucccuuuguuaaauuggaaga

SEQ ID NO: 8489 - RNA, 22 nt, Homo sapiens
uuaccacagugccugucuaaug

SEQ ID NO: 8490 - RNA, 22 nt, Homo sapiens
uugggguaggaauauggaauga

SEQ ID NO: 8491 - RNA, 22 nt, Homo sapiens
uuggucugcucugauguuuucu

SEQ ID NO: 8492 - RNA, 22 nt, Homo sapiens
ugauagucuuugcuggugaccu

SEQ ID NO: 8493 - RNA, 19 nt, Homo sapiens
gcaguauugaaggccaguc

SEQ ID NO: 8494 - RNA, 22 nt, Homo sapiens
gugagauggaguuggugucuuu

SEQ ID NO: 8495 - RNA, 22 nt, Homo sapiens
auugaggcaggaggaccaucua

SEQ ID NO: 8496 - RNA, 22 nt, Homo sapiens
gagccggugugauggggcuucu

SEQ ID NO: 8497 - RNA, 22 nt, Homo sapiens
acacuguuggugggaguguaaa

SEQ ID NO: 8498 - RNA, 22 nt, Homo sapiens
cacccuuguaggcaaauaauuu

SEQ ID NO: 8499 - RNA, 22 nt, Homo sapiens
uuaaggccccgcccauucaggc

SEQ ID NO: 8500 - RNA, 21 nt, Homo sapiens
auggacugugugacccugcac

SEQ ID NO: 8501 - RNA, 22 nt, Homo sapiens
aaaugcaucauuaggugauuuu

SEQ ID NO: 8502 - RNA, 22 nt, Homo sapiens
ccuggaucauugucauucccaa

SEQ ID NO: 8503 - RNA, 22 nt, Homo sapiens
gugucucagcccagaccuauuu

SEQ ID NO: 8504 - RNA, 22 nt, Homo sapiens
ggauuagagauguuauuaagag

SEQ ID NO: 8505 - RNA, 22 nt, Homo sapiens
agggcuuguuuaacuaucauua

SEQ ID NO: 8506 - RNA, 22 nt, Homo sapiens
ugagaagugauauagaaguuaa

SEQ ID NO: 8507 - RNA, 22 nt, Homo sapiens
agucacagccuuuuacuuuaga

SEQ ID NO: 8508 - RNA, 22 nt, Homo sapiens
guucaucaggaauauuggccua

SEQ ID NO: 8509 - RNA, 22 nt, Homo sapiens
auaaagccaugagcuugagaug

SEQ ID NO: 8510 - RNA, 22 nt, Homo sapiens
uaugugcacaugcccuggugac

SEQ ID NO: 8511 - RNA, 22 nt, Homo sapiens
auugauaguuuaauaggaauug

SEQ ID NO: 8512 - RNA, 22 nt, Homo sapiens
ucucacagccauuucucccucu

SEQ ID NO: 8513 - RNA, 22 nt, Homo sapiens
uauugcuugaggaaaugguaau

SEQ ID NO: 8514 - RNA, 22 nt, Homo sapiens
uggcauuguccaauaaaauuuu

SEQ ID NO: 8515 - RNA, 22 nt, Homo sapiens
aaauugcauugagcugcuuauu

SEQ ID NO: 8516 - RNA, 22 nt, Homo sapiens
cugaaagagcauguaacacagu

SEQ ID NO: 8517 - RNA, 22 nt, Homo sapiens
gugagguugaaaauaauggaaa

SEQ ID NO: 8518 - RNA, 22 nt, Homo sapiens
uuugugacacaaacacauauau

SEQ ID NO: 8519 - RNA, 19 nt, Homo sapiens
acagcugguuuugguuucu

SEQ ID NO: 8520 - RNA, 22 nt, Homo sapiens
aagauauguuaguuauaaacuc

SEQ ID NO: 8521 - RNA, 22 nt, Homo sapiens
ccaguuuuucauuuauacuagu

SEQ ID NO: 8522 - RNA, 22 nt, Homo sapiens
guucaucagggauacuggccug

SEQ ID NO: 8523 - RNA, 22 nt, Homo sapiens
uccuuuggucaguauucuuuug

SEQ ID NO: 8524 - RNA, 22 nt, Homo sapiens
ucaccaguaauaaagagccugc

SEQ ID NO: 8525 - RNA, 22 nt, Homo sapiens
cuuccagcuggguucagucagu

SEQ ID NO: 8526 - RNA, 19 nt, Homo sapiens
ccaguguugccagagcuga

SEQ ID NO: 8527 - RNA, 22 nt, Homo sapiens
aacugguauuucccaugaauuu

SEQ ID NO: 8528 - RNA, 22 nt, Homo sapiens
ucuggcuuucuuuacuuaaugu

SEQ ID NO: 8529 - RNA, 18 nt, Homo sapiens
auaaacucaucauuuuua

SEQ ID NO: 8530 - RNA, 22 nt, Homo sapiens
guggcgagaucauagcucauug

SEQ ID NO: 8531 - RNA, 18 nt, Homo sapiens
ugacaaugcuaguccugg

SEQ ID NO: 8532 - RNA, 22 nt, Homo sapiens
uucauccccuccaaaucucaug

SEQ ID NO: 8533 - RNA, 22 nt, Homo sapiens
gauauguugaguagaguuuuug

SEQ ID NO: 8534 - RNA, 22 nt, Homo sapiens
uauugcuuuacucucuuauccu

SEQ ID NO: 8535 - RNA, 21 nt, Homo sapiens
uuacaguugguugugaggugg

SEQ ID NO: 8536 - RNA, 20 nt, Homo sapiens
uggaccagagagguggggac

SEQ ID NO: 8537 - RNA, 22 nt, Homo sapiens
aaaugcagcacucaagugggaa

SEQ ID NO: 8538 - RNA, 22 nt, Homo sapiens
aauaaugucacaggggguuagc

SEQ ID NO: 8539 - RNA, 22 nt, Homo sapiens
uugugguagugaaugagucuca

SEQ ID NO: 8540 - RNA, 22 nt, Homo sapiens
ugucucaguuucuguggguuag

SEQ ID NO: 8541 - RNA, 22 nt, Homo sapiens
ucaguagagacaggauuucacc

SEQ ID NO: 8542 - RNA, 22 nt, Homo sapiens
ccaguauuuuauugaggguuuu

SEQ ID NO: 8543 - RNA, 21 nt, Homo sapiens
gugugcuugagugaugggauu

SEQ ID NO: 8544 - RNA, 22 nt, Homo sapiens
augcuuguugcagccugagccu

SEQ ID NO: 8545 - RNA, 22 nt, Homo sapiens
gcagcauuaccaagacauggca

SEQ ID NO: 8546 - RNA, 22 nt, Homo sapiens
ugugaugugaugagaaguuccu

SEQ ID NO: 8547 - RNA, 22 nt, Homo sapiens
uucauagugaaaaauucaaagu

SEQ ID NO: 8548 - RNA, 21 nt, Homo sapiens
ggaguauaaggcaaaggagug

SEQ ID NO: 8549 - RNA, 22 nt, Homo sapiens
uccaaguaauuggcggggaguu

SEQ ID NO: 8550 - RNA, 21 nt, Homo sapiens
uggcuguuuucaugcuagaac

SEQ ID NO: 8551 - RNA, 22 nt, Homo sapiens
ucauuagagaucuuggggaaaa

SEQ ID NO: 8552 - RNA, 22 nt, Homo sapiens
caaaagugguucuuauccuuuu

SEQ ID NO: 8553 - RNA, 22 nt, Homo sapiens
gugcaacaucccuccauaauuu

SEQ ID NO: 8554 - RNA, 22 nt, Homo sapiens
aaaugcacagaaaggaugugga

SEQ ID NO: 8555 - RNA, 22 nt, Homo sapiens
ugaguagugcugcaauaaacau

SEQ ID NO: 8556 - RNA, 22 nt, Homo sapiens
guacaguggguguagggaccag

SEQ ID NO: 8557 - RNA, 22 nt, Homo sapiens
uacaggugcuuauguggacaua

SEQ ID NO: 8558 - RNA, 22 nt, Homo sapiens
uagcagcauaaauggacuaaga

SEQ ID NO: 8559 - RNA, 22 nt, Homo sapiens
cuauuugcauucagaggcaugu

SEQ ID NO: 8560 - RNA, 22 nt, Homo sapiens
gcuaggagauccacugcucucu

SEQ ID NO: 8561 - RNA, 22 nt, Homo sapiens
uuacugcuagcugugugcucuu

SEQ ID NO: 8562 - RNA, 22 nt, Homo sapiens
acugcacuccagccugugagac

SEQ ID NO: 8563 - RNA, 22 nt, Homo sapiens
aucacagaguuaaaacuuucuu

SEQ ID NO: 8564 - RNA, 22 nt, Homo sapiens
auagugcugcaauaaacauacg

SEQ ID NO: 8565 - RNA, 22 nt, Homo sapiens
auagugcugcaaugaacauaca

SEQ ID NO: 8566 - RNA, 22 nt, Homo sapiens
guagaugcauggauuuacuucu

SEQ ID NO: 8567 - RNA, 22 nt, Homo sapiens
ugcuauguuuucccuccuuauc

SEQ ID NO: 8568 - RNA, 22 nt, Homo sapiens
ugugcauaugucuuuauaguag

SEQ ID NO: 8569 - RNA, 22 nt, Homo sapiens
agggcaagacuuguuaagaaca

SEQ ID NO: 8570 - RNA, 22 nt, Homo sapiens
uuggagagucacuaguuagugc

SEQ ID NO: 8571 - RNA, 21 nt, Homo sapiens
uuagcauccauguucaucaac

SEQ ID NO: 8572 - RNA, 22 nt, Homo sapiens
ugccuggagagcuccuacauau

SEQ ID NO: 8573 - RNA, 22 nt, Homo sapiens
uaaguaauugcagcaauuugcc

SEQ ID NO: 8574 - RNA, 22 nt, Homo sapiens
gcugucaugagcaacacaugaa

SEQ ID NO: 8575 - RNA, 22 nt, Homo sapiens
uggaagccuagauucuuuucuu

SEQ ID NO: 8576 - RNA, 18 nt, Homo sapiens
uucauaguagcaugauuu

SEQ ID NO: 8577 - RNA, 22 nt, Homo sapiens
aauggagcugaguggccuuggg

SEQ ID NO: 8578 - RNA, 22 nt, Homo sapiens
uuugugaggugauggauauguc

SEQ ID NO: 8579 - RNA, 22 nt, Homo sapiens
uagcagcaccccacucuacugg

SEQ ID NO: 8580 - RNA, 22 nt, Homo sapiens
agcagugugaaaugauuuaagg

SEQ ID NO: 8581 - RNA, 22 nt, Homo sapiens
uuaaggccugaagcucauaaag

SEQ ID NO: 8582 - RNA, 22 nt, Homo sapiens
uguauguugauguuauauucug

SEQ ID NO: 8583 - RNA, 22 nt, Homo sapiens
uugugaaugaugucgcaguaaa

SEQ ID NO: 8584 - RNA, 22 nt, Homo sapiens
cugcaagaaucguaguauuuga

SEQ ID NO: 8585 - RNA, 22 nt, Homo sapiens
cauggcacugagcagguaugca

SEQ ID NO: 8586 - RNA, 22 nt, Homo sapiens
agguuguugcaugcuccuuagg

SEQ ID NO: 8587 - RNA, 19 nt, Homo sapiens
ggcaauacuuucuuguugg

SEQ ID NO: 8588 - RNA, 22 nt, Homo sapiens
cuugagacauuguuuuccaagu

SEQ ID NO: 8589 - RNA, 22 nt, Homo sapiens
ggugauguuugaguugagacag

SEQ ID NO: 8590 - RNA, 22 nt, Homo sapiens
guacaggcagcaaacaccauaa

SEQ ID NO: 8591 - RNA, 22 nt, Homo sapiens
uugaauagcauguuuagugcau

SEQ ID NO: 8592 - RNA, 22 nt, Homo sapiens
ugucaucuagguuuuaagccuu

SEQ ID NO: 8593 - RNA, 22 nt, Homo sapiens
gccuagagacuugguaucuugc

SEQ ID NO: 8594 - RNA, 21 nt, Homo sapiens
uagcugcacccaggccuccuu

SEQ ID NO: 8595 - RNA, 22 nt, Homo sapiens
uugcaaagaccucuucacuucc

SEQ ID NO: 8596 - RNA, 18 nt, Homo sapiens
augagucauuguggaaau

SEQ ID NO: 8597 - RNA, 16 nt, Homo sapiens
gcucuuguucucuguu

SEQ ID NO: 8598 - RNA, 22 nt, Homo sapiens
uggcaaauagcaauaggagggu

SEQ ID NO: 8599 - RNA, 22 nt, Homo sapiens
cugucacaguuuuggaggccag

SEQ ID NO: 8600 - RNA, 22 nt, Homo sapiens
cucccacccucauuuuuaggca

SEQ ID NO: 8601 - RNA, 22 nt, Homo sapiens
auauguauuuuaacguguaagg

SEQ ID NO: 8602 - RNA, 23 nt, Homo sapiens
uggaagacuccucucuuggcugc

SEQ ID NO: 8603 - RNA, 22 nt, Homo sapiens
ggcaagaaagaaaucaucuguc

SEQ ID NO: 8604 - RNA, 22 nt, Homo sapiens
guggugucuuuuuugauuagga

SEQ ID NO: 8605 - RNA, 22 nt, Homo sapiens
gcaguguucaaaucaugcccau

SEQ ID NO: 8606 - RNA, 22 nt, Homo sapiens
agcugccagucuuguaaggccu

SEQ ID NO: 8607 - RNA, 22 nt, Homo sapiens
ucacuggccaaauucuggguga

SEQ ID NO: 8608 - RNA, 22 nt, Homo sapiens
aaucuguagaaggugcacauuc

SEQ ID NO: 8609 - RNA, 22 nt, Homo sapiens
auauaugcacacgugugcauau

SEQ ID NO: 8610 - RNA, 22 nt, Homo sapiens
ugaugaaguauaggaagggcuu

SEQ ID NO: 8611 - RNA, 22 nt, Homo sapiens
augaccuuggggaaccaugucu

SEQ ID NO: 8612 - RNA, 22 nt, Homo sapiens
uauagcagugugagaacagacu

SEQ ID NO: 8613 - RNA, 22 nt, Homo sapiens
agucacaugccagcacacccag

SEQ ID NO: 8614 - RNA, 17 nt, Homo sapiens
uuguucccauuaaaaag

SEQ ID NO: 8615 - RNA, 22 nt, Homo sapiens
ucagguugcuaaguauaauauu

SEQ ID NO: 8616 - RNA, 22 nt, Homo sapiens
agcuaguauuuuguuaaggauu

SEQ ID NO: 8617 - RNA, 22 nt, Homo sapiens
gaaucacugugguaucccaugc

SEQ ID NO: 8618 - RNA, 22 nt, Homo sapiens
gaaaugcucagggguuuuccag

SEQ ID NO: 8619 - RNA, 22 nt, Homo sapiens
gaagugcaguggcacagucaug

SEQ ID NO: 8620 - RNA, 22 nt, Homo sapiens
ucacaccauucuucuacuucag

SEQ ID NO: 8621 - RNA, 17 nt, Homo sapiens
ugcaauuuaagcuagau

SEQ ID NO: 8622 - RNA, 22 nt, Homo sapiens
aaucaccaugcacuacagccuu

SEQ ID NO: 8623 - RNA, 22 nt, Homo sapiens
ucuccauuuguaaggguuucuc

SEQ ID NO: 8624 - RNA, 22 nt, Homo sapiens
guaugucuugucuauggcugcu

SEQ ID NO: 8625 - RNA, 22 nt, Homo sapiens
uuugggaaugaguuuaucauuu

SEQ ID NO: 8626 - RNA, 22 nt, Homo sapiens
uggaauguaacuugaaacuuuu

SEQ ID NO: 8627 - RNA, 22 nt, Homo sapiens
auugcuaauaugcuucaggcaa

SEQ ID NO: 8628 - RNA, 22 nt, Homo sapiens
uagaguguaaaccacauaguga

SEQ ID NO: 8629 - RNA, 22 nt, Homo sapiens
auaagagugggguguuagggau

SEQ ID NO: 8630 - RNA, 22 nt, Homo sapiens
ugguguuugagaagcugauguc

SEQ ID NO: 8631 - RNA, 22 nt, Homo sapiens
aaacucuguagcagagacagau

SEQ ID NO: 8632 - RNA, 22 nt, Homo sapiens
uugggagugucucuggacugca

SEQ ID NO: 8633 - RNA, 22 nt, Homo sapiens
guaaauguccccugugauauug

SEQ ID NO: 8634 - RNA, 22 nt, Homo sapiens
guggcgaagauggauugaguca

SEQ ID NO: 8635 - RNA, 22 nt, Homo sapiens
ugguacuguccuucuagauucc

SEQ ID NO: 8636 - RNA, 22 nt, Homo sapiens
augaucuagaguaggaaacaga

SEQ ID NO: 8637 - RNA, 22 nt, Homo sapiens
uuguaauguuaccaaauggugu

SEQ ID NO: 8638 - RNA, 22 nt, Homo sapiens
uucaaaggauagauuaagauca

SEQ ID NO: 8639 - RNA, 22 nt, Homo sapiens
guucagucacgugcccaaguuc

SEQ ID NO: 8640 - RNA, 22 nt, Homo sapiens
uagggcauugaacugaauucuu

SEQ ID NO: 8641 - RNA, 22 nt, Homo sapiens
gucuuuaguugaaacauguggu

SEQ ID NO: 8642 - RNA, 23 nt, Homo sapiens
gagaccagcuucagaaagcacga

SEQ ID NO: 8643 - RNA, 22 nt, Homo sapiens
uguugccacuguuauuaaccua

SEQ ID NO: 8644 - RNA, 22 nt, Homo sapiens
gugaucaugauccugaagcauu

SEQ ID NO: 8645 - RNA, 22 nt, Homo sapiens
uacccuuagcuuacauucuagg

SEQ ID NO: 8646 - RNA, 22 nt, Homo sapiens
ggcucaguuuccuccgucugcu

SEQ ID NO: 8647 - RNA, 22 nt, Homo sapiens
ggcagcacaauuuucugaugga

SEQ ID NO: 8648 - RNA, 22 nt, Homo sapiens
caugcauagccauucauucguu

SEQ ID NO: 8649 - RNA, 22 nt, Homo sapiens
uagagcuugacacuuuccaugg

SEQ ID NO: 8650 - RNA, 20 nt, Homo sapiens
augccacugagcagugguga

SEQ ID NO: 8651 - RNA, 22 nt, Homo sapiens
uugagauggagucucacucuuc

SEQ ID NO: 8652 - RNA, 22 nt, Homo sapiens
cagcaucauucaucugggguaa

SEQ ID NO: 8653 - RNA, 22 nt, Homo sapiens
aagaggcuguaggauaaugccu

SEQ ID NO: 8654 - RNA, 22 nt, Homo sapiens
uuagagguaggauuucaccaug

SEQ ID NO: 8655 - RNA, 22 nt, Homo sapiens
aaguagcagaggcaagacuuga

SEQ ID NO: 8656 - RNA, 22 nt, Homo sapiens
cuuuugcugggucagcgguggu

SEQ ID NO: 8657 - RNA, 22 nt, Homo sapiens
uuuuaguggaauauuuacaguu

SEQ ID NO: 8658 - RNA, 22 nt, Homo sapiens
cauugcacuccagccuagccaa

SEQ ID NO: 8659 - RNA, 22 nt, Homo sapiens
uguggcauuuucagaaaggaug

SEQ ID NO: 8660 - RNA, 22 nt, Homo sapiens
ucccacugucuucucgugcucg

SEQ ID NO: 8661 - RNA, 22 nt, Homo sapiens
caaagugcugaaagaggccagg

SEQ ID NO: 8662 - RNA, 17 nt, Homo sapiens
ucuaauaauaugcauuu

SEQ ID NO: 8663 - RNA, 22 nt, Homo sapiens
agucaaguuuuuucagagaaua

SEQ ID NO: 8664 - RNA, 22 nt, Homo sapiens
uuaaguaaucagagaagagaac

SEQ ID NO: 8665 - RNA, 18 nt, Homo sapiens
uggacagugauuauccau

SEQ ID NO: 8666 - RNA, 18 nt, Homo sapiens
guaugcacaugccccugc

SEQ ID NO: 8667 - RNA, 22 nt, Homo sapiens
uugcacauugauuuuguauccu

SEQ ID NO: 8668 - RNA, 21 nt, Homo sapiens
uggaaacuucuagcuuacgua

SEQ ID NO: 8669 - RNA, 22 nt, Homo sapiens
agcucuauuagaagccgugggu

SEQ ID NO: 8670 - RNA, 22 nt, Homo sapiens
agaagaacauagggugacugaa

SEQ ID NO: 8671 - RNA, 23 nt, Homo sapiens
gaaaugucuuagugaaauugcuu

SEQ ID NO: 8672 - RNA, 22 nt, Homo sapiens
uacucugcagagaugcauaaca

SEQ ID NO: 8673 - RNA, 22 nt, Homo sapiens
uauauaagcugaugagccacaa

SEQ ID NO: 8674 - RNA, 22 nt, Homo sapiens
auaaaugcaaugguauuuuuga

SEQ ID NO: 8675 - RNA, 22 nt, Homo sapiens
ucauggguuuugguccaagcaa

SEQ ID NO: 8676 - RNA, 22 nt, Homo sapiens
cugaaucauugcauuaucaagg

SEQ ID NO: 8677 - RNA, 22 nt, Homo sapiens
gucguggagucucuggcuugua

SEQ ID NO: 8678 - RNA, 22 nt, Homo sapiens
gagcuuguggucuucguguuau

SEQ ID NO: 8679 - RNA, 22 nt, Homo sapiens
ucagugauugcuuucauggaaa

SEQ ID NO: 8680 - RNA, 22 nt, Homo sapiens
uuagcacaucuuucuauguaag

SEQ ID NO: 8681 - RNA, 22 nt, Homo sapiens
uaaagcgaggucuccuacaaga

SEQ ID NO: 8682 - RNA, 22 nt, Homo sapiens
uguagguagggucuguuuuuga

SEQ ID NO: 8683 - RNA, 22 nt, Homo sapiens
ugaguguguaugugcauacaca

SEQ ID NO: 8684 - RNA, 22 nt, Homo sapiens
uucucgcuuuuuccaccuguau

SEQ ID NO: 8685 - RNA, 22 nt, Homo sapiens
auguggaaauguauaugugucu

SEQ ID NO: 8686 - RNA, 22 nt, Homo sapiens
acagaaccauucacuccccugg

SEQ ID NO: 8687 - RNA, 22 nt, Homo sapiens
acauugcucuuaccaaguuugu

SEQ ID NO: 8688 - RNA, 18 nt, Homo sapiens
cuuugguccccgcacccu

SEQ ID NO: 8689 - RNA, 22 nt, Homo sapiens
ucagaguguuuuccaacuuggu

SEQ ID NO: 8690 - RNA, 22 nt, Homo sapiens
ucccagaaacgcauauguucau

SEQ ID NO: 8691 - RNA, 22 nt, Homo sapiens
gugagcuaagcaaauaugagcc

SEQ ID NO: 8692 - RNA, 22 nt, Homo sapiens
uucaagucaaggaaagaggucu

SEQ ID NO: 8693 - RNA, 22 nt, Homo sapiens
uugcuacauugauugccucuuu

SEQ ID NO: 8694 - RNA, 22 nt, Homo sapiens
ugguaaaaugucauuuaccaga

SEQ ID NO: 8695 - RNA, 22 nt, Homo sapiens
cugagcaaagaagugauaauga

SEQ ID NO: 8696 - RNA, 18 nt, Homo sapiens
cuuagguagcucauucca

SEQ ID NO: 8697 - RNA, 22 nt, Homo sapiens
ccaccgggucccagcucugcuc

SEQ ID NO: 8698 - RNA, 22 nt, Homo sapiens
agcucauugcuguccuggagga

SEQ ID NO: 8699 - RNA, 22 nt, Homo sapiens
acugguguaugggaggucccaa

SEQ ID NO: 8700 - RNA, 22 nt, Homo sapiens
uaugugguuaauaggaauuugu

SEQ ID NO: 8701 - RNA, 22 nt, Homo sapiens
auuguacuuaagccugggugaa

SEQ ID NO: 8702 - RNA, 22 nt, Homo sapiens
uugggauaaucacaaaguaaaa

SEQ ID NO: 8703 - RNA, 22 nt, Homo sapiens
aagcugguuuuauaucugugag

SEQ ID NO: 8704 - RNA, 22 nt, Homo sapiens
uccccugauaccaaccaccaug

SEQ ID NO: 8705 - RNA, 22 nt, Homo sapiens
auugcacuccagccucggugac

SEQ ID NO: 8706 - RNA, 22 nt, Homo sapiens
augugcaagaucauuaaagcuc

SEQ ID NO: 8707 - RNA, 22 nt, Homo sapiens
uugaagagaaccgcggcuuauu

SEQ ID NO: 8708 - RNA, 22 nt, Homo sapiens
uugcacagucuagcuccaccuu

SEQ ID NO: 8709 - RNA, 22 nt, Homo sapiens
ugagacggagucucgcucuguc

SEQ ID NO: 8710 - RNA, 22 nt, Homo sapiens
auuggcaauguacauaucuugc

SEQ ID NO: 8711 - RNA, 22 nt, Homo sapiens
cuggauagucaggagauauaua

SEQ ID NO: 8712 - RNA, 19 nt, Homo sapiens
uagaugucuuugcauagau

SEQ ID NO: 8713 - RNA, 22 nt, Homo sapiens
uuaugccuauugugccuuggau

SEQ ID NO: 8714 - RNA, 22 nt, Homo sapiens
aagcaccguugccuccccugca

SEQ ID NO: 8715 - RNA, 22 nt, Homo sapiens
ugaaaugcuaauucguagcuaa

SEQ ID NO: 8716 - RNA, 22 nt, Homo sapiens
ucacccugacaugcggccgaac

SEQ ID NO: 8717 - RNA, 22 nt, Homo sapiens
auucacagcuuuaaaaggcgug

SEQ ID NO: 8718 - RNA, 23 nt, Homo sapiens
ucgcagcauucaauaccaggcag

SEQ ID NO: 8719 - RNA, 22 nt, Homo sapiens
uauggcauuauuuugauagaca

SEQ ID NO: 8720 - RNA, 22 nt, Homo sapiens
ugggguagaauagaauugauau

SEQ ID NO: 8721 - RNA, 22 nt, Homo sapiens
ucgguacuugagagagacacag

SEQ ID NO: 8722 - RNA, 22 nt, Homo sapiens
aggcuagaaucuuccaucuugg

SEQ ID NO: 8723 - RNA, 22 nt, Homo sapiens
cacaaugucugguaggccacuu

SEQ ID NO: 8724 - RNA, 22 nt, Homo sapiens
cauugcucuuacagagugagua

SEQ ID NO: 8725 - RNA, 23 nt, Homo sapiens
caauacugaccucacguuaauag

SEQ ID NO: 8726 - RNA, 22 nt, Homo sapiens
uuuagguacgcaccggcucagu

SEQ ID NO: 8727 - RNA, 22 nt, Homo sapiens
augcaaggaugguuagauauau

SEQ ID NO: 8728 - RNA, 16 nt, Homo sapiens
gacugggcugaggaau

SEQ ID NO: 8729 - RNA, 22 nt, Homo sapiens
ugacuugaaacgugaacagauc

SEQ ID NO: 8730 - RNA, 22 nt, Homo sapiens
ugagauccugagaguugggacu

SEQ ID NO: 8731 - RNA, 20 nt, Homo sapiens
uugaguauugccagggaggc

SEQ ID NO: 8732 - RNA, 22 nt, Homo sapiens
gaugagaucauaaguguggagc

SEQ ID NO: 8733 - RNA, 22 nt, Homo sapiens
agguauuuuuuauccuccagca

SEQ ID NO: 8734 - RNA, 22 nt, Homo sapiens
uacugcacucuagccuggguga

SEQ ID NO: 8735 - RNA, 22 nt, Homo sapiens
uuccuggaggggaaguguccaa

SEQ ID NO: 8736 - RNA, 20 nt, Homo sapiens
agcauugguuagaacaguag

SEQ ID NO: 8737 - RNA, 18 nt, Homo sapiens
ugcaauggagaugcagcc

SEQ ID NO: 8738 - RNA, 22 nt, Homo sapiens
uacaggacuauagaacuuuccc

SEQ ID NO: 8739 - RNA, 22 nt, Homo sapiens
augagguguuuauuguauccug

SEQ ID NO: 8740 - RNA, 22 nt, Homo sapiens
aaacugaucugaaggccaggcu

SEQ ID NO: 8741 - RNA, 22 nt, Homo sapiens
acauugcauauggcacccucuu

SEQ ID NO: 8742 - RNA, 22 nt, Homo sapiens
ugaguagaagugaagauagugg

SEQ ID NO: 8743 - RNA, 22 nt, Homo sapiens
gcagcagugugggcugaaccua

SEQ ID NO: 8744 - RNA, 22 nt, Homo sapiens
ugagacacuucccagaucccuu

SEQ ID NO: 8745 - RNA, 22 nt, Homo sapiens
agagauaguuuccaacucauac

SEQ ID NO: 8746 - RNA, 22 nt, Homo sapiens
uaguaaacauuuuucuaucauu

SEQ ID NO: 8747 - RNA, 16 nt, Homo sapiens
cuaaaaugucuacuug

SEQ ID NO: 8748 - RNA, 22 nt, Homo sapiens
uccuuggucaaaaagaaagugu

SEQ ID NO: 8749 - RNA, 23 nt, Homo sapiens
ugcaccacuacacacucuugggu

SEQ ID NO: 8750 - RNA, 22 nt, Homo sapiens
ucuauggaguuugaaugagaaa

SEQ ID NO: 8751 - RNA, 22 nt, Homo sapiens
cagaugcaugaccugggcuugg

SEQ ID NO: 8752 - RNA, 21 nt, Homo sapiens
ugaugcuuuucuuaaccuugc

SEQ ID NO: 8753 - RNA, 22 nt, Homo sapiens
gucuguuugauccagaucaaaa

SEQ ID NO: 8754 - RNA, 22 nt, Homo sapiens
ucugccaaccacaaaauuuauu

SEQ ID NO: 8755 - RNA, 22 nt, Homo sapiens
uuuaaugcugcccagucauggg

SEQ ID NO: 8756 - RNA, 22 nt, Homo sapiens
uugccugagaagccaagaauaa

SEQ ID NO: 8757 - RNA, 18 nt, Homo sapiens
cacuuggcuuugccccuc

SEQ ID NO: 8758 - RNA, 22 nt, Homo sapiens
uaggaucauuuuauguugccca

SEQ ID NO: 8759 - RNA, 22 nt, Homo sapiens
guaacucugucacuuacuaguu

SEQ ID NO: 8760 - RNA, 22 nt, Homo sapiens
agcgccauugcacuccagccuu

SEQ ID NO: 8761 - RNA, 22 nt, Homo sapiens
ucacaguucagcauggcugagg

SEQ ID NO: 8762 - RNA, 23 nt, Homo sapiens
uugcauagacauccucauagauu

SEQ ID NO: 8763 - RNA, 22 nt, Homo sapiens
ucagugucugugauggagaggu

SEQ ID NO: 8764 - RNA, 22 nt, Homo sapiens
uuaaugugaaucaggaugcauu

SEQ ID NO: 8765 - RNA, 22 nt, Homo sapiens
gcuauggccugaauguuugugu

SEQ ID NO: 8766 - RNA, 22 nt, Homo sapiens
ugucucaguuacggcaauucca

SEQ ID NO: 8767 - RNA, 22 nt, Homo sapiens
auaucaacaugguaggguuggu

SEQ ID NO: 8768 - RNA, 22 nt, Homo sapiens
gggaggucauuguaaggucuua

SEQ ID NO: 8769 - RNA, 22 nt, Homo sapiens
uagaagcuacucuucuuguggc

SEQ ID NO: 8770 - RNA, 22 nt, Homo sapiens
cuggcugagugguaaguagagg

SEQ ID NO: 8771 - RNA, 22 nt, Homo sapiens
augaauuuucugauguugggua

SEQ ID NO: 8772 - RNA, 22 nt, Homo sapiens
augacuuuucugaaaaccacca

SEQ ID NO: 8773 - RNA, 22 nt, Homo sapiens
ccugagaucauacuguuaguaa

SEQ ID NO: 8774 - RNA, 22 nt, Homo sapiens
gcuuuggauaaaugucaguuua

SEQ ID NO: 8775 - RNA, 22 nt, Homo sapiens
auauuugguuaccugugggucu

SEQ ID NO: 8776 - RNA, 22 nt, Homo sapiens
ugaguuauuaguagaggcuaug

SEQ ID NO: 8777 - RNA, 22 nt, Homo sapiens
cucuggauauuccugucuaaaa

SEQ ID NO: 8778 - RNA, 22 nt, Homo sapiens
gccaagaagugucuaagcagga

SEQ ID NO: 8779 - RNA, 22 nt, Homo sapiens
gugccacugcacuccggccugg

SEQ ID NO: 8780 - RNA, 22 nt, Homo sapiens
cauugcuaaaagucauauauaa

SEQ ID NO: 8781 - RNA, 22 nt, Homo sapiens
ugcaccacugcacugccugggu

SEQ ID NO: 8782 - RNA, 22 nt, Homo sapiens
aaaugcaugaggugggaagaaa

SEQ ID NO: 8783 - RNA, 22 nt, Homo sapiens
guaucauuggcauguaaccaga

SEQ ID NO: 8784 - RNA, 21 nt, Homo sapiens
ugagauaauauguuucugaug

SEQ ID NO: 8785 - RNA, 22 nt, Homo sapiens
auggcagcaccccacucuacug

SEQ ID NO: 8786 - RNA, 22 nt, Homo sapiens
auugcaccacugcccuccagcc

SEQ ID NO: 8787 - RNA, 22 nt, Homo sapiens
uaucaaggccacucauuuuaug

SEQ ID NO: 8788 - RNA, 22 nt, Homo sapiens
ggaaugcuaaaauaggaugcug

SEQ ID NO: 8789 - RNA, 22 nt, Homo sapiens
gucuggcaauggcagacuggca

SEQ ID NO: 8790 - RNA, 22 nt, Homo sapiens
augaggcacugcgcccuacuga

SEQ ID NO: 8791 - RNA, 22 nt, Homo sapiens
guuaagaaguguaacuuaaguu

SEQ ID NO: 8792 - RNA, 22 nt, Homo sapiens
auuguacuccagccugggcagc

SEQ ID NO: 8793 - RNA, 23 nt, Homo sapiens
acacuugcugaguaaaucaaaua

SEQ ID NO: 8794 - RNA, 22 nt, Homo sapiens
agggcuuuugagcugagauggu

SEQ ID NO: 8795 - RNA, 22 nt, Homo sapiens
ugagauguugcucugaaacaag

SEQ ID NO: 8796 - RNA, 22 nt, Homo sapiens
cauugcacuccagccugccugg

SEQ ID NO: 8797 - RNA, 22 nt, Homo sapiens
uggaggucauuggaucaugggg

SEQ ID NO: 8798 - RNA, 22 nt, Homo sapiens
aaaccaccauuacuuuugcacc

SEQ ID NO: 8799 - RNA, 22 nt, Homo sapiens
augagaugcaagauuagauggg

SEQ ID NO: 8800 - RNA, 22 nt, Homo sapiens
augucacugcacuccugccugg

SEQ ID NO: 8801 - RNA, 22 nt, Homo sapiens
agugaaaucugaagaaggucau

SEQ ID NO: 8802 - RNA, 22 nt, Homo sapiens
gggagcaaaaaugaugcccaag

SEQ ID NO: 8803 - RNA, 22 nt, Homo sapiens
uugcacaauccugugagugagu

SEQ ID NO: 8804 - RNA, 22 nt, Homo sapiens
acugcacuccagccuggacgaa

SEQ ID NO: 8805 - RNA, 22 nt, Homo sapiens
uaauuggaucucaaaaaagugu

SEQ ID NO: 8806 - RNA, 20 nt, Homo sapiens
ucagguagggcuucaacauu

SEQ ID NO: 8807 - RNA, 22 nt, Homo sapiens
ugccaugucauagguuaagccu

SEQ ID NO: 8808 - RNA, 22 nt, Homo sapiens
auagcagaauuuggucaagucu

SEQ ID NO: 8809 - RNA, 22 nt, Homo sapiens
gauggcacuguagcaacacaaa

SEQ ID NO: 8810 - RNA, 22 nt, Homo sapiens
ugaagacauuuuugggugugua

SEQ ID NO: 8811 - RNA, 22 nt, Homo sapiens
ugagacaaucucaucucaguga

SEQ ID NO: 8812 - RNA, 22 nt, Homo sapiens
gcaagaugagagcccgggcagu

SEQ ID NO: 8813 - RNA, 22 nt, Homo sapiens
ugcaugaugcugagauuuggga

SEQ ID NO: 8814 - RNA, 22 nt, Homo sapiens
ugacagucaccaggacccacag

SEQ ID NO: 8815 - RNA, 22 nt, Homo sapiens
uaggauaguccuccugagaccu

SEQ ID NO: 8816 - RNA, 22 nt, Homo sapiens
ugacuugaucacccccuaaggg

SEQ ID NO: 8817 - RNA, 22 nt, Homo sapiens
ucaacguauuuauauagcagag

SEQ ID NO: 8818 - RNA, 22 nt, Homo sapiens
uaccugagcccucugcugaguu

SEQ ID NO: 8819 - RNA, 19 nt, Homo sapiens
uuaaguaguuagagggucu

SEQ ID NO: 8820 - RNA, 22 nt, Homo sapiens
uuagccggguguguuggcgggc

SEQ ID NO: 8821 - RNA, 21 nt, Homo sapiens
ugacuagggauaugugccacu

SEQ ID NO: 8822 - RNA, 22 nt, Homo sapiens
cugacauuguugaucacagcca

SEQ ID NO: 8823 - RNA, 22 nt, Homo sapiens
uuauuagguuagugcaaaaguu

SEQ ID NO: 8824 - RNA, 22 nt, Homo sapiens
gagguauaauugacaagcaaaa

SEQ ID NO: 8825 - RNA, 20 nt, Homo sapiens
uuacagugggaccuuccuga

SEQ ID NO: 8826 - RNA, 22 nt, Homo sapiens
cuccacugagcaggugggaggc

SEQ ID NO: 8827 - RNA, 22 nt, Homo sapiens
gaaauguauuaaugaguugaaa

SEQ ID NO: 8828 - RNA, 22 nt, Homo sapiens
ugagccauggcaccuugucuaa

SEQ ID NO: 8829 - RNA, 22 nt, Homo sapiens
aguucaaugcucuuucuacuau

SEQ ID NO: 8830 - RNA, 22 nt, Homo sapiens
guauggcauuuguggauuggcc

SEQ ID NO: 8831 - RNA, 22 nt, Homo sapiens
uugagcuuuuuacuuguccaau

SEQ ID NO: 8832 - RNA, 22 nt, Homo sapiens
gauagcauucaauuaucuguug

SEQ ID NO: 8833 - RNA, 17 nt, Homo sapiens
agcagcccauaucccca

SEQ ID NO: 8834 - RNA, 22 nt, Homo sapiens
uauggcuuuguuaacauuuucu

SEQ ID NO: 8835 - RNA, 22 nt, Homo sapiens
auuagguagggaauauggaggu

SEQ ID NO: 8836 - RNA, 20 nt, Homo sapiens
aagcauggguuuuaggguca

SEQ ID NO: 8837 - RNA, 22 nt, Homo sapiens
ucauacaggccaccagggaagu

SEQ ID NO: 8838 - RNA, 22 nt, Homo sapiens
auggcccuguguggagcugcug

SEQ ID NO: 8839 - RNA, 22 nt, Homo sapiens
cagggcauugucuucuuaguac

SEQ ID NO: 8840 - RNA, 22 nt, Homo sapiens
ggcgguguugauggcccccaca

SEQ ID NO: 8841 - RNA, 22 nt, Homo sapiens
cggaaugaaaauguccuucagu

SEQ ID NO: 8842 - RNA, 22 nt, Homo sapiens
gagguauggauaucuggagagg

SEQ ID NO: 8843 - RNA, 22 nt, Homo sapiens
ugacuacacacaauuugucaag

SEQ ID NO: 8844 - RNA, 22 nt, Homo sapiens
agacucauuuuuaucgagcaug

SEQ ID NO: 8845 - RNA, 22 nt, Homo sapiens
ugucuuuguuaguuguccuagu

SEQ ID NO: 8846 - RNA, 22 nt, Homo sapiens
guaccugauacaggcgcacggu

SEQ ID NO: 8847 - RNA, 22 nt, Homo sapiens
gugcacaaugugcagguuuguu

SEQ ID NO: 8848 - RNA, 22 nt, Homo sapiens
auggcuuuugcccuaaauggau

SEQ ID NO: 8849 - RNA, 21 nt, Homo sapiens
gacuacaccaggaugcuaguu

SEQ ID NO: 8850 - RNA, 22 nt, Homo sapiens
acagguauagaaagcuaaaggg

SEQ ID NO: 8851 - RNA, 22 nt, Homo sapiens
gagauggagacuuggccuuaaa

SEQ ID NO: 8852 - RNA, 22 nt, Homo sapiens
auuggucuugaaaccagagaga

SEQ ID NO: 8853 - RNA, 22 nt, Homo sapiens
cugugaucuuuuuucauguggu

SEQ ID NO: 8854 - RNA, 22 nt, Homo sapiens
ugaucuuuuuaauguccauggg

SEQ ID NO: 8855 - RNA, 22 nt, Homo sapiens
aaugauauguuauguuuagguu

SEQ ID NO: 8856 - RNA, 21 nt, Homo sapiens
ucaccuguugcgaugaagcug

SEQ ID NO: 8857 - RNA, 22 nt, Homo sapiens
ugagcgaugggaggaagugaua

SEQ ID NO: 8858 - RNA, 22 nt, Homo sapiens
uauggcaaugcauaggaaggaa

SEQ ID NO: 8859 - RNA, 21 nt, Homo sapiens
uucuucaggcagaaggauuau

SEQ ID NO: 8860 - RNA, 22 nt, Homo sapiens
ucaagugcauaugcuaacgguu

SEQ ID NO: 8861 - RNA, 22 nt, Homo sapiens
aggaagugucuucuuuuaggca

SEQ ID NO: 8862 - RNA, 21 nt, Homo sapiens
uggaaucuauuauuccaguuu

SEQ ID NO: 8863 - RNA, 22 nt, Homo sapiens
agcaguacauaaaaagcauccu

SEQ ID NO: 8864 - RNA, 22 nt, Homo sapiens
ugcacaguccagugcccacuga

SEQ ID NO: 8865 - RNA, 22 nt, Homo sapiens
auaagucaauggaacagauuaa

SEQ ID NO: 8866 - RNA, 23 nt, Homo sapiens
auaaacugucaaaagccagcccu

SEQ ID NO: 8867 - RNA, 22 nt, Homo sapiens
aagcaucauuuggaauuugaga

SEQ ID NO: 8868 - RNA, 22 nt, Homo sapiens
gacuuagagauguuguauuugg

SEQ ID NO: 8869 - RNA, 21 nt, Homo sapiens
ugacauuauuucaugucagua

SEQ ID NO: 8870 - RNA, 22 nt, Homo sapiens
ugaguuguaggggucaccuggc

SEQ ID NO: 8871 - RNA, 22 nt, Homo sapiens
uugauuagugacuggcuacacg

SEQ ID NO: 8872 - RNA, 22 nt, Homo sapiens
aggaaaucuuagcugaggggau

SEQ ID NO: 8873 - RNA, 22 nt, Homo sapiens
ucaggcaugcagcaaugcagug

SEQ ID NO: 8874 - RNA, 22 nt, Homo sapiens
uaucguaguguuggaaaacaag

SEQ ID NO: 8875 - RNA, 22 nt, Homo sapiens
uuggaagcaugguuauugacgu

SEQ ID NO: 8876 - RNA, 22 nt, Homo sapiens
auggccugaugcaccuguccca

SEQ ID NO: 8877 - RNA, 22 nt, Homo sapiens
ucauugcacucccagacacccu

SEQ ID NO: 8878 - RNA, 16 nt, Homo sapiens
auaugacuuuaggagg

SEQ ID NO: 8879 - RNA, 22 nt, Homo sapiens
cuuuguguaggugccucuggcu

SEQ ID NO: 8880 - RNA, 22 nt, Homo sapiens
cauacaugugcuugucuuaugc

SEQ ID NO: 8881 - RNA, 22 nt, Homo sapiens
uggcaaaauauuuugguuucug

SEQ ID NO: 8882 - RNA, 22 nt, Homo sapiens
auggcacuaaguucaacacuua

SEQ ID NO: 8883 - RNA, 22 nt, Homo sapiens
augcauagcaucugcaaauguu

SEQ ID NO: 8884 - RNA, 22 nt, Homo sapiens
ucauacaguaguccucacuugu

SEQ ID NO: 8885 - RNA, 18 nt, Homo sapiens
uuagguaggucuuugugu

SEQ ID NO: 8886 - RNA, 22 nt, Homo sapiens
gagaacuaaugguuugauaagg

SEQ ID NO: 8887 - RNA, 22 nt, Homo sapiens
uugcaaugugaugugauuugga

SEQ ID NO: 8888 - RNA, 22 nt, Homo sapiens
uccaguagaauuuuauucaaca

SEQ ID NO: 8889 - RNA, 18 nt, Homo sapiens
cuucauugcuguuuugcu

SEQ ID NO: 8890 - RNA, 22 nt, Homo sapiens
ugcugaguguuaccggacaccg

SEQ ID NO: 8891 - RNA, 22 nt, Homo sapiens
agaauguaaacagaauagagga

SEQ ID NO: 8892 - RNA, 22 nt, Homo sapiens
ugugcaguuuuagcguauuuua

SEQ ID NO: 8893 - RNA, 22 nt, Homo sapiens
gaauagugcugcaaugaacaua

SEQ ID NO: 8894 - RNA, 22 nt, Homo sapiens
uuauggccauucuuguaggagu

SEQ ID NO: 8895 - RNA, 22 nt, Homo sapiens
acaguagugggcuacagaauca

SEQ ID NO: 8896 - RNA, 22 nt, Homo sapiens
uucaaaguaaaaauguguucac

SEQ ID NO: 8897 - RNA, 23 nt, Homo sapiens
ucaguacucuauaagugccagcu

SEQ ID NO: 8898 - RNA, 22 nt, Homo sapiens
ugcaaauuauugggccccaacu

SEQ ID NO: 8899 - RNA, 22 nt, Homo sapiens
uuacaagaugucuguccaacac

SEQ ID NO: 8900 - RNA, 20 nt, Homo sapiens
gggaugugagguacacucuu

SEQ ID NO: 8901 - RNA, 22 nt, Homo sapiens
gacccucuagauggaagcacug

SEQ ID NO: 8902 - RNA, 22 nt, Homo sapiens
ucaguucauggaggugucugcu

SEQ ID NO: 8903 - RNA, 22 nt, Homo sapiens
cuguuugaggguuugcuuucag

SEQ ID NO: 8904 - RNA, 22 nt, Homo sapiens
uugguucaguuuaacgaguaau

SEQ ID NO: 8905 - RNA, 22 nt, Homo sapiens
uuaauggagaguuucauuggug

SEQ ID NO: 8906 - RNA, 22 nt, Homo sapiens
uagaucauauacuugccaugac

SEQ ID NO: 8907 - RNA, 22 nt, Homo sapiens
ugcugguauuauguuauccaga

SEQ ID NO: 8908 - RNA, 22 nt, Homo sapiens
uaccacauuguagagggcauuc

SEQ ID NO: 8909 - RNA, 22 nt, Homo sapiens
uuagguagaauugauuaaguuu

SEQ ID NO: 8910 - RNA, 22 nt, Homo sapiens
uuggaaugugacugauaauauu

SEQ ID NO: 8911 - RNA, 22 nt, Homo sapiens
ucuguugguucuuugaggagga

SEQ ID NO: 8912 - RNA, 22 nt, Homo sapiens
ucaggcuuuucccagagugaug

SEQ ID NO: 8913 - RNA, 19 nt, Homo sapiens
aaaguucuucccuuuggag

SEQ ID NO: 8914 - RNA, 22 nt, Homo sapiens
auggcuuuguguucagagcuga

SEQ ID NO: 8915 - RNA, 22 nt, Homo sapiens
uggagggcuagucauuucuuuu

SEQ ID NO: 8916 - RNA, 22 nt, Homo sapiens
ggaguaggcuguccggcaccca

SEQ ID NO: 8917 - RNA, 22 nt, Homo sapiens
gaggcggugugaugucacaugc

SEQ ID NO: 8918 - RNA, 22 nt, Homo sapiens
guagcaugcaauauuauagaga

SEQ ID NO: 8919 - RNA, 22 nt, Homo sapiens
aaaugacuuuuuaugcagagua

SEQ ID NO: 8920 - RNA, 22 nt, Homo sapiens
aaccuguaaccauaugaucagu

SEQ ID NO: 8921 - RNA, 22 nt, Homo sapiens
uacagccacauaauguaugauu

SEQ ID NO: 8922 - RNA, 22 nt, Homo sapiens
uuauauguuucuuagggacaga

SEQ ID NO: 8923 - RNA, 17 nt, Homo sapiens
ucacaguguuaggauga

SEQ ID NO: 8924 - RNA, 18 nt, Homo sapiens
agcucaguguuugcuuac

SEQ ID NO: 8925 - RNA, 22 nt, Homo sapiens
uuccugagaucagaauucaaau

SEQ ID NO: 8926 - RNA, 22 nt, Homo sapiens
gauuagagaaauacugcugcua

SEQ ID NO: 8927 - RNA, 22 nt, Homo sapiens
cuccauuuggaacagauguccu

SEQ ID NO: 8928 - RNA, 22 nt, Homo sapiens
uuuguacuccuuggccagcuuc

SEQ ID NO: 8929 - RNA, 22 nt, Homo sapiens
ucacauagcugaguaaaaugga

SEQ ID NO: 8930 - RNA, 22 nt, Homo sapiens
aucucugagauguucugauuuu

SEQ ID NO: 8931 - RNA, 22 nt, Homo sapiens
uaaugcauguaaugggcugaua

SEQ ID NO: 8932 - RNA, 22 nt, Homo sapiens
agauauguuauugauguuaaug

SEQ ID NO: 8933 - RNA, 22 nt, Homo sapiens
ugugaagaugagaugacgcccu

SEQ ID NO: 8934 - RNA, 22 nt, Homo sapiens
ugugcuuguaaaggccagagca

SEQ ID NO: 8935 - RNA, 22 nt, Homo sapiens
cucugguuuuucuuccauuaag

SEQ ID NO: 8936 - RNA, 22 nt, Homo sapiens
ucagcagugugaaaauggacua

SEQ ID NO: 8937 - RNA, 20 nt, Homo sapiens
uggaguuguggcaguuugga

SEQ ID NO: 8938 - RNA, 21 nt, Homo sapiens
agcuuguguguaucacagugu

SEQ ID NO: 8939 - RNA, 22 nt, Homo sapiens
ucuugccacuucauccccuuuc

SEQ ID NO: 8940 - RNA, 22 nt, Homo sapiens
gcuuguguuuacuguaguuacu

SEQ ID NO: 8941 - RNA, 22 nt, Homo sapiens
auggcuauuccauaggcagagc

SEQ ID NO: 8942 - RNA, 22 nt, Homo sapiens
uuggccagugucuuuuuuuccu

SEQ ID NO: 8943 - RNA, 18 nt, Homo sapiens
uuggacggagagucaaau

SEQ ID NO: 8944 - RNA, 22 nt, Homo sapiens
agaagugcuggguucaggcugg

SEQ ID NO: 8945 - RNA, 22 nt, Homo sapiens
ucuuggcaaagaauuuuuggcu

SEQ ID NO: 8946 - RNA, 22 nt, Homo sapiens
guuguauaggcauggggagaau

SEQ ID NO: 8947 - RNA, 22 nt, Homo sapiens
acugcacuccagccugccgaca

SEQ ID NO: 8948 - RNA, 20 nt, Homo sapiens
cuuggcuuucuugguguuaa

SEQ ID NO: 8949 - RNA, 22 nt, Homo sapiens
uucauggaguuuaaauuguagu

SEQ ID NO: 8950 - RNA, 22 nt, Homo sapiens
uuggcgacugcugcuaaucagg

SEQ ID NO: 8951 - RNA, 22 nt, Homo sapiens
augccacugcauaagguuuuca

SEQ ID NO: 8952 - RNA, 22 nt, Homo sapiens
auggacagacacuggccuucug

SEQ ID NO: 8953 - RNA, 22 nt, Homo sapiens
auuggcaagauagcauaugagg

SEQ ID NO: 8954 - RNA, 22 nt, Homo sapiens
acacuguauccuucuguccuuu

SEQ ID NO: 8955 - RNA, 22 nt, Homo sapiens
ucacaugugcguuuuggcaugu

SEQ ID NO: 8956 - RNA, 22 nt, Homo sapiens
uugcaccccuacuauuugccaa

SEQ ID NO: 8957 - RNA, 22 nt, Homo sapiens
agacaguauuggcaaagugugu

SEQ ID NO: 8958 - RNA, 22 nt, Homo sapiens
uugagauaggaacucacuaugc

SEQ ID NO: 8959 - RNA, 22 nt, Homo sapiens
uggcauuuucucuguucuuaga

SEQ ID NO: 8960 - RNA, 22 nt, Homo sapiens
uggagucgugcccuugcauuua

SEQ ID NO: 8961 - RNA, 22 nt, Homo sapiens
cugcauaaucaucucucugcau

SEQ ID NO: 8962 - RNA, 16 nt, Homo sapiens
ucccaccauugcuugu

SEQ ID NO: 8963 - RNA, 22 nt, Homo sapiens
ugaccuguuugaaauugccaau

SEQ ID NO: 8964 - RNA, 22 nt, Homo sapiens
uuaaggaaagcauuuaauucag

SEQ ID NO: 8965 - RNA, 22 nt, Homo sapiens
uugaaauguguaagcuccgaaa

SEQ ID NO: 8966 - RNA, 23 nt, Homo sapiens
cuguggugaggcccuagaaucug

SEQ ID NO: 8967 - RNA, 22 nt, Homo sapiens
augauugugaauaugugguuuu

SEQ ID NO: 8968 - RNA, 22 nt, Homo sapiens
auuuggguuuuacaucaggcua

SEQ ID NO: 8969 - RNA, 19 nt, Homo sapiens
cccuggcacauggaaaaug

SEQ ID NO: 8970 - RNA, 22 nt, Homo sapiens
uauucaucuuaagcuuuggcuu

SEQ ID NO: 8971 - RNA, 22 nt, Homo sapiens
uuggcauuuuggacacccagga

SEQ ID NO: 8972 - RNA, 22 nt, Homo sapiens
aaacgugcagagaucaauagca

SEQ ID NO: 8973 - RNA, 22 nt, Homo sapiens
uacaguacacagguaccaagcu

SEQ ID NO: 8974 - RNA, 22 nt, Homo sapiens
uuaaaugcauagaauguguagu

SEQ ID NO: 8975 - RNA, 22 nt, Homo sapiens
uccagaguggugaugcuggggc

SEQ ID NO: 8976 - RNA, 22 nt, Homo sapiens
uagaucuuuaaaaggugcuaga

SEQ ID NO: 8977 - RNA, 22 nt, Homo sapiens
uaucucuuuucauguguaaaug

SEQ ID NO: 8978 - RNA, 23 nt, Homo sapiens
ucagguaggccuagaguauucuu

SEQ ID NO: 8979 - RNA, 22 nt, Homo sapiens
cuugggcagugugcauguguau

SEQ ID NO: 8980 - RNA, 22 nt, Homo sapiens
cuccaguuucagaaucccaugu

SEQ ID NO: 8981 - RNA, 22 nt, Homo sapiens
ugacaugauuguauauuuagaa

SEQ ID NO: 8982 - RNA, 22 nt, Homo sapiens
ucauguguugcacugaggaccu

SEQ ID NO: 8983 - RNA, 22 nt, Homo sapiens
uuggaauuaaccuggugcugga

SEQ ID NO: 8984 - RNA, 22 nt, Homo sapiens
ugguauuuaauauaugagaguu

SEQ ID NO: 8985 - RNA, 20 nt, Homo sapiens
auuagacuugccuuauccuu

SEQ ID NO: 8986 - RNA, 22 nt, Homo sapiens
acugcacuucagccuugggaaa

SEQ ID NO: 8987 - RNA, 20 nt, Homo sapiens
auuuggcauaguuuaagcaa

SEQ ID NO: 8988 - RNA, 22 nt, Homo sapiens
uuaagguuuuuguagcaaggau

SEQ ID NO: 8989 - RNA, 22 nt, Homo sapiens
gugugcaugucuuuuuaguagg

SEQ ID NO: 8990 - RNA, 22 nt, Homo sapiens
ggcacaauugcagcaauaaaca

SEQ ID NO: 8991 - RNA, 22 nt, Homo sapiens
uccuugagucugaacuuuggau

SEQ ID NO: 8992 - RNA, 22 nt, Homo sapiens
uuccuugagaaaggcacaaguu

SEQ ID NO: 8993 - RNA, 22 nt, Homo sapiens
uucugugguagaaaucucaaau

SEQ ID NO: 8994 - RNA, 22 nt, Homo sapiens
ugcagcacugaacuucugggcu

SEQ ID NO: 8995 - RNA, 22 nt, Homo sapiens
cuugcacuccacuguucuccug

SEQ ID NO: 8996 - RNA, 22 nt, Homo sapiens
ucaguaaucuuagcugugcaga

SEQ ID NO: 8997 - RNA, 21 nt, Homo sapiens
uguuuuugcuguguaucucuc

SEQ ID NO: 8998 - RNA, 22 nt, Homo sapiens
auugugauugcugcuaggccua

SEQ ID NO: 8999 - RNA, 22 nt, Homo sapiens
acaucuguacaguggguguggu

SEQ ID NO: 9000 - RNA, 22 nt, Homo sapiens
gagguaagaugauucguguccu

SEQ ID NO: 9001 - RNA, 22 nt, Homo sapiens
uacaaagcuuugaugugucuuu

SEQ ID NO: 9002 - RNA, 22 nt, Homo sapiens
uaugaaccuguuaucuagguuu

SEQ ID NO: 9003 - RNA, 22 nt, Homo sapiens
gacguagagaaaugugaaaugg

SEQ ID NO: 9004 - RNA, 19 nt, Homo sapiens
cccagugucagagaagggu

SEQ ID NO: 9005 - RNA, 22 nt, Homo sapiens
gugagcauaacaacagaguuua

SEQ ID NO: 9006 - RNA, 22 nt, Homo sapiens
ugauaguguccugugccacauu

SEQ ID NO: 9007 - RNA, 22 nt, Homo sapiens
cucagagcacaguuuaugacag

SEQ ID NO: 9008 - RNA, 23 nt, Homo sapiens
ucaucacagcauuuccugguauu

SEQ ID NO: 9009 - RNA, 22 nt, Homo sapiens
aggcaugauuguauuuugcucu

SEQ ID NO: 9010 - RNA, 22 nt, Homo sapiens
gagcugccuugccuaugcaaga

SEQ ID NO: 9011 - RNA, 22 nt, Homo sapiens
acugcacugucaaccuccuggg

SEQ ID NO: 9012 - RNA, 22 nt, Homo sapiens
agagagcuuuugguugcccuaa

SEQ ID NO: 9013 - RNA, 22 nt, Homo sapiens
uauugcauauuauucuaguggc

SEQ ID NO: 9014 - RNA, 22 nt, Homo sapiens
cauugcacuccagccugcacga

SEQ ID NO: 9015 - RNA, 22 nt, Homo sapiens
uaugggucuuaaaucacuuagu

SEQ ID NO: 9016 - RNA, 22 nt, Homo sapiens
agggcuuaucuguguagaguuc

SEQ ID NO: 9017 - RNA, 22 nt, Homo sapiens
agaucaauugcugauucgcucu

SEQ ID NO: 9018 - RNA, 22 nt, Homo sapiens
acaccaguacuuuauacaagca

SEQ ID NO: 9019 - RNA, 22 nt, Homo sapiens
gaccuaggaggauugcuugagc

SEQ ID NO: 9020 - RNA, 22 nt, Homo sapiens
cucucaagaugcugggauuaca

SEQ ID NO: 9021 - RNA, 22 nt, Homo sapiens
cuggcagugcuuguuauccugg

SEQ ID NO: 9022 - RNA, 22 nt, Homo sapiens
ggaucacuugagaccaggaguu

SEQ ID NO: 9023 - RNA, 22 nt, Homo sapiens
auuagugaaugugaugucuuga

SEQ ID NO: 9024 - RNA, 22 nt, Homo sapiens
caaauacuuucauguugucuug

SEQ ID NO: 9025 - RNA, 22 nt, Homo sapiens
ggaagaauaaugggccuuagag

SEQ ID NO: 9026 - RNA, 22 nt, Homo sapiens
ucacagaggagaagaccuuuaa

SEQ ID NO: 9027 - RNA, 22 nt, Homo sapiens
uagaaugaaacaagcugugccu

SEQ ID NO: 9028 - RNA, 22 nt, Homo sapiens
cccagugaagagaaccuuacga

SEQ ID NO: 9029 - RNA, 18 nt, Homo sapiens
uccauuuguaugggaugg

SEQ ID NO: 9030 - RNA, 22 nt, Homo sapiens
cuccauagucuucgaagaauga

SEQ ID NO: 9031 - RNA, 22 nt, Homo sapiens
ugagguaugacuuauuauucuu

SEQ ID NO: 9032 - RNA, 18 nt, Homo sapiens
uugcauaguguauccaaa

SEQ ID NO: 9033 - RNA, 18 nt, Homo sapiens
gucauagaaugaugguuc

SEQ ID NO: 9034 - RNA, 22 nt, Homo sapiens
ucuugaacuucugcacacucag

SEQ ID NO: 9035 - RNA, 22 nt, Homo sapiens
acugcacuccagccucggcaau

SEQ ID NO: 9036 - RNA, 22 nt, Homo sapiens
uggcaaauauuuuguuuuguaa

SEQ ID NO: 9037 - RNA, 22 nt, Homo sapiens
ucacagucggugacuucuugcu

SEQ ID NO: 9038 - RNA, 22 nt, Homo sapiens
ucacacggugaugauuccuaga

SEQ ID NO: 9039 - RNA, 22 nt, Homo sapiens
uuguauccaucuuucaggcaac

SEQ ID NO: 9040 - RNA, 22 nt, Homo sapiens
uuugaaaguaauuugguuggug

SEQ ID NO: 9041 - RNA, 22 nt, Homo sapiens
uagagcuagggacucgcaaugu

SEQ ID NO: 9042 - RNA, 20 nt, Homo sapiens
ugggaaauguccaggacaua

SEQ ID NO: 9043 - RNA, 19 nt, Homo sapiens
acaguaccuggcaugaggu

SEQ ID NO: 9044 - RNA, 22 nt, Homo sapiens
uugauauucugagaagcugaag

SEQ ID NO: 9045 - RNA, 22 nt, Homo sapiens
uaccucagccaaugcccagaag

SEQ ID NO: 9046 - RNA, 22 nt, Homo sapiens
uacaguaauguuaaucuuugug

SEQ ID NO: 9047 - RNA, 22 nt, Homo sapiens
uaaauacguccauuugugguau

SEQ ID NO: 9048 - RNA, 22 nt, Homo sapiens
guagaagcacaggugaguuggu

SEQ ID NO: 9049 - RNA, 22 nt, Homo sapiens
aagaugauguuguguuuucacu

SEQ ID NO: 9050 - RNA, 22 nt, Homo sapiens
uugaggcaaugaggagaagcug

SEQ ID NO: 9051 - RNA, 22 nt, Homo sapiens
caguggaugaacaagaagugau

SEQ ID NO: 9052 - RNA, 19 nt, Homo sapiens
cuuguacucggcgcaguug

SEQ ID NO: 9053 - RNA, 22 nt, Homo sapiens
ucuggcuuugugaguugccaga

SEQ ID NO: 9054 - RNA, 23 nt, Homo sapiens
uacagcacacugaugggucuuga

SEQ ID NO: 9055 - RNA, 22 nt, Homo sapiens
uuacuauguuucaaagugucuc

SEQ ID NO: 9056 - RNA, 19 nt, Homo sapiens
ucuuuagucacauuuuuau

SEQ ID NO: 9057 - RNA, 22 nt, Homo sapiens
uguauaggcaaauuuccucaug

SEQ ID NO: 9058 - RNA, 22 nt, Homo sapiens
ccugucuugauuaaauuacuua

SEQ ID NO: 9059 - RNA, 22 nt, Homo sapiens
ucaauugcuuaugaagauacau

SEQ ID NO: 9060 - RNA, 22 nt, Homo sapiens
uaugcacuauggaaguagcuca

SEQ ID NO: 9061 - RNA, 22 nt, Homo sapiens
aaggcacugaacuuaaauucug

SEQ ID NO: 9062 - RNA, 22 nt, Homo sapiens
uggaagauucuagaagauucca

SEQ ID NO: 9063 - RNA, 18 nt, Homo sapiens
uaacugugggaacuaacu

SEQ ID NO: 9064 - RNA, 22 nt, Homo sapiens
ucacacuguuuugauuauuaua

SEQ ID NO: 9065 - RNA, 22 nt, Homo sapiens
agauacauuggauaaugguggg

SEQ ID NO: 9066 - RNA, 22 nt, Homo sapiens
caugauauugcagaauguuggu

SEQ ID NO: 9067 - RNA, 22 nt, Homo sapiens
acugcacuccagccuccugaca

SEQ ID NO: 9068 - RNA, 19 nt, Homo sapiens
ugagauccacugaagauuc

SEQ ID NO: 9069 - RNA, 22 nt, Homo sapiens
auggcauugaagaguugucccu

SEQ ID NO: 9070 - RNA, 22 nt, Homo sapiens
cugauuguuugccucuaaaauc

SEQ ID NO: 9071 - RNA, 22 nt, Homo sapiens
augauuuuuguaucgccugaug

SEQ ID NO: 9072 - RNA, 22 nt, Homo sapiens
gcuguguucucgaggcggggga

SEQ ID NO: 9073 - RNA, 22 nt, Homo sapiens
uaagugaugucuuuuugugugc

SEQ ID NO: 9074 - RNA, 22 nt, Homo sapiens
ucucauggagucaggagcagaa

SEQ ID NO: 9075 - RNA, 22 nt, Homo sapiens
gcaucacagggagacaggccuc

SEQ ID NO: 9076 - RNA, 22 nt, Homo sapiens
acccucaagggacugacagaau

SEQ ID NO: 9077 - RNA, 22 nt, Homo sapiens
uuaccagucugauuccuguuag

SEQ ID NO: 9078 - RNA, 22 nt, Homo sapiens
caucagcaauguaugaggguuc

SEQ ID NO: 9079 - RNA, 22 nt, Homo sapiens
uuugcaauguugugauggugaa

SEQ ID NO: 9080 - RNA, 22 nt, Homo sapiens
uugcaagaaaugcagauucuca

SEQ ID NO: 9081 - RNA, 22 nt, Homo sapiens
uauugcagauacccaggaaguu

SEQ ID NO: 9082 - RNA, 22 nt, Homo sapiens
ugacuagugcccuuugcugccu

SEQ ID NO: 9083 - RNA, 22 nt, Homo sapiens
gugcacaacgugcaaguuuguu

SEQ ID NO: 9084 - RNA, 22 nt, Homo sapiens
uuaugccagugauuauaagggc

SEQ ID NO: 9085 - RNA, 19 nt, Homo sapiens
agaagugcauggucuagag

SEQ ID NO: 9086 - RNA, 22 nt, Homo sapiens
cugagguagcucaggguauugc

SEQ ID NO: 9087 - RNA, 22 nt, Homo sapiens
auugccucaauuccaagacugc

SEQ ID NO: 9088 - RNA, 22 nt, Homo sapiens
agcugguucuuugccuuguaga

SEQ ID NO: 9089 - RNA, 22 nt, Homo sapiens
uaauucuguauguaucagaguu

SEQ ID NO: 9090 - RNA, 22 nt, Homo sapiens
uacugcacuugaccuccugggc

SEQ ID NO: 9091 - RNA, 22 nt, Homo sapiens
aaccuacauucuuaacuguugc

SEQ ID NO: 9092 - RNA, 22 nt, Homo sapiens
aauggcacacaccuggucuaac

SEQ ID NO: 9093 - RNA, 22 nt, Homo sapiens
uagugguaguagcaguaauauu

SEQ ID NO: 9094 - RNA, 22 nt, Homo sapiens
auugaacacuucugugugccag

SEQ ID NO: 9095 - RNA, 22 nt, Homo sapiens
uuacagucaaguuacauuucuc

SEQ ID NO: 9096 - RNA, 22 nt, Homo sapiens
aaaguaauugcaguuuuugcaa

SEQ ID NO: 9097 - RNA, 21 nt, Homo sapiens
uuuguaguagcaugauuuaua

SEQ ID NO: 9098 - RNA, 22 nt, Homo sapiens
guaugauacuguaacagugggu

SEQ ID NO: 9099 - RNA, 22 nt, Homo sapiens
agacagcugggaaauggagugu

SEQ ID NO: 9100 - RNA, 22 nt, Homo sapiens
augcacuguuguuauuggauaa

SEQ ID NO: 9101 - RNA, 22 nt, Homo sapiens
auuguacuccagccugggcaaa

SEQ ID NO: 9102 - RNA, 22 nt, Homo sapiens
uggcaagaagagcaugagacca

SEQ ID NO: 9103 - RNA, 22 nt, Homo sapiens
gugcauacgucuuuauaguagc

SEQ ID NO: 9104 - RNA, 22 nt, Homo sapiens
agcuaguguucaccagagguca

SEQ ID NO: 9105 - RNA, 22 nt, Homo sapiens
uggauugugaagaccaugggaa

SEQ ID NO: 9106 - RNA, 22 nt, Homo sapiens
ucagugaauacauguacucaug

SEQ ID NO: 9107 - RNA, 22 nt, Homo sapiens
uuggcuguguuccucaaggagu

SEQ ID NO: 9108 - RNA, 22 nt, Homo sapiens
auuuggcaauuuugaagaugcc

SEQ ID NO: 9109 - RNA, 22 nt, Homo sapiens
ugcauuguuccgaauguguccu

SEQ ID NO: 9110 - RNA, 22 nt, Homo sapiens
ugccaacaugccuggcuguuuu

SEQ ID NO: 9111 - RNA, 22 nt, Homo sapiens
gaguaaaugucaaguacuuagg

SEQ ID NO: 9112 - RNA, 22 nt, Homo sapiens
auacugccuuuagcaaaacagu

SEQ ID NO: 9113 - RNA, 22 nt, Homo sapiens
uugauagacacauauccaugug

SEQ ID NO: 9114 - RNA, 22 nt, Homo sapiens
uuccauuuguucggugucgcca

SEQ ID NO: 9115 - RNA, 22 nt, Homo sapiens
uuggaauuaagagauauuuucu

SEQ ID NO: 9116 - RNA, 22 nt, Homo sapiens
auuuggcaacguagggaggcau

SEQ ID NO: 9117 - RNA, 22 nt, Homo sapiens
ugucaucauuggaaucugccuc

SEQ ID NO: 9118 - RNA, 22 nt, Homo sapiens
uccaauguaaucaucauugaau

SEQ ID NO: 9119 - RNA, 22 nt, Homo sapiens
gaauguuuacuuuguuuaauac

SEQ ID NO: 9120 - RNA, 22 nt, Homo sapiens
cucacugcauuucaguuuuguu

SEQ ID NO: 9121 - RNA, 22 nt, Homo sapiens
acccacuagaugccaguggcac

SEQ ID NO: 9122 - RNA, 18 nt, Homo sapiens
ugacaucauuuagaaagg

SEQ ID NO: 9123 - RNA, 20 nt, Homo sapiens
ccagcaucauuagauucugg

SEQ ID NO: 9124 - RNA, 22 nt, Homo sapiens
ucacugcacuccagccuuuaug

SEQ ID NO: 9125 - RNA, 22 nt, Homo sapiens
uaguagagauggggcacaugcc

SEQ ID NO: 9126 - RNA, 22 nt, Homo sapiens
ccccagugguugcaacagcaga

SEQ ID NO: 9127 - RNA, 22 nt, Homo sapiens
cuugagcaaacaaaggugguag

SEQ ID NO: 9128 - RNA, 22 nt, Homo sapiens
aauagugcugugcagugagugg

SEQ ID NO: 9129 - RNA, 22 nt, Homo sapiens
uuguaacaugcuuucacuucag

SEQ ID NO: 9130 - RNA, 18 nt, Homo sapiens
cuuugcagcuuccagagg

SEQ ID NO: 9131 - RNA, 22 nt, Homo sapiens
uggguaguuuuucagcucuugc

SEQ ID NO: 9132 - RNA, 22 nt, Homo sapiens
uuccaguguguucauccucaga

SEQ ID NO: 9133 - RNA, 22 nt, Homo sapiens
auaauagguaguaauggauuga

SEQ ID NO: 9134 - RNA, 22 nt, Homo sapiens
uaauugaaugcagacaccaggg

SEQ ID NO: 9135 - RNA, 19 nt, Homo sapiens
cucauggagaaggagaaua

SEQ ID NO: 9136 - RNA, 22 nt, Homo sapiens
auggauuuguaguacaugguug

SEQ ID NO: 9137 - RNA, 22 nt, Homo sapiens
uaacuguggaaaugacuuuaaa

SEQ ID NO: 9138 - RNA, 22 nt, Homo sapiens
gaguaaaugucacuguugcugu

SEQ ID NO: 9139 - RNA, 22 nt, Homo sapiens
gauggcacuaagccauguagga

SEQ ID NO: 9140 - RNA, 22 nt, Homo sapiens
gacauguuuucauguauuugga

SEQ ID NO: 9141 - RNA, 22 nt, Homo sapiens
augacccugaccuaagccaauc

SEQ ID NO: 9142 - RNA, 22 nt, Homo sapiens
aucccaguucagccucugacac

SEQ ID NO: 9143 - RNA, 22 nt, Homo sapiens
augacaagagccuucuuuccuu

SEQ ID NO: 9144 - RNA, 22 nt, Homo sapiens
uuaaucugucuaugauuuuggu

SEQ ID NO: 9145 - RNA, 22 nt, Homo sapiens
uacaguggcaugucaggugcuu

SEQ ID NO: 9146 - RNA, 22 nt, Homo sapiens
agagcaaugacaugcuaugugg

SEQ ID NO: 9147 - RNA, 22 nt, Homo sapiens
aagcgguguugaauuuuguuga

SEQ ID NO: 9148 - RNA, 22 nt, Homo sapiens
uaagggcacuaaucccauuuau

SEQ ID NO: 9149 - RNA, 21 nt, Homo sapiens
uaucauggugaaacccugucu

SEQ ID NO: 9150 - RNA, 22 nt, Homo sapiens
aucagagugaaacaugggagau

SEQ ID NO: 9151 - RNA, 22 nt, Homo sapiens
uugcacaauggaauuuaucuuu

SEQ ID NO: 9152 - RNA, 22 nt, Homo sapiens
gggugguuuuauuaucagugac

SEQ ID NO: 9153 - RNA, 22 nt, Homo sapiens
acagugucaugucguguucccc

SEQ ID NO: 9154 - RNA, 22 nt, Homo sapiens
uugagaugauggauaugcuaau

SEQ ID NO: 9155 - RNA, 22 nt, Homo sapiens
ugccaguauuuuacugaggauu

SEQ ID NO: 9156 - RNA, 22 nt, Homo sapiens
agucgguguuacugacagaaug

SEQ ID NO: 9157 - RNA, 22 nt, Homo sapiens
ugucuagaucugaauguaauug

SEQ ID NO: 9158 - RNA, 21 nt, Homo sapiens
auagggcuuguugauaguuaa

SEQ ID NO: 9159 - RNA, 22 nt, Homo sapiens
cauuacacuuguaagguuuuuc

SEQ ID NO: 9160 - RNA, 17 nt, Homo sapiens
guacucagugaccaugg

SEQ ID NO: 9161 - RNA, 19 nt, Homo sapiens
uuggaauuuuagaguuuga

SEQ ID NO: 9162 - RNA, 22 nt, Homo sapiens
uacacacguguguauauauaca

SEQ ID NO: 9163 - RNA, 20 nt, Homo sapiens
cagugcauugcuucugauuu

SEQ ID NO: 9164 - RNA, 22 nt, Homo sapiens
ucagugauugguuauuuuaggc

SEQ ID NO: 9165 - RNA, 22 nt, Homo sapiens
cuggcaauaggcagugucccaa

SEQ ID NO: 9166 - RNA, 22 nt, Homo sapiens
ugccaugaagagaggaagcagu

SEQ ID NO: 9167 - RNA, 22 nt, Homo sapiens
aacuggugauccacccgccuca

SEQ ID NO: 9168 - RNA, 22 nt, Homo sapiens
ugauacguaggaauuaugggag

SEQ ID NO: 9169 - RNA, 22 nt, Homo sapiens
ucaugaaguaguuaacugguug

SEQ ID NO: 9170 - RNA, 22 nt, Homo sapiens
uggaaguuaaauuaguugauga

SEQ ID NO: 9171 - RNA, 22 nt, Homo sapiens
uauuccacuauuaguccagaug

SEQ ID NO: 9172 - RNA, 22 nt, Homo sapiens
aaugacacugagcaucuuucau

SEQ ID NO: 9173 - RNA, 22 nt, Homo sapiens
uuucagagucaucugcccaagu

SEQ ID NO: 9174 - RNA, 22 nt, Homo sapiens
aauggcuuuuaauauccauaau

SEQ ID NO: 9175 - RNA, 18 nt, Homo sapiens
gugcauagccauggcagc

SEQ ID NO: 9176 - RNA, 22 nt, Homo sapiens
uugaggugaagggcagagcagc

SEQ ID NO: 9177 - RNA, 22 nt, Homo sapiens
cucacuggguguaaaacaugua

SEQ ID NO: 9178 - RNA, 22 nt, Homo sapiens
uggagugagaacuucaaugaug

SEQ ID NO: 9179 - RNA, 22 nt, Homo sapiens
agcauggucacuuugggcccca

SEQ ID NO: 9180 - RNA, 22 nt, Homo sapiens
gggaacauggaaauucugcucu

SEQ ID NO: 9181 - RNA, 22 nt, Homo sapiens
augaaauguaugagucuggguu

SEQ ID NO: 9182 - RNA, 22 nt, Homo sapiens
gaagcgaggugauuagcagaca

SEQ ID NO: 9183 - RNA, 22 nt, Homo sapiens
uuuuaguggacaaagguauuua

SEQ ID NO: 9184 - RNA, 22 nt, Homo sapiens
aauugguuaagauaagaucaua

SEQ ID NO: 9185 - RNA, 22 nt, Homo sapiens
acauguagacaacggacaaagu

SEQ ID NO: 9186 - RNA, 22 nt, Homo sapiens
gguauguaggucuacgguacaa

SEQ ID NO: 9187 - RNA, 22 nt, Homo sapiens
uuggcagcauuccagccaagca

SEQ ID NO: 9188 - RNA, 22 nt, Homo sapiens
augaggugauuucuguucgggu

SEQ ID NO: 9189 - RNA, 22 nt, Homo sapiens
uagcagucuguuaaaacuuuua

SEQ ID NO: 9190 - RNA, 22 nt, Homo sapiens
guggcacaauuaaguagcuauu

SEQ ID NO: 9191 - RNA, 22 nt, Homo sapiens
uacauuggcuagguuuggaggc

SEQ ID NO: 9192 - RNA, 22 nt, Homo sapiens
ugauaugacagcucugcugcca

SEQ ID NO: 9193 - RNA, 22 nt, Homo sapiens
uaucacccuuucauuguucuuc

SEQ ID NO: 9194 - RNA, 22 nt, Homo sapiens
auacaugugccauguucgugug

SEQ ID NO: 9195 - RNA, 21 nt, Homo sapiens
aauacucuagguuaagagagc

SEQ ID NO: 9196 - RNA, 22 nt, Homo sapiens
ucacugaaacuguccuggguua

SEQ ID NO: 9197 - RNA, 22 nt, Homo sapiens
augagauacuacaaaugaguuu

SEQ ID NO: 9198 - RNA, 22 nt, Homo sapiens
ugugagacugguucugaaccca

SEQ ID NO: 9199 - RNA, 22 nt, Homo sapiens
uaaguaguuuucuuggaggcga

SEQ ID NO: 9200 - RNA, 22 nt, Homo sapiens
gauauguacagcucucuaggau

SEQ ID NO: 9201 - RNA, 22 nt, Homo sapiens
augaucacuguggaaauucagc

SEQ ID NO: 9202 - RNA, 22 nt, Homo sapiens
guucaucagggauauuggcuua

SEQ ID NO: 9203 - RNA, 22 nt, Homo sapiens
ugguauguguucuaaaauuaug

SEQ ID NO: 9204 - RNA, 23 nt, Homo sapiens
ugcucgguguugacagucacauc

SEQ ID NO: 9205 - RNA, 19 nt, Homo sapiens
agucaugugaggacccuug

SEQ ID NO: 9206 - RNA, 22 nt, Homo sapiens
ugggaugaugcuugagaauauc

SEQ ID NO: 9207 - RNA, 22 nt, Homo sapiens
uugaguuugaguauucuaaagc

SEQ ID NO: 9208 - RNA, 22 nt, Homo sapiens
cccuggacauucaucauuaugu

SEQ ID NO: 9209 - RNA, 22 nt, Homo sapiens
ucuugucacugcauccccagcu

SEQ ID NO: 9210 - RNA, 22 nt, Homo sapiens
uagguuaucucaaguguaauuu

SEQ ID NO: 9211 - RNA, 23 nt, Homo sapiens
augugguuuuagguguugaacug

SEQ ID NO: 9212 - RNA, 16 nt, Homo sapiens
uucacauggcagcagg

SEQ ID NO: 9213 - RNA, 22 nt, Homo sapiens
uacugcacuccagccugccaac

SEQ ID NO: 9214 - RNA, 22 nt, Homo sapiens
uuaauuguccauuauucuguuc

SEQ ID NO: 9215 - RNA, 22 nt, Homo sapiens
uggaaaucuaaguuuggauuga

SEQ ID NO: 9216 - RNA, 16 nt, Homo sapiens
uacuacugccuauuau

SEQ ID NO: 9217 - RNA, 22 nt, Homo sapiens
uacaggugcucuacagacagga

SEQ ID NO: 9218 - RNA, 22 nt, Homo sapiens
auguaguagcagaaaauauuuu

SEQ ID NO: 9219 - RNA, 22 nt, Homo sapiens
uuugcuuaguaaauguagaaaa

SEQ ID NO: 9220 - RNA, 22 nt, Homo sapiens
gugcaacaugccuggcuaauuu

SEQ ID NO: 9221 - RNA, 22 nt, Homo sapiens
cuuaagcauugacuuuggacag

SEQ ID NO: 9222 - RNA, 17 nt, Homo sapiens
uucucaguucugaucuc

SEQ ID NO: 9223 - RNA, 22 nt, Homo sapiens
gccaguguguguuguucuccgc

SEQ ID NO: 9224 - RNA, 22 nt, Homo sapiens
ugucaccauuuguaggugagga

SEQ ID NO: 9225 - RNA, 22 nt, Homo sapiens
gcaagauuguguggcugaagua

SEQ ID NO: 9226 - RNA, 22 nt, Homo sapiens
gcaaugcugucugugcacagau

SEQ ID NO: 9227 - RNA, 22 nt, Homo sapiens
uuucugggggugcugauggaaa

SEQ ID NO: 9228 - RNA, 22 nt, Homo sapiens
uaucaacaggguggccagugua

SEQ ID NO: 9229 - RNA, 22 nt, Homo sapiens
uguagcagccauaaacacagug

SEQ ID NO: 9230 - RNA, 22 nt, Homo sapiens
uggcuuuuauuauguugaggua

SEQ ID NO: 9231 - RNA, 22 nt, Homo sapiens
ugugaagauggacuaauauagu

SEQ ID NO: 9232 - RNA, 22 nt, Homo sapiens
uuuuacacaucaccgcucgugu

SEQ ID NO: 9233 - RNA, 22 nt, Homo sapiens
uucuugcacuuggcccucauua

SEQ ID NO: 9234 - RNA, 22 nt, Homo sapiens
gggaguguguaggacccagugu

SEQ ID NO: 9235 - RNA, 22 nt, Homo sapiens
ugaauguuugcagcuuauacca

SEQ ID NO: 9236 - RNA, 22 nt, Homo sapiens
uucacuguuaagcaguuaaacu

SEQ ID NO: 9237 - RNA, 22 nt, Homo sapiens
uuaagguaugugggcauuuugu

SEQ ID NO: 9238 - RNA, 22 nt, Homo sapiens
cacugcauggucuagcuggguu

SEQ ID NO: 9239 - RNA, 22 nt, Homo sapiens
gcauauuuuaaaguguaaccug

SEQ ID NO: 9240 - RNA, 22 nt, Homo sapiens
auccugaugacacagugcugca

SEQ ID NO: 9241 - RNA, 22 nt, Homo sapiens
ucauugcauguuaauuaaacag

SEQ ID NO: 9242 - RNA, 22 nt, Homo sapiens
uauggauuugcauuccccaugu

SEQ ID NO: 9243 - RNA, 22 nt, Homo sapiens
auggaaggagaauggucuuuga

SEQ ID NO: 9244 - RNA, 22 nt, Homo sapiens
uucucaaggagccuucguaacu

SEQ ID NO: 9245 - RNA, 22 nt, Homo sapiens
ucauuggcuaagcuuguuacac

SEQ ID NO: 9246 - RNA, 22 nt, Homo sapiens
uuccauugugucaucuuggugg

SEQ ID NO: 9247 - RNA, 22 nt, Homo sapiens
auguaaacuacagauuuugggu

SEQ ID NO: 9248 - RNA, 22 nt, Homo sapiens
uaggucaguuuuggcuuggcuu

SEQ ID NO: 9249 - RNA, 22 nt, Homo sapiens
uggcgagaugcucgugugcaga

SEQ ID NO: 9250 - RNA, 22 nt, Homo sapiens
uugucacuauaaauaagcauuu

SEQ ID NO: 9251 - RNA, 22 nt, Homo sapiens
gucugugguuccuaugucaccu

SEQ ID NO: 9252 - RNA, 22 nt, Homo sapiens
gagagugcuuuggguguaggcc

SEQ ID NO: 9253 - RNA, 22 nt, Homo sapiens
ugaaugguuuuuagagaacaau

SEQ ID NO: 9254 - RNA, 22 nt, Homo sapiens
uuauugcuccagaggcugauuu

SEQ ID NO: 9255 - RNA, 22 nt, Homo sapiens
uaucauaguuuggacuuucauu

SEQ ID NO: 9256 - RNA, 22 nt, Homo sapiens
uuuguucuucguuccugagcca

SEQ ID NO: 9257 - RNA, 22 nt, Homo sapiens
cagcuagcaugcguaacuuucu

SEQ ID NO: 9258 - RNA, 22 nt, Homo sapiens
uaaugcuguggucuaaugggga

SEQ ID NO: 9259 - RNA, 22 nt, Homo sapiens
uuauaggcaggugguguagaug

SEQ ID NO: 9260 - RNA, 22 nt, Homo sapiens
ucuugguuuauugauggagagg

SEQ ID NO: 9261 - RNA, 22 nt, Homo sapiens
aaagugcugggauuggccgggc

SEQ ID NO: 9262 - RNA, 22 nt, Homo sapiens
uuugggccucugauuucuuugg

SEQ ID NO: 9263 - RNA, 21 nt, Homo sapiens
uuucugggggagcauggcagg

SEQ ID NO: 9264 - RNA, 22 nt, Homo sapiens
ucccuguguccugggggcaccu

SEQ ID NO: 9265 - RNA, 22 nt, Homo sapiens
ugacccauagaaauguggauaa

SEQ ID NO: 9266 - RNA, 22 nt, Homo sapiens
gaucacauguguacucaaugug

SEQ ID NO: 9267 - RNA, 19 nt, Homo sapiens
ugacuauagccugaucagu

SEQ ID NO: 9268 - RNA, 22 nt, Homo sapiens
aagugucuuaccgggagggagu

SEQ ID NO: 9269 - RNA, 22 nt, Homo sapiens
uugagacugaacauuuguguac

SEQ ID NO: 9270 - RNA, 22 nt, Homo sapiens
agagaacugauucagggaaaau

SEQ ID NO: 9271 - RNA, 22 nt, Homo sapiens
gaaggagcuuaucugccauuuc

SEQ ID NO: 9272 - RNA, 22 nt, Homo sapiens
uaugggauuucauuaagugucu

SEQ ID NO: 9273 - RNA, 22 nt, Homo sapiens
aucaagcuggcauauguaguuc

SEQ ID NO: 9274 - RNA, 22 nt, Homo sapiens
ugagaugaugggauaagagggc

SEQ ID NO: 9275 - RNA, 22 nt, Homo sapiens
uugaguaguaagaagaugauag

SEQ ID NO: 9276 - RNA, 22 nt, Homo sapiens
aucagcaugcagaagucggggg

SEQ ID NO: 9277 - RNA, 20 nt, Homo sapiens
uaucacaguucaggaacucu

SEQ ID NO: 9278 - RNA, 22 nt, Homo sapiens
gucauguuuaacuucuugagga

SEQ ID NO: 9279 - RNA, 22 nt, Homo sapiens
auguaguauuaaugagagauaa

SEQ ID NO: 9280 - RNA, 21 nt, Homo sapiens
uggucccuucagaucggauuu

SEQ ID NO: 9281 - RNA, 21 nt, Homo sapiens
cauaaugcuacuuauuuuaug

SEQ ID NO: 9282 - RNA, 22 nt, Homo sapiens
gugaagugugaccucagcaucu

SEQ ID NO: 9283 - RNA, 22 nt, Homo sapiens
auggaguguaauauugagagcu

SEQ ID NO: 9284 - RNA, 22 nt, Homo sapiens
ugcaucaggcugcuuauuacaa

SEQ ID NO: 9285 - RNA, 22 nt, Homo sapiens
cugagaucaugggucagguggu

SEQ ID NO: 9286 - RNA, 20 nt, Homo sapiens
cguugcacuccagccugggc

SEQ ID NO: 9287 - RNA, 22 nt, Homo sapiens
cucaaaugguccagcuaguggu

SEQ ID NO: 9288 - RNA, 22 nt, Homo sapiens
uuguaaagucugucucagucag

SEQ ID NO: 9289 - RNA, 22 nt, Homo sapiens
gugcuauguuauccagcaagau

SEQ ID NO: 9290 - RNA, 22 nt, Homo sapiens
uugugucccuacccaaaucuca

SEQ ID NO: 9291 - RNA, 22 nt, Homo sapiens
aaauggcuuuuugggcaaggug

SEQ ID NO: 9292 - RNA, 17 nt, Homo sapiens
guggaaugucaugucaa

SEQ ID NO: 9293 - RNA, 22 nt, Homo sapiens
ugaauguuguugguugagauau

SEQ ID NO: 9294 - RNA, 22 nt, Homo sapiens
uucacugggugugguggcucac

SEQ ID NO: 9295 - RNA, 22 nt, Homo sapiens
guggaguaugaaaacugacuuu

SEQ ID NO: 9296 - RNA, 21 nt, Homo sapiens
ugcauuguugcugagagcagg

SEQ ID NO: 9297 - RNA, 23 nt, Homo sapiens
uuucacagaaggauuguagggcc

SEQ ID NO: 9298 - RNA, 19 nt, Homo sapiens
aggcauugugcucaucugu

SEQ ID NO: 9299 - RNA, 22 nt, Homo sapiens
auauccguacaguggaauauua

SEQ ID NO: 9300 - RNA, 22 nt, Homo sapiens
ucauagucuaagguucuuuugc

SEQ ID NO: 9301 - RNA, 22 nt, Homo sapiens
cuauaguauaguuugaagucag

SEQ ID NO: 9302 - RNA, 22 nt, Homo sapiens
aggauacugguaugggcugaau

SEQ ID NO: 9303 - RNA, 18 nt, Homo sapiens
cucacaguaacuuuuaag

SEQ ID NO: 9304 - RNA, 22 nt, Homo sapiens
guaauagucucaaacuccugga

SEQ ID NO: 9305 - RNA, 22 nt, Homo sapiens
uuguccaagucccauuuguuga

SEQ ID NO: 9306 - RNA, 22 nt, Homo sapiens
uuguacuccagccugggugaca

SEQ ID NO: 9307 - RNA, 23 nt, Homo sapiens
gagaucauucuggaauuagagug

SEQ ID NO: 9308 - RNA, 22 nt, Homo sapiens
uuuggccauaauuuuaauuggc

SEQ ID NO: 9309 - RNA, 22 nt, Homo sapiens
uuagguuguugccauugaaagu

SEQ ID NO: 9310 - RNA, 22 nt, Homo sapiens
uuaguaguugugauagguaccu

SEQ ID NO: 9311 - RNA, 22 nt, Homo sapiens
ucacuagggagaaacugaggcu

SEQ ID NO: 9312 - RNA, 22 nt, Homo sapiens
ucucaaccuccacacuacaaua

SEQ ID NO: 9313 - RNA, 22 nt, Homo sapiens
ucucauugauucuggggugaug

SEQ ID NO: 9314 - RNA, 22 nt, Homo sapiens
acaguacucugcucuuuugauu

SEQ ID NO: 9315 - RNA, 22 nt, Homo sapiens
gugggagugucccguuuuucca

SEQ ID NO: 9316 - RNA, 22 nt, Homo sapiens
guuauguuaguuacaaggcuag

SEQ ID NO: 9317 - RNA, 22 nt, Homo sapiens
ugccaguauuuuguugaggauu

SEQ ID NO: 9318 - RNA, 22 nt, Homo sapiens
caugaacacugugcggcuuccu

SEQ ID NO: 9319 - RNA, 22 nt, Homo sapiens
augaccaugauccuugccgacc

SEQ ID NO: 9320 - RNA, 22 nt, Homo sapiens
gucaugucugcacauaguaaaa

SEQ ID NO: 9321 - RNA, 22 nt, Homo sapiens
ccuugguugugcuucaacuucu

SEQ ID NO: 9322 - RNA, 23 nt, Homo sapiens
uaguaccauauuguuggcagcac

SEQ ID NO: 9323 - RNA, 22 nt, Homo sapiens
uucuugguuggcaaccaacagu

SEQ ID NO: 9324 - RNA, 22 nt, Homo sapiens
uugauaagaaaaauauaccaga

SEQ ID NO: 9325 - RNA, 22 nt, Homo sapiens
auagcagcauauguaauguuga

SEQ ID NO: 9326 - RNA, 22 nt, Homo sapiens
uagcaguuguuguuacuuguau

SEQ ID NO: 9327 - RNA, 17 nt, Homo sapiens
aaguggcuuguucacca

SEQ ID NO: 9328 - RNA, 22 nt, Homo sapiens
caguguaugcuucuauuuuugg

SEQ ID NO: 9329 - RNA, 22 nt, Homo sapiens
uaagugaaggaaguguguuuac

SEQ ID NO: 9330 - RNA, 23 nt, Homo sapiens
ggaaugaaaccugguuaugauau

SEQ ID NO: 9331 - RNA, 22 nt, Homo sapiens
auuaaggaguggguucauggug

SEQ ID NO: 9332 - RNA, 22 nt, Homo sapiens
ugcaguguucuuuagaggaaau

SEQ ID NO: 9333 - RNA, 22 nt, Homo sapiens
augagacuguucuuccucauug

SEQ ID NO: 9334 - RNA, 22 nt, Homo sapiens
uuauugcuuaugauuagguguu

SEQ ID NO: 9335 - RNA, 22 nt, Homo sapiens
uuaucacauugacugauuugca

SEQ ID NO: 9336 - RNA, 22 nt, Homo sapiens
ggaggcuaguaaaaagguagaa

SEQ ID NO: 9337 - RNA, 22 nt, Homo sapiens
agucaguggaguaaauguaauu

SEQ ID NO: 9338 - RNA, 22 nt, Homo sapiens
aaaguucuguugauagugcuga

SEQ ID NO: 9339 - RNA, 22 nt, Homo sapiens
gcugcacuuuaaggcauccccu

SEQ ID NO: 9340 - RNA, 22 nt, Homo sapiens
ugaaaaguuguugaaggcuuca

SEQ ID NO: 9341 - RNA, 22 nt, Homo sapiens
uggcaagagauaugugucuaua

SEQ ID NO: 9342 - RNA, 22 nt, Homo sapiens
uugauauguggaauauuuaucu

SEQ ID NO: 9343 - RNA, 20 nt, Homo sapiens
ucaguauauuguuuccacag

SEQ ID NO: 9344 - RNA, 22 nt, Homo sapiens
acacugucugaugaaaguaguu

SEQ ID NO: 9345 - RNA, 22 nt, Homo sapiens
cuguaagcauuauaaagagaua

SEQ ID NO: 9346 - RNA, 22 nt, Homo sapiens
auuccauuuguuaucacacccg

SEQ ID NO: 9347 - RNA, 22 nt, Homo sapiens
uagugcugugauauuuuuggcc

SEQ ID NO: 9348 - RNA, 22 nt, Homo sapiens
agucaagugggguuagauaguu

SEQ ID NO: 9349 - RNA, 22 nt, Homo sapiens
uaugacuguuugcucauucagg

SEQ ID NO: 9350 - RNA, 22 nt, Homo sapiens
ugagaugauagauauguuaauu

SEQ ID NO: 9351 - RNA, 22 nt, Homo sapiens
agaaugucaguauuggcuaaaa

SEQ ID NO: 9352 - RNA, 22 nt, Homo sapiens
uuaauagcaaagaguuuagacu

SEQ ID NO: 9353 - RNA, 22 nt, Homo sapiens
cugacuuuagaacccaaaaagu

SEQ ID NO: 9354 - RNA, 22 nt, Homo sapiens
uucuuuaguucacuugcuccag

SEQ ID NO: 9355 - RNA, 22 nt, Homo sapiens
uauuccauuugugaaaggaagu

SEQ ID NO: 9356 - RNA, 22 nt, Homo sapiens
uccuugagccucccagacucag

SEQ ID NO: 9357 - RNA, 20 nt, Homo sapiens
acaguauguuuggaugcaua

SEQ ID NO: 9358 - RNA, 22 nt, Homo sapiens
cuaaggcaguagccugaauaau

SEQ ID NO: 9359 - RNA, 19 nt, Homo sapiens
uggaacauaaaaguugguu

SEQ ID NO: 9360 - RNA, 22 nt, Homo sapiens
ucaccggcagacguggccugau

SEQ ID NO: 9361 - RNA, 22 nt, Homo sapiens
ucagaucauauucuucgcugcu

SEQ ID NO: 9362 - RNA, 22 nt, Homo sapiens
aaggcaugcugaguccuaaaag

SEQ ID NO: 9363 - RNA, 22 nt, Homo sapiens
ucacagucugcgugaugagaca

SEQ ID NO: 9364 - RNA, 22 nt, Homo sapiens
gucucccaaccccugugcccag

SEQ ID NO: 9365 - RNA, 22 nt, Homo sapiens
uugagauggagucucgcacugu

SEQ ID NO: 9366 - RNA, 22 nt, Homo sapiens
aucuccaggugccagcugcgcc

SEQ ID NO: 9367 - RNA, 22 nt, Homo sapiens
uggagguagagaugggaucucc

SEQ ID NO: 9368 - RNA, 22 nt, Homo sapiens
augguaucauuacuguuuuauu

SEQ ID NO: 9369 - RNA, 22 nt, Homo sapiens
ugauaauuuugucagguuuugg

SEQ ID NO: 9370 - RNA, 22 nt, Homo sapiens
cccucgagaaaccaucugcuga

SEQ ID NO: 9371 - RNA, 22 nt, Homo sapiens
guacuuuguuauaacccacagg

SEQ ID NO: 9372 - RNA, 22 nt, Homo sapiens
aucaaguaguuauacguaaagg

SEQ ID NO: 9373 - RNA, 22 nt, Homo sapiens
guaucaugaaguuucuucauuu

SEQ ID NO: 9374 - RNA, 22 nt, Homo sapiens
ggcauguaauuauucaaagugg

SEQ ID NO: 9375 - RNA, 21 nt, Homo sapiens
uaaagcuagaaccuuagcuuu

SEQ ID NO: 9376 - RNA, 22 nt, Homo sapiens
cugugcaaguuauaggccaggu

SEQ ID NO: 9377 - RNA, 22 nt, Homo sapiens
gcaccauugacaagaaauaggu

SEQ ID NO: 9378 - RNA, 22 nt, Homo sapiens
uugauagacaucugaguuguug

SEQ ID NO: 9379 - RNA, 18 nt, Homo sapiens
agagcacugaguuuuaga

SEQ ID NO: 9380 - RNA, 20 nt, Homo sapiens
uaaguuguauuugucaugaa

SEQ ID NO: 9381 - RNA, 22 nt, Homo sapiens
auguuaagauggaacaugggaa

SEQ ID NO: 9382 - RNA, 22 nt, Homo sapiens
agcagguguggcuuauccugaa

SEQ ID NO: 9383 - RNA, 22 nt, Homo sapiens
aauacagcacacagaugggucu

SEQ ID NO: 9384 - RNA, 22 nt, Homo sapiens
ugccuacugagacuggguggcc

SEQ ID NO: 9385 - RNA, 22 nt, Homo sapiens
uggcaacaucuggggacauguu

SEQ ID NO: 9386 - RNA, 22 nt, Homo sapiens
auacuaugagauaauaaagacu

SEQ ID NO: 9387 - RNA, 22 nt, Homo sapiens
aaucacaguguucuugugaggg

SEQ ID NO: 9388 - RNA, 22 nt, Homo sapiens
augauacuguucuaagauuuuu

SEQ ID NO: 9389 - RNA, 22 nt, Homo sapiens
gcagcacauggcagaacauauu

SEQ ID NO: 9390 - RNA, 22 nt, Homo sapiens
guucaaggaauguuggcuucuc

SEQ ID NO: 9391 - RNA, 22 nt, Homo sapiens
gaauagugcugcgauaaacaua

SEQ ID NO: 9392 - RNA, 22 nt, Homo sapiens
acugcacuccaccuugggcaac

SEQ ID NO: 9393 - RNA, 22 nt, Homo sapiens
uuugcagagucuuucgcugggc

SEQ ID NO: 9394 - RNA, 22 nt, Homo sapiens
cuuggcuugguaucaaauaacc

SEQ ID NO: 9395 - RNA, 22 nt, Homo sapiens
uaauacuguaauggugguuccg

SEQ ID NO: 9396 - RNA, 22 nt, Homo sapiens
auagcacuuauagauuuggucu

SEQ ID NO: 9397 - RNA, 22 nt, Homo sapiens
gaggcauugaagauauggaagu

SEQ ID NO: 9398 - RNA, 22 nt, Homo sapiens
cucauuggucagacgcgucggu

SEQ ID NO: 9399 - RNA, 22 nt, Homo sapiens
uggaaauaaaauagaguuugcc

SEQ ID NO: 9400 - RNA, 22 nt, Homo sapiens
ggacugucagggcuauuaguca

SEQ ID NO: 9401 - RNA, 22 nt, Homo sapiens
uguaaggcaguuagagcaaauu

SEQ ID NO: 9402 - RNA, 22 nt, Homo sapiens
auagugcugugaugaacauaca

SEQ ID NO: 9403 - RNA, 22 nt, Homo sapiens
gaggcagucugucccuuagcag

SEQ ID NO: 9404 - RNA, 22 nt, Homo sapiens
uuccagaugggaguucuauucu

SEQ ID NO: 9405 - RNA, 22 nt, Homo sapiens
ugagacaucucuccugagacag

SEQ ID NO: 9406 - RNA, 22 nt, Homo sapiens
augaacucaucauuuuuugugg

SEQ ID NO: 9407 - RNA, 22 nt, Homo sapiens
uguuauguuuuagagguuucaa

SEQ ID NO: 9408 - RNA, 22 nt, Homo sapiens
uaucaccuugcaggagcuauga

SEQ ID NO: 9409 - RNA, 22 nt, Homo sapiens
cugugguauuauuagaaauauc

SEQ ID NO: 9410 - RNA, 22 nt, Homo sapiens
uaucaaacccaaggaggggguu

SEQ ID NO: 9411 - RNA, 22 nt, Homo sapiens
uggugcaaugaagugaucucaa

SEQ ID NO: 9412 - RNA, 22 nt, Homo sapiens
gacaaguuugauuuauuccaag

SEQ ID NO: 9413 - RNA, 22 nt, Homo sapiens
ugagagaugauaaaauguuugu

SEQ ID NO: 9414 - RNA, 22 nt, Homo sapiens
uugagcuagggagaucgagguc

SEQ ID NO: 9415 - RNA, 22 nt, Homo sapiens
ugaugcugaugccugccagaag

SEQ ID NO: 9416 - RNA, 18 nt, Homo sapiens
gcuguugucagagcacau

SEQ ID NO: 9417 - RNA, 22 nt, Homo sapiens
uuggcauagaggcucucaagcu

SEQ ID NO: 9418 - RNA, 23 nt, Homo sapiens
uuugugcuaauuuaugggcucuu

SEQ ID NO: 9419 - RNA, 22 nt, Homo sapiens
guauacaguugacccuugaacc

SEQ ID NO: 9420 - RNA, 22 nt, Homo sapiens
agcagguauucgggucaugggg

SEQ ID NO: 9421 - RNA, 22 nt, Homo sapiens
gaguuagguugucaaugucuua

SEQ ID NO: 9422 - RNA, 22 nt, Homo sapiens
uuuggucuuuuauuuaaagcag

SEQ ID NO: 9423 - RNA, 22 nt, Homo sapiens
uaaaccacguuuacauuugaga

SEQ ID NO: 9424 - RNA, 22 nt, Homo sapiens
aguuuugguugaguuacuagca

SEQ ID NO: 9425 - RNA, 22 nt, Homo sapiens
uggucucuuugcuuuagucauc

SEQ ID NO: 9426 - RNA, 22 nt, Homo sapiens
cucacaguucuaaaggcaagaa

SEQ ID NO: 9427 - RNA, 22 nt, Homo sapiens
cuuuggcauuagccuguauaga

SEQ ID NO: 9428 - RNA, 22 nt, Homo sapiens
gaacuguaaagaaauucuaagg

SEQ ID NO: 9429 - RNA, 22 nt, Homo sapiens
uacugcugucagugccaaguag

SEQ ID NO: 9430 - RNA, 22 nt, Homo sapiens
caugccacugcacuccaaccug

SEQ ID NO: 9431 - RNA, 20 nt, Homo sapiens
agcaucacagagccgggugu

SEQ ID NO: 9432 - RNA, 20 nt, Homo sapiens
uaagccacacagucuaaggu

SEQ ID NO: 9433 - RNA, 22 nt, Homo sapiens
cacugcauccuugaccuucugg

SEQ ID NO: 9434 - RNA, 21 nt, Homo sapiens
agaggacugaccacagcccua

SEQ ID NO: 9435 - RNA, 22 nt, Homo sapiens
ucagucuuuuuuuggcaagcau

SEQ ID NO: 9436 - RNA, 22 nt, Homo sapiens
ccuucauugcaucuuuaagaga

SEQ ID NO: 9437 - RNA, 22 nt, Homo sapiens
uggucaguugaguccuugccaa

SEQ ID NO: 9438 - RNA, 22 nt, Homo sapiens
ugagagacaguuuguuaaaauu

SEQ ID NO: 9439 - RNA, 22 nt, Homo sapiens
gugcaauucacuguuaugucug

SEQ ID NO: 9440 - RNA, 22 nt, Homo sapiens
cccuguguuuagcugaagguuu

SEQ ID NO: 9441 - RNA, 22 nt, Homo sapiens
agugccaaaucgagggcucuga

SEQ ID NO: 9442 - RNA, 22 nt, Homo sapiens
aacagugcauuccuguccauau

SEQ ID NO: 9443 - RNA, 22 nt, Homo sapiens
agcugguauuuugucaaggaua

SEQ ID NO: 9444 - RNA, 22 nt, Homo sapiens
uucaguaguacauucccguguu

SEQ ID NO: 9445 - RNA, 18 nt, Homo sapiens
guaggucaguaccaagca

SEQ ID NO: 9446 - RNA, 22 nt, Homo sapiens
ugugccacugcacuccugccug

SEQ ID NO: 9447 - RNA, 22 nt, Homo sapiens
gccauugcacuccagccucggc

SEQ ID NO: 9448 - RNA, 17 nt, Homo sapiens
aaugagacauuucugcu

SEQ ID NO: 9449 - RNA, 20 nt, Homo sapiens
aaaguaggcuaauaccaaaa

SEQ ID NO: 9450 - RNA, 22 nt, Homo sapiens
uugugaaaaaccucucguggaa

SEQ ID NO: 9451 - RNA, 22 nt, Homo sapiens
ccggguguuuuguucucucaga

SEQ ID NO: 9452 - RNA, 22 nt, Homo sapiens
gaugccuauugcuaguccuaaa

SEQ ID NO: 9453 - RNA, 22 nt, Homo sapiens
ucugugguucaggcuggagugc

SEQ ID NO: 9454 - RNA, 22 nt, Homo sapiens
uucccugaaauauucacuuuca

SEQ ID NO: 9455 - RNA, 23 nt, Homo sapiens
uuuguaguagcaugauuuauaau

SEQ ID NO: 9456 - RNA, 22 nt, Homo sapiens
uuuguacuugaagaaucuuuau

SEQ ID NO: 9457 - RNA, 20 nt, Homo sapiens
agcaucguuguguuauagcc

SEQ ID NO: 9458 - RNA, 22 nt, Homo sapiens
auugcuuacccuguauuagauc

SEQ ID NO: 9459 - RNA, 22 nt, Homo sapiens
uucagacugggugaagagggua

SEQ ID NO: 9460 - RNA, 22 nt, Homo sapiens
uacaggcaccuggcuaauuuuu

SEQ ID NO: 9461 - RNA, 22 nt, Homo sapiens
ugcauaauuccuugcaccagaa

SEQ ID NO: 9462 - RNA, 22 nt, Homo sapiens
ucccugaaucucagguucugua

SEQ ID NO: 9463 - RNA, 21 nt, Homo sapiens
ugagcauuaguacaguaggga

SEQ ID NO: 9464 - RNA, 22 nt, Homo sapiens
uaagugaauuucacuacugagu

SEQ ID NO: 9465 - RNA, 22 nt, Homo sapiens
accccuuacaucagcucuggua

SEQ ID NO: 9466 - RNA, 22 nt, Homo sapiens
ugugaauggugcugccgugaag

SEQ ID NO: 9467 - RNA, 22 nt, Homo sapiens
guagcagaacauguuccuugua

SEQ ID NO: 9468 - RNA, 19 nt, Homo sapiens
ucuugcacaugugaacuca

SEQ ID NO: 9469 - RNA, 22 nt, Homo sapiens
cucagauacuugggagguugag

SEQ ID NO: 9470 - RNA, 22 nt, Homo sapiens
aucugguguuuccuucacauug

SEQ ID NO: 9471 - RNA, 22 nt, Homo sapiens
aagguguagucucuggauaagc

SEQ ID NO: 9472 - RNA, 22 nt, Homo sapiens
gucaugcaggguucgccagccc

SEQ ID NO: 9473 - RNA, 19 nt, Homo sapiens
auaaacuagaacugucccc

SEQ ID NO: 9474 - RNA, 17 nt, Homo sapiens
uuuuggauuagaaaucc

SEQ ID NO: 9475 - RNA, 22 nt, Homo sapiens
ucaucagugcuugcaaauuauu

SEQ ID NO: 9476 - RNA, 22 nt, Homo sapiens
ugagugugacuuagcagaagga

SEQ ID NO: 9477 - RNA, 22 nt, Homo sapiens
gguauguagugugaaguaggga

SEQ ID NO: 9478 - RNA, 22 nt, Homo sapiens
accauugcacuccuuucugggc

SEQ ID NO: 9479 - RNA, 22 nt, Homo sapiens
uaauaauguuaggcuuacucaa

SEQ ID NO: 9480 - RNA, 22 nt, Homo sapiens
gucagugcauguaaacauaaaa

SEQ ID NO: 9481 - RNA, 20 nt, Homo sapiens
acugcauuuaguccucagga

SEQ ID NO: 9482 - RNA, 17 nt, Homo sapiens
aaaguccuuugcuaucu

SEQ ID NO: 9483 - RNA, 22 nt, Homo sapiens
uugcccuuuagguaacuauaua

SEQ ID NO: 9484 - RNA, 21 nt, Homo sapiens
ucagcucaucacugccuggag

SEQ ID NO: 9485 - RNA, 22 nt, Homo sapiens
auacaaguuauuugaacugcgg

SEQ ID NO: 9486 - RNA, 22 nt, Homo sapiens
ucugguggugaugagagacagu

SEQ ID NO: 9487 - RNA, 22 nt, Homo sapiens
gagguaaguaagaauggcaagc

SEQ ID NO: 9488 - RNA, 22 nt, Homo sapiens
ucaaaugcacguagagaaaaua

SEQ ID NO: 9489 - RNA, 22 nt, Homo sapiens
guguauguuguccauggaugcg

SEQ ID NO: 9490 - RNA, 22 nt, Homo sapiens
ucaacauugcugucaggcaucu

SEQ ID NO: 9491 - RNA, 22 nt, Homo sapiens
uuaggcuuuauugaaaacaaua

SEQ ID NO: 9492 - RNA, 22 nt, Homo sapiens
ugcaacacauugccccugcucu

SEQ ID NO: 9493 - RNA, 18 nt, Homo sapiens
ucuuuggcugaacuguag

SEQ ID NO: 9494 - RNA, 22 nt, Homo sapiens
uugaauagaagguuuuuuguuc

SEQ ID NO: 9495 - RNA, 22 nt, Homo sapiens
ucuauugguugaaauugcuuuu

SEQ ID NO: 9496 - RNA, 22 nt, Homo sapiens
acugcacuccaguuugggcagc

SEQ ID NO: 9497 - RNA, 22 nt, Homo sapiens
uuugccacugcaggcuguuuaa

SEQ ID NO: 9498 - RNA, 22 nt, Homo sapiens
ggaaguuaauacagauagagua

SEQ ID NO: 9499 - RNA, 22 nt, Homo sapiens
ugagauguagauauggauuaga

SEQ ID NO: 9500 - RNA, 22 nt, Homo sapiens
uaaguuagugugagaauuuugc

SEQ ID NO: 9501 - RNA, 22 nt, Homo sapiens
gugagccaugauuuuaccacug

SEQ ID NO: 9502 - RNA, 21 nt, Homo sapiens
ugcagugugguugcccugcug

SEQ ID NO: 9503 - RNA, 22 nt, Homo sapiens
gugcacaacaugcaguuuuguu

SEQ ID NO: 9504 - RNA, 22 nt, Homo sapiens
ugugcacauaacauuuuuuuag

SEQ ID NO: 9505 - RNA, 22 nt, Homo sapiens
gacuugaagaaucuaagggagg

SEQ ID NO: 9506 - RNA, 22 nt, Homo sapiens
gagaucaaugccuauggcuuuc

SEQ ID NO: 9507 - RNA, 22 nt, Homo sapiens
uuguauguuucugugcacauga

SEQ ID NO: 9508 - RNA, 22 nt, Homo sapiens
aagugcuuuguacagggguuga

SEQ ID NO: 9509 - RNA, 18 nt, Homo sapiens
uuuugcuuaacugcgcca

SEQ ID NO: 9510 - RNA, 22 nt, Homo sapiens
aagcucuuguugaaucuuguca

SEQ ID NO: 9511 - RNA, 17 nt, Homo sapiens
ugagcuaugauccuguc

SEQ ID NO: 9512 - RNA, 22 nt, Homo sapiens
caaauugcuugucuguagugga

SEQ ID NO: 9513 - RNA, 20 nt, Homo sapiens
uugccgagagaaagguguua

SEQ ID NO: 9514 - RNA, 22 nt, Homo sapiens
gugggcaagucacuucaguucu

SEQ ID NO: 9515 - RNA, 22 nt, Homo sapiens
ugccaguuuuuacauuuccugu

SEQ ID NO: 9516 - RNA, 22 nt, Homo sapiens
uugcaaggugcagcuuaugcaa

SEQ ID NO: 9517 - RNA, 21 nt, Homo sapiens
auccuucuuuuucaaccugug

SEQ ID NO: 9518 - RNA, 22 nt, Homo sapiens
gugcaagagugauugcaguuuu

SEQ ID NO: 9519 - RNA, 22 nt, Homo sapiens
uucuguguuuaggucacggcua

SEQ ID NO: 9520 - RNA, 22 nt, Homo sapiens
gucaugaaguuuugaaugaaau

SEQ ID NO: 9521 - RNA, 22 nt, Homo sapiens
ucacacugucuugguuacucuu

SEQ ID NO: 9522 - RNA, 22 nt, Homo sapiens
augacaguaugacuccaaaagu

SEQ ID NO: 9523 - RNA, 22 nt, Homo sapiens
gagcuacacugauucauuuguu

SEQ ID NO: 9524 - RNA, 22 nt, Homo sapiens
aagugcuucagaagacaauauu

SEQ ID NO: 9525 - RNA, 22 nt, Homo sapiens
aagcuggauuuaguguggagca

SEQ ID NO: 9526 - RNA, 19 nt, Homo sapiens
ucagcaguaaucaacuuca

SEQ ID NO: 9527 - RNA, 22 nt, Homo sapiens
uagaaucuaacucgcaugaaaa

SEQ ID NO: 9528 - RNA, 22 nt, Homo sapiens
aauggccacugaccuguguuga

SEQ ID NO: 9529 - RNA, 22 nt, Homo sapiens
uggcaaaaaaacgcaauuacgu

SEQ ID NO: 9530 - RNA, 22 nt, Homo sapiens
augagaauguaaguuaaugaaa

SEQ ID NO: 9531 - RNA, 22 nt, Homo sapiens
ugacauguccaggugguccugu

SEQ ID NO: 9532 - RNA, 22 nt, Homo sapiens
uaucacaguaucuagcacagug

SEQ ID NO: 9533 - RNA, 22 nt, Homo sapiens
gaugcaguaagaaugcauagcg

SEQ ID NO: 9534 - RNA, 22 nt, Homo sapiens
cuguuaacauguuguggauaau

SEQ ID NO: 9535 - RNA, 20 nt, Homo sapiens
uugcacagagaaggaggcag

SEQ ID NO: 9536 - RNA, 22 nt, Homo sapiens
uaacaccuuugauagcacuuuu

SEQ ID NO: 9537 - RNA, 22 nt, Homo sapiens
aguucaauggguuuucacucau

SEQ ID NO: 9538 - RNA, 22 nt, Homo sapiens
cucagcuacuugggaagcugag

SEQ ID NO: 9539 - RNA, 22 nt, Homo sapiens
uugucaccucuaaaucucauau

SEQ ID NO: 9540 - RNA, 22 nt, Homo sapiens
uugugcuugauuugccuagcug

SEQ ID NO: 9541 - RNA, 22 nt, Homo sapiens
ggagugucagaaacaguguccu

SEQ ID NO: 9542 - RNA, 22 nt, Homo sapiens
ugcaccacugcacuucagccug

SEQ ID NO: 9543 - RNA, 18 nt, Homo sapiens
uggaauguuuggguuaau

SEQ ID NO: 9544 - RNA, 22 nt, Homo sapiens
augaucuguagaacuaguccuu

SEQ ID NO: 9545 - RNA, 22 nt, Homo sapiens
aauaaagcagcuuuuugggacu

SEQ ID NO: 9546 - RNA, 22 nt, Homo sapiens
acccucagaccaguuucccugg

SEQ ID NO: 9547 - RNA, 22 nt, Homo sapiens
uagguuaugauccaucuuggcu

SEQ ID NO: 9548 - RNA, 22 nt, Homo sapiens
aguaaacuucagaguucuuccu

SEQ ID NO: 9549 - RNA, 22 nt, Homo sapiens
uguccugaagcuuuguuaugua

SEQ ID NO: 9550 - RNA, 22 nt, Homo sapiens
ucacacugaauuugaagcaaug

SEQ ID NO: 9551 - RNA, 22 nt, Homo sapiens
augacugagacuaacuuacuuu

SEQ ID NO: 9552 - RNA, 20 nt, Homo sapiens
cucugguugugaauugucuu

SEQ ID NO: 9553 - RNA, 22 nt, Homo sapiens
caucagauugagaucaucuaag

SEQ ID NO: 9554 - RNA, 22 nt, Homo sapiens
ucugugguaagaaacgcauguc

SEQ ID NO: 9555 - RNA, 22 nt, Homo sapiens
cugauaaguuuuucuuuauaag

SEQ ID NO: 9556 - RNA, 22 nt, Homo sapiens
caguggacuaaauggggaauau

SEQ ID NO: 9557 - RNA, 22 nt, Homo sapiens
caucccugaaccccagaaaucu

SEQ ID NO: 9558 - RNA, 22 nt, Homo sapiens
uuuagcagcaaagagccaugcu

SEQ ID NO: 9559 - RNA, 21 nt, Homo sapiens
uggaauguucugacuucaggg

SEQ ID NO: 9560 - RNA, 22 nt, Homo sapiens
ucucugauuauugcauuucauu

SEQ ID NO: 9561 - RNA, 22 nt, Homo sapiens
uguaaaucuauuuuuaguguuu

SEQ ID NO: 9562 - RNA, 22 nt, Homo sapiens
cauuccacauguaggacaauuu

SEQ ID NO: 9563 - RNA, 22 nt, Homo sapiens
auucacagggggagaaggguau

SEQ ID NO: 9564 - RNA, 22 nt, Homo sapiens
ccucuuuguugagacuucacca

SEQ ID NO: 9565 - RNA, 23 nt, Homo sapiens
gcaaauaucguagagugucccug

SEQ ID NO: 9566 - RNA, 22 nt, Homo sapiens
aagugcucuugugggaagagag

SEQ ID NO: 9567 - RNA, 22 nt, Homo sapiens
gauagguagaagauguuuucau

SEQ ID NO: 9568 - RNA, 22 nt, Homo sapiens
uaucacaguugcauauuuaagg

SEQ ID NO: 9569 - RNA, 22 nt, Homo sapiens
uuuuguacaacagcucugggga

SEQ ID NO: 9570 - RNA, 22 nt, Homo sapiens
uggcaguuucauaugguucaac

SEQ ID NO: 9571 - RNA, 22 nt, Homo sapiens
aaaugcuucuauguggcauguu

SEQ ID NO: 9572 - RNA, 22 nt, Homo sapiens
gaucuguuuuccuauuguuugu

SEQ ID NO: 9573 - RNA, 22 nt, Homo sapiens
uaggcaauguacauaucggccc

SEQ ID NO: 9574 - RNA, 22 nt, Homo sapiens
auauagcucuggcuggaugacu

SEQ ID NO: 9575 - RNA, 22 nt, Homo sapiens
uaaguuguugacauuaggggaa

SEQ ID NO: 9576 - RNA, 22 nt, Homo sapiens
aaaguguguuuccaaccugugg

SEQ ID NO: 9577 - RNA, 22 nt, Homo sapiens
acugcacuccagccuuggcaac

SEQ ID NO: 9578 - RNA, 22 nt, Homo sapiens
gcucugguuacaaaggcaaauu

SEQ ID NO: 9579 - RNA, 22 nt, Homo sapiens
augaaugcaucuaucaaagcau

SEQ ID NO: 9580 - RNA, 22 nt, Homo sapiens
acucugucuaguuguaaaauuu

SEQ ID NO: 9581 - RNA, 22 nt, Homo sapiens
uuggaaugcaacagaaggauaa

SEQ ID NO: 9582 - RNA, 20 nt, Homo sapiens
ucagugcagauuguccaagu

SEQ ID NO: 9583 - RNA, 22 nt, Homo sapiens
ugugcaaauuagcacaacccga

SEQ ID NO: 9584 - RNA, 22 nt, Homo sapiens
uggcauggggcagaacauuaca

SEQ ID NO: 9585 - RNA, 22 nt, Homo sapiens
ggaagacuuagaguagcaucag

SEQ ID NO: 9586 - RNA, 22 nt, Homo sapiens
uugugaauggaguagcaggauc

SEQ ID NO: 9587 - RNA, 22 nt, Homo sapiens
acuguacucuacccugggcaac

SEQ ID NO: 9588 - RNA, 22 nt, Homo sapiens
ggaucacugugaaccgugucag

SEQ ID NO: 9589 - RNA, 22 nt, Homo sapiens
aaguauuagugaggauauggaa

SEQ ID NO: 9590 - RNA, 22 nt, Homo sapiens
uuaguugcauucaugugagagu

SEQ ID NO: 9591 - RNA, 22 nt, Homo sapiens
gugaucuucauggaaggugaaa

SEQ ID NO: 9592 - RNA, 22 nt, Homo sapiens
ugguuccauauuaauuuuagga

SEQ ID NO: 9593 - RNA, 22 nt, Homo sapiens
gugucaguggggagugaucuuc

SEQ ID NO: 9594 - RNA, 22 nt, Homo sapiens
uugguaaucccuagugucuaga

SEQ ID NO: 9595 - RNA, 22 nt, Homo sapiens
guacucuggaguaggccuaauu

SEQ ID NO: 9596 - RNA, 23 nt, Homo sapiens
ucaugaggccauucaaauccauu

SEQ ID NO: 9597 - RNA, 20 nt, Homo sapiens
gugauuggucacugguuguu

SEQ ID NO: 9598 - RNA, 22 nt, Homo sapiens
guguugcacauucuguggaugu

SEQ ID NO: 9599 - RNA, 18 nt, Homo sapiens
ugucccuuugcuguucau

SEQ ID NO: 9600 - RNA, 23 nt, Homo sapiens
auuccaguggcaauuggagaaac

SEQ ID NO: 9601 - RNA, 22 nt, Homo sapiens
uucagcacugaaaauaugucau

SEQ ID NO: 9602 - RNA, 22 nt, Homo sapiens
agcugguaguuuucuaguguuu

SEQ ID NO: 9603 - RNA, 20 nt, Homo sapiens
cuggaugucgaggcagaggu

SEQ ID NO: 9604 - RNA, 22 nt, Homo sapiens
cugccuagaucugaaccuggcu

SEQ ID NO: 9605 - RNA, 22 nt, Homo sapiens
aagcaugguuuccaggggucac

SEQ ID NO: 9606 - RNA, 22 nt, Homo sapiens
aucacauuuauaguggcacgca

SEQ ID NO: 9607 - RNA, 22 nt, Homo sapiens
augaaugcagcacuguuuuucu

SEQ ID NO: 9608 - RNA, 18 nt, Homo sapiens
uguuugguucugcgccuc

SEQ ID NO: 9609 - RNA, 22 nt, Homo sapiens
aauggcucuuuaggcaauagau

SEQ ID NO: 9610 - RNA, 23 nt, Homo sapiens
agggcacuauagauguuauucua

SEQ ID NO: 9611 - RNA, 22 nt, Homo sapiens
augaggacaucuuccuuaugga

SEQ ID NO: 9612 - RNA, 21 nt, Homo sapiens
ugaauacugcugcucccuuug

SEQ ID NO: 9613 - RNA, 22 nt, Homo sapiens
uugagcucuuccagccuggagc

SEQ ID NO: 9614 - RNA, 22 nt, Homo sapiens
auaaggaguaucauauuaaaac

SEQ ID NO: 9615 - RNA, 22 nt, Homo sapiens
guggaauuauagagacaucuug

SEQ ID NO: 9616 - RNA, 23 nt, Homo sapiens
aggcauuguacaguaauggaaaa

SEQ ID NO: 9617 - RNA, 22 nt, Homo sapiens
aaagugcugggaucacacugaa

SEQ ID NO: 9618 - RNA, 21 nt, Homo sapiens
uuggggaauggagagguuuuc

SEQ ID NO: 9619 - RNA, 19 nt, Homo sapiens
uggagauauccccuucaca

SEQ ID NO: 9620 - RNA, 22 nt, Homo sapiens
gaaugucuuauugcucguugua

SEQ ID NO: 9621 - RNA, 22 nt, Homo sapiens
cugagaagaaacagguaaggac

SEQ ID NO: 9622 - RNA, 22 nt, Homo sapiens
auacaguugccauuucuugugc

SEQ ID NO: 9623 - RNA, 22 nt, Homo sapiens
ugcaacauguguaccacucugu

SEQ ID NO: 9624 - RNA, 22 nt, Homo sapiens
ggcagcucaggccccgcgcuga

SEQ ID NO: 9625 - RNA, 22 nt, Homo sapiens
auagcacaguguguguacacca

SEQ ID NO: 9626 - RNA, 22 nt, Homo sapiens
ucuacccugugagggacacagu

SEQ ID NO: 9627 - RNA, 22 nt, Homo sapiens
cuuuugugauuccucaguuacu

SEQ ID NO: 9628 - RNA, 22 nt, Homo sapiens
agucaugggagagaugugaucg

SEQ ID NO: 9629 - RNA, 22 nt, Homo sapiens
auuguaauuuuagagaaagugg

SEQ ID NO: 9630 - RNA, 22 nt, Homo sapiens
ugauaggucacucaacagugag

SEQ ID NO: 9631 - RNA, 22 nt, Homo sapiens
uuccagagucaccuuucugucg

SEQ ID NO: 9632 - RNA, 22 nt, Homo sapiens
ugagaacuguuuugguuugggu

SEQ ID NO: 9633 - RNA, 22 nt, Homo sapiens
uggagacaaagauagaaaagca

SEQ ID NO: 9634 - RNA, 22 nt, Homo sapiens
aauagugcugcaaaaacauacg

SEQ ID NO: 9635 - RNA, 20 nt, Homo sapiens
aagagcucaccagaauaucu

SEQ ID NO: 9636 - RNA, 22 nt, Homo sapiens
uugggguagaauugcaacauau

SEQ ID NO: 9637 - RNA, 22 nt, Homo sapiens
uugagauggagcuucacucuug

SEQ ID NO: 9638 - RNA, 22 nt, Homo sapiens
uucgucaugagacagaugcuga

SEQ ID NO: 9639 - RNA, 22 nt, Homo sapiens
gagguaggggccuuaaagaugc

SEQ ID NO: 9640 - RNA, 22 nt, Homo sapiens
aggagcuuuggggaaaacagau

SEQ ID NO: 9641 - RNA, 22 nt, Homo sapiens
ggcaacauggugaaacucuguc

SEQ ID NO: 9642 - RNA, 22 nt, Homo sapiens
gaguucaauuuccagcuguucu

SEQ ID NO: 9643 - RNA, 22 nt, Homo sapiens
cugaaaugaauuauuuucuuuc

SEQ ID NO: 9644 - RNA, 23 nt, Homo sapiens
cagugguguuagagaaaucuuuu

SEQ ID NO: 9645 - RNA, 22 nt, Homo sapiens
uuacaguagaugaggguauaau

SEQ ID NO: 9646 - RNA, 22 nt, Homo sapiens
acugcacuccagccugagccug

SEQ ID NO: 9647 - RNA, 22 nt, Homo sapiens
ugcgaucuuuuuccuuguuccu

SEQ ID NO: 9648 - RNA, 22 nt, Homo sapiens
uauguuaucaaaaagcuaagga

SEQ ID NO: 9649 - RNA, 22 nt, Homo sapiens
guaacacaugcugcucucuggu

SEQ ID NO: 9650 - RNA, 22 nt, Homo sapiens
gacuuagaauuuuugccugcua

SEQ ID NO: 9651 - RNA, 22 nt, Homo sapiens
ggucauggauaagauccagaag

SEQ ID NO: 9652 - RNA, 22 nt, Homo sapiens
guaccacaguugcucacggguu

SEQ ID NO: 9653 - RNA, 22 nt, Homo sapiens
aacugguauugaauuuaggaag

SEQ ID NO: 9654 - RNA, 22 nt, Homo sapiens
ucauugcauuccagcccaagca

SEQ ID NO: 9655 - RNA, 22 nt, Homo sapiens
ggguaggcaagcggaugucaga

SEQ ID NO: 9656 - RNA, 22 nt, Homo sapiens
guauccugaaguucucagcacu

SEQ ID NO: 9657 - RNA, 21 nt, Homo sapiens
cuacccuguauuagagaaaga

SEQ ID NO: 9658 - RNA, 22 nt, Homo sapiens
ggcaaugucagcuaaugaugga

SEQ ID NO: 9659 - RNA, 22 nt, Homo sapiens
uugaccccuucuaauagccuca

SEQ ID NO: 9660 - RNA, 22 nt, Homo sapiens
ucucuuggcggaaguugcagug

SEQ ID NO: 9661 - RNA, 22 nt, Homo sapiens
ugggaagcugcauuuuaacaag

SEQ ID NO: 9662 - RNA, 22 nt, Homo sapiens
guaacaccaguuauaucaguuc

SEQ ID NO: 9663 - RNA, 22 nt, Homo sapiens
aagugaauguuugguagcagug

SEQ ID NO: 9664 - RNA, 22 nt, Homo sapiens
uuaagcuaguuuauucaggaaa

SEQ ID NO: 9665 - RNA, 22 nt, Homo sapiens
aucccaguaaaaauggcuucua

SEQ ID NO: 9666 - RNA, 22 nt, Homo sapiens
acaacaguuuuaucaccccaga

SEQ ID NO: 9667 - RNA, 22 nt, Homo sapiens
guggcaagaauguacaaaaggu

SEQ ID NO: 9668 - RNA, 19 nt, Homo sapiens
uaugcaacuuauagugcug

SEQ ID NO: 9669 - RNA, 22 nt, Homo sapiens
ucugguuccuuggcuucggguc

SEQ ID NO: 9670 - RNA, 22 nt, Homo sapiens
aaggauuguaacaccaagguua

SEQ ID NO: 9671 - RNA, 23 nt, Homo sapiens
uuuaagcuucauguccuaacauc

SEQ ID NO: 9672 - RNA, 22 nt, Homo sapiens
uugcaccuugaagccaauagca

SEQ ID NO: 9673 - RNA, 22 nt, Homo sapiens
uggacacugguggauauggaau

SEQ ID NO: 9674 - RNA, 22 nt, Homo sapiens
ucagcaccauguaacaauugau

SEQ ID NO: 9675 - RNA, 22 nt, Homo sapiens
gagcuagggucaugcuacugca

SEQ ID NO: 9676 - RNA, 22 nt, Homo sapiens
ucugaaucguucccaugcagga

SEQ ID NO: 9677 - RNA, 22 nt, Homo sapiens
aaaggcuucggaucagaaggua

SEQ ID NO: 9678 - RNA, 22 nt, Homo sapiens
gauauuacuuccaauauugcaa

SEQ ID NO: 9679 - RNA, 22 nt, Homo sapiens
cuauggcagccacggccuggag

SEQ ID NO: 9680 - RNA, 22 nt, Homo sapiens
aaguaaacauuuuguacaauaa

SEQ ID NO: 9681 - RNA, 19 nt, Homo sapiens
cuaaguccccuugauuaga

SEQ ID NO: 9682 - RNA, 21 nt, Homo sapiens
ugacauguuggugugcugcac

SEQ ID NO: 9683 - RNA, 22 nt, Homo sapiens
aggagguagucugucccuuagc

SEQ ID NO: 9684 - RNA, 22 nt, Homo sapiens
ugauccuguccuuaugauguua

SEQ ID NO: 9685 - RNA, 22 nt, Homo sapiens
ugaugcugaguggcuauuugaa

SEQ ID NO: 9686 - RNA, 22 nt, Homo sapiens
uggggcuuuuucuuguauucuc

SEQ ID NO: 9687 - RNA, 22 nt, Homo sapiens
auaaacugucaguggagaguaa

SEQ ID NO: 9688 - RNA, 22 nt, Homo sapiens
gugugacuagucaugccugaau

SEQ ID NO: 9689 - RNA, 22 nt, Homo sapiens
aaucacaggucuuggcugcaug

SEQ ID NO: 9690 - RNA, 22 nt, Homo sapiens
ccacagucuaugcaacaagguc

SEQ ID NO: 9691 - RNA, 22 nt, Homo sapiens
acuacuucuaaguuuuggaaga

SEQ ID NO: 9692 - RNA, 21 nt, Homo sapiens
gucacuggggcuggauaauuc

SEQ ID NO: 9693 - RNA, 22 nt, Homo sapiens
uugucauuuucagaguguuacg

SEQ ID NO: 9694 - RNA, 22 nt, Homo sapiens
uugaaagcuaucucaaaucgcu

SEQ ID NO: 9695 - RNA, 22 nt, Homo sapiens
gcacaguggcucccgucuauaa

SEQ ID NO: 9696 - RNA, 22 nt, Homo sapiens
uaacaguggucugugguaucug

SEQ ID NO: 9697 - RNA, 22 nt, Homo sapiens
uucuuaguggcaccacuuuuuu

SEQ ID NO: 9698 - RNA, 22 nt, Homo sapiens
ugccaggaugaggucaauguuu

SEQ ID NO: 9699 - RNA, 19 nt, Homo sapiens
guugacacuggcucuucag

SEQ ID NO: 9700 - RNA, 22 nt, Homo sapiens
ccugcauaguucaccgcugaua

SEQ ID NO: 9701 - RNA, 21 nt, Homo sapiens
uaugguuucuaauucugcagg

SEQ ID NO: 9702 - RNA, 22 nt, Homo sapiens
uuauugcucauuugggcauucu

SEQ ID NO: 9703 - RNA, 22 nt, Homo sapiens
uucaggguggagaguaugaggu

SEQ ID NO: 9704 - RNA, 18 nt, Homo sapiens
cucacacccuaaucagga

SEQ ID NO: 9705 - RNA, 22 nt, Homo sapiens
auacagacacagucagaggggu

SEQ ID NO: 9706 - RNA, 22 nt, Homo sapiens
gguaaacauacugcugucuucu

SEQ ID NO: 9707 - RNA, 22 nt, Homo sapiens
ugacuauugauuuagacgugcu

SEQ ID NO: 9708 - RNA, 22 nt, Homo sapiens
ugaggaucucuaggaauuuauc

SEQ ID NO: 9709 - RNA, 22 nt, Homo sapiens
uagagugcugucaaagacuugu

SEQ ID NO: 9710 - RNA, 20 nt, Homo sapiens
aaaugcuguaauguuuggga

SEQ ID NO: 9711 - RNA, 22 nt, Homo sapiens
caagaucauuuaugcuaaaauu

SEQ ID NO: 9712 - RNA, 22 nt, Homo sapiens
ugagaugaguugcgcucugucg

SEQ ID NO: 9713 - RNA, 22 nt, Homo sapiens
ugagcuaggaucacaccugcau

SEQ ID NO: 9714 - RNA, 22 nt, Homo sapiens
guggcaaggaaaugcugcucac

SEQ ID NO: 9715 - RNA, 22 nt, Homo sapiens
ggucagugcauucuaaaggcaa

SEQ ID NO: 9716 - RNA, 22 nt, Homo sapiens
aaggcaagaagagaaccaucgg

SEQ ID NO: 9717 - RNA, 22 nt, Homo sapiens
uggcaagaccccaucucuacaa

SEQ ID NO: 9718 - RNA, 22 nt, Homo sapiens
auugcacuccagccccggggac

SEQ ID NO: 9719 - RNA, 22 nt, Homo sapiens
gaaauguuuuucaugugggcaa

SEQ ID NO: 9720 - RNA, 23 nt, Homo sapiens
augacacuguccuugaccauuuc

SEQ ID NO: 9721 - RNA, 21 nt, Homo sapiens
aggcaagguguuauuauugaa

SEQ ID NO: 9722 - RNA, 22 nt, Homo sapiens
ucuuggcauggcugaagauucc

SEQ ID NO: 9723 - RNA, 22 nt, Homo sapiens
uggcaguuuacagcuuuaggag

SEQ ID NO: 9724 - RNA, 23 nt, Homo sapiens
ucccaagauggaccagaccaagg

SEQ ID NO: 9725 - RNA, 22 nt, Homo sapiens
uauaguguuuucaaaaguaugu

SEQ ID NO: 9726 - RNA, 22 nt, Homo sapiens
gcacaguuaaagggucauguga

SEQ ID NO: 9727 - RNA, 22 nt, Homo sapiens
guaagauaguauguuuaaccca

SEQ ID NO: 9728 - RNA, 22 nt, Homo sapiens
ucaagugcauugauucaguauu

SEQ ID NO: 9729 - RNA, 22 nt, Homo sapiens
augaacagagccuugagaaccu

SEQ ID NO: 9730 - RNA, 22 nt, Homo sapiens
gaucuggucuuugauuagacac

SEQ ID NO: 9731 - RNA, 22 nt, Homo sapiens
augagggagggguggugccgca

SEQ ID NO: 9732 - RNA, 22 nt, Homo sapiens
uauggccacugucuuugaguca

SEQ ID NO: 9733 - RNA, 16 nt, Homo sapiens
auuggcaagaugccuu

SEQ ID NO: 9734 - RNA, 22 nt, Homo sapiens
uuaguucauugugacuggacuc

SEQ ID NO: 9735 - RNA, 22 nt, Homo sapiens
ggacuagggacauggggagcug

SEQ ID NO: 9736 - RNA, 22 nt, Homo sapiens
cuggaaacaucuuaggaaugca

SEQ ID NO: 9737 - RNA, 22 nt, Homo sapiens
ugacuagagcaauuggaaacaa

SEQ ID NO: 9738 - RNA, 22 nt, Homo sapiens
uugauauggcugcuuaccauaa

SEQ ID NO: 9739 - RNA, 22 nt, Homo sapiens
uauuguacauauccucccuuca

SEQ ID NO: 9740 - RNA, 22 nt, Homo sapiens
auguaaacagaugugcagcuug

SEQ ID NO: 9741 - RNA, 22 nt, Homo sapiens
gacauagagccuugacuucauu

SEQ ID NO: 9742 - RNA, 22 nt, Homo sapiens
auuguacucuagccucugggca

SEQ ID NO: 9743 - RNA, 22 nt, Homo sapiens
augaaaucuuuggcagaucuua

SEQ ID NO: 9744 - RNA, 19 nt, Homo sapiens
uucaaugcagcauugccac

SEQ ID NO: 9745 - RNA, 16 nt, Homo sapiens
ucacaaacucuagcag

SEQ ID NO: 9746 - RNA, 22 nt, Homo sapiens
ugugccuacugugggagcguca

SEQ ID NO: 9747 - RNA, 22 nt, Homo sapiens
uuaaguacuucccuguuggaca

SEQ ID NO: 9748 - RNA, 17 nt, Homo sapiens
ugcauaggcaggcucag

SEQ ID NO: 9749 - RNA, 20 nt, Homo sapiens
ggagguguuggauuucuagu

SEQ ID NO: 9750 - RNA, 22 nt, Homo sapiens
uucaucaggaauauugaccugu

SEQ ID NO: 9751 - RNA, 22 nt, Homo sapiens
gaggaguauuuugucgaauguc

SEQ ID NO: 9752 - RNA, 22 nt, Homo sapiens
aucugugguuguaugcauauua

SEQ ID NO: 9753 - RNA, 22 nt, Homo sapiens
cucaaagugcugggacuggcug

SEQ ID NO: 9754 - RNA, 20 nt, Homo sapiens
uaguuggugauacagugcau

SEQ ID NO: 9755 - RNA, 22 nt, Homo sapiens
gucagcaaagaggaauaguuug

SEQ ID NO: 9756 - RNA, 21 nt, Homo sapiens
aggagauguuuguccuuuuag

SEQ ID NO: 9757 - RNA, 22 nt, Homo sapiens
uggauccaucacgccucuuccc

SEQ ID NO: 9758 - RNA, 22 nt, Homo sapiens
aggaacuguaacuaugucucug

SEQ ID NO: 9759 - RNA, 22 nt, Homo sapiens
ugagaugaggucucacucuguu

SEQ ID NO: 9760 - RNA, 20 nt, Homo sapiens
aaaggcugugagaacgagau

SEQ ID NO: 9761 - RNA, 22 nt, Homo sapiens
agugagcuggagaaaagaaacu

SEQ ID NO: 9762 - RNA, 22 nt, Homo sapiens
aguguaaugauauuuggagagg

SEQ ID NO: 9763 - RNA, 22 nt, Homo sapiens
ugguaagaucugugagccaggc

SEQ ID NO: 9764 - RNA, 19 nt, Homo sapiens
uacccagaagcagcauugu

SEQ ID NO: 9765 - RNA, 22 nt, Homo sapiens
uaagggacgcccccuucucucu

SEQ ID NO: 9766 - RNA, 22 nt, Homo sapiens
acugcacuccagccuggacgac

SEQ ID NO: 9767 - RNA, 22 nt, Homo sapiens
uuguuauguuaaacuacugaaa

SEQ ID NO: 9768 - RNA, 22 nt, Homo sapiens
uucauugcugcuuaucuccaga

SEQ ID NO: 9769 - RNA, 19 nt, Homo sapiens
uccaugagcccacagugau

SEQ ID NO: 9770 - RNA, 22 nt, Homo sapiens
uugaaugaaaugaugucauuug

SEQ ID NO: 9771 - RNA, 22 nt, Homo sapiens
cacaccuacuagggccgugggc

SEQ ID NO: 9772 - RNA, 22 nt, Homo sapiens
gagaucaugcugguucucucau

SEQ ID NO: 9773 - RNA, 22 nt, Homo sapiens
ugguaauguaauuuggagaagg

SEQ ID NO: 9774 - RNA, 22 nt, Homo sapiens
auugcacuccacccugggcaac

SEQ ID NO: 9775 - RNA, 22 nt, Homo sapiens
auggcccaguuugcuaucccua

SEQ ID NO: 9776 - RNA, 22 nt, Homo sapiens
uggugcuugaugaggguggagc

SEQ ID NO: 9777 - RNA, 22 nt, Homo sapiens
uuuguguccccacccacaucuc

SEQ ID NO: 9778 - RNA, 20 nt, Homo sapiens
auugaagacuccggggcaga

SEQ ID NO: 9779 - RNA, 22 nt, Homo sapiens
ugccaguauuuuguugaagauu

SEQ ID NO: 9780 - RNA, 21 nt, Homo sapiens
ucaacccuugcgucaccaagc

SEQ ID NO: 9781 - RNA, 22 nt, Homo sapiens
ucagugccauugccauaugagu

SEQ ID NO: 9782 - RNA, 22 nt, Homo sapiens
uuggacuaagaacuuaaaauaa

SEQ ID NO: 9783 - RNA, 22 nt, Homo sapiens
cauaguacuugcauaguacuau

SEQ ID NO: 9784 - RNA, 19 nt, Homo sapiens
aagugaaugcuuuguucac

SEQ ID NO: 9785 - RNA, 22 nt, Homo sapiens
aucucaguuaauuccaucuuuc

SEQ ID NO: 9786 - RNA, 22 nt, Homo sapiens
cucacggugcaggcuucuggga

SEQ ID NO: 9787 - RNA, 22 nt, Homo sapiens
cacccuugcagggacagcuuug

SEQ ID NO: 9788 - RNA, 22 nt, Homo sapiens
gacuuugguagaggaaaaaucu

SEQ ID NO: 9789 - RNA, 22 nt, Homo sapiens
ggcacuguggcucaagccugua

SEQ ID NO: 9790 - RNA, 22 nt, Homo sapiens
gugguucuagagggacagaaug

SEQ ID NO: 9791 - RNA, 22 nt, Homo sapiens
gucagaaucucagaugacaacg

SEQ ID NO: 9792 - RNA, 22 nt, Homo sapiens
guauuugguuauugcagccuga

SEQ ID NO: 9793 - RNA, 22 nt, Homo sapiens
gcucuuuugggguaauucugag

SEQ ID NO: 9794 - RNA, 21 nt, Homo sapiens
uccugagagaggaguaacucu

SEQ ID NO: 9795 - RNA, 22 nt, Homo sapiens
ugucauggggaaaauaacagac

SEQ ID NO: 9796 - RNA, 22 nt, Homo sapiens
uuaccagagaagacgaggggga

SEQ ID NO: 9797 - RNA, 22 nt, Homo sapiens
aagguucuugcuugcaugacug

SEQ ID NO: 9798 - RNA, 22 nt, Homo sapiens
gagauaguguggguacagcuau

SEQ ID NO: 9799 - RNA, 22 nt, Homo sapiens
gugccacugcaccuggccuaag

SEQ ID NO: 9800 - RNA, 22 nt, Homo sapiens
uacaaguggguuugugcaggag

SEQ ID NO: 9801 - RNA, 22 nt, Homo sapiens
ccagauguuuucauucagcaag

SEQ ID NO: 9802 - RNA, 22 nt, Homo sapiens
ggaagguaauugucagcucaua

SEQ ID NO: 9803 - RNA, 22 nt, Homo sapiens
uuaauuguaucuauagauguca

SEQ ID NO: 9804 - RNA, 22 nt, Homo sapiens
gugaaauguguagaggaucugg

SEQ ID NO: 9805 - RNA, 22 nt, Homo sapiens
uuauaguuuuucaccuggagaa

SEQ ID NO: 9806 - RNA, 22 nt, Homo sapiens
ggaagguaauuggcuaaugaga

SEQ ID NO: 9807 - RNA, 22 nt, Homo sapiens
uuuguacuucauacaauaacuc

SEQ ID NO: 9808 - RNA, 22 nt, Homo sapiens
ucauguauuaucauuagugggu

SEQ ID NO: 9809 - RNA, 22 nt, Homo sapiens
cuaagcaccuuaguggggaauc

SEQ ID NO: 9810 - RNA, 21 nt, Homo sapiens
cugcauccauuucugagugau

SEQ ID NO: 9811 - RNA, 22 nt, Homo sapiens
aaguauuaugaguccuuguuuu

SEQ ID NO: 9812 - RNA, 22 nt, Homo sapiens
cugacagaugacugccacugua

SEQ ID NO: 9813 - RNA, 22 nt, Homo sapiens
uagggcuuuaguuugcuugugu

SEQ ID NO: 9814 - RNA, 22 nt, Homo sapiens
aaaugcaugaauaagcucgugu

SEQ ID NO: 9815 - RNA, 22 nt, Homo sapiens
cacacuguuuuccauggggguu

SEQ ID NO: 9816 - RNA, 22 nt, Homo sapiens
ugcaccacugcacuccaggcug

SEQ ID NO: 9817 - RNA, 22 nt, Homo sapiens
cuaaaugucucuacuaaguuua

SEQ ID NO: 9818 - RNA, 22 nt, Homo sapiens
uacugguuuuggugggcaggug

SEQ ID NO: 9819 - RNA, 22 nt, Homo sapiens
ugagacugaguuuugccuuugu

SEQ ID NO: 9820 - RNA, 22 nt, Homo sapiens
auagggcacgagaugugagccu

SEQ ID NO: 9821 - RNA, 18 nt, Homo sapiens
uggagauaagaagaacuu

SEQ ID NO: 9822 - RNA, 22 nt, Homo sapiens
uauaucuguccauggcccugcu

SEQ ID NO: 9823 - RNA, 22 nt, Homo sapiens
uucacugcacuccagccugagc

SEQ ID NO: 9824 - RNA, 22 nt, Homo sapiens
ucagucauucacucacucggac

SEQ ID NO: 9825 - RNA, 22 nt, Homo sapiens
uugagcacaguagguuguggcu

SEQ ID NO: 9826 - RNA, 22 nt, Homo sapiens
uguguaaauagcuacggaucug

SEQ ID NO: 9827 - RNA, 22 nt, Homo sapiens
agugcacuccagccugggcaac

SEQ ID NO: 9828 - RNA, 22 nt, Homo sapiens
uuggauaguuuaugaaaaaugg

SEQ ID NO: 9829 - RNA, 22 nt, Homo sapiens
ugagacaucacaaaauccucaa

SEQ ID NO: 9830 - RNA, 22 nt, Homo sapiens
uaucccaguggauguaccccau

SEQ ID NO: 9831 - RNA, 22 nt, Homo sapiens
auuauguuguauuuccuugcag

SEQ ID NO: 9832 - RNA, 15 nt, Homo sapiens
gugaaauguuucaga

SEQ ID NO: 9833 - RNA, 18 nt, Homo sapiens
ugcagcaucaguacccag

SEQ ID NO: 9834 - RNA, 17 nt, Homo sapiens
augacuucuucagugug

SEQ ID NO: 9835 - RNA, 22 nt, Homo sapiens
uuccaguggaguaaauggacaa

SEQ ID NO: 9836 - RNA, 22 nt, Homo sapiens
gagaugaaaucuugcucuguca

SEQ ID NO: 9837 - RNA, 22 nt, Homo sapiens
auggcacuacugggaaugucuu

SEQ ID NO: 9838 - RNA, 22 nt, Homo sapiens
uuuauggagagauauuuauggu

SEQ ID NO: 9839 - RNA, 21 nt, Homo sapiens
cuaucucaguguuuacauuug

SEQ ID NO: 9840 - RNA, 19 nt, Homo sapiens
gauauguugagcacccuuu

SEQ ID NO: 9841 - RNA, 18 nt, Homo sapiens
uaaaggcacuguguuguu

SEQ ID NO: 9842 - RNA, 22 nt, Homo sapiens
agagccacacucuccuaacuca

SEQ ID NO: 9843 - RNA, 22 nt, Homo sapiens
uccacagugguugaacuaguaa

SEQ ID NO: 9844 - RNA, 19 nt, Homo sapiens
uaaugccacugccuggcau

SEQ ID NO: 9845 - RNA, 22 nt, Homo sapiens
uggcagauaggauacaggacua

SEQ ID NO: 9846 - RNA, 22 nt, Homo sapiens
gagugcaauggcagaucuccgc

SEQ ID NO: 9847 - RNA, 22 nt, Homo sapiens
ggucauguguccaggagguagc

SEQ ID NO: 9848 - RNA, 22 nt, Homo sapiens
acugaucaauguuaaggcuuau

SEQ ID NO: 9849 - RNA, 22 nt, Homo sapiens
gaucacauggccauuucuagcu

SEQ ID NO: 9850 - RNA, 22 nt, Homo sapiens
augucaaggugggugauaguuu

SEQ ID NO: 9851 - RNA, 21 nt, Homo sapiens
uaacagcuccacuccauucuc

SEQ ID NO: 9852 - RNA, 22 nt, Homo sapiens
uagagguagguguaugaacuag

SEQ ID NO: 9853 - RNA, 22 nt, Homo sapiens
aucuuguccugagguuuuauug

SEQ ID NO: 9854 - RNA, 22 nt, Homo sapiens
aggaauggaaacuuuugauggu

SEQ ID NO: 9855 - RNA, 22 nt, Homo sapiens
ugacuacagauuugcugccaga

SEQ ID NO: 9856 - RNA, 22 nt, Homo sapiens
uuggaauuuuaaaauaggcaac

SEQ ID NO: 9857 - RNA, 22 nt, Homo sapiens
gucaguggagaaaaggacaugu

SEQ ID NO: 9858 - RNA, 22 nt, Homo sapiens
gucacuggcugucuuguaugau

SEQ ID NO: 9859 - RNA, 21 nt, Homo sapiens
ucuuuggucaccaguuuucau

SEQ ID NO: 9860 - RNA, 22 nt, Homo sapiens
uggauggagaggcuugugaugc

SEQ ID NO: 9861 - RNA, 22 nt, Homo sapiens
ccaggguugagacccacugacu

SEQ ID NO: 9862 - RNA, 22 nt, Homo sapiens
guuugugcuccuaugagaaccu

SEQ ID NO: 9863 - RNA, 22 nt, Homo sapiens
uucuaaguaauuuugcaugccu

SEQ ID NO: 9864 - RNA, 22 nt, Homo sapiens
gugaucucauuuggaauuagag

SEQ ID NO: 9865 - RNA, 22 nt, Homo sapiens
guauggcacuauccucucugau

SEQ ID NO: 9866 - RNA, 22 nt, Homo sapiens
guauacaugucaaaacucacau

SEQ ID NO: 9867 - RNA, 20 nt, Homo sapiens
ugaaggaggucauuuauacc

SEQ ID NO: 9868 - RNA, 17 nt, Homo sapiens
guuuggguacuggguaa

SEQ ID NO: 9869 - RNA, 22 nt, Homo sapiens
aacagcauaguacccgugauaa

SEQ ID NO: 9870 - RNA, 22 nt, Homo sapiens
uuucugaggccucaccagaagc

SEQ ID NO: 9871 - RNA, 22 nt, Homo sapiens
agauggauuuuguagccccagc

SEQ ID NO: 9872 - RNA, 22 nt, Homo sapiens
uauagcuuuuuagggaauuugg

SEQ ID NO: 9873 - RNA, 22 nt, Homo sapiens
cagugcacugggauuauaagug

SEQ ID NO: 9874 - RNA, 22 nt, Homo sapiens
cuccaguacagagagguuccuc

SEQ ID NO: 9875 - RNA, 22 nt, Homo sapiens
cccuucauucaaggguugugag

SEQ ID NO: 9876 - RNA, 22 nt, Homo sapiens
auagugcugcaauuaacauaca

SEQ ID NO: 9877 - RNA, 22 nt, Homo sapiens
uuccuuaguuauuugguccccu

SEQ ID NO: 9878 - RNA, 22 nt, Homo sapiens
uucuggccccucccaaucucau

SEQ ID NO: 9879 - RNA, 22 nt, Homo sapiens
gcagaucucuucauuucucuua

SEQ ID NO: 9880 - RNA, 22 nt, Homo sapiens
ugaacagcuaucuugucagugu

SEQ ID NO: 9881 - RNA, 22 nt, Homo sapiens
uaugguuuuggaauccugcaga

SEQ ID NO: 9882 - RNA, 22 nt, Homo sapiens
guccaguacucuuuccugaaaa

SEQ ID NO: 9883 - RNA, 22 nt, Homo sapiens
auaauaccugccacauuugaau

SEQ ID NO: 9884 - RNA, 22 nt, Homo sapiens
ucagaucuucagcaggggcccc

SEQ ID NO: 9885 - RNA, 22 nt, Homo sapiens
uauagcauuuugauccuguaga

SEQ ID NO: 9886 - RNA, 20 nt, Homo sapiens
uggaaucuaggcggagguuu

SEQ ID NO: 9887 - RNA, 22 nt, Homo sapiens
gcaagaguauuucaaggaagau

SEQ ID NO: 9888 - RNA, 22 nt, Homo sapiens
uaaagcuaucacauuggugauu

SEQ ID NO: 9889 - RNA, 22 nt, Homo sapiens
uauggcuucuuauucuuucccg

SEQ ID NO: 9890 - RNA, 22 nt, Homo sapiens
aauacucaguccuggugaggcu

SEQ ID NO: 9891 - RNA, 22 nt, Homo sapiens
auaagaagugaaccagacgucu

SEQ ID NO: 9892 - RNA, 22 nt, Homo sapiens
gagauggaguuucacuucgcuc

SEQ ID NO: 9893 - RNA, 20 nt, Homo sapiens
ugauaugguuuggcuguguu

SEQ ID NO: 9894 - RNA, 18 nt, Homo sapiens
ugcaaacauguguguguu

SEQ ID NO: 9895 - RNA, 22 nt, Homo sapiens
uuuuuggauaaugguacaugua

SEQ ID NO: 9896 - RNA, 22 nt, Homo sapiens
cugugaagaaagucauugguag

SEQ ID NO: 9897 - RNA, 22 nt, Homo sapiens
cuaaaacuuucugagugcagca

SEQ ID NO: 9898 - RNA, 22 nt, Homo sapiens
uuguuuuggagaugagcuaaaa

SEQ ID NO: 9899 - RNA, 22 nt, Homo sapiens
ccaaauccauccaaaucauaga

SEQ ID NO: 9900 - RNA, 22 nt, Homo sapiens
aagcucauugagaucuauggcu

SEQ ID NO: 9901 - RNA, 22 nt, Homo sapiens
guggagcuguguggccuugggc

SEQ ID NO: 9902 - RNA, 22 nt, Homo sapiens
cuauaugucuguuuugguacca

SEQ ID NO: 9903 - RNA, 22 nt, Homo sapiens
acccggcaguaauccugcgcgc

SEQ ID NO: 9904 - RNA, 22 nt, Homo sapiens
uguaugucugcucuuuggaacu

SEQ ID NO: 9905 - RNA, 21 nt, Homo sapiens
caauggcacgaucuuggcuca

SEQ ID NO: 9906 - RNA, 20 nt, Homo sapiens
uggauugugaugggauuugc

SEQ ID NO: 9907 - RNA, 22 nt, Homo sapiens
uuaaggcuuguacuuguuuucu

SEQ ID NO: 9908 - RNA, 22 nt, Homo sapiens
uuccugagccuuguaucuagua

SEQ ID NO: 9909 - RNA, 16 nt, Homo sapiens
acacuguuuagggaca

SEQ ID NO: 9910 - RNA, 22 nt, Homo sapiens
auugagacaaauuuguaugcag

SEQ ID NO: 9911 - RNA, 22 nt, Homo sapiens
aauaagcauaguaccugauagg

SEQ ID NO: 9912 - RNA, 22 nt, Homo sapiens
gccaguauuuuauugaggauuu

SEQ ID NO: 9913 - RNA, 22 nt, Homo sapiens
agaucacucagguuucucccug

SEQ ID NO: 9914 - RNA, 22 nt, Homo sapiens
uggucccaugaacuuuagguca

SEQ ID NO: 9915 - RNA, 22 nt, Homo sapiens
gugcacauuguuuaugucuguu

SEQ ID NO: 9916 - RNA, 22 nt, Homo sapiens
gguguuccccuuaccucuuggc

SEQ ID NO: 9917 - RNA, 22 nt, Homo sapiens
uuggcagcuguggaaucugggc

SEQ ID NO: 9918 - RNA, 22 nt, Homo sapiens
guaugaccucgcuuuauugcag

SEQ ID NO: 9919 - RNA, 22 nt, Homo sapiens
uauuguuuuucccaggagucua

SEQ ID NO: 9920 - RNA, 22 nt, Homo sapiens
aacagucaauugcugaugaccu

SEQ ID NO: 9921 - RNA, 22 nt, Homo sapiens
ccagcaccauuuguugaauagg

SEQ ID NO: 9922 - RNA, 22 nt, Homo sapiens
auguuacggaguuuuuauccag

SEQ ID NO: 9923 - RNA, 22 nt, Homo sapiens
cucgcuccauuucggugaucaa

SEQ ID NO: 9924 - RNA, 22 nt, Homo sapiens
uuuauucggcuaggagcuucgg

SEQ ID NO: 9925 - RNA, 22 nt, Homo sapiens
gcgugguguuagaaugagaagu

SEQ ID NO: 9926 - RNA, 22 nt, Homo sapiens
gagauuuucagcuugacuggga

SEQ ID NO: 9927 - RNA, 22 nt, Homo sapiens
uuuauagucaggaacuugagga

SEQ ID NO: 9928 - RNA, 22 nt, Homo sapiens
uccaugagaauaguuaggcucu

SEQ ID NO: 9929 - RNA, 22 nt, Homo sapiens
ugacucaagagccugacucauc

SEQ ID NO: 9930 - RNA, 22 nt, Homo sapiens
auguaagugugcucaaauguua

SEQ ID NO: 9931 - RNA, 20 nt, Homo sapiens
agguacacugacaugccuuc

SEQ ID NO: 9932 - RNA, 22 nt, Homo sapiens
cccagagacagaaugauaaacu

SEQ ID NO: 9933 - RNA, 22 nt, Homo sapiens
cagagcaaugcuuuugcuuuga

SEQ ID NO: 9934 - RNA, 22 nt, Homo sapiens
ucucaguuuucuggggaagaaa

SEQ ID NO: 9935 - RNA, 22 nt, Homo sapiens
uucauggaugcauuugaggggu

SEQ ID NO: 9936 - RNA, 22 nt, Homo sapiens
uucaccuggguuggccaucauu

SEQ ID NO: 9937 - RNA, 22 nt, Homo sapiens
uaugccucuucauaaaguauga

SEQ ID NO: 9938 - RNA, 21 nt, Homo sapiens
gugcuuguagccucacuucug

SEQ ID NO: 9939 - RNA, 22 nt, Homo sapiens
guggcaagaugacuacucacug

SEQ ID NO: 9940 - RNA, 22 nt, Homo sapiens
uagguaggugucauaauccaug

SEQ ID NO: 9941 - RNA, 22 nt, Homo sapiens
uuauuauguuggugcaaaggua

SEQ ID NO: 9942 - RNA, 22 nt, Homo sapiens
uugagauggagucucacucuuu

SEQ ID NO: 9943 - RNA, 22 nt, Homo sapiens
uuaguagcacagaguaucagca

SEQ ID NO: 9944 - RNA, 22 nt, Homo sapiens
uuucacagcaauugccuauugu

SEQ ID NO: 9945 - RNA, 22 nt, Homo sapiens
cauugcacacauuuaccuaugu

SEQ ID NO: 9946 - RNA, 21 nt, Homo sapiens
gugaucaugucacugcacucc

SEQ ID NO: 9947 - RNA, 22 nt, Homo sapiens
ugcugguuuucaucaucagugg

SEQ ID NO: 9948 - RNA, 16 nt, Homo sapiens
aggcaagaauugaggu

SEQ ID NO: 9949 - RNA, 17 nt, Homo sapiens
uugagaguauaucuuac

SEQ ID NO: 9950 - RNA, 22 nt, Homo sapiens
ugugaacaugacagugggcuag

SEQ ID NO: 9951 - RNA, 21 nt, Homo sapiens
ucagugcaauucuauggggaa

SEQ ID NO: 9952 - RNA, 16 nt, Homo sapiens
uugucccuucccaaau

SEQ ID NO: 9953 - RNA, 22 nt, Homo sapiens
gaggcauuauucccaucuuaca

SEQ ID NO: 9954 - RNA, 20 nt, Homo sapiens
gagcugguguacugccgggc

SEQ ID NO: 9955 - RNA, 22 nt, Homo sapiens
agcagagcauauucauucgggg

SEQ ID NO: 9956 - RNA, 23 nt, Homo sapiens
agagguuuaaucaggcaguugcu

SEQ ID NO: 9957 - RNA, 22 nt, Homo sapiens
gcccauuguuccuaggcuacaa

SEQ ID NO: 9958 - RNA, 22 nt, Homo sapiens
uauugcaacagaagaaagaguc

SEQ ID NO: 9959 - RNA, 22 nt, Homo sapiens
uuacacaguugguaggggcaga

SEQ ID NO: 9960 - RNA, 22 nt, Homo sapiens
aguggauuuuagacugagauuu

SEQ ID NO: 9961 - RNA, 19 nt, Homo sapiens
ggcacugugugagugagga

SEQ ID NO: 9962 - RNA, 22 nt, Homo sapiens
aggcauugugcaucgaugauuu

SEQ ID NO: 9963 - RNA, 18 nt, Homo sapiens
cuuaacauugggaugaua

SEQ ID NO: 9964 - RNA, 21 nt, Homo sapiens
ccaugggacggaaugaauaca

SEQ ID NO: 9965 - RNA, 22 nt, Homo sapiens
ugaagcuaacuugauugugaug

SEQ ID NO: 9966 - RNA, 22 nt, Homo sapiens
uuacagucaccugggggacaua

SEQ ID NO: 9967 - RNA, 22 nt, Homo sapiens
augguauggaaggucuggagga

SEQ ID NO: 9968 - RNA, 22 nt, Homo sapiens
uaccaaaguuucggccucuguu

SEQ ID NO: 9969 - RNA, 22 nt, Homo sapiens
acugcacuccagccuaggcgac

SEQ ID NO: 9970 - RNA, 22 nt, Homo sapiens
auuauaguguauacuugaaauu

SEQ ID NO: 9971 - RNA, 22 nt, Homo sapiens
uagauuauccggcugggacaau

SEQ ID NO: 9972 - RNA, 23 nt, Homo sapiens
uacugcauccuccgccucuaggg

SEQ ID NO: 9973 - RNA, 22 nt, Homo sapiens
uggcaguuuugauguggagaga

SEQ ID NO: 9974 - RNA, 18 nt, Homo sapiens
uuucaagucuuaggugac

SEQ ID NO: 9975 - RNA, 22 nt, Homo sapiens
uuuaauguuacaguauugguau

SEQ ID NO: 9976 - RNA, 22 nt, Homo sapiens
acccauguaggugggauuacag

SEQ ID NO: 9977 - RNA, 22 nt, Homo sapiens
aagcaaacaucagcuugguuaa

SEQ ID NO: 9978 - RNA, 22 nt, Homo sapiens
auuagguuggugcaaaacuuuc

SEQ ID NO: 9979 - RNA, 22 nt, Homo sapiens
uuggaacacauguuuuucuacc

SEQ ID NO: 9980 - RNA, 22 nt, Homo sapiens
auaggagugugcacagaguagg

SEQ ID NO: 9981 - RNA, 22 nt, Homo sapiens
guugaggcaggagaauuacuug

SEQ ID NO: 9982 - RNA, 22 nt, Homo sapiens
ucaguggagagcuuccaggauu

SEQ ID NO: 9983 - RNA, 22 nt, Homo sapiens
ucacccacacaggagacaggga

SEQ ID NO: 9984 - RNA, 22 nt, Homo sapiens
gucagguaccugaaagcagcca

SEQ ID NO: 9985 - RNA, 16 nt, Homo sapiens
agcagguguuagguga

SEQ ID NO: 9986 - RNA, 18 nt, Homo sapiens
auggguguuggaaaauga

SEQ ID NO: 9987 - RNA, 22 nt, Homo sapiens
uggcgagaaucacauucuaauu

SEQ ID NO: 9988 - RNA, 22 nt, Homo sapiens
ugugacagcacagcaucucuuu

SEQ ID NO: 9989 - RNA, 22 nt, Homo sapiens
uuagugcaaacucuucaaugcu

SEQ ID NO: 9990 - RNA, 22 nt, Homo sapiens
uacagucauaaugccuagugac

SEQ ID NO: 9991 - RNA, 22 nt, Homo sapiens
augguuuauuuguaagcagagu

SEQ ID NO: 9992 - RNA, 22 nt, Homo sapiens
uuggcuaugaguccuaugugca

SEQ ID NO: 9993 - RNA, 22 nt, Homo sapiens
agaucacaguaccguaaggcug

SEQ ID NO: 9994 - RNA, 23 nt, Homo sapiens
cacagggugaacaccccuaaucc

SEQ ID NO: 9995 - RNA, 22 nt, Homo sapiens
uucuacaggcuguucaagaagc

SEQ ID NO: 9996 - RNA, 20 nt, Homo sapiens
uugacagagggaaaguugcu

SEQ ID NO: 9997 - RNA, 22 nt, Homo sapiens
gagcuagguuuugaauccagac

SEQ ID NO: 9998 - RNA, 22 nt, Homo sapiens
cugagcuagaccacuuggcucc

SEQ ID NO: 9999 - RNA, 22 nt, Homo sapiens
ucagugcuguaccaucuaagga

SEQ ID NO: 10000 - RNA, 22 nt, Homo sapiens
ggcaguguaauaauuuauuaau

SEQ ID NO: 10001 - RNA, 22 nt, Homo sapiens
uuucugagaccaaaacuuguaa

SEQ ID NO: 10002 - RNA, 22 nt, Homo sapiens
guauagcacauaauacuugaug

SEQ ID NO: 10003 - RNA, 22 nt, Homo sapiens
uaacugcaaccuccgccucccg

SEQ ID NO: 10004 - RNA, 22 nt, Homo sapiens
uggcaagagggaugcaagguuu

SEQ ID NO: 10005 - RNA, 22 nt, Homo sapiens
caaaggcuucugaaacugcaga

SEQ ID NO: 10006 - RNA, 20 nt, Homo sapiens
cugaaugucaaggcagaggu

SEQ ID NO: 10007 - RNA, 22 nt, Homo sapiens
gagauugucaugauuacauugu

SEQ ID NO: 10008 - RNA, 22 nt, Homo sapiens
agagauuauccuggcuucucug

SEQ ID NO: 10009 - RNA, 22 nt, Homo sapiens
uaaaguuauugccccucaguua

SEQ ID NO: 10010 - RNA, 22 nt, Homo sapiens
augaaguuagcucauuucuuuu

SEQ ID NO: 10011 - RNA, 22 nt, Homo sapiens
acaguguuccuuuguugugacu

SEQ ID NO: 10012 - RNA, 22 nt, Homo sapiens
gugcaaccaucaccacugacuc

SEQ ID NO: 10013 - RNA, 22 nt, Homo sapiens
ucucacacugaauguguguggg

SEQ ID NO: 10014 - RNA, 19 nt, Homo sapiens
uuccugagaacaagggcuu

SEQ ID NO: 10015 - RNA, 22 nt, Homo sapiens
uaagcuauagugaauaaauugc

SEQ ID NO: 10016 - RNA, 22 nt, Homo sapiens
uauggccugcguccagugguau

SEQ ID NO: 10017 - RNA, 22 nt, Homo sapiens
gucacugagaagguuaguuugu

SEQ ID NO: 10018 - RNA, 22 nt, Homo sapiens
guuaagggaagccuggguaaga

SEQ ID NO: 10019 - RNA, 21 nt, Homo sapiens
ucagggaccugcuguacugau

SEQ ID NO: 10020 - RNA, 22 nt, Homo sapiens
ucacuagggaucacuuuacccg

SEQ ID NO: 10021 - RNA, 20 nt, Homo sapiens
ugcagcacgggcccuuucca

SEQ ID NO: 10022 - RNA, 22 nt, Homo sapiens
aaagcacugaauaaauuugcuu

SEQ ID NO: 10023 - RNA, 22 nt, Homo sapiens
uucaguugcaucaguugaccag

SEQ ID NO: 10024 - RNA, 22 nt, Homo sapiens
uuuuugagaauuggugaaacac

SEQ ID NO: 10025 - RNA, 22 nt, Homo sapiens
uugcuuaggcuggagugcagug

SEQ ID NO: 10026 - RNA, 22 nt, Homo sapiens
agggcacuguagguccugccuc

SEQ ID NO: 10027 - RNA, 23 nt, Homo sapiens
ugugcacauuuacauauauacac

SEQ ID NO: 10028 - RNA, 20 nt, Homo sapiens
gcaagcaugaagaguagaga

SEQ ID NO: 10029 - RNA, 22 nt, Homo sapiens
agguuguguuugugauuagaua

SEQ ID NO: 10030 - RNA, 22 nt, Homo sapiens
uuggcaaauagguuuuauugca

SEQ ID NO: 10031 - RNA, 21 nt, Homo sapiens
ugugaccucugucucugaguc

SEQ ID NO: 10032 - RNA, 22 nt, Homo sapiens
cuagcagcauaagaaucaccaa

SEQ ID NO: 10033 - RNA, 22 nt, Homo sapiens
ggagaugauuaugaaucacuua

SEQ ID NO: 10034 - RNA, 20 nt, Homo sapiens
ucaaaguaugcucugcacua

SEQ ID NO: 10035 - RNA, 22 nt, Homo sapiens
uagguagaacccagaaaucuga

SEQ ID NO: 10036 - RNA, 22 nt, Homo sapiens
uugagauuauuguguuccuuua

SEQ ID NO: 10037 - RNA, 22 nt, Homo sapiens
gauggauuuuaagugaaugaaa

SEQ ID NO: 10038 - RNA, 22 nt, Homo sapiens
cugagauaauuucuagguguca

SEQ ID NO: 10039 - RNA, 22 nt, Homo sapiens
augcacuguauaggaucuugcg

SEQ ID NO: 10040 - RNA, 22 nt, Homo sapiens
uagguaaguaauauacagauga

SEQ ID NO: 10041 - RNA, 19 nt, Homo sapiens
ucucacagcucuacuaugu

SEQ ID NO: 10042 - RNA, 23 nt, Homo sapiens
uucuaucaggcccaggagcccug

SEQ ID NO: 10043 - RNA, 19 nt, Homo sapiens
uucugguguuuuaagccaa

SEQ ID NO: 10044 - RNA, 22 nt, Homo sapiens
uugcagagccccacacugggcu

SEQ ID NO: 10045 - RNA, 22 nt, Homo sapiens
ugucauggauucugagucuggg

SEQ ID NO: 10046 - RNA, 22 nt, Homo sapiens
ugguguccugucucugcgcuug

SEQ ID NO: 10047 - RNA, 22 nt, Homo sapiens
uuggcagucugaggcacagacu

SEQ ID NO: 10048 - RNA, 19 nt, Homo sapiens
uaaguagaugacugaugcu

SEQ ID NO: 10049 - RNA, 22 nt, Homo sapiens
uugaggcuuuugaccucaugug

SEQ ID NO: 10050 - RNA, 22 nt, Homo sapiens
uuuggucccaaugugauaaggu

SEQ ID NO: 10051 - RNA, 22 nt, Homo sapiens
gagagguaguuuuuuggucguc

SEQ ID NO: 10052 - RNA, 22 nt, Homo sapiens
gauaaaguauuggguacuaugc

SEQ ID NO: 10053 - RNA, 22 nt, Homo sapiens
acacuguccaguuaggcuacau

SEQ ID NO: 10054 - RNA, 22 nt, Homo sapiens
uaugaauuuuauccaggauaua

SEQ ID NO: 10055 - RNA, 22 nt, Homo sapiens
caguuacuuuugcaccaaccua

SEQ ID NO: 10056 - RNA, 22 nt, Homo sapiens
caaggaauucucaauagaguua

SEQ ID NO: 10057 - RNA, 22 nt, Homo sapiens
gcccuguguuuggguaugguca

SEQ ID NO: 10058 - RNA, 22 nt, Homo sapiens
ucuagccuaugaagcuugucca

SEQ ID NO: 10059 - RNA, 22 nt, Homo sapiens
cugauugucuauuuaguucacu

SEQ ID NO: 10060 - RNA, 22 nt, Homo sapiens
accaccacucccgcauucuaaa

SEQ ID NO: 10061 - RNA, 22 nt, Homo sapiens
acagugcuguggucaugggucu

SEQ ID NO: 10062 - RNA, 22 nt, Homo sapiens
aggcuuuuguuuuggucucagg

SEQ ID NO: 10063 - RNA, 22 nt, Homo sapiens
aagugguuuuaaucuggugagu

SEQ ID NO: 10064 - RNA, 22 nt, Homo sapiens
uucagguacuauaggcuguugg

SEQ ID NO: 10065 - RNA, 22 nt, Homo sapiens
augugcagauguuacaaauugu

SEQ ID NO: 10066 - RNA, 22 nt, Homo sapiens
ugaaagcuacaggaaaguauuu

SEQ ID NO: 10067 - RNA, 22 nt, Homo sapiens
uguagacaccaaagacagcaua

SEQ ID NO: 10068 - RNA, 22 nt, Homo sapiens
uaucacagauucuccaggguuu

SEQ ID NO: 10069 - RNA, 22 nt, Homo sapiens
auauuacuggcuauaucgcaag

SEQ ID NO: 10070 - RNA, 22 nt, Homo sapiens
ugucauauagaauguucuauga

SEQ ID NO: 10071 - RNA, 22 nt, Homo sapiens
aaggcagucacuaaauagugag

SEQ ID NO: 10072 - RNA, 23 nt, Homo sapiens
auagagcuaggaugcagacagau

SEQ ID NO: 10073 - RNA, 22 nt, Homo sapiens
ugaaaguuauauugugaaauuc

SEQ ID NO: 10074 - RNA, 22 nt, Homo sapiens
ugagacggaguuucgcucuugu

SEQ ID NO: 10075 - RNA, 22 nt, Homo sapiens
ugagacugaguuucucucuugu

SEQ ID NO: 10076 - RNA, 22 nt, Homo sapiens
cagagagcuugcccuuguauau

SEQ ID NO: 10077 - RNA, 22 nt, Homo sapiens
uuagauguuugacugggccuua

SEQ ID NO: 10078 - RNA, 22 nt, Homo sapiens
uggagaacugaugucuccaaga

SEQ ID NO: 10079 - RNA, 16 nt, Homo sapiens
aggaagacuuagagau

SEQ ID NO: 10080 - RNA, 22 nt, Homo sapiens
uauacaugugccauguuggugu

SEQ ID NO: 10081 - RNA, 22 nt, Homo sapiens
uucccagagaaaaggguuucuu

SEQ ID NO: 10082 - RNA, 22 nt, Homo sapiens
ugaugucuugagauggagcuua

SEQ ID NO: 10083 - RNA, 22 nt, Homo sapiens
uuaccagucuagggcucaguuu

SEQ ID NO: 10084 - RNA, 22 nt, Homo sapiens
uuggccauaugacuugcuuugg

SEQ ID NO: 10085 - RNA, 22 nt, Homo sapiens
cgcuggugaucuagacccccaa

SEQ ID NO: 10086 - RNA, 22 nt, Homo sapiens
aggugcaugcuucacuggauau

SEQ ID NO: 10087 - RNA, 22 nt, Homo sapiens
agugaucauuugaauugaugau

SEQ ID NO: 10088 - RNA, 22 nt, Homo sapiens
gaucugucuuuccuuauagucu

SEQ ID NO: 10089 - RNA, 18 nt, Homo sapiens
aaaaagugcucaggccua

SEQ ID NO: 10090 - RNA, 22 nt, Homo sapiens
auggcccugcuaccacuuuucu

SEQ ID NO: 10091 - RNA, 23 nt, Homo sapiens
uucaccguguuggccaggcuggu

SEQ ID NO: 10092 - RNA, 22 nt, Homo sapiens
auagugcuuuugaaucuuguug

SEQ ID NO: 10093 - RNA, 22 nt, Homo sapiens
uauggcauuguuggugaugaua

SEQ ID NO: 10094 - RNA, 22 nt, Homo sapiens
uuguaacaguucugcgagcagc

SEQ ID NO: 10095 - RNA, 22 nt, Homo sapiens
aucugcauucccauguuuauug

SEQ ID NO: 10096 - RNA, 22 nt, Homo sapiens
ugaaauguugggugauggaauc

SEQ ID NO: 10097 - RNA, 22 nt, Homo sapiens
uggagugcaauggugagaucuu

SEQ ID NO: 10098 - RNA, 22 nt, Homo sapiens
uggcuugauggcacaagguuuc

SEQ ID NO: 10099 - RNA, 19 nt, Homo sapiens
uaugagcuaugacaugcau

SEQ ID NO: 10100 - RNA, 22 nt, Homo sapiens
auaaagcaagucucuggccuca

SEQ ID NO: 10101 - RNA, 20 nt, Homo sapiens
gcaguguucugaccugaauc

SEQ ID NO: 10102 - RNA, 22 nt, Homo sapiens
uucuucugguuaugaaauuuga

SEQ ID NO: 10103 - RNA, 22 nt, Homo sapiens
uggauguaauugauucauguug

SEQ ID NO: 10104 - RNA, 22 nt, Homo sapiens
ugagaugagggcugcacucaaa

SEQ ID NO: 10105 - RNA, 20 nt, Homo sapiens
ggaauguuaaucuccaugau

SEQ ID NO: 10106 - RNA, 22 nt, Homo sapiens
uccagguacucagggggcugag

SEQ ID NO: 10107 - RNA, 20 nt, Homo sapiens
uguugcacucuagccugggu

SEQ ID NO: 10108 - RNA, 17 nt, Homo sapiens
uagcucuauuucuagcc

SEQ ID NO: 10109 - RNA, 22 nt, Homo sapiens
ucccugacagucacagagcuac

SEQ ID NO: 10110 - RNA, 22 nt, Homo sapiens
uuccugugacuguguggcaccc

SEQ ID NO: 10111 - RNA, 22 nt, Homo sapiens
gucuaugguucaggguggagug

SEQ ID NO: 10112 - RNA, 22 nt, Homo sapiens
gauguguuuccaggauuuguuu

SEQ ID NO: 10113 - RNA, 18 nt, Homo sapiens
gagguuagguucugacag

SEQ ID NO: 10114 - RNA, 22 nt, Homo sapiens
aagcaggugugggaggaaaugg

SEQ ID NO: 10115 - RNA, 22 nt, Homo sapiens
uuucagguauuuaagggccguu

SEQ ID NO: 10116 - RNA, 22 nt, Homo sapiens
ugucuagaaaagccugccuucu

SEQ ID NO: 10117 - RNA, 22 nt, Homo sapiens
uggcaugaagaccccauccuuu

SEQ ID NO: 10118 - RNA, 22 nt, Homo sapiens
uaauauguuuugaaaucaggaa

SEQ ID NO: 10119 - RNA, 22 nt, Homo sapiens
gagaucuucguguggggagaca

SEQ ID NO: 10120 - RNA, 22 nt, Homo sapiens
ugaacagucaucucucuuguau

SEQ ID NO: 10121 - RNA, 20 nt, Homo sapiens
ggagguuguauaaguacauc

SEQ ID NO: 10122 - RNA, 22 nt, Homo sapiens
auagaauguuugcgccagguga

SEQ ID NO: 10123 - RNA, 22 nt, Homo sapiens
uggguagauaucauaguugccc

SEQ ID NO: 10124 - RNA, 22 nt, Homo sapiens
uugugcuuguaacuacauucag

SEQ ID NO: 10125 - RNA, 22 nt, Homo sapiens
gaugacagcugacucccuugcu

SEQ ID NO: 10126 - RNA, 23 nt, Homo sapiens
auugaacacuuucauaugugagg

SEQ ID NO: 10127 - RNA, 22 nt, Homo sapiens
uucuaaacaucuuacaaugcau

SEQ ID NO: 10128 - RNA, 22 nt, Homo sapiens
agccuguguugaauuauagaaa

SEQ ID NO: 10129 - RNA, 22 nt, Homo sapiens
uaauaguguuaaugcuagagcu

SEQ ID NO: 10130 - RNA, 22 nt, Homo sapiens
agaugguuuuguucacagcucu

SEQ ID NO: 10131 - RNA, 22 nt, Homo sapiens
ggcaccauuuuacuccuucccu

SEQ ID NO: 10132 - RNA, 22 nt, Homo sapiens
aaaugcucuguggguaguaaug

SEQ ID NO: 10133 - RNA, 22 nt, Homo sapiens
cuggagauuaaccaauugccau

SEQ ID NO: 10134 - RNA, 22 nt, Homo sapiens
auauguaguuucagaaguggaa

SEQ ID NO: 10135 - RNA, 22 nt, Homo sapiens
auagauucauuugaggagauuu

SEQ ID NO: 10136 - RNA, 19 nt, Homo sapiens
acauugcauuuguaggcuu

SEQ ID NO: 10137 - RNA, 22 nt, Homo sapiens
cuggaaugugagccccaaaaag

SEQ ID NO: 10138 - RNA, 22 nt, Homo sapiens
ugugcaguuuugagugaauuuc

SEQ ID NO: 10139 - RNA, 22 nt, Homo sapiens
ggguaaaucucuuuucauggcu

SEQ ID NO: 10140 - RNA, 22 nt, Homo sapiens
accauugcacuccaaccugggc

SEQ ID NO: 10141 - RNA, 22 nt, Homo sapiens
ugacggaggcauuggaagcuug

SEQ ID NO: 10142 - RNA, 22 nt, Homo sapiens
auggcagagucagaaagucagg

SEQ ID NO: 10143 - RNA, 22 nt, Homo sapiens
cugaggcacggcgaccuuaagu

SEQ ID NO: 10144 - RNA, 22 nt, Homo sapiens
augaacacuccaauuguacucc

SEQ ID NO: 10145 - RNA, 20 nt, Homo sapiens
ugaaaucuucacuaagucuc

SEQ ID NO: 10146 - RNA, 22 nt, Homo sapiens
caagugacugagccgccucggc

SEQ ID NO: 10147 - RNA, 22 nt, Homo sapiens
gcugcuguaccagaugugguua

SEQ ID NO: 10148 - RNA, 19 nt, Homo sapiens
uaggacccugguggccccc

SEQ ID NO: 10149 - RNA, 22 nt, Homo sapiens
caggcagucuggcucccaagug

SEQ ID NO: 10150 - RNA, 20 nt, Homo sapiens
guccauuugcugccauugcu

SEQ ID NO: 10151 - RNA, 22 nt, Homo sapiens
uaggucuccuuuuugccuaaau

SEQ ID NO: 10152 - RNA, 22 nt, Homo sapiens
ugagguagaaugauucuaauau

SEQ ID NO: 10153 - RNA, 22 nt, Homo sapiens
ucuguuguuaucauaauauuga

SEQ ID NO: 10154 - RNA, 22 nt, Homo sapiens
cuguuuguuuaggguacucaga

SEQ ID NO: 10155 - RNA, 22 nt, Homo sapiens
ucuucguuuaaagcaguggaag

SEQ ID NO: 10156 - RNA, 22 nt, Homo sapiens
uggagagugauaaguaaaugga

SEQ ID NO: 10157 - RNA, 22 nt, Homo sapiens
gaggagauauucugcuggaugg

SEQ ID NO: 10158 - RNA, 22 nt, Homo sapiens
uuaaagugcacacgggucaggc

SEQ ID NO: 10159 - RNA, 22 nt, Homo sapiens
acaucauugggggcuacaggug

SEQ ID NO: 10160 - RNA, 22 nt, Homo sapiens
uuauauguuacucccucuagca

SEQ ID NO: 10161 - RNA, 22 nt, Homo sapiens
ucccgaggacaucugggggcaa

SEQ ID NO: 10162 - RNA, 22 nt, Homo sapiens
cugagacuggugauuuaugaag

SEQ ID NO: 10163 - RNA, 22 nt, Homo sapiens
uaacccacgcagaauggacaag

SEQ ID NO: 10164 - RNA, 22 nt, Homo sapiens
ugaaaugccuuuaaugaauuua

SEQ ID NO: 10165 - RNA, 22 nt, Homo sapiens
gggaggucauuguucaaugcug

SEQ ID NO: 10166 - RNA, 22 nt, Homo sapiens
aguauguagugcaaucagucag

SEQ ID NO: 10167 - RNA, 22 nt, Homo sapiens
uagguaggaaguguuguuuuua

SEQ ID NO: 10168 - RNA, 22 nt, Homo sapiens
cuggauauuaacauugaugaaa

SEQ ID NO: 10169 - RNA, 22 nt, Homo sapiens
uagagcacauuaucauuuccaa

SEQ ID NO: 10170 - RNA, 22 nt, Homo sapiens
ugagaacugcagggagcugcau

SEQ ID NO: 10171 - RNA, 22 nt, Homo sapiens
auuguacauacaccggugugua

SEQ ID NO: 10172 - RNA, 22 nt, Homo sapiens
uuuugguguacaauucuaugga

SEQ ID NO: 10173 - RNA, 22 nt, Homo sapiens
augugaacugaauuaauucaca

SEQ ID NO: 10174 - RNA, 22 nt, Homo sapiens
uguggcaaagucuugugaauau

SEQ ID NO: 10175 - RNA, 22 nt, Homo sapiens
uuuggaaugaaacagcagagcc

SEQ ID NO: 10176 - RNA, 22 nt, Homo sapiens
cugaauagucaacgauggacug

SEQ ID NO: 10177 - RNA, 19 nt, Homo sapiens
uuacagugugcccuuuuag

SEQ ID NO: 10178 - RNA, 17 nt, Homo sapiens
accagugcaugugcuuu

SEQ ID NO: 10179 - RNA, 22 nt, Homo sapiens
uggcaauaauucagugugggcu

SEQ ID NO: 10180 - RNA, 22 nt, Homo sapiens
uuaaggcagugcaucuggaguu

SEQ ID NO: 10181 - RNA, 23 nt, Homo sapiens
uaaguucaucucuaauaggugga

SEQ ID NO: 10182 - RNA, 16 nt, Homo sapiens
ugcagaguaggugaau

SEQ ID NO: 10183 - RNA, 22 nt, Homo sapiens
augagaugaauaccgacgaugu

SEQ ID NO: 10184 - RNA, 22 nt, Homo sapiens
ucuggguuuuuacaauguuuac

SEQ ID NO: 10185 - RNA, 22 nt, Homo sapiens
ucaaugggcuacacauugagug

SEQ ID NO: 10186 - RNA, 22 nt, Homo sapiens
cuuaaguaguuguggaaugaau

SEQ ID NO: 10187 - RNA, 22 nt, Homo sapiens
uuggagcccuaacucucaguac

SEQ ID NO: 10188 - RNA, 22 nt, Homo sapiens
uugagauggagucucacucugc

SEQ ID NO: 10189 - RNA, 22 nt, Homo sapiens
ugucaggaugcuccuuuuggcu

SEQ ID NO: 10190 - RNA, 22 nt, Homo sapiens
guaaauaccaguuucuggaaca

SEQ ID NO: 10191 - RNA, 22 nt, Homo sapiens
aucuggcguuuacuuccuuccu

SEQ ID NO: 10192 - RNA, 22 nt, Homo sapiens
gcuuguguuugcuccccagaau

SEQ ID NO: 10193 - RNA, 22 nt, Homo sapiens
auggauauugccuaggguagua

SEQ ID NO: 10194 - RNA, 22 nt, Homo sapiens
uugacauaaucauuucacagug

SEQ ID NO: 10195 - RNA, 22 nt, Homo sapiens
ugagcugagaucacacuacugu

SEQ ID NO: 10196 - RNA, 22 nt, Homo sapiens
augagguaauaaguccuuggaa

SEQ ID NO: 10197 - RNA, 22 nt, Homo sapiens
agccuagagagccacuuugaga

SEQ ID NO: 10198 - RNA, 22 nt, Homo sapiens
gugaagaucccuguccuguucc

SEQ ID NO: 10199 - RNA, 22 nt, Homo sapiens
ugaguagaacuccuggagaugu

SEQ ID NO: 10200 - RNA, 22 nt, Homo sapiens
acauaugaguacaugugccaug

SEQ ID NO: 10201 - RNA, 22 nt, Homo sapiens
uugcuccccaggaaaggaagca

SEQ ID NO: 10202 - RNA, 22 nt, Homo sapiens
uugacacuuuguaagaaagggg

SEQ ID NO: 10203 - RNA, 22 nt, Homo sapiens
uaucaguauggauucauggauu

SEQ ID NO: 10204 - RNA, 22 nt, Homo sapiens
aucaaaucuccagaaccugucu

SEQ ID NO: 10205 - RNA, 22 nt, Homo sapiens
acccuggaguaguaggaaucug

SEQ ID NO: 10206 - RNA, 22 nt, Homo sapiens
aggcaugauggcuccagaucau

SEQ ID NO: 10207 - RNA, 22 nt, Homo sapiens
agcaagauuguucccauuuucu

SEQ ID NO: 10208 - RNA, 22 nt, Homo sapiens
gcacaguguuacuugauauauu

SEQ ID NO: 10209 - RNA, 22 nt, Homo sapiens
aauggcaucuagaguggugaau

SEQ ID NO: 10210 - RNA, 22 nt, Homo sapiens
uguauacauguguguucacgca

SEQ ID NO: 10211 - RNA, 22 nt, Homo sapiens
uuacaguucugguggagaggua

SEQ ID NO: 10212 - RNA, 21 nt, Homo sapiens
ugucaagugggaaaacaugua

SEQ ID NO: 10213 - RNA, 22 nt, Homo sapiens
cuugcagagcccauggauguca

SEQ ID NO: 10214 - RNA, 22 nt, Homo sapiens
uuugugacuugcuucucagaau

SEQ ID NO: 10215 - RNA, 22 nt, Homo sapiens
guuauggaguauaugugaacug

SEQ ID NO: 10216 - RNA, 22 nt, Homo sapiens
augguacuagaguaagaauugu

SEQ ID NO: 10217 - RNA, 22 nt, Homo sapiens
uagguagugugugcaugagagg

SEQ ID NO: 10218 - RNA, 22 nt, Homo sapiens
cugaauguuucacucugaaaug

SEQ ID NO: 10219 - RNA, 22 nt, Homo sapiens
aguaagucucaagguaggguag

SEQ ID NO: 10220 - RNA, 22 nt, Homo sapiens
cugaauguuuucuucuauucug

SEQ ID NO: 10221 - RNA, 22 nt, Homo sapiens
uggaguguagcggcaccuauua

SEQ ID NO: 10222 - RNA, 22 nt, Homo sapiens
accaguuuuuuauacaucuucu

SEQ ID NO: 10223 - RNA, 22 nt, Homo sapiens
uauugcuaaaacucaugguugc

SEQ ID NO: 10224 - RNA, 18 nt, Homo sapiens
gauguaguauggugugga

SEQ ID NO: 10225 - RNA, 22 nt, Homo sapiens
aguaccauuagauuaggaugac

SEQ ID NO: 10226 - RNA, 20 nt, Homo sapiens
uaugagacugggagaaguuc

SEQ ID NO: 10227 - RNA, 23 nt, Homo sapiens
uggucccguguucuggcuuuagg

SEQ ID NO: 10228 - RNA, 21 nt, Homo sapiens
uauaguaguaugauuuacaau

SEQ ID NO: 10229 - RNA, 22 nt, Homo sapiens
guucaguaguucauucauuuau

SEQ ID NO: 10230 - RNA, 22 nt, Homo sapiens
uauuuggauagucuggaaaaaa

SEQ ID NO: 10231 - RNA, 22 nt, Homo sapiens
uuccgcuguaguuguugguacc

SEQ ID NO: 10232 - RNA, 22 nt, Homo sapiens
acacuuucuggagcugcacaua

SEQ ID NO: 10233 - RNA, 22 nt, Homo sapiens
guauggaauuugugaccuuaua

SEQ ID NO: 10234 - RNA, 17 nt, Homo sapiens
ugacuagugcccuuauu

SEQ ID NO: 10235 - RNA, 20 nt, Homo sapiens
ugucccaaccccauggguuc

SEQ ID NO: 10236 - RNA, 22 nt, Homo sapiens
auggcuuuggucucccagugau

SEQ ID NO: 10237 - RNA, 22 nt, Homo sapiens
uauugcccugcuuuguucuaaa

SEQ ID NO: 10238 - RNA, 22 nt, Homo sapiens
cuccuggugauuggagugugaa

SEQ ID NO: 10239 - RNA, 22 nt, Homo sapiens
ugcagugcaugacuguguuaug

SEQ ID NO: 10240 - RNA, 22 nt, Homo sapiens
aagaccuaugcaggaagaaaug

SEQ ID NO: 10241 - RNA, 22 nt, Homo sapiens
uggcagcugcuucaugggaugc

SEQ ID NO: 10242 - RNA, 17 nt, Homo sapiens
aaucagauuucugagga

SEQ ID NO: 10243 - RNA, 22 nt, Homo sapiens
cucccagagccaguuauaggcu

SEQ ID NO: 10244 - RNA, 22 nt, Homo sapiens
uguugcacuccagccugggcaa

SEQ ID NO: 10245 - RNA, 22 nt, Homo sapiens
aucuuggauuaccugggugggu

SEQ ID NO: 10246 - RNA, 22 nt, Homo sapiens
ugugguuuuaguaaaacuaugu

SEQ ID NO: 10247 - RNA, 19 nt, Homo sapiens
uugagcacugccggaguua

SEQ ID NO: 10248 - RNA, 20 nt, Homo sapiens
uacacguguagcauucucua

SEQ ID NO: 10249 - RNA, 22 nt, Homo sapiens
uuuuagcaaagagacugguggc

SEQ ID NO: 10250 - RNA, 22 nt, Homo sapiens
agaacacugaguucagggucag

SEQ ID NO: 10251 - RNA, 22 nt, Homo sapiens
uaugucauggguaaagugcccu

SEQ ID NO: 10252 - RNA, 22 nt, Homo sapiens
uagugcccuuauaagagcagga

SEQ ID NO: 10253 - RNA, 22 nt, Homo sapiens
gggcaugauggugcacacaugu

SEQ ID NO: 10254 - RNA, 22 nt, Homo sapiens
uugugaaugaugccgcaauaaa

SEQ ID NO: 10255 - RNA, 22 nt, Homo sapiens
uugugaauggugccgcaguaaa

SEQ ID NO: 10256 - RNA, 22 nt, Homo sapiens
guugacuaggagcuacuacuac

SEQ ID NO: 10257 - RNA, 22 nt, Homo sapiens
aauugcacuacugcacucccac

SEQ ID NO: 10258 - RNA, 22 nt, Homo sapiens
uuuauccagccucuagcaaggu

SEQ ID NO: 10259 - RNA, 22 nt, Homo sapiens
aguggguguuccauuggauaaa

SEQ ID NO: 10260 - RNA, 23 nt, Homo sapiens
augaaagcccuugcaaaugcugg

SEQ ID NO: 10261 - RNA, 22 nt, Homo sapiens
uacugagagaggaauauugaaa

SEQ ID NO: 10262 - RNA, 22 nt, Homo sapiens
agggaauguaaguuuuaugaga

SEQ ID NO: 10263 - RNA, 22 nt, Homo sapiens
ugaaauaguuaaguugccuagu

SEQ ID NO: 10264 - RNA, 22 nt, Homo sapiens
uugauuuguagaaugccccaac

SEQ ID NO: 10265 - RNA, 22 nt, Homo sapiens
uaaaugcuugagaugauggaua

SEQ ID NO: 10266 - RNA, 22 nt, Homo sapiens
ugagauagaaaacauaggagaa

SEQ ID NO: 10267 - RNA, 22 nt, Homo sapiens
caugaaagacugaggaauugga

SEQ ID NO: 10268 - RNA, 22 nt, Homo sapiens
guaaucucagcuacuugggagc

SEQ ID NO: 10269 - RNA, 21 nt, Homo sapiens
ggcucuguggucucagguuuc

SEQ ID NO: 10270 - RNA, 22 nt, Homo sapiens
augaauguaaagaaugugggaa

SEQ ID NO: 10271 - RNA, 22 nt, Homo sapiens
uuaaaggcauguacacuagagu

SEQ ID NO: 10272 - RNA, 22 nt, Homo sapiens
gggcaugaugucuuaugccuau

SEQ ID NO: 10273 - RNA, 22 nt, Homo sapiens
agagaucaauaugaaggaaaug

SEQ ID NO: 10274 - RNA, 22 nt, Homo sapiens
cuuuguggggucuuuccucaaa

SEQ ID NO: 10275 - RNA, 22 nt, Homo sapiens
cagugaauuucaggucaagagu

SEQ ID NO: 10276 - RNA, 22 nt, Homo sapiens
uuggauuauaaacugagauuug

SEQ ID NO: 10277 - RNA, 22 nt, Homo sapiens
uggucuggagagucccgcccag

SEQ ID NO: 10278 - RNA, 22 nt, Homo sapiens
gauugcuaaauuguccuucugu

SEQ ID NO: 10279 - RNA, 22 nt, Homo sapiens
gcaaaauugagaagggaauaua

SEQ ID NO: 10280 - RNA, 22 nt, Homo sapiens
uucagcuacuugggaggcugaa

SEQ ID NO: 10281 - RNA, 22 nt, Homo sapiens
uggauauguucuuuguguaagg

SEQ ID NO: 10282 - RNA, 22 nt, Homo sapiens
ucuuugguauugugaauagugu

SEQ ID NO: 10283 - RNA, 20 nt, Homo sapiens
agacuagggagcagaaagcc

SEQ ID NO: 10284 - RNA, 22 nt, Homo sapiens
ugaagaucuuaggagcugaggg

SEQ ID NO: 10285 - RNA, 22 nt, Homo sapiens
aauacugugauaucgagcgauu

SEQ ID NO: 10286 - RNA, 22 nt, Homo sapiens
uagcagccaggaagggcuggcu

SEQ ID NO: 10287 - RNA, 22 nt, Homo sapiens
uuugccuuugugauauggucua

SEQ ID NO: 10288 - RNA, 22 nt, Homo sapiens
cuguagcuuuuauaugcuuagc

SEQ ID NO: 10289 - RNA, 22 nt, Homo sapiens
auacaguaaugucuuaggcugu

SEQ ID NO: 10290 - RNA, 22 nt, Homo sapiens
uaagggcaugcugcaugagagu

SEQ ID NO: 10291 - RNA, 22 nt, Homo sapiens
uugauuagauccaguugauuga

SEQ ID NO: 10292 - RNA, 22 nt, Homo sapiens
uggaagaugggaccucaguuuu

SEQ ID NO: 10293 - RNA, 22 nt, Homo sapiens
ucucagcacagucagggcgccu

SEQ ID NO: 10294 - RNA, 22 nt, Homo sapiens
cugggaucaguucuagucagaa

SEQ ID NO: 10295 - RNA, 22 nt, Homo sapiens
aaagcacuggagucaucaucua

SEQ ID NO: 10296 - RNA, 22 nt, Homo sapiens
auucaccauggaccaggggccu

SEQ ID NO: 10297 - RNA, 22 nt, Homo sapiens
ugugguagugcuuaccugcagu

SEQ ID NO: 10298 - RNA, 22 nt, Homo sapiens
uugauaguaccauugggaaauu

SEQ ID NO: 10299 - RNA, 22 nt, Homo sapiens
auggaaucauccuccugggagc

SEQ ID NO: 10300 - RNA, 20 nt, Homo sapiens
uggcuaaaugaaugauagca

SEQ ID NO: 10301 - RNA, 18 nt, Homo sapiens
ucagagugcagacuauac

SEQ ID NO: 10302 - RNA, 22 nt, Homo sapiens
uaaggcacucuucugugugccu

SEQ ID NO: 10303 - RNA, 22 nt, Homo sapiens
ucagguaucuucauagcaaugc

SEQ ID NO: 10304 - RNA, 22 nt, Homo sapiens
guacaguucucuuuguugucag

SEQ ID NO: 10305 - RNA, 22 nt, Homo sapiens
gauaugaccauguagaccucag

SEQ ID NO: 10306 - RNA, 17 nt, Homo sapiens
uuaugagacuucuuagc

SEQ ID NO: 10307 - RNA, 22 nt, Homo sapiens
ggggcauugugucuggguuccu

SEQ ID NO: 10308 - RNA, 22 nt, Homo sapiens
guggacguguguccccauggcu

SEQ ID NO: 10309 - RNA, 22 nt, Homo sapiens
ugggagacuacauuuuuaacaa

SEQ ID NO: 10310 - RNA, 20 nt, Homo sapiens
cuccuucauuccuuuggacc

SEQ ID NO: 10311 - RNA, 22 nt, Homo sapiens
accaucuagauuuguguaggua

SEQ ID NO: 10312 - RNA, 22 nt, Homo sapiens
gugucuccuguggagcuaugua

SEQ ID NO: 10313 - RNA, 22 nt, Homo sapiens
ucgcugcgaccuccaccucccg

SEQ ID NO: 10314 - RNA, 22 nt, Homo sapiens
cuuuguguggacauuucaggca

SEQ ID NO: 10315 - RNA, 22 nt, Homo sapiens
aagucauggaggaguaugugag

SEQ ID NO: 10316 - RNA, 22 nt, Homo sapiens
uagcagugugaaaacagacuaa

SEQ ID NO: 10317 - RNA, 22 nt, Homo sapiens
uaaggcuaggaauucucugaag

SEQ ID NO: 10318 - RNA, 22 nt, Homo sapiens
guaguaccauuaggauauuucu

SEQ ID NO: 10319 - RNA, 19 nt, Homo sapiens
uggugccuuguucuuggau

SEQ ID NO: 10320 - RNA, 22 nt, Homo sapiens
uacucugcaguaauuccagccc

SEQ ID NO: 10321 - RNA, 20 nt, Homo sapiens
ucucauggagggaaagagca

SEQ ID NO: 10322 - RNA, 22 nt, Homo sapiens
ugacaacugauuaacuccuuua

SEQ ID NO: 10323 - RNA, 22 nt, Homo sapiens
uugauacuagagucuuucugac

SEQ ID NO: 10324 - RNA, 22 nt, Homo sapiens
uggaagcaugcaaucugugggg

SEQ ID NO: 10325 - RNA, 22 nt, Homo sapiens
guaacacucuaaagggaugcac

SEQ ID NO: 10326 - RNA, 22 nt, Homo sapiens
uggguaaaucucuguucagggc

SEQ ID NO: 10327 - RNA, 22 nt, Homo sapiens
ugaggucacuuguuuuaugcuu

SEQ ID NO: 10328 - RNA, 22 nt, Homo sapiens
auauugcuccuaauaccacggu

SEQ ID NO: 10329 - RNA, 22 nt, Homo sapiens
uagguugucaucagucuccacu

SEQ ID NO: 10330 - RNA, 22 nt, Homo sapiens
ggcaaggauuagauucuccccu

SEQ ID NO: 10331 - RNA, 22 nt, Homo sapiens
acccuuaagcacuaguucagcu

SEQ ID NO: 10332 - RNA, 22 nt, Homo sapiens
cugugcacaucuggcggcccga

SEQ ID NO: 10333 - RNA, 22 nt, Homo sapiens
acugcaaugucgaauagagaug

SEQ ID NO: 10334 - RNA, 22 nt, Homo sapiens
uagcugcccagcacgaaguugg

SEQ ID NO: 10335 - RNA, 22 nt, Homo sapiens
uuuaagccaggugcaguggcuc

SEQ ID NO: 10336 - RNA, 23 nt, Homo sapiens
uuggaaugagaccuaagaguuuu

SEQ ID NO: 10337 - RNA, 22 nt, Homo sapiens
ugaaauacuuaauuucuccaug

SEQ ID NO: 10338 - RNA, 22 nt, Homo sapiens
gcaagaaugagaaggauuaauu

SEQ ID NO: 10339 - RNA, 22 nt, Homo sapiens
augaccaaagaaaugcuauagg

SEQ ID NO: 10340 - RNA, 22 nt, Homo sapiens
accauugcacuccagccugggc

SEQ ID NO: 10341 - RNA, 22 nt, Homo sapiens
aucacauggccuagccuaaccu

SEQ ID NO: 10342 - RNA, 22 nt, Homo sapiens
ucacagugaguggaguggggug

SEQ ID NO: 10343 - RNA, 22 nt, Homo sapiens
auuuaugguuaauauaggaagu

SEQ ID NO: 10344 - RNA, 22 nt, Homo sapiens
augccacugcacuucagcuugg

SEQ ID NO: 10345 - RNA, 23 nt, Homo sapiens
aucagauaguuguagguaugugg

SEQ ID NO: 10346 - RNA, 22 nt, Homo sapiens
cugcauuggguuaugcauuuuu

SEQ ID NO: 10347 - RNA, 22 nt, Homo sapiens
uacaccaauuuaaucaaaagca

SEQ ID NO: 10348 - RNA, 22 nt, Homo sapiens
auaaggcagcugcuaaaaggca

SEQ ID NO: 10349 - RNA, 22 nt, Homo sapiens
auggccuuguauaccuggcaaa

SEQ ID NO: 10350 - RNA, 22 nt, Homo sapiens
aucacugggcaagauaucauga

SEQ ID NO: 10351 - RNA, 22 nt, Homo sapiens
uugugagggagcuaagaugagu

SEQ ID NO: 10352 - RNA, 18 nt, Homo sapiens
ucuggcuucuuuguucca

SEQ ID NO: 10353 - RNA, 22 nt, Homo sapiens
auggauagucucacucacauac

SEQ ID NO: 10354 - RNA, 22 nt, Homo sapiens
uuucugcuugagagaauugcug

SEQ ID NO: 10355 - RNA, 22 nt, Homo sapiens
ucaauguaucuccaagaauuga

SEQ ID NO: 10356 - RNA, 22 nt, Homo sapiens
augaaugcaugaagguugggug

SEQ ID NO: 10357 - RNA, 22 nt, Homo sapiens
agacucauuuccauagucagcu

SEQ ID NO: 10358 - RNA, 22 nt, Homo sapiens
augccacuguacucuagccuag

SEQ ID NO: 10359 - RNA, 23 nt, Homo sapiens
cuacuagucaagucuuuuccagu

SEQ ID NO: 10360 - RNA, 22 nt, Homo sapiens
uagcugguucuccaggagcuag

SEQ ID NO: 10361 - RNA, 22 nt, Homo sapiens
cugacaucuucaagugaggaga

SEQ ID NO: 10362 - RNA, 22 nt, Homo sapiens
ucgcugggaagacugaaguguc

SEQ ID NO: 10363 - RNA, 22 nt, Homo sapiens
uugugguuuucagcuuauauau

SEQ ID NO: 10364 - RNA, 22 nt, Homo sapiens
auggccauuacuaagaauguuu

SEQ ID NO: 10365 - RNA, 22 nt, Homo sapiens
uuaaaugucuguagaugugcug

SEQ ID NO: 10366 - RNA, 22 nt, Homo sapiens
uugguacuacacuucuaaucuu

SEQ ID NO: 10367 - RNA, 22 nt, Homo sapiens
uuggcaguaucuacuacagcua

SEQ ID NO: 10368 - RNA, 22 nt, Homo sapiens
acacuguuuuguggagaaugua

SEQ ID NO: 10369 - RNA, 22 nt, Homo sapiens
uggcaagagcaaaauguacagu

SEQ ID NO: 10370 - RNA, 22 nt, Homo sapiens
uccuuuagacugaauccugaga

SEQ ID NO: 10371 - RNA, 22 nt, Homo sapiens
acuuuguuauggcaacccuaag

SEQ ID NO: 10372 - RNA, 19 nt, Homo sapiens
augaguuaggggaaauuuc

SEQ ID NO: 10373 - RNA, 22 nt, Homo sapiens
uuauugcuuuugugcaggugag

SEQ ID NO: 10374 - RNA, 22 nt, Homo sapiens
uggguaguguaaagcacuccag

SEQ ID NO: 10375 - RNA, 22 nt, Homo sapiens
gaaaugcucauuuuggauccuu

SEQ ID NO: 10376 - RNA, 22 nt, Homo sapiens
aauacugcuuugauguaagcua

SEQ ID NO: 10377 - RNA, 22 nt, Homo sapiens
ugagauccugugacuacacuga

SEQ ID NO: 10378 - RNA, 22 nt, Homo sapiens
uggccaguugaagacaaugcuc

SEQ ID NO: 10379 - RNA, 21 nt, Homo sapiens
aggauaguagauuaaauauuu

SEQ ID NO: 10380 - RNA, 22 nt, Homo sapiens
gaaugguaaacuuccaugacug

SEQ ID NO: 10381 - RNA, 22 nt, Homo sapiens
ugcaaugugaaauaagcacauc

SEQ ID NO: 10382 - RNA, 22 nt, Homo sapiens
uaacagcauuugugucuaguag

SEQ ID NO: 10383 - RNA, 22 nt, Homo sapiens
acugaaucaucagguguguuug

SEQ ID NO: 10384 - RNA, 22 nt, Homo sapiens
ugagauuaucuguacauaggag

SEQ ID NO: 10385 - RNA, 22 nt, Homo sapiens
aauggcaagagccacagaggcg

SEQ ID NO: 10386 - RNA, 22 nt, Homo sapiens
gucuuggagaacucagcuuggc

SEQ ID NO: 10387 - RNA, 22 nt, Homo sapiens
uggcauauaauauagaagacua

SEQ ID NO: 10388 - RNA, 22 nt, Homo sapiens
ugaaaguaauugcaguuuuuac

SEQ ID NO: 10389 - RNA, 20 nt, Homo sapiens
agcugguuuuaugaaucuuu

SEQ ID NO: 10390 - RNA, 19 nt, Homo sapiens
uggucaguucugggagcug

SEQ ID NO: 10391 - RNA, 22 nt, Homo sapiens
cauugcacuuagacaacuuuug

SEQ ID NO: 10392 - RNA, 18 nt, Homo sapiens
acagugcugucacugcuu

SEQ ID NO: 10393 - RNA, 22 nt, Homo sapiens
aaguuaauguuuaagacuccua

SEQ ID NO: 10394 - RNA, 22 nt, Homo sapiens
agcuccuacuguuacaucauug

SEQ ID NO: 10395 - RNA, 22 nt, Homo sapiens
guaaucuguaguaaagcaccau

SEQ ID NO: 10396 - RNA, 22 nt, Homo sapiens
aaaugcccuaaaauggagcauc

SEQ ID NO: 10397 - RNA, 22 nt, Homo sapiens
aagugaaugaugugaaguguaa

SEQ ID NO: 10398 - RNA, 22 nt, Homo sapiens
augagaucugugaacaccuguc

SEQ ID NO: 10399 - RNA, 22 nt, Homo sapiens
ugaggaacuagcuacccuaaua

SEQ ID NO: 10400 - RNA, 22 nt, Homo sapiens
cucugagguuauucguaauauu

SEQ ID NO: 10401 - RNA, 21 nt, Homo sapiens
agcugcguuuaggcauuuucc

SEQ ID NO: 10402 - RNA, 22 nt, Homo sapiens
gaguauauuugcacuguuaugu

SEQ ID NO: 10403 - RNA, 20 nt, Homo sapiens
auguucuggaggacagaagc

SEQ ID NO: 10404 - RNA, 22 nt, Homo sapiens
augcacuuggcaggaugauucc

SEQ ID NO: 10405 - RNA, 20 nt, Homo sapiens
uggagugaagguucuggacc

SEQ ID NO: 10406 - RNA, 22 nt, Homo sapiens
ucugugaaugaacacuugaaaa

SEQ ID NO: 10407 - RNA, 22 nt, Homo sapiens
ucuuugguuguuuagggugcau

SEQ ID NO: 10408 - RNA, 22 nt, Homo sapiens
uggugccguccugcaauccugg

SEQ ID NO: 10409 - RNA, 21 nt, Homo sapiens
cuuuugcacuccagccugggu

SEQ ID NO: 10410 - RNA, 22 nt, Homo sapiens
ugagcacauuuacaucaguucc

SEQ ID NO: 10411 - RNA, 22 nt, Homo sapiens
uuugguguauaaaaaugcuagu

SEQ ID NO: 10412 - RNA, 21 nt, Homo sapiens
cccugguguuuggaguuugag

SEQ ID NO: 10413 - RNA, 22 nt, Homo sapiens
cuugauagugguaaucauuuuu

SEQ ID NO: 10414 - RNA, 20 nt, Homo sapiens
uggaaugcagccuccuucug

SEQ ID NO: 10415 - RNA, 22 nt, Homo sapiens
guuauguuaaauuguuguaugc

SEQ ID NO: 10416 - RNA, 22 nt, Homo sapiens
aagcuacuuuggugguuccuua

SEQ ID NO: 10417 - RNA, 22 nt, Homo sapiens
agguuaccuggugauuuugucu

SEQ ID NO: 10418 - RNA, 22 nt, Homo sapiens
uuguaaucaacacaucauuggg

SEQ ID NO: 10419 - RNA, 22 nt, Homo sapiens
aaugcacauauauuuccuuauu

SEQ ID NO: 10420 - RNA, 22 nt, Homo sapiens
uauuagugucuuuugguuagaa

SEQ ID NO: 10421 - RNA, 21 nt, Homo sapiens
ugucuagaccucauccuacag

SEQ ID NO: 10422 - RNA, 22 nt, Homo sapiens
uuggauugugaaaguauucucu

SEQ ID NO: 10423 - RNA, 22 nt, Homo sapiens
uucacaauuaaaugugguuauu

SEQ ID NO: 10424 - RNA, 22 nt, Homo sapiens
uucauagucuaauuuuuuccac

SEQ ID NO: 10425 - RNA, 22 nt, Homo sapiens
ccagaguggagccuuugcgagg

SEQ ID NO: 10426 - RNA, 22 nt, Homo sapiens
uggaaucuacuaaagcaaaauc

SEQ ID NO: 10427 - RNA, 22 nt, Homo sapiens
ucacuuggccgcagccuucucu

SEQ ID NO: 10428 - RNA, 22 nt, Homo sapiens
cuuuggcaaugucauuuucaau

SEQ ID NO: 10429 - RNA, 22 nt, Homo sapiens
cugacacuucaaaacugccaau

SEQ ID NO: 10430 - RNA, 22 nt, Homo sapiens
uuauuagcacccuaccaugugg

SEQ ID NO: 10431 - RNA, 22 nt, Homo sapiens
gugagaccaauguacuaccuuc

SEQ ID NO: 10432 - RNA, 22 nt, Homo sapiens
auagcagaagaagggacaauuc

SEQ ID NO: 10433 - RNA, 21 nt, Homo sapiens
uauccacuugcaacagagaag

SEQ ID NO: 10434 - RNA, 22 nt, Homo sapiens
cacagcuagucaaugguagaca

SEQ ID NO: 10435 - RNA, 22 nt, Homo sapiens
ugucacccuuuauccauuuccu

SEQ ID NO: 10436 - RNA, 22 nt, Homo sapiens
aucaagcuugacuccuuaaagg

SEQ ID NO: 10437 - RNA, 22 nt, Homo sapiens
augauauggguugucaguugua

SEQ ID NO: 10438 - RNA, 21 nt, Homo sapiens
gugcaaacaucauagaaugua

SEQ ID NO: 10439 - RNA, 22 nt, Homo sapiens
uuccuucaugcuugaaggguau

SEQ ID NO: 10440 - RNA, 22 nt, Homo sapiens
guuauuguccauuuauuuagca

SEQ ID NO: 10441 - RNA, 22 nt, Homo sapiens
uacauguauguguuuauggcug

SEQ ID NO: 10442 - RNA, 22 nt, Homo sapiens
uuagucaaguguacugugaaug

SEQ ID NO: 10443 - RNA, 22 nt, Homo sapiens
ugagcagaaguuuugauuggcg

SEQ ID NO: 10444 - RNA, 22 nt, Homo sapiens
uuuuagcuuuucccaggacucc

SEQ ID NO: 10445 - RNA, 23 nt, Homo sapiens
acauguauagacuuuuuuuccuu

SEQ ID NO: 10446 - RNA, 22 nt, Homo sapiens
cucucugagccccagacaccuu

SEQ ID NO: 10447 - RNA, 19 nt, Homo sapiens
aagaugauguuugggcuaa

SEQ ID NO: 10448 - RNA, 22 nt, Homo sapiens
uugugguuauagagucucccug

SEQ ID NO: 10449 - RNA, 22 nt, Homo sapiens
aaagugccuucuauuuuaguga

SEQ ID NO: 10450 - RNA, 22 nt, Homo sapiens
ucugagguuaaauuuuauaguu

SEQ ID NO: 10451 - RNA, 22 nt, Homo sapiens
gugaccauuugacauauccuug

SEQ ID NO: 10452 - RNA, 22 nt, Homo sapiens
ugaguauguuuagaaguaaagg

SEQ ID NO: 10453 - RNA, 20 nt, Homo sapiens
uuggugaccuguuugguauu

SEQ ID NO: 10454 - RNA, 22 nt, Homo sapiens
ugagggaugcguacccuaugcc

SEQ ID NO: 10455 - RNA, 21 nt, Homo sapiens
gggcaaaucuuuauccuaagc

SEQ ID NO: 10456 - RNA, 22 nt, Homo sapiens
gucaaaugcacagaaccauuaa

SEQ ID NO: 10457 - RNA, 22 nt, Homo sapiens
augaggcaggaaaggcguaucu

SEQ ID NO: 10458 - RNA, 22 nt, Homo sapiens
gagauaaauaggucacaguucu

SEQ ID NO: 10459 - RNA, 16 nt, Homo sapiens
cacuggucuuaccaug

SEQ ID NO: 10460 - RNA, 22 nt, Homo sapiens
ugguaucauuuuaucugcucua

SEQ ID NO: 10461 - RNA, 22 nt, Homo sapiens
augugacuugugaaaaguucag

SEQ ID NO: 10462 - RNA, 22 nt, Homo sapiens
uuuagcgaaugcuugcuccugu

SEQ ID NO: 10463 - RNA, 22 nt, Homo sapiens
cugagcuaguagcauuguguca

SEQ ID NO: 10464 - RNA, 18 nt, Homo sapiens
cuaugccacuuuauauca

SEQ ID NO: 10465 - RNA, 22 nt, Homo sapiens
accucagcccggggaaguugag

SEQ ID NO: 10466 - RNA, 22 nt, Homo sapiens
gugaggcacugcugcuuuccag

SEQ ID NO: 10467 - RNA, 22 nt, Homo sapiens
ugguggcuuuucguagguucac

SEQ ID NO: 10468 - RNA, 22 nt, Homo sapiens
ugugcaaucuuccauuuuuagg

SEQ ID NO: 10469 - RNA, 22 nt, Homo sapiens
uuaguuuaucagugguuucuga

SEQ ID NO: 10470 - RNA, 22 nt, Homo sapiens
ugugaaaucagauagccuuuuu

SEQ ID NO: 10471 - RNA, 22 nt, Homo sapiens
agguuaucccgcauuauuuggu

SEQ ID NO: 10472 - RNA, 22 nt, Homo sapiens
ugauaucugaucauccuugaua

SEQ ID NO: 10473 - RNA, 22 nt, Homo sapiens
uuugaguaggcuuauauuuugg

SEQ ID NO: 10474 - RNA, 22 nt, Homo sapiens
ggcacaaugucagcucacugca

SEQ ID NO: 10475 - RNA, 22 nt, Homo sapiens
aguaaucaucugagggcagaaa

SEQ ID NO: 10476 - RNA, 22 nt, Homo sapiens
acugacaugaucaggcauguuc

SEQ ID NO: 10477 - RNA, 22 nt, Homo sapiens
uuugccaauauuuuauugagga

SEQ ID NO: 10478 - RNA, 22 nt, Homo sapiens
uccugagucagcauccguuugu

SEQ ID NO: 10479 - RNA, 19 nt, Homo sapiens
guauuugacuuucuuguuu

SEQ ID NO: 10480 - RNA, 22 nt, Homo sapiens
uccucaguggauuggauggugc

SEQ ID NO: 10481 - RNA, 22 nt, Homo sapiens
cuggaagcacaacgcauuuauu

SEQ ID NO: 10482 - RNA, 22 nt, Homo sapiens
gagagugugucagaggcugcga

SEQ ID NO: 10483 - RNA, 22 nt, Homo sapiens
ugagaugauuuaauggagccca

SEQ ID NO: 10484 - RNA, 22 nt, Homo sapiens
uugugccauucuucugccucag

SEQ ID NO: 10485 - RNA, 22 nt, Homo sapiens
uagaguaguggcgugaucucgg

SEQ ID NO: 10486 - RNA, 22 nt, Homo sapiens
ucuuuggucuacuuucauaugu

SEQ ID NO: 10487 - RNA, 22 nt, Homo sapiens
cugugcuuggagucccccuagg

SEQ ID NO: 10488 - RNA, 22 nt, Homo sapiens
ugagauagggucucacucuguc

SEQ ID NO: 10489 - RNA, 22 nt, Homo sapiens
augguauuuaacagucuuucua

SEQ ID NO: 10490 - RNA, 22 nt, Homo sapiens
uucaacugcuucagccucccaa

SEQ ID NO: 10491 - RNA, 22 nt, Homo sapiens
ugaauguacuuaacacuggauu

SEQ ID NO: 10492 - RNA, 21 nt, Homo sapiens
uagcauacauuuugcaucuua

SEQ ID NO: 10493 - RNA, 22 nt, Homo sapiens
uccuuugguggagucuuuaggg

SEQ ID NO: 10494 - RNA, 22 nt, Homo sapiens
uaacucugccuagugacauggu

SEQ ID NO: 10495 - RNA, 22 nt, Homo sapiens
gucuuuggaaagacaaaguuca

SEQ ID NO: 10496 - RNA, 22 nt, Homo sapiens
uugagguauaaagguagguugu

SEQ ID NO: 10497 - RNA, 22 nt, Homo sapiens
agaaugauccuucucagaggca

SEQ ID NO: 10498 - RNA, 22 nt, Homo sapiens
gagauggugugcuguuggaagu

SEQ ID NO: 10499 - RNA, 22 nt, Homo sapiens
auugucacuuaaaagugcaugu

SEQ ID NO: 10500 - RNA, 22 nt, Homo sapiens
uggacuaaagaaacauuccgug

SEQ ID NO: 10501 - RNA, 22 nt, Homo sapiens
uaccugagacaacuuugaggaa

SEQ ID NO: 10502 - RNA, 22 nt, Homo sapiens
uugauauguuguuagauucagu

SEQ ID NO: 10503 - RNA, 22 nt, Homo sapiens
uugaaguauagaguuuaagaac

SEQ ID NO: 10504 - RNA, 22 nt, Homo sapiens
uggagugucaguuuccagaguu

SEQ ID NO: 10505 - RNA, 21 nt, Homo sapiens
cugcaaaugcugcugccugau

SEQ ID NO: 10506 - RNA, 22 nt, Homo sapiens
gcguugcacuccagccugggua

SEQ ID NO: 10507 - RNA, 22 nt, Homo sapiens
cucauugcaaucuccaccuccc

SEQ ID NO: 10508 - RNA, 22 nt, Homo sapiens
caucucauugaauugcugagca

SEQ ID NO: 10509 - RNA, 22 nt, Homo sapiens
ugugcuugaaauucaguuuuga

SEQ ID NO: 10510 - RNA, 18 nt, Homo sapiens
agagcuaugaacauaugc

SEQ ID NO: 10511 - RNA, 22 nt, Homo sapiens
cccgugucuuggucuagggccu

SEQ ID NO: 10512 - RNA, 22 nt, Homo sapiens
ugaguacuacuaguuacugcua

SEQ ID NO: 10513 - RNA, 22 nt, Homo sapiens
uuauagcuaacaucugugaaaa

SEQ ID NO: 10514 - RNA, 22 nt, Homo sapiens
aucuaaucaucgcaaccuucaa

SEQ ID NO: 10515 - RNA, 22 nt, Homo sapiens
uaacaguguauuccuuuggaca

SEQ ID NO: 10516 - RNA, 22 nt, Homo sapiens
ugauagucauucaauuuagcca

SEQ ID NO: 10517 - RNA, 22 nt, Homo sapiens
aucccugagccugacucucaga

SEQ ID NO: 10518 - RNA, 22 nt, Homo sapiens
ucuuagguaagaaauuuuaaca

SEQ ID NO: 10519 - RNA, 22 nt, Homo sapiens
ccuuuuuguaguggaaguagga

SEQ ID NO: 10520 - RNA, 23 nt, Homo sapiens
caucacauagaggaaagaggaca

SEQ ID NO: 10521 - RNA, 19 nt, Homo sapiens
ugagaauguuaccaggucc

SEQ ID NO: 10522 - RNA, 22 nt, Homo sapiens
accugguuuucucacaguggcu

SEQ ID NO: 10523 - RNA, 22 nt, Homo sapiens
cucagcaguggauuuaccacca

SEQ ID NO: 10524 - RNA, 22 nt, Homo sapiens
gauaugaguagucgcauugaug

SEQ ID NO: 10525 - RNA, 22 nt, Homo sapiens
ugagcuaagugccaauauuaau

SEQ ID NO: 10526 - RNA, 22 nt, Homo sapiens
ucacaaggcaggaaugaaaggg

SEQ ID NO: 10527 - RNA, 22 nt, Homo sapiens
ggaaugggauuugaagucuggc

SEQ ID NO: 10528 - RNA, 17 nt, Homo sapiens
agucaguaguuuguauu

SEQ ID NO: 10529 - RNA, 22 nt, Homo sapiens
auaaugacuuccaguuccacuc

SEQ ID NO: 10530 - RNA, 22 nt, Homo sapiens
uuuuugaguaaauauaaauugu

SEQ ID NO: 10531 - RNA, 22 nt, Homo sapiens
ucaguggacuuagucuuucccc

SEQ ID NO: 10532 - RNA, 22 nt, Homo sapiens
ucaguagcauugcuuauacagu

SEQ ID NO: 10533 - RNA, 22 nt, Homo sapiens
ugagaucacuaagagguaaugg

SEQ ID NO: 10534 - RNA, 22 nt, Homo sapiens
gaucuguguuuguaugcauaag

SEQ ID NO: 10535 - RNA, 22 nt, Homo sapiens
cauggcucuuguuuacucccag

SEQ ID NO: 10536 - RNA, 22 nt, Homo sapiens
uuugugcaaacuaggauugcga

SEQ ID NO: 10537 - RNA, 22 nt, Homo sapiens
cagguaggccaauguuuuccaa

SEQ ID NO: 10538 - RNA, 22 nt, Homo sapiens
gcugagacauugguuuucuccu

SEQ ID NO: 10539 - RNA, 22 nt, Homo sapiens
agggguauuauguaaaucugac

SEQ ID NO: 10540 - RNA, 22 nt, Homo sapiens
cccaguuuugcuucucaugagg

SEQ ID NO: 10541 - RNA, 22 nt, Homo sapiens
ggugacugguuuaucuggcagu

SEQ ID NO: 10542 - RNA, 22 nt, Homo sapiens
uccaguacaggucucucauuuc

SEQ ID NO: 10543 - RNA, 22 nt, Homo sapiens
uuaaugacaucauaggugaagu

SEQ ID NO: 10544 - RNA, 22 nt, Homo sapiens
uuagcaugucuacuaauuugcu

SEQ ID NO: 10545 - RNA, 22 nt, Homo sapiens
ucgcaguuaauaaugaugugcg

SEQ ID NO: 10546 - RNA, 22 nt, Homo sapiens
aucccuuucucuggcuaggggg

SEQ ID NO: 10547 - RNA, 22 nt, Homo sapiens
uugaaguagcauuucaugucua

SEQ ID NO: 10548 - RNA, 22 nt, Homo sapiens
uucaauuaauauuauacucuca

SEQ ID NO: 10549 - RNA, 22 nt, Homo sapiens
uggcauuuuguuuuagaauuag

SEQ ID NO: 10550 - RNA, 22 nt, Homo sapiens
cucacugugguguccuuaggua

SEQ ID NO: 10551 - RNA, 22 nt, Homo sapiens
uuggaagauuacuuaguuuucu

SEQ ID NO: 10552 - RNA, 22 nt, Homo sapiens
augcauggagucuuucacaagu

SEQ ID NO: 10553 - RNA, 22 nt, Homo sapiens
uugcaucagcuccugauguacu

SEQ ID NO: 10554 - RNA, 22 nt, Homo sapiens
auugcacugcagccugggcaac

SEQ ID NO: 10555 - RNA, 22 nt, Homo sapiens
ucuggcauuuucucugcuugca

SEQ ID NO: 10556 - RNA, 22 nt, Homo sapiens
cacugugcaaccuccaccuccc

SEQ ID NO: 10557 - RNA, 22 nt, Homo sapiens
ucaguuaaugcugccugcugga

SEQ ID NO: 10558 - RNA, 22 nt, Homo sapiens
gagauguagucuugcccuguca

SEQ ID NO: 10559 - RNA, 22 nt, Homo sapiens
gauuugguguucuggcucaaga

SEQ ID NO: 10560 - RNA, 22 nt, Homo sapiens
acacagugucuguguauuuaaa

SEQ ID NO: 10561 - RNA, 22 nt, Homo sapiens
augcagagucccagccccuagc

SEQ ID NO: 10562 - RNA, 22 nt, Homo sapiens
uagaguguuuuguuaggcagca

SEQ ID NO: 10563 - RNA, 22 nt, Homo sapiens
uuucauggagaaucuucuuacu

SEQ ID NO: 10564 - RNA, 22 nt, Homo sapiens
cagagcacugauacuggguucu

SEQ ID NO: 10565 - RNA, 22 nt, Homo sapiens
gagucuauucaauguaguuaga

SEQ ID NO: 10566 - RNA, 22 nt, Homo sapiens
uguaauaguaggcucacauuug

SEQ ID NO: 10567 - RNA, 22 nt, Homo sapiens
ucagagucuagaucacucacug

SEQ ID NO: 10568 - RNA, 22 nt, Homo sapiens
aaggaguguggugaucuugggc

SEQ ID NO: 10569 - RNA, 22 nt, Homo sapiens
uguuuguuugugauacgguaca

SEQ ID NO: 10570 - RNA, 22 nt, Homo sapiens
ucucagcacaaacaaaauugcu

SEQ ID NO: 10571 - RNA, 22 nt, Homo sapiens
aacuggcauagccagacuucuc

SEQ ID NO: 10572 - RNA, 22 nt, Homo sapiens
accauugcacuccagcccgggc

SEQ ID NO: 10573 - RNA, 22 nt, Homo sapiens
uaaaugcuuaauugaaugugga

SEQ ID NO: 10574 - RNA, 22 nt, Homo sapiens
ugugguccucugaaggcuuuuc

SEQ ID NO: 10575 - RNA, 22 nt, Homo sapiens
cccugagcagccugaguuuccc

SEQ ID NO: 10576 - RNA, 22 nt, Homo sapiens
uugagauggauagacauagcau

SEQ ID NO: 10577 - RNA, 19 nt, Homo sapiens
uucacguaggagaaagaag

SEQ ID NO: 10578 - RNA, 22 nt, Homo sapiens
uaagugaauauggacaguuagc

SEQ ID NO: 10579 - RNA, 22 nt, Homo sapiens
uccuucaugcaucaauguaucc

SEQ ID NO: 10580 - RNA, 22 nt, Homo sapiens
uugagauggagucucacugugu

SEQ ID NO: 10581 - RNA, 19 nt, Homo sapiens
aaaguacucugaugccucu

SEQ ID NO: 10582 - RNA, 22 nt, Homo sapiens
uuauauguuagacauggugggu

SEQ ID NO: 10583 - RNA, 22 nt, Homo sapiens
uucuugcugaauugugcccuuc

SEQ ID NO: 10584 - RNA, 20 nt, Homo sapiens
uaucucaguuuguccuaaac

SEQ ID NO: 10585 - RNA, 23 nt, Homo sapiens
cuacagugccugucucuuuggcc

SEQ ID NO: 10586 - RNA, 22 nt, Homo sapiens
ugaguaucuugaugaauuugaa

SEQ ID NO: 10587 - RNA, 22 nt, Homo sapiens
uauggcuuuucacuuaaguccu

SEQ ID NO: 10588 - RNA, 22 nt, Homo sapiens
ucucaguggcacccccaacacc

SEQ ID NO: 10589 - RNA, 22 nt, Homo sapiens
ugcauggauguuugaacacacu

SEQ ID NO: 10590 - RNA, 23 nt, Homo sapiens
ugauaugccuaggaguauauuuu

SEQ ID NO: 10591 - RNA, 22 nt, Homo sapiens
ucuaaguaguagcuggucagaa

SEQ ID NO: 10592 - RNA, 20 nt, Homo sapiens
cuuuggcaaugagaacaggg

SEQ ID NO: 10593 - RNA, 22 nt, Homo sapiens
ugcacugucuugucgcauagca

SEQ ID NO: 10594 - RNA, 22 nt, Homo sapiens
gguuagaaacagguccucagga

SEQ ID NO: 10595 - RNA, 22 nt, Homo sapiens
gugccuucuagcuaugguuggc

SEQ ID NO: 10596 - RNA, 22 nt, Homo sapiens
gcggguguuuuacccuugcaga

SEQ ID NO: 10597 - RNA, 22 nt, Homo sapiens
acugcacuccagccucccgucu

SEQ ID NO: 10598 - RNA, 22 nt, Homo sapiens
gaugguuuucaccugcaugcuu

SEQ ID NO: 10599 - RNA, 19 nt, Homo sapiens
auauaacauccaggagcag

SEQ ID NO: 10600 - RNA, 22 nt, Homo sapiens
agaacccuuugaaauguguuug

SEQ ID NO: 10601 - RNA, 22 nt, Homo sapiens
agucagauuggcauuuguuggg

SEQ ID NO: 10602 - RNA, 22 nt, Homo sapiens
uucuuuggaaacaguacuaauu

SEQ ID NO: 10603 - RNA, 22 nt, Homo sapiens
ugugcuauguuauucacauggg

SEQ ID NO: 10604 - RNA, 21 nt, Homo sapiens
aagcacauugaguguguguga

SEQ ID NO: 10605 - RNA, 22 nt, Homo sapiens
auuggcaauccauauauuuucu

SEQ ID NO: 10606 - RNA, 22 nt, Homo sapiens
uuggauuuugguggcaacucau

SEQ ID NO: 10607 - RNA, 21 nt, Homo sapiens
agcugguuuccacagugugcu

SEQ ID NO: 10608 - RNA, 22 nt, Homo sapiens
uagguacuuuacauguuaucuc

SEQ ID NO: 10609 - RNA, 22 nt, Homo sapiens
aguagcacaugccacccugucu

SEQ ID NO: 10610 - RNA, 22 nt, Homo sapiens
uaggucccguuucagacugaga

SEQ ID NO: 10611 - RNA, 22 nt, Homo sapiens
acugcacuccagccuuggcggc

SEQ ID NO: 10612 - RNA, 22 nt, Homo sapiens
ucuggccuacaucauuuuuccg

SEQ ID NO: 10613 - RNA, 22 nt, Homo sapiens
ucugugcauuacacuuuucuca

SEQ ID NO: 10614 - RNA, 21 nt, Homo sapiens
uucggcaauaugaaccaaugu

SEQ ID NO: 10615 - RNA, 22 nt, Homo sapiens
gaaucauuguuucuaaguuugu

SEQ ID NO: 10616 - RNA, 22 nt, Homo sapiens
gacuucaucauacuaugugugg

SEQ ID NO: 10617 - RNA, 22 nt, Homo sapiens
ugcuauguccccacccaaaucu

SEQ ID NO: 10618 - RNA, 22 nt, Homo sapiens
cugauauuuuucuggcuugugu

SEQ ID NO: 10619 - RNA, 22 nt, Homo sapiens
auacaugcauuugcacgagagu

SEQ ID NO: 10620 - RNA, 19 nt, Homo sapiens
ugaaugacaucuaaagucc

SEQ ID NO: 10621 - RNA, 22 nt, Homo sapiens
uuauguaggcuauagcucugca

SEQ ID NO: 10622 - RNA, 22 nt, Homo sapiens
gucccugugucuuuauguggcc

SEQ ID NO: 10623 - RNA, 22 nt, Homo sapiens
uaaggcauuuuuuugaguugca

SEQ ID NO: 10624 - RNA, 22 nt, Homo sapiens
aagauaguaaacauuuucugcu

SEQ ID NO: 10625 - RNA, 22 nt, Homo sapiens
agcaacauagaaauuugggugg

SEQ ID NO: 10626 - RNA, 22 nt, Homo sapiens
gugacugcauauaaguguaugu

SEQ ID NO: 10627 - RNA, 22 nt, Homo sapiens
ucagauguuuuguuuaucugcu

SEQ ID NO: 10628 - RNA, 21 nt, Homo sapiens
ucaaauugaaauuaggucauu

SEQ ID NO: 10629 - RNA, 19 nt, Homo sapiens
uuggucccuuuggguucuu

SEQ ID NO: 10630 - RNA, 22 nt, Homo sapiens
uuugggccaugguuuguguaua

SEQ ID NO: 10631 - RNA, 22 nt, Homo sapiens
uauuccagcccuggugagccag

SEQ ID NO: 10632 - RNA, 22 nt, Homo sapiens
uuccacgugaaguauucuaaag

SEQ ID NO: 10633 - RNA, 22 nt, Homo sapiens
ugaguuaguguggugcuuggaa

SEQ ID NO: 10634 - RNA, 22 nt, Homo sapiens
uggcagugggagauauuuuauu

SEQ ID NO: 10635 - RNA, 20 nt, Homo sapiens
ugagccccuggacucaagcg

SEQ ID NO: 10636 - RNA, 22 nt, Homo sapiens
gggaagguaaucauuacuugau

SEQ ID NO: 10637 - RNA, 22 nt, Homo sapiens
ugagugaaggggcucuguugug

SEQ ID NO: 10638 - RNA, 22 nt, Homo sapiens
augaugcugagguuugggguau

SEQ ID NO: 10639 - RNA, 22 nt, Homo sapiens
aggcaugguggcacauacaugu

SEQ ID NO: 10640 - RNA, 22 nt, Homo sapiens
augauguccacagggguguuca

SEQ ID NO: 10641 - RNA, 22 nt, Homo sapiens
caggcauuguauuguaaucccc

SEQ ID NO: 10642 - RNA, 22 nt, Homo sapiens
uuggacuuuaagauagagaugu

SEQ ID NO: 10643 - RNA, 22 nt, Homo sapiens
ggcaugauguauuugagguuug

SEQ ID NO: 10644 - RNA, 22 nt, Homo sapiens
uagcaguucauuguugugugaa

SEQ ID NO: 10645 - RNA, 22 nt, Homo sapiens
guucaagugauucuacugccuc

SEQ ID NO: 10646 - RNA, 22 nt, Homo sapiens
gucuccgagccguguggagccg

SEQ ID NO: 10647 - RNA, 22 nt, Homo sapiens
uugguucucuuagccaucuuaa

SEQ ID NO: 10648 - RNA, 22 nt, Homo sapiens
uuggcacgugguggggcucgga

SEQ ID NO: 10649 - RNA, 22 nt, Homo sapiens
gugcaguguuugcauggaauca

SEQ ID NO: 10650 - RNA, 22 nt, Homo sapiens
uuucaacaggucuggggugguc

SEQ ID NO: 10651 - RNA, 22 nt, Homo sapiens
ucagguaugucuuuaacagcag

SEQ ID NO: 10652 - RNA, 22 nt, Homo sapiens
gaccuggugguccacccgccuu

SEQ ID NO: 10653 - RNA, 22 nt, Homo sapiens
agacuagagggaaaugaguugg

SEQ ID NO: 10654 - RNA, 22 nt, Homo sapiens
ugagcccauuguccugguuuau

SEQ ID NO: 10655 - RNA, 22 nt, Homo sapiens
uacauguauccauuguuuuugg

SEQ ID NO: 10656 - RNA, 22 nt, Homo sapiens
gucagguauguuccaaaggcgg

SEQ ID NO: 10657 - RNA, 22 nt, Homo sapiens
uuuugcaggucaggggcagaga

SEQ ID NO: 10658 - RNA, 20 nt, Homo sapiens
gugggcaaauccuuuccucu

SEQ ID NO: 10659 - RNA, 22 nt, Homo sapiens
caucagagugagauauaagauc

SEQ ID NO: 10660 - RNA, 22 nt, Homo sapiens
cgcccuguagcuagcuagaggu

SEQ ID NO: 10661 - RNA, 22 nt, Homo sapiens
ugauaacugaucuggauuugua

SEQ ID NO: 10662 - RNA, 21 nt, Homo sapiens
ucacaucguuuagcugugccu

SEQ ID NO: 10663 - RNA, 21 nt, Homo sapiens
gagaaucaucauggcugcaua

SEQ ID NO: 10664 - RNA, 22 nt, Homo sapiens
uaggguaguaauaguuguuuca

SEQ ID NO: 10665 - RNA, 22 nt, Homo sapiens
ugugcaaucagcuucauuacau

SEQ ID NO: 10666 - RNA, 22 nt, Homo sapiens
guuaaagacauccacauaggag

SEQ ID NO: 10667 - RNA, 22 nt, Homo sapiens
aacagugcauucagggauauau

SEQ ID NO: 10668 - RNA, 22 nt, Homo sapiens
uggcauggaguggauggcccca

SEQ ID NO: 10669 - RNA, 22 nt, Homo sapiens
aaauaacugucagguucuggaa

SEQ ID NO: 10670 - RNA, 19 nt, Homo sapiens
ucaagcuauucuccugccu

SEQ ID NO: 10671 - RNA, 22 nt, Homo sapiens
ccauggcuauucuguaaggguu

SEQ ID NO: 10672 - RNA, 21 nt, Homo sapiens
uucuuugcucaguguuagagu

SEQ ID NO: 10673 - RNA, 22 nt, Homo sapiens
uacagguaugugucuauauaca

SEQ ID NO: 10674 - RNA, 22 nt, Homo sapiens
ucacaguauucaugaacaugga

SEQ ID NO: 10675 - RNA, 21 nt, Homo sapiens
uuuuugguggucauggauaga

SEQ ID NO: 10676 - RNA, 22 nt, Homo sapiens
ugucaugucuuuguguaucaau

SEQ ID NO: 10677 - RNA, 22 nt, Homo sapiens
ugagaacuagagaacaagguga

SEQ ID NO: 10678 - RNA, 22 nt, Homo sapiens
gucacagcuggcauugucugca

SEQ ID NO: 10679 - RNA, 22 nt, Homo sapiens
aucuacagccagucugguuugu

SEQ ID NO: 10680 - RNA, 22 nt, Homo sapiens
augggcuaguaaagacaaacuu

SEQ ID NO: 10681 - RNA, 22 nt, Homo sapiens
augagguccuagccaacuuuuu

SEQ ID NO: 10682 - RNA, 22 nt, Homo sapiens
auagcccauuuguugguccugg

SEQ ID NO: 10683 - RNA, 23 nt, Homo sapiens
uggccagaaacuucuuuucaucc

SEQ ID NO: 10684 - RNA, 22 nt, Homo sapiens
agcaguagugaaaguagacuua

SEQ ID NO: 10685 - RNA, 22 nt, Homo sapiens
auugaauuugguuugcuaagaa

SEQ ID NO: 10686 - RNA, 22 nt, Homo sapiens
ugucaugugagggaacuuguuc

SEQ ID NO: 10687 - RNA, 22 nt, Homo sapiens
uuuccuggagaaucuuaacaaa

SEQ ID NO: 10688 - RNA, 22 nt, Homo sapiens
caccuguacauggcaguguccu

SEQ ID NO: 10689 - RNA, 22 nt, Homo sapiens
aaaaguucuuugagccuugaca

SEQ ID NO: 10690 - RNA, 22 nt, Homo sapiens
ugcaccacuguacuccagucug

SEQ ID NO: 10691 - RNA, 22 nt, Homo sapiens
cuagcccugagauaaaugucau

SEQ ID NO: 10692 - RNA, 22 nt, Homo sapiens
agaauguuuuagaccaauacaa

SEQ ID NO: 10693 - RNA, 22 nt, Homo sapiens
aguguuuuuacaagcacucugg

SEQ ID NO: 10694 - RNA, 22 nt, Homo sapiens
ugaccucugauagcaguaggug

SEQ ID NO: 10695 - RNA, 22 nt, Homo sapiens
aggugcuugaaucuaugagcuc

SEQ ID NO: 10696 - RNA, 22 nt, Homo sapiens
ugaguggagacuguguguagag

SEQ ID NO: 10697 - RNA, 22 nt, Homo sapiens
ugagguugaaggacauuuuuau

SEQ ID NO: 10698 - RNA, 22 nt, Homo sapiens
acagucacaauuuguaccuuuu

SEQ ID NO: 10699 - RNA, 22 nt, Homo sapiens
uugagcaacauagugagacugu

SEQ ID NO: 10700 - RNA, 22 nt, Homo sapiens
aaaccacagugugcugcugggg

SEQ ID NO: 10701 - RNA, 22 nt, Homo sapiens
uuacauguggugugaagaagag

SEQ ID NO: 10702 - RNA, 22 nt, Homo sapiens
cauugcacugcagcccgggcaa

SEQ ID NO: 10703 - RNA, 22 nt, Homo sapiens
uuggucucuuaaucacacuuuu

SEQ ID NO: 10704 - RNA, 22 nt, Homo sapiens
aaggucauugugguuuuugcca

SEQ ID NO: 10705 - RNA, 22 nt, Homo sapiens
aaucugucuuuuguuauugagg

SEQ ID NO: 10706 - RNA, 22 nt, Homo sapiens
gagcuagaauauuuuguauagu

SEQ ID NO: 10707 - RNA, 21 nt, Homo sapiens
cuuugguuucugacuugcaua

SEQ ID NO: 10708 - RNA, 22 nt, Homo sapiens
uaagacugccccagacagcaag

SEQ ID NO: 10709 - RNA, 21 nt, Homo sapiens
ugaguagcuagaacuaggggc

SEQ ID NO: 10710 - RNA, 22 nt, Homo sapiens
uuagggaggacaguuacaacag

SEQ ID NO: 10711 - RNA, 22 nt, Homo sapiens
cccauuguuaaguugaguaucu

SEQ ID NO: 10712 - RNA, 22 nt, Homo sapiens
aaaagucuguagugaaagguga

SEQ ID NO: 10713 - RNA, 22 nt, Homo sapiens
gugagguauacugggaucacua

SEQ ID NO: 10714 - RNA, 22 nt, Homo sapiens
auguccauggaaucuguagcaa

SEQ ID NO: 10715 - RNA, 22 nt, Homo sapiens
agagguaagcaguggcaagugc

SEQ ID NO: 10716 - RNA, 22 nt, Homo sapiens
ugugguuuuauaaacgugaccu

SEQ ID NO: 10717 - RNA, 22 nt, Homo sapiens
uguuaucauuacguucuuaguu

SEQ ID NO: 10718 - RNA, 17 nt, Homo sapiens
gcugauguuugcauuuu

SEQ ID NO: 10719 - RNA, 18 nt, Homo sapiens
uugugccugagaaggugg

SEQ ID NO: 10720 - RNA, 22 nt, Homo sapiens
ugguccuuuccauuggagacac

SEQ ID NO: 10721 - RNA, 22 nt, Homo sapiens
gaggagucagacugugcaaggu

SEQ ID NO: 10722 - RNA, 22 nt, Homo sapiens
ugacaugaaggcaccucugucc

SEQ ID NO: 10723 - RNA, 22 nt, Homo sapiens
gguauuauuugccuuuuacuga

SEQ ID NO: 10724 - RNA, 22 nt, Homo sapiens
uuaugucuuugagcaaugcugu

SEQ ID NO: 10725 - RNA, 22 nt, Homo sapiens
augugacagcaacccccagccc

SEQ ID NO: 10726 - RNA, 22 nt, Homo sapiens
auuuggcauagaguaucauucu

SEQ ID NO: 10727 - RNA, 22 nt, Homo sapiens
cuggagauauuggaagaaagaa

SEQ ID NO: 10728 - RNA, 22 nt, Homo sapiens
uggcauguguuugaaugaguau

SEQ ID NO: 10729 - RNA, 22 nt, Homo sapiens
ccuuggcaauggcuggggcuga

SEQ ID NO: 10730 - RNA, 22 nt, Homo sapiens
ugagaucuuaccuuccugccuu

SEQ ID NO: 10731 - RNA, 22 nt, Homo sapiens
ucagugacuggguauuaaauca

SEQ ID NO: 10732 - RNA, 22 nt, Homo sapiens
gcucguccccuccugacucugc

SEQ ID NO: 10733 - RNA, 20 nt, Homo sapiens
guggaagauaaguagccuga

SEQ ID NO: 10734 - RNA, 22 nt, Homo sapiens
ugggcaaaugcuuuuuagucaa

SEQ ID NO: 10735 - RNA, 22 nt, Homo sapiens
gugggguaggcaauuccuagug

SEQ ID NO: 10736 - RNA, 22 nt, Homo sapiens
auaaguaguaaagcagugacua

SEQ ID NO: 10737 - RNA, 22 nt, Homo sapiens
uuuuuggguaaugauuaucaau

SEQ ID NO: 10738 - RNA, 22 nt, Homo sapiens
uugaauguguugggaagcccuu

SEQ ID NO: 10739 - RNA, 21 nt, Homo sapiens
ucacaaugaacagcagcagaa

SEQ ID NO: 10740 - RNA, 22 nt, Homo sapiens
gugguuguuggaguggcaauuu

SEQ ID NO: 10741 - RNA, 22 nt, Homo sapiens
ugacaggauggagaucgguauu

SEQ ID NO: 10742 - RNA, 22 nt, Homo sapiens
cugagaucugaaccaggagugu

SEQ ID NO: 10743 - RNA, 22 nt, Homo sapiens
uaacaagagagucagucagucc

SEQ ID NO: 10744 - RNA, 22 nt, Homo sapiens
uuugguugucacaacuggggga

SEQ ID NO: 10745 - RNA, 22 nt, Homo sapiens
auugcacuccagucugggcaac

SEQ ID NO: 10746 - RNA, 22 nt, Homo sapiens
cucaaguaauccucccgccuug

SEQ ID NO: 10747 - RNA, 22 nt, Homo sapiens
uacugaccugucauucagaguu

SEQ ID NO: 10748 - RNA, 22 nt, Homo sapiens
uauagcacugagaauguaauuc

SEQ ID NO: 10749 - RNA, 22 nt, Homo sapiens
aaauggcacaguaagggcauuu

SEQ ID NO: 10750 - RNA, 22 nt, Homo sapiens
uccacagugguugaacuaguuu

SEQ ID NO: 10751 - RNA, 19 nt, Homo sapiens
uugaaggccgccuugcaga

SEQ ID NO: 10752 - RNA, 22 nt, Homo sapiens
cauugucccucaaugacuauga

SEQ ID NO: 10753 - RNA, 21 nt, Homo sapiens
ugucgugcaggaucuguggga

SEQ ID NO: 10754 - RNA, 22 nt, Homo sapiens
uuaugguuguuaucuugguucg

SEQ ID NO: 10755 - RNA, 21 nt, Homo sapiens
aucauaugcucacuccuagaa

SEQ ID NO: 10756 - RNA, 22 nt, Homo sapiens
ccccuguaaacuggcuucccug

SEQ ID NO: 10757 - RNA, 21 nt, Homo sapiens
ccagugguuggaaacuauggg

SEQ ID NO: 10758 - RNA, 22 nt, Homo sapiens
ccaguuuucucacuguugcagu

SEQ ID NO: 10759 - RNA, 22 nt, Homo sapiens
aucagagugaugguuuaaguau

SEQ ID NO: 10760 - RNA, 22 nt, Homo sapiens
uugugaucuucagaaaguggcu

SEQ ID NO: 10761 - RNA, 22 nt, Homo sapiens
uaaguauuaugugcugcauuuu

SEQ ID NO: 10762 - RNA, 22 nt, Homo sapiens
agcaugauugggguugggcaca

SEQ ID NO: 10763 - RNA, 22 nt, Homo sapiens
ugggaagaugcugcuucuuccu

SEQ ID NO: 10764 - RNA, 22 nt, Homo sapiens
ugacuaggaaauuagaacuuuu

SEQ ID NO: 10765 - RNA, 22 nt, Homo sapiens
uggcaagagaacaacaucucuc

SEQ ID NO: 10766 - RNA, 22 nt, Homo sapiens
cagcaagucucuaagaguucau

SEQ ID NO: 10767 - RNA, 22 nt, Homo sapiens
uauaugcucugggauccugaaa

SEQ ID NO: 10768 - RNA, 22 nt, Homo sapiens
cucaaagugcuaagauuaggcu

SEQ ID NO: 10769 - RNA, 22 nt, Homo sapiens
aucuguagauucagcacaagcu

SEQ ID NO: 10770 - RNA, 22 nt, Homo sapiens
gucauugcuuaucugcugacgu

SEQ ID NO: 10771 - RNA, 22 nt, Homo sapiens
aauaaagcugaauccuuccuga

SEQ ID NO: 10772 - RNA, 22 nt, Homo sapiens
uuggccuuucucuaaauacuuu

SEQ ID NO: 10773 - RNA, 22 nt, Homo sapiens
uucauggguuaauuuguucgau

SEQ ID NO: 10774 - RNA, 22 nt, Homo sapiens
augaggugauaucuggaaauua

SEQ ID NO: 10775 - RNA, 22 nt, Homo sapiens
ggaugugugcacgcgcacaugc

SEQ ID NO: 10776 - RNA, 22 nt, Homo sapiens
gugcaugucuaugcgagucuaa

SEQ ID NO: 10777 - RNA, 20 nt, Homo sapiens
auaugcauguguuuucacuu

SEQ ID NO: 10778 - RNA, 22 nt, Homo sapiens
gaacugggguuggguugcgaua

SEQ ID NO: 10779 - RNA, 22 nt, Homo sapiens
auuagguauuuguccuaaauau

SEQ ID NO: 10780 - RNA, 22 nt, Homo sapiens
cuucaccaguuuggcagucuca

SEQ ID NO: 10781 - RNA, 22 nt, Homo sapiens
gggaugaaguugauguagaaag

SEQ ID NO: 10782 - RNA, 22 nt, Homo sapiens
ugccuagucuauugagagucuu

SEQ ID NO: 10783 - RNA, 22 nt, Homo sapiens
uauugacuugaugagggagggu

SEQ ID NO: 10784 - RNA, 22 nt, Homo sapiens
acuuauuguggcugacccaaac

SEQ ID NO: 10785 - RNA, 22 nt, Homo sapiens
uugcacauguugaaccagcaaa

SEQ ID NO: 10786 - RNA, 22 nt, Homo sapiens
caugucuuuuaaacauucaacu

SEQ ID NO: 10787 - RNA, 22 nt, Homo sapiens
cauugcacucuagucuggguga

SEQ ID NO: 10788 - RNA, 22 nt, Homo sapiens
gucauggaaaucuacauuguua

SEQ ID NO: 10789 - RNA, 22 nt, Homo sapiens
gugaggucguagucauaggcaa

SEQ ID NO: 10790 - RNA, 22 nt, Homo sapiens
acgugcaugcacacacaugcgc

SEQ ID NO: 10791 - RNA, 22 nt, Homo sapiens
ucacugaaaccuccaccucucg

SEQ ID NO: 10792 - RNA, 22 nt, Homo sapiens
aagcugccuugugaaggcauuc

SEQ ID NO: 10793 - RNA, 22 nt, Homo sapiens
uacugcaguugcagcuugagga

SEQ ID NO: 10794 - RNA, 22 nt, Homo sapiens
aucacuagaucauagguaaaca

SEQ ID NO: 10795 - RNA, 22 nt, Homo sapiens
ucagucauguuuaccagacgua

SEQ ID NO: 10796 - RNA, 22 nt, Homo sapiens
cuuccauaguuacacccaggga

SEQ ID NO: 10797 - RNA, 22 nt, Homo sapiens
auaccugguagucuugcuacac

SEQ ID NO: 10798 - RNA, 22 nt, Homo sapiens
ggaaucugaaccaugggaaugg

SEQ ID NO: 10799 - RNA, 22 nt, Homo sapiens
aguuaguguugugauaaaucca

SEQ ID NO: 10800 - RNA, 22 nt, Homo sapiens
gacaccauuucaguacuagguu

SEQ ID NO: 10801 - RNA, 22 nt, Homo sapiens
uaacaaugucuuaugggcuuaa

SEQ ID NO: 10802 - RNA, 22 nt, Homo sapiens
uucccguacugguguugccuau

SEQ ID NO: 10803 - RNA, 22 nt, Homo sapiens
uuggcaaagaggaaugccacuu

SEQ ID NO: 10804 - RNA, 22 nt, Homo sapiens
gagguaaguggauuaugagguc

SEQ ID NO: 10805 - RNA, 22 nt, Homo sapiens
uugcacaguguguacagcacca

SEQ ID NO: 10806 - RNA, 22 nt, Homo sapiens
gaauuguacugcaaucagggga

SEQ ID NO: 10807 - RNA, 22 nt, Homo sapiens
uauggguauuuuauacauaacc

SEQ ID NO: 10808 - RNA, 22 nt, Homo sapiens
aagugaguaauacgucaguugu

SEQ ID NO: 10809 - RNA, 22 nt, Homo sapiens
ugucacagagauuuugguaugu

SEQ ID NO: 10810 - RNA, 19 nt, Homo sapiens
ucccuuuguagguaaccug

SEQ ID NO: 10811 - RNA, 22 nt, Homo sapiens
gagugcaauggcgcgaucuggg

SEQ ID NO: 10812 - RNA, 22 nt, Homo sapiens
ucauugcacuucuuuaguugca

SEQ ID NO: 10813 - RNA, 22 nt, Homo sapiens
accugggugcugaugggcuuua

SEQ ID NO: 10814 - RNA, 19 nt, Homo sapiens
uuuccaguaaucuuaugug

SEQ ID NO: 10815 - RNA, 22 nt, Homo sapiens
auggcauggugcaggguuuaag

SEQ ID NO: 10816 - RNA, 22 nt, Homo sapiens
auccugaagcuuuacugaauuc

SEQ ID NO: 10817 - RNA, 22 nt, Homo sapiens
ugaguuguagcuauaguuucuu

SEQ ID NO: 10818 - RNA, 22 nt, Homo sapiens
uuguggcuuaucucauuuagcg

SEQ ID NO: 10819 - RNA, 22 nt, Homo sapiens
agagguagaagauaggcuacag

SEQ ID NO: 10820 - RNA, 23 nt, Homo sapiens
uaccacauuccuucuuuccuguu

SEQ ID NO: 10821 - RNA, 22 nt, Homo sapiens
ucagugcuuuuuguugucauca

SEQ ID NO: 10822 - RNA, 21 nt, Homo sapiens
uagugcagugggguaugacuu

SEQ ID NO: 10823 - RNA, 22 nt, Homo sapiens
agcugcauuuacuuuugcacaa

SEQ ID NO: 10824 - RNA, 20 nt, Homo sapiens
uugauucccucuaaacucgc

SEQ ID NO: 10825 - RNA, 22 nt, Homo sapiens
ugggauauaaaaaacgcuauuc

SEQ ID NO: 10826 - RNA, 21 nt, Homo sapiens
ugugaacauguuggguggcau

SEQ ID NO: 10827 - RNA, 22 nt, Homo sapiens
ugacaugauguuccuacacugu

SEQ ID NO: 10828 - RNA, 22 nt, Homo sapiens
augccacuguuuaugucacuua

SEQ ID NO: 10829 - RNA, 22 nt, Homo sapiens
auauuggacugugcuaguuaga

SEQ ID NO: 10830 - RNA, 22 nt, Homo sapiens
uauuccacuggcacugcauuug

SEQ ID NO: 10831 - RNA, 22 nt, Homo sapiens
ugagcuaggauccugucacugu

SEQ ID NO: 10832 - RNA, 22 nt, Homo sapiens
cuaagauugucuuaguguguug

SEQ ID NO: 10833 - RNA, 17 nt, Homo sapiens
gggucaccuugcaggua

SEQ ID NO: 10834 - RNA, 19 nt, Homo sapiens
uugcauagguugaaccagc

SEQ ID NO: 10835 - RNA, 22 nt, Homo sapiens
acugcacuucaaccucauugac

SEQ ID NO: 10836 - RNA, 22 nt, Homo sapiens
gggguaguuacuguuguucuuu

SEQ ID NO: 10837 - RNA, 22 nt, Homo sapiens
uggauagaacuaagugcuuaga

SEQ ID NO: 10838 - RNA, 22 nt, Homo sapiens
aucaccuuucccuuucugaauc

SEQ ID NO: 10839 - RNA, 22 nt, Homo sapiens
aagcuccauuucugccaugaga

SEQ ID NO: 10840 - RNA, 22 nt, Homo sapiens
cugaucuguuauacuuuucuau

SEQ ID NO: 10841 - RNA, 22 nt, Homo sapiens
aaagugcuguagacugggcgca

SEQ ID NO: 10842 - RNA, 22 nt, Homo sapiens
caaaguaauuacgguuuuggcc

SEQ ID NO: 10843 - RNA, 22 nt, Homo sapiens
augaccagagagugcgcagggu

SEQ ID NO: 10844 - RNA, 22 nt, Homo sapiens
uggaaugguuggugugauuuua

SEQ ID NO: 10845 - RNA, 22 nt, Homo sapiens
ggcucguguuuucuguccaguu

SEQ ID NO: 10846 - RNA, 22 nt, Homo sapiens
uaccuguagacuacagcuucag

SEQ ID NO: 10847 - RNA, 19 nt, Homo sapiens
ucaugugcauacauuuggg

SEQ ID NO: 10848 - RNA, 22 nt, Homo sapiens
aagugacauugugcccauuuga

SEQ ID NO: 10849 - RNA, 22 nt, Homo sapiens
gauuccauuuguggcuauuuac

SEQ ID NO: 10850 - RNA, 22 nt, Homo sapiens
uuuuuuaguuagcugggcauga

SEQ ID NO: 10851 - RNA, 21 nt, Homo sapiens
cacuggguucaggcuugugga

SEQ ID NO: 10852 - RNA, 20 nt, Homo sapiens
ugacaucagcaauguaauaa

SEQ ID NO: 10853 - RNA, 22 nt, Homo sapiens
cuuagguuaaucaugaaccuuu

SEQ ID NO: 10854 - RNA, 18 nt, Homo sapiens
ucaccuugcuuuuagaac

SEQ ID NO: 10855 - RNA, 22 nt, Homo sapiens
cagugcaaagccucugcccaga

SEQ ID NO: 10856 - RNA, 22 nt, Homo sapiens
guauagcaaugccccacaccug

SEQ ID NO: 10857 - RNA, 22 nt, Homo sapiens
aaucacuuuggcaccaaccuaa

SEQ ID NO: 10858 - RNA, 22 nt, Homo sapiens
guucaagcaauucugcugccuc

SEQ ID NO: 10859 - RNA, 22 nt, Homo sapiens
agaggucuuaucaaacaugcuu

SEQ ID NO: 10860 - RNA, 22 nt, Homo sapiens
gagacugagucucgcucugccg

SEQ ID NO: 10861 - RNA, 22 nt, Homo sapiens
ugagauguaaucucgcucuguc

SEQ ID NO: 10862 - RNA, 22 nt, Homo sapiens
cuccuugauuagaguauagagu

SEQ ID NO: 10863 - RNA, 22 nt, Homo sapiens
guagagugcugggcacuggcuc

SEQ ID NO: 10864 - RNA, 22 nt, Homo sapiens
uuagggaggcucaggacaagag

SEQ ID NO: 10865 - RNA, 22 nt, Homo sapiens
gugaguuauuauuuauguaaac

SEQ ID NO: 10866 - RNA, 22 nt, Homo sapiens
uacugcacuccagccugggaga

SEQ ID NO: 10867 - RNA, 22 nt, Homo sapiens
gugucaugagggggacaggaag

SEQ ID NO: 10868 - RNA, 19 nt, Homo sapiens
acaguauugugcacagguu

SEQ ID NO: 10869 - RNA, 22 nt, Homo sapiens
gcugagcuaugccauauaugcc

SEQ ID NO: 10870 - RNA, 22 nt, Homo sapiens
cuccagugcaaagucaugauca

SEQ ID NO: 10871 - RNA, 22 nt, Homo sapiens
aauugcauaugcaguagaucua

SEQ ID NO: 10872 - RNA, 22 nt, Homo sapiens
ugaaauacuuuggcucuuuguu

SEQ ID NO: 10873 - RNA, 22 nt, Homo sapiens
uuguccuugagauaguuugcag

SEQ ID NO: 10874 - RNA, 20 nt, Homo sapiens
agcaucauugcaauuuguca

SEQ ID NO: 10875 - RNA, 22 nt, Homo sapiens
uaugaaacucuaagauucacau

SEQ ID NO: 10876 - RNA, 18 nt, Homo sapiens
cauagcacuucagcacau

SEQ ID NO: 10877 - RNA, 22 nt, Homo sapiens
ucagugucaucuggguuguuug

SEQ ID NO: 10878 - RNA, 22 nt, Homo sapiens
auggcacuuuggacugcuagau

SEQ ID NO: 10879 - RNA, 22 nt, Homo sapiens
uacucuuuagcuccuuaaggaa

SEQ ID NO: 10880 - RNA, 22 nt, Homo sapiens
uucccugugggaguaggaaagu

SEQ ID NO: 10881 - RNA, 22 nt, Homo sapiens
ugugucuugaauuuuguaugua

SEQ ID NO: 10882 - RNA, 22 nt, Homo sapiens
uugauugacaugucucuguuca

SEQ ID NO: 10883 - RNA, 22 nt, Homo sapiens
aaagucacuggagaaggaauau

SEQ ID NO: 10884 - RNA, 22 nt, Homo sapiens
ugcauacacaagcauacaugua

SEQ ID NO: 10885 - RNA, 22 nt, Homo sapiens
ugaguuaaucucuacgauagaa

SEQ ID NO: 10886 - RNA, 22 nt, Homo sapiens
aaagugcuuccuuuuugagggu

SEQ ID NO: 10887 - RNA, 22 nt, Homo sapiens
ugagacugaguuuugcucguug

SEQ ID NO: 10888 - RNA, 22 nt, Homo sapiens
gucucuuguuaucauuucugag

SEQ ID NO: 10889 - RNA, 22 nt, Homo sapiens
uaggcaauggagauagaggaug

SEQ ID NO: 10890 - RNA, 22 nt, Homo sapiens
uugccuuuguuggaaacaagug

SEQ ID NO: 10891 - RNA, 22 nt, Homo sapiens
cugagguuguucuucucagugg

SEQ ID NO: 10892 - RNA, 22 nt, Homo sapiens
ugccuagaaacacuauuucucc

SEQ ID NO: 10893 - RNA, 22 nt, Homo sapiens
agcaauaugacauugcuacauc

SEQ ID NO: 10894 - RNA, 22 nt, Homo sapiens
ugagaggugauaaagcaagggu

SEQ ID NO: 10895 - RNA, 22 nt, Homo sapiens
ucaugcaucuuguggaauuuga

SEQ ID NO: 10896 - RNA, 22 nt, Homo sapiens
gucaagugaagcagugggagua

SEQ ID NO: 10897 - RNA, 22 nt, Homo sapiens
uugugcauguauauuaguucac

SEQ ID NO: 10898 - RNA, 22 nt, Homo sapiens
ucacaauggagacucgggcgga

SEQ ID NO: 10899 - RNA, 22 nt, Homo sapiens
ggagguagguuugugauuugua

SEQ ID NO: 10900 - RNA, 22 nt, Homo sapiens
ccuggaaugaagcuuauauugc

SEQ ID NO: 10901 - RNA, 22 nt, Homo sapiens
auagguaguuuuucaauccuca

SEQ ID NO: 10902 - RNA, 22 nt, Homo sapiens
caacucuguaggauccaggugg

SEQ ID NO: 10903 - RNA, 22 nt, Homo sapiens
ucaugcaaugcaaggggaaauu

SEQ ID NO: 10904 - RNA, 22 nt, Homo sapiens
augguaagcugaaaauaucgaa

SEQ ID NO: 10905 - RNA, 22 nt, Homo sapiens
caaguguuuccuuaaauacuug

SEQ ID NO: 10906 - RNA, 22 nt, Homo sapiens
uuagcagcacaaaagcagacua

SEQ ID NO: 10907 - RNA, 22 nt, Homo sapiens
guucccaguugaaaugauuagu

SEQ ID NO: 10908 - RNA, 22 nt, Homo sapiens
cuacagguaugaaagggaguau

SEQ ID NO: 10909 - RNA, 22 nt, Homo sapiens
uucagguaauuaugguuugucu

SEQ ID NO: 10910 - RNA, 22 nt, Homo sapiens
ugaagacucaauuauuaugaac

SEQ ID NO: 10911 - RNA, 22 nt, Homo sapiens
aguggaauuaagaaacugaauu

SEQ ID NO: 10912 - RNA, 22 nt, Homo sapiens
gaaaauccauccccagggagua

SEQ ID NO: 10913 - RNA, 22 nt, Homo sapiens
gagcugaucuuuauguaaauuc

SEQ ID NO: 10914 - RNA, 22 nt, Homo sapiens
ugagcacaggugcgcgguuacu

SEQ ID NO: 10915 - RNA, 21 nt, Homo sapiens
ugcauauuggaacuuucucuc

SEQ ID NO: 10916 - RNA, 22 nt, Homo sapiens
gagauguaagaauuuauuuguu

SEQ ID NO: 10917 - RNA, 22 nt, Homo sapiens
uuggucaggcuagaguguggug

SEQ ID NO: 10918 - RNA, 22 nt, Homo sapiens
gaugauauuugagucauuagaa

SEQ ID NO: 10919 - RNA, 22 nt, Homo sapiens
ucacauggauuaacucauuuau

SEQ ID NO: 10920 - RNA, 22 nt, Homo sapiens
uuggacuggaacuauaccauug

SEQ ID NO: 10921 - RNA, 22 nt, Homo sapiens
aggcacggugucucaugccugu

SEQ ID NO: 10922 - RNA, 16 nt, Homo sapiens
ugaauguuuguggcug

SEQ ID NO: 10923 - RNA, 22 nt, Homo sapiens
auucccuuggucaacggaugca

SEQ ID NO: 10924 - RNA, 22 nt, Homo sapiens
ugagcauuguguuugacuguga

SEQ ID NO: 10925 - RNA, 21 nt, Homo sapiens
uuaucccagugucucugcagg

SEQ ID NO: 10926 - RNA, 22 nt, Homo sapiens
ucugagaucaugucugugcugu

SEQ ID NO: 10927 - RNA, 22 nt, Homo sapiens
guuggguaauggggcgcaccgu

SEQ ID NO: 10928 - RNA, 22 nt, Homo sapiens
ugacuacaggucaggaagcugu

SEQ ID NO: 10929 - RNA, 20 nt, Homo sapiens
gucacuggcccagggcuugu

SEQ ID NO: 10930 - RNA, 22 nt, Homo sapiens
uuucccuuuagcuuagugauuu

SEQ ID NO: 10931 - RNA, 22 nt, Homo sapiens
agcaccauuucucuaaagcacu

SEQ ID NO: 10932 - RNA, 22 nt, Homo sapiens
augaaauugcuaucgcaguacu

SEQ ID NO: 10933 - RNA, 22 nt, Homo sapiens
uaagguuuuugauaugcugcug

SEQ ID NO: 10934 - RNA, 22 nt, Homo sapiens
uucgucccuuuuggaauccucu

SEQ ID NO: 10935 - RNA, 22 nt, Homo sapiens
aucgcugagaaagggacuuuca

SEQ ID NO: 10936 - RNA, 22 nt, Homo sapiens
uuuuagcagccaugacaaagau

SEQ ID NO: 10937 - RNA, 22 nt, Homo sapiens
auggcccugggaaaggaggcau

SEQ ID NO: 10938 - RNA, 22 nt, Homo sapiens
cauggcacuguaugaaaugugc

SEQ ID NO: 10939 - RNA, 22 nt, Homo sapiens
uaugaaucuggcuacuccaggg

SEQ ID NO: 10940 - RNA, 22 nt, Homo sapiens
ugagaugaagucuugcucuguu

SEQ ID NO: 10941 - RNA, 22 nt, Homo sapiens
auccuagguuagagaacaaaac

SEQ ID NO: 10942 - RNA, 22 nt, Homo sapiens
guacaguaguaaaagugaauga

SEQ ID NO: 10943 - RNA, 22 nt, Homo sapiens
ugaggaguauguucuguagacc

SEQ ID NO: 10944 - RNA, 22 nt, Homo sapiens
ggaucacagagcuugggaaagg

SEQ ID NO: 10945 - RNA, 22 nt, Homo sapiens
ugagacugaguuuccaucuugu

SEQ ID NO: 10946 - RNA, 22 nt, Homo sapiens
gucagagcacugaguugugggc

SEQ ID NO: 10947 - RNA, 22 nt, Homo sapiens
agucauaggagagauaucacug

SEQ ID NO: 10948 - RNA, 22 nt, Homo sapiens
ggcaugcauuguacuaguaugc

SEQ ID NO: 10949 - RNA, 22 nt, Homo sapiens
guauugaguaaauguuuauugg

SEQ ID NO: 10950 - RNA, 22 nt, Homo sapiens
gauuuugguuagggaaggauac

SEQ ID NO: 10951 - RNA, 22 nt, Homo sapiens
gccauugcacuccgcccugggc

SEQ ID NO: 10952 - RNA, 22 nt, Homo sapiens
cuauggcuguaugacgugcaug

SEQ ID NO: 10953 - RNA, 19 nt, Homo sapiens
cuugccccauucauccucu

SEQ ID NO: 10954 - RNA, 22 nt, Homo sapiens
uagguaucuuuauagcaguagc

SEQ ID NO: 10955 - RNA, 21 nt, Homo sapiens
ccuccauuuguauucuugccc

SEQ ID NO: 10956 - RNA, 22 nt, Homo sapiens
aacaggguguuugcaguuucuu

SEQ ID NO: 10957 - RNA, 22 nt, Homo sapiens
auuguacuccagccuuggggac

SEQ ID NO: 10958 - RNA, 22 nt, Homo sapiens
ggacuguaauaccaugaggaca

SEQ ID NO: 10959 - RNA, 20 nt, Homo sapiens
gacaaaccuagaugguacag

SEQ ID NO: 10960 - RNA, 22 nt, Homo sapiens
uguauacauauguauguuuugu

SEQ ID NO: 10961 - RNA, 22 nt, Homo sapiens
auugaacuuuugucacugacau

SEQ ID NO: 10962 - RNA, 22 nt, Homo sapiens
cugcuggucuuuaaggucuagg

SEQ ID NO: 10963 - RNA, 22 nt, Homo sapiens
gugagcuaguuucuuugcugug

SEQ ID NO: 10964 - RNA, 22 nt, Homo sapiens
augauggaggccgugauggacg

SEQ ID NO: 10965 - RNA, 22 nt, Homo sapiens
uugaaugcguuguguggcccgu

SEQ ID NO: 10966 - RNA, 22 nt, Homo sapiens
gucaacauauuaauuauguucu

SEQ ID NO: 10967 - RNA, 22 nt, Homo sapiens
ugaguacugauuuaagauacac

SEQ ID NO: 10968 - RNA, 22 nt, Homo sapiens
cugugguuuaaggaauuuugac

SEQ ID NO: 10969 - RNA, 22 nt, Homo sapiens
gagacggagucacgcccuguca

SEQ ID NO: 10970 - RNA, 22 nt, Homo sapiens
uuugacuagaguguuuuacaac

SEQ ID NO: 10971 - RNA, 22 nt, Homo sapiens
uucuuagucauguaauagucca

SEQ ID NO: 10972 - RNA, 21 nt, Homo sapiens
ugcauugucuugaguuuaaau

SEQ ID NO: 10973 - RNA, 22 nt, Homo sapiens
uugguccguugugaaaaggccu

SEQ ID NO: 10974 - RNA, 22 nt, Homo sapiens
ggcaugaugcgcacgccuguag

SEQ ID NO: 10975 - RNA, 21 nt, Homo sapiens
uuugcacuuugcaaaucccua

SEQ ID NO: 10976 - RNA, 19 nt, Homo sapiens
cucuuuggugucucuucuu

SEQ ID NO: 10977 - RNA, 17 nt, Homo sapiens
uccagauuucaauugaa

SEQ ID NO: 10978 - RNA, 17 nt, Homo sapiens
gaaguguuucuucauga

SEQ ID NO: 10979 - RNA, 22 nt, Homo sapiens
uugagcccuggagguggaggcu

SEQ ID NO: 10980 - RNA, 20 nt, Homo sapiens
ucuugggaauguagccuagg

SEQ ID NO: 10981 - RNA, 22 nt, Homo sapiens
guaccugagaaguuccagggga

SEQ ID NO: 10982 - RNA, 21 nt, Homo sapiens
cuuugcacugcuccucagcuc

SEQ ID NO: 10983 - RNA, 22 nt, Homo sapiens
ucauggcauuguuaaggguuuu

SEQ ID NO: 10984 - RNA, 22 nt, Homo sapiens
cuacaguucucaggaguuggcc

SEQ ID NO: 10985 - RNA, 22 nt, Homo sapiens
auugcacuccagccuggccgag

SEQ ID NO: 10986 - RNA, 23 nt, Homo sapiens
ucagugucuggauccugcucagu

SEQ ID NO: 10987 - RNA, 22 nt, Homo sapiens
uaugacauaguccuuaacccuc

SEQ ID NO: 10988 - RNA, 20 nt, Homo sapiens
aaacucugucuucuuuauca

SEQ ID NO: 10989 - RNA, 22 nt, Homo sapiens
uuauucauuaacagggaccaaa

SEQ ID NO: 10990 - RNA, 22 nt, Homo sapiens
cuagcagacaggcugggagcag

SEQ ID NO: 10991 - RNA, 23 nt, Homo sapiens
ggcacggaauucaaagaggcauu

SEQ ID NO: 10992 - RNA, 22 nt, Homo sapiens
ugagcucagcuuucuuuuucac

SEQ ID NO: 10993 - RNA, 22 nt, Homo sapiens
ucugugguucaaaccagcaacu

SEQ ID NO: 10994 - RNA, 22 nt, Homo sapiens
uugucaguguucacucaaagcu

SEQ ID NO: 10995 - RNA, 22 nt, Homo sapiens
uggucuucuggccuccagaacc

SEQ ID NO: 10996 - RNA, 22 nt, Homo sapiens
auccucugagagaguuucauaa

SEQ ID NO: 10997 - RNA, 22 nt, Homo sapiens
cuuuccauuguuggagcauaaa

SEQ ID NO: 10998 - RNA, 22 nt, Homo sapiens
uuaauuguccaaguucaucucu

SEQ ID NO: 10999 - RNA, 20 nt, Homo sapiens
gacauguuuuguggccuaac

SEQ ID NO: 11000 - RNA, 22 nt, Homo sapiens
cugugguugagcuuugccauga

SEQ ID NO: 11001 - RNA, 22 nt, Homo sapiens
gaaugcagcagugacagggcug

SEQ ID NO: 11002 - RNA, 22 nt, Homo sapiens
uauucaagccaaauucaagcca

SEQ ID NO: 11003 - RNA, 22 nt, Homo sapiens
uuaaguuguagcuacaaauaca

SEQ ID NO: 11004 - RNA, 18 nt, Homo sapiens
uugaauagagccaagcac

SEQ ID NO: 11005 - RNA, 19 nt, Homo sapiens
ucuaaaucucuugauagac

SEQ ID NO: 11006 - RNA, 22 nt, Homo sapiens
aauacugaaaguauuuucaaau

SEQ ID NO: 11007 - RNA, 22 nt, Homo sapiens
guacaagugcaguuucguuaca

SEQ ID NO: 11008 - RNA, 22 nt, Homo sapiens
gucaugggguacuacacauggg

SEQ ID NO: 11009 - RNA, 19 nt, Homo sapiens
ugucccagccauagaggca

SEQ ID NO: 11010 - RNA, 22 nt, Homo sapiens
ucaugacacuggcaggagcuaa

SEQ ID NO: 11011 - RNA, 22 nt, Homo sapiens
uucuaguacucccuggagcugg

SEQ ID NO: 11012 - RNA, 22 nt, Homo sapiens
gagugcaauggugccaucucgg

SEQ ID NO: 11013 - RNA, 22 nt, Homo sapiens
gaguuaggaucucacuguguca

SEQ ID NO: 11014 - RNA, 22 nt, Homo sapiens
cagacaugucuuguggccgugg

SEQ ID NO: 11015 - RNA, 22 nt, Homo sapiens
cuugagcauauucuauauuaaa

SEQ ID NO: 11016 - RNA, 22 nt, Homo sapiens
cauuuuacuuuccagacgugga

SEQ ID NO: 11017 - RNA, 21 nt, Homo sapiens
ucaggcuuuuugagugccaau

SEQ ID NO: 11018 - RNA, 22 nt, Homo sapiens
gaucacaugggagaaugagagu

SEQ ID NO: 11019 - RNA, 19 nt, Homo sapiens
cauugcacuccacccuggg

SEQ ID NO: 11020 - RNA, 22 nt, Homo sapiens
aagugauguuauugggugacuc

SEQ ID NO: 11021 - RNA, 22 nt, Homo sapiens
uauugcagaaugugaguuggca

SEQ ID NO: 11022 - RNA, 22 nt, Homo sapiens
uaugcacaugcaugcuugaaua

SEQ ID NO: 11023 - RNA, 22 nt, Homo sapiens
uagcagcaucucuggcuucuac

SEQ ID NO: 11024 - RNA, 22 nt, Homo sapiens
ucuggcacugaugugggaugcu

SEQ ID NO: 11025 - RNA, 22 nt, Homo sapiens
ugagccaaugauuugaauagag

SEQ ID NO: 11026 - RNA, 21 nt, Homo sapiens
aacacggugaaaucccgucuc

SEQ ID NO: 11027 - RNA, 22 nt, Homo sapiens
aguacaucuggcuggauagaua

SEQ ID NO: 11028 - RNA, 22 nt, Homo sapiens
uccuuuggguagcuguucagau

SEQ ID NO: 11029 - RNA, 22 nt, Homo sapiens
ucgcagugcacucuuuuagcuu

SEQ ID NO: 11030 - RNA, 22 nt, Homo sapiens
ugauguaggacauuauuauuuc

SEQ ID NO: 11031 - RNA, 22 nt, Homo sapiens
augaauccauuccugccacaga

SEQ ID NO: 11032 - RNA, 22 nt, Homo sapiens
cagggcauuggcugguaccugg

SEQ ID NO: 11033 - RNA, 22 nt, Homo sapiens
ugcuggugauuaaauccugaag

SEQ ID NO: 11034 - RNA, 22 nt, Homo sapiens
aucacugggauggaacugcuga

SEQ ID NO: 11035 - RNA, 22 nt, Homo sapiens
cuauauacugccugcugauuag

SEQ ID NO: 11036 - RNA, 22 nt, Homo sapiens
gagaugaugagauguucacagu

SEQ ID NO: 11037 - RNA, 22 nt, Homo sapiens
uaacuauagagaauguugagua

SEQ ID NO: 11038 - RNA, 22 nt, Homo sapiens
ugaacuguugggggaaauucag

SEQ ID NO: 11039 - RNA, 22 nt, Homo sapiens
aaacuugucuaauuauaagcau

SEQ ID NO: 11040 - RNA, 22 nt, Homo sapiens
uugagauggagucucacucugu

SEQ ID NO: 11041 - RNA, 22 nt, Homo sapiens
ucacucggugaugauucuuaaa

SEQ ID NO: 11042 - RNA, 23 nt, Homo sapiens
ccacaaugguugaacuagauuac

SEQ ID NO: 11043 - RNA, 22 nt, Homo sapiens
auucaaagugcauguucccacu

SEQ ID NO: 11044 - RNA, 22 nt, Homo sapiens
auaagugagugauucaguguua

SEQ ID NO: 11045 - RNA, 22 nt, Homo sapiens
augugacagugguuuuaagcgu

SEQ ID NO: 11046 - RNA, 22 nt, Homo sapiens
gugaaucuguuuucuucuguuc

SEQ ID NO: 11047 - RNA, 22 nt, Homo sapiens
ugacuuuagaauuuuauccaga

SEQ ID NO: 11048 - RNA, 22 nt, Homo sapiens
agcagagcaguggauuuuguga

SEQ ID NO: 11049 - RNA, 22 nt, Homo sapiens
ugacaugaugagcaauaauggc

SEQ ID NO: 11050 - RNA, 22 nt, Homo sapiens
uggcaguuuuaugugguucaac

SEQ ID NO: 11051 - RNA, 22 nt, Homo sapiens
cuaagguacuguuaacauugua

SEQ ID NO: 11052 - RNA, 22 nt, Homo sapiens
aucuucucuugaagggugggga

SEQ ID NO: 11053 - RNA, 22 nt, Homo sapiens
auaugucuuaguuaccuugggc

SEQ ID NO: 11054 - RNA, 22 nt, Homo sapiens
augagauauuuuauaagaucau

SEQ ID NO: 11055 - RNA, 22 nt, Homo sapiens
aaaugcugucaaauuguguucu

SEQ ID NO: 11056 - RNA, 22 nt, Homo sapiens
gacgauaucaaggaaaugaagu

SEQ ID NO: 11057 - RNA, 22 nt, Homo sapiens
uuaguaguuugauaggaauagc

SEQ ID NO: 11058 - RNA, 22 nt, Homo sapiens
cugagcaugacaucaugugacu

SEQ ID NO: 11059 - RNA, 21 nt, Homo sapiens
uggucccauaagauuacaaug

SEQ ID NO: 11060 - RNA, 22 nt, Homo sapiens
aaagugcugggauuuuaggcau

SEQ ID NO: 11061 - RNA, 22 nt, Homo sapiens
ugccauagagacucaacagccu

SEQ ID NO: 11062 - RNA, 22 nt, Homo sapiens
ucucaauuugauuacauucaua

SEQ ID NO: 11063 - RNA, 22 nt, Homo sapiens
uaucaucauguuuuugcugugu

SEQ ID NO: 11064 - RNA, 22 nt, Homo sapiens
uauggcugugacuuaucuuguu

SEQ ID NO: 11065 - RNA, 21 nt, Homo sapiens
agacacuuggaagguuuuaga

SEQ ID NO: 11066 - RNA, 22 nt, Homo sapiens
gugauuuaguagaugcuaguua

SEQ ID NO: 11067 - RNA, 22 nt, Homo sapiens
aagcuggcauucauucguucuu

SEQ ID NO: 11068 - RNA, 22 nt, Homo sapiens
cuuuuugguagagcaggugugc

SEQ ID NO: 11069 - RNA, 22 nt, Homo sapiens
agcuuuggauaccugcuguucc

SEQ ID NO: 11070 - RNA, 22 nt, Homo sapiens
auauaccuaggcuacaugguuu

SEQ ID NO: 11071 - RNA, 22 nt, Homo sapiens
guugcagaguucuuccuccuga

SEQ ID NO: 11072 - RNA, 22 nt, Homo sapiens
uggguccccuacucuuuccaca

SEQ ID NO: 11073 - RNA, 22 nt, Homo sapiens
agcuggucucaggugcccugcu

SEQ ID NO: 11074 - RNA, 22 nt, Homo sapiens
guguaaaucugcugugaacauu

SEQ ID NO: 11075 - RNA, 20 nt, Homo sapiens
uaucacauggggagaaaccu

SEQ ID NO: 11076 - RNA, 22 nt, Homo sapiens
ugauugucucuccugccccauc

SEQ ID NO: 11077 - RNA, 22 nt, Homo sapiens
uacugcagucagacuccugggc

SEQ ID NO: 11078 - RNA, 22 nt, Homo sapiens
cagccggguggcuccuagggua

SEQ ID NO: 11079 - RNA, 22 nt, Homo sapiens
caguguuuuuaacaggugcccg

SEQ ID NO: 11080 - RNA, 22 nt, Homo sapiens
agugcaguugucacgugccuuc

SEQ ID NO: 11081 - RNA, 22 nt, Homo sapiens
uugagauguggcaguuuaugag

SEQ ID NO: 11082 - RNA, 23 nt, Homo sapiens
ugcuauguaagcauuuauuaaau

SEQ ID NO: 11083 - RNA, 22 nt, Homo sapiens
agacuagacagaugaacagcac

SEQ ID NO: 11084 - RNA, 23 nt, Homo sapiens
auugcagaaucacagagguagug

SEQ ID NO: 11085 - RNA, 22 nt, Homo sapiens
aauaaagucugaagugugcuua

SEQ ID NO: 11086 - RNA, 22 nt, Homo sapiens
uuacaugagacugucgcuaguu

SEQ ID NO: 11087 - RNA, 22 nt, Homo sapiens
ugaaauggugcggucugcagca

SEQ ID NO: 11088 - RNA, 22 nt, Homo sapiens
uaccuuugucaguuacucaccu

SEQ ID NO: 11089 - RNA, 22 nt, Homo sapiens
aggagaauugguucuucuugau

SEQ ID NO: 11090 - RNA, 22 nt, Homo sapiens
ucacaugcacaucucuggaacc

SEQ ID NO: 11091 - RNA, 22 nt, Homo sapiens
uguaagcauugggcaugcaguc

SEQ ID NO: 11092 - RNA, 22 nt, Homo sapiens
uggcaaagugugacgugggggu

SEQ ID NO: 11093 - RNA, 20 nt, Homo sapiens
ugggaacaugugguauaugg

SEQ ID NO: 11094 - RNA, 19 nt, Homo sapiens
uuagagaucaucugcuuca

SEQ ID NO: 11095 - RNA, 22 nt, Homo sapiens
uagguucucaggaaugagcuuc

SEQ ID NO: 11096 - RNA, 22 nt, Homo sapiens
uugagguuggaggccuugccug

SEQ ID NO: 11097 - RNA, 22 nt, Homo sapiens
ugagaguauaaauugaugcagc

SEQ ID NO: 11098 - RNA, 22 nt, Homo sapiens
ucagguagugccaugauugauu

SEQ ID NO: 11099 - RNA, 22 nt, Homo sapiens
uaguccauuuucaugcugcuau

SEQ ID NO: 11100 - RNA, 22 nt, Homo sapiens
gugacugcauccauccaggcuu

SEQ ID NO: 11101 - RNA, 22 nt, Homo sapiens
uauaaaguaauuucuaggggcu

SEQ ID NO: 11102 - RNA, 22 nt, Homo sapiens
ucacugugcaugaaggaugcug

SEQ ID NO: 11103 - RNA, 22 nt, Homo sapiens
agcgccacugcacuccagccug

SEQ ID NO: 11104 - RNA, 22 nt, Homo sapiens
ugccuaggcuggaaugcagugg

SEQ ID NO: 11105 - RNA, 22 nt, Homo sapiens
ucucccuaccugagccgagcca

SEQ ID NO: 11106 - RNA, 20 nt, Homo sapiens
ugagauccacgugaaguaug

SEQ ID NO: 11107 - RNA, 22 nt, Homo sapiens
aaugauacuguguacaagggca

SEQ ID NO: 11108 - RNA, 22 nt, Homo sapiens
auuauuagucggccagcuguua

SEQ ID NO: 11109 - RNA, 20 nt, Homo sapiens
cauugcacuccagcuugggc

SEQ ID NO: 11110 - RNA, 22 nt, Homo sapiens
auugcacuccagcccugcugac

SEQ ID NO: 11111 - RNA, 22 nt, Homo sapiens
gagguggugguggaggcauagc

SEQ ID NO: 11112 - RNA, 22 nt, Homo sapiens
uacaagcaggaaaugguauaug

SEQ ID NO: 11113 - RNA, 22 nt, Homo sapiens
ucccuggacagccuugccuggg

SEQ ID NO: 11114 - RNA, 23 nt, Homo sapiens
ugagguguuaagcagacuugucu

SEQ ID NO: 11115 - RNA, 22 nt, Homo sapiens
gucauaugcucggaaaauguua

SEQ ID NO: 11116 - RNA, 22 nt, Homo sapiens
auaauagguugauugacauugc

SEQ ID NO: 11117 - RNA, 22 nt, Homo sapiens
uaugaacacuuuugggaggcau

SEQ ID NO: 11118 - RNA, 22 nt, Homo sapiens
ugugaacagcagcugggcuuug

SEQ ID NO: 11119 - RNA, 23 nt, Homo sapiens
uagcacuuuuuacauauggacau

SEQ ID NO: 11120 - RNA, 22 nt, Homo sapiens
gugcaaugucaggagaugcagc

SEQ ID NO: 11121 - RNA, 21 nt, Homo sapiens
acaaagcuggagggagacugc

SEQ ID NO: 11122 - RNA, 22 nt, Homo sapiens
agugcacugcccgcuuccuguc

SEQ ID NO: 11123 - RNA, 22 nt, Homo sapiens
agugcaauaaggauguagaacu

SEQ ID NO: 11124 - RNA, 22 nt, Homo sapiens
caagggguggaaaugguagugu

SEQ ID NO: 11125 - RNA, 22 nt, Homo sapiens
uugucacugcacuccagucugg

SEQ ID NO: 11126 - RNA, 22 nt, Homo sapiens
cuugaccaauauggugaaaccc

SEQ ID NO: 11127 - RNA, 22 nt, Homo sapiens
ugagauggcuuuauugcugaau

SEQ ID NO: 11128 - RNA, 22 nt, Homo sapiens
uuaagaagugauuuuccucauu

SEQ ID NO: 11129 - RNA, 22 nt, Homo sapiens
agggaagugugcuaugcauuua

SEQ ID NO: 11130 - RNA, 22 nt, Homo sapiens
cuagaguguaguuuucuuagga

SEQ ID NO: 11131 - RNA, 22 nt, Homo sapiens
ugaaugguaauuuaguaggcac

SEQ ID NO: 11132 - RNA, 22 nt, Homo sapiens
ugaaauuauucuuaccaaggug

SEQ ID NO: 11133 - RNA, 22 nt, Homo sapiens
uugaagugaagaacaauaucac

SEQ ID NO: 11134 - RNA, 22 nt, Homo sapiens
uucccaguuggggaaagcgacc

SEQ ID NO: 11135 - RNA, 22 nt, Homo sapiens
cacaggucauccuggaucaagg

SEQ ID NO: 11136 - RNA, 22 nt, Homo sapiens
uaagacucuggacucuaauguu

SEQ ID NO: 11137 - RNA, 22 nt, Homo sapiens
auucaucagggauacuggccug

SEQ ID NO: 11138 - RNA, 22 nt, Homo sapiens
augcuacauucuacaauuaggc

SEQ ID NO: 11139 - RNA, 22 nt, Homo sapiens
auggaagaaaguuggguucuug

SEQ ID NO: 11140 - RNA, 22 nt, Homo sapiens
acacaaugguaaguguuugugu

SEQ ID NO: 11141 - RNA, 22 nt, Homo sapiens
cuaucucaggcccaggcccuug

SEQ ID NO: 11142 - RNA, 21 nt, Homo sapiens
caucaaauugucauggugggu

SEQ ID NO: 11143 - RNA, 22 nt, Homo sapiens
uguaauguuucaucauuauuaa

SEQ ID NO: 11144 - RNA, 22 nt, Homo sapiens
uaugucuggaguuacugagcug

SEQ ID NO: 11145 - RNA, 22 nt, Homo sapiens
aggugcugacaggauagguuuc

SEQ ID NO: 11146 - RNA, 22 nt, Homo sapiens
gugaugacauucagagaugaag

SEQ ID NO: 11147 - RNA, 22 nt, Homo sapiens
gucauuguguggacauggagaa

SEQ ID NO: 11148 - RNA, 19 nt, Homo sapiens
cagguagugugcugacaug

SEQ ID NO: 11149 - RNA, 22 nt, Homo sapiens
caucacauucugagauacugag

SEQ ID NO: 11150 - RNA, 22 nt, Homo sapiens
uagcaccucuuuggccuuucgu

SEQ ID NO: 11151 - RNA, 22 nt, Homo sapiens
cuuugguuuacuuggugcuagu

SEQ ID NO: 11152 - RNA, 22 nt, Homo sapiens
uuggaagguaaucaaaaguucu

SEQ ID NO: 11153 - RNA, 22 nt, Homo sapiens
acugcauuugguaaagucaaga

SEQ ID NO: 11154 - RNA, 22 nt, Homo sapiens
uugacuucagagcugauucaag

SEQ ID NO: 11155 - RNA, 20 nt, Homo sapiens
acugggcuaccgaaguaagg

SEQ ID NO: 11156 - RNA, 22 nt, Homo sapiens
aucacuguuuugaugcucggac

SEQ ID NO: 11157 - RNA, 20 nt, Homo sapiens
gacauagagacucucaaaaa

SEQ ID NO: 11158 - RNA, 22 nt, Homo sapiens
gugagacugguccugaacccag

SEQ ID NO: 11159 - RNA, 21 nt, Homo sapiens
gcaaguacuaucaucauuauc

SEQ ID NO: 11160 - RNA, 22 nt, Homo sapiens
agagagcuugggguguuaaauu

SEQ ID NO: 11161 - RNA, 22 nt, Homo sapiens
uuggauuuuaacaaacuaggug

SEQ ID NO: 11162 - RNA, 22 nt, Homo sapiens
gauggcuauucuuaccauuucu

SEQ ID NO: 11163 - RNA, 22 nt, Homo sapiens
uucagagagggagggauaccua

SEQ ID NO: 11164 - RNA, 22 nt, Homo sapiens
uggagagcaaagaauuuguuag

SEQ ID NO: 11165 - RNA, 22 nt, Homo sapiens
uacagaauucugucccuugagu

SEQ ID NO: 11166 - RNA, 22 nt, Homo sapiens
cuauggcucugguuauggcugu

SEQ ID NO: 11167 - RNA, 22 nt, Homo sapiens
uggucaugaggugaggcuucuc

SEQ ID NO: 11168 - RNA, 22 nt, Homo sapiens
cagauacuggaguccugaaguu

SEQ ID NO: 11169 - RNA, 23 nt, Homo sapiens
ggcagguuggucuaggucuauuc

SEQ ID NO: 11170 - RNA, 22 nt, Homo sapiens
aaaugcacaaagauuuugcacu

SEQ ID NO: 11171 - RNA, 22 nt, Homo sapiens
ucuccggguggcggcgaaggga

SEQ ID NO: 11172 - RNA, 22 nt, Homo sapiens
ggacauguauauauaugugugu

SEQ ID NO: 11173 - RNA, 22 nt, Homo sapiens
aucagugcagugggaacuagaa

SEQ ID NO: 11174 - RNA, 22 nt, Homo sapiens
ugaguagucagugggcaggaag

SEQ ID NO: 11175 - RNA, 22 nt, Homo sapiens
uggucagaugcugaguggaucu

SEQ ID NO: 11176 - RNA, 22 nt, Homo sapiens
uguuaacauggucucagucugu

SEQ ID NO: 11177 - RNA, 22 nt, Homo sapiens
augaagugcaugauaguugguu

SEQ ID NO: 11178 - RNA, 22 nt, Homo sapiens
cagcuaguaauuuauugaagau

SEQ ID NO: 11179 - RNA, 22 nt, Homo sapiens
ccuucacaggcacugguucaga

SEQ ID NO: 11180 - RNA, 22 nt, Homo sapiens
uguguuuuuauguaaaauggaa

SEQ ID NO: 11181 - RNA, 22 nt, Homo sapiens
ccacuguuuaaauggcugagga

SEQ ID NO: 11182 - RNA, 21 nt, Homo sapiens
auugcacaauauacccaugua

SEQ ID NO: 11183 - RNA, 22 nt, Homo sapiens
uuuaugcgucuguaauuucuuu

SEQ ID NO: 11184 - RNA, 22 nt, Homo sapiens
ugagagucacugaccugguaua

SEQ ID NO: 11185 - RNA, 22 nt, Homo sapiens
cacaaccuccgccuccuggguu

SEQ ID NO: 11186 - RNA, 22 nt, Homo sapiens
gagccuguaggaggagaggugg

SEQ ID NO: 11187 - RNA, 22 nt, Homo sapiens
cuaggcacgccugggucuccag

SEQ ID NO: 11188 - RNA, 22 nt, Homo sapiens
uggcaugaaguguguuuuaucu

SEQ ID NO: 11189 - RNA, 22 nt, Homo sapiens
ugacucuagagcugccuguggc

SEQ ID NO: 11190 - RNA, 22 nt, Homo sapiens
ucaguggauuuaaccugaauca

SEQ ID NO: 11191 - RNA, 22 nt, Homo sapiens
ugaggugcagcaauccucaugu

SEQ ID NO: 11192 - RNA, 22 nt, Homo sapiens
uaggugguuugaaauacucaag

SEQ ID NO: 11193 - RNA, 22 nt, Homo sapiens
augugcuuaaaaaugcagagaa

SEQ ID NO: 11194 - RNA, 22 nt, Homo sapiens
ucuaaaacuagauugugaugau

SEQ ID NO: 11195 - RNA, 22 nt, Homo sapiens
ugucaggagcaaugauaaauuu

SEQ ID NO: 11196 - RNA, 19 nt, Homo sapiens
caguaucauugcacauagu

SEQ ID NO: 11197 - RNA, 22 nt, Homo sapiens
cuugaccuauggaucuguuuuu

SEQ ID NO: 11198 - RNA, 22 nt, Homo sapiens
uugaguagaaguaugucaguau

SEQ ID NO: 11199 - RNA, 22 nt, Homo sapiens
auaucccuguauaagugaaugu

SEQ ID NO: 11200 - RNA, 22 nt, Homo sapiens
uacauccauccugcugggcagu

SEQ ID NO: 11201 - RNA, 22 nt, Homo sapiens
cagguacauuuuaaagggcuca

SEQ ID NO: 11202 - RNA, 22 nt, Homo sapiens
aucauaucaucugcaaacaaag

SEQ ID NO: 11203 - RNA, 19 nt, Homo sapiens
uuguguccccacaaaauuc

SEQ ID NO: 11204 - RNA, 22 nt, Homo sapiens
ugagccaugguuagcuucucau

SEQ ID NO: 11205 - RNA, 22 nt, Homo sapiens
gggaagauauaggcugggcacc

SEQ ID NO: 11206 - RNA, 22 nt, Homo sapiens
uguguaauacucuaaugaugca

SEQ ID NO: 11207 - RNA, 22 nt, Homo sapiens
cgccugagcugaggaagcugca

SEQ ID NO: 11208 - RNA, 23 nt, Homo sapiens
uaagacacuaacuuuaugcuuug

SEQ ID NO: 11209 - RNA, 22 nt, Homo sapiens
cucaccuugugauccacccgcc

SEQ ID NO: 11210 - RNA, 22 nt, Homo sapiens
uucucauggugauggcaaaauc

SEQ ID NO: 11211 - RNA, 16 nt, Homo sapiens
auugacaguggguguu

SEQ ID NO: 11212 - RNA, 22 nt, Homo sapiens
ugagcuacuacacccagcuugg

SEQ ID NO: 11213 - RNA, 22 nt, Homo sapiens
ggcaaggugcuacagacaguga

SEQ ID NO: 11214 - RNA, 20 nt, Homo sapiens
cuaaucaucccagaagaaau

SEQ ID NO: 11215 - RNA, 22 nt, Homo sapiens
auacccauacauauuggugacu

SEQ ID NO: 11216 - RNA, 22 nt, Homo sapiens
gugucaaggaugccugucaggc

SEQ ID NO: 11217 - RNA, 22 nt, Homo sapiens
uauuacugucaauaucacagaa

SEQ ID NO: 11218 - RNA, 21 nt, Homo sapiens
uuuccuggagcguauggcuuc

SEQ ID NO: 11219 - RNA, 22 nt, Homo sapiens
gugcaagcaucauggaguguac

SEQ ID NO: 11220 - RNA, 22 nt, Homo sapiens
auauuagguuggugccaaagua

SEQ ID NO: 11221 - RNA, 22 nt, Homo sapiens
cuguaaggcacuaagcauaugu

SEQ ID NO: 11222 - RNA, 22 nt, Homo sapiens
uagaguacucugguaaguucuu

SEQ ID NO: 11223 - RNA, 22 nt, Homo sapiens
uugaagguaauugguuuuauga

SEQ ID NO: 11224 - RNA, 22 nt, Homo sapiens
ugacuaggggcccuggcuucuu

SEQ ID NO: 11225 - RNA, 22 nt, Homo sapiens
gucugugcauuaauacgugcug

SEQ ID NO: 11226 - RNA, 22 nt, Homo sapiens
ugagguaacagaagcgagcauu

SEQ ID NO: 11227 - RNA, 22 nt, Homo sapiens
gagcaaaaguauguauugguua

SEQ ID NO: 11228 - RNA, 22 nt, Homo sapiens
ugagugagguucuacucuguga

SEQ ID NO: 11229 - RNA, 22 nt, Homo sapiens
aauggcaguagauggaugggua

SEQ ID NO: 11230 - RNA, 22 nt, Homo sapiens
ucuguacugccaaguuucuuua

SEQ ID NO: 11231 - RNA, 22 nt, Homo sapiens
cccuguagcagcauucuuaaau

SEQ ID NO: 11232 - RNA, 22 nt, Homo sapiens
aguaucacaguggguguauacc

SEQ ID NO: 11233 - RNA, 16 nt, Homo sapiens
ugagaacaugcagcau

SEQ ID NO: 11234 - RNA, 22 nt, Homo sapiens
uuugaagcuaaggugcuugguu

SEQ ID NO: 11235 - RNA, 22 nt, Homo sapiens
auaugguuuuuggaagcauauc

SEQ ID NO: 11236 - RNA, 22 nt, Homo sapiens
cuuuggucaaaauaaguaaguu

SEQ ID NO: 11237 - RNA, 22 nt, Homo sapiens
gauggcacuuaagagcaagagc

SEQ ID NO: 11238 - RNA, 20 nt, Homo sapiens
ugcauguccucacuuacuug

SEQ ID NO: 11239 - RNA, 20 nt, Homo sapiens
augcaaacccugcuuugugg

SEQ ID NO: 11240 - RNA, 22 nt, Homo sapiens
uugaggaggcagucuucccauu

SEQ ID NO: 11241 - RNA, 23 nt, Homo sapiens
uuucaggcaggugaaagaccagc

SEQ ID NO: 11242 - RNA, 22 nt, Homo sapiens
uggagagcaaaaucaauccaaa

SEQ ID NO: 11243 - RNA, 22 nt, Homo sapiens
uggcaagauuguuccgguuugg

SEQ ID NO: 11244 - RNA, 22 nt, Homo sapiens
augaccagagguaugauguuug

SEQ ID NO: 11245 - RNA, 22 nt, Homo sapiens
uuggcuuaguugaccacagucu

SEQ ID NO: 11246 - RNA, 22 nt, Homo sapiens
uaguggauguucagagauuuga

SEQ ID NO: 11247 - RNA, 22 nt, Homo sapiens
ucagcagugagagaccucaccc

SEQ ID NO: 11248 - RNA, 22 nt, Homo sapiens
aguaucaucuuguuggccaggc

SEQ ID NO: 11249 - RNA, 22 nt, Homo sapiens
ggagagugacauauuucuaggc

SEQ ID NO: 11250 - RNA, 22 nt, Homo sapiens
auagcagugccccaaacuccug

SEQ ID NO: 11251 - RNA, 22 nt, Homo sapiens
uugaguaguaagugguucaccg

SEQ ID NO: 11252 - RNA, 22 nt, Homo sapiens
ccaucacacugugauuauuauc

SEQ ID NO: 11253 - RNA, 23 nt, Homo sapiens
uuugccacuuauuagcugggagg

SEQ ID NO: 11254 - RNA, 22 nt, Homo sapiens
agcaccauuguacuccagccug

SEQ ID NO: 11255 - RNA, 22 nt, Homo sapiens
ugaaagacugaaagcuuuucuu

SEQ ID NO: 11256 - RNA, 22 nt, Homo sapiens
acuagguaguaaucugcagaga

SEQ ID NO: 11257 - RNA, 22 nt, Homo sapiens
uucccuugcaggaugaucugga

SEQ ID NO: 11258 - RNA, 22 nt, Homo sapiens
uacauugcacuuuauuagauac

SEQ ID NO: 11259 - RNA, 22 nt, Homo sapiens
gugugcaacuuucauuaauauu

SEQ ID NO: 11260 - RNA, 22 nt, Homo sapiens
auguaacaguauuuggagaugu

SEQ ID NO: 11261 - RNA, 22 nt, Homo sapiens
aucugguguccucgugggaguc

SEQ ID NO: 11262 - RNA, 22 nt, Homo sapiens
gaaguaguaaaauuuauugcag

SEQ ID NO: 11263 - RNA, 22 nt, Homo sapiens
uacaccugaguuugugguuuuc

SEQ ID NO: 11264 - RNA, 21 nt, Homo sapiens
auagugcuagagaguagcagg

SEQ ID NO: 11265 - RNA, 22 nt, Homo sapiens
gcagucacagggagauggugac

SEQ ID NO: 11266 - RNA, 22 nt, Homo sapiens
agcuggacuugauaaaugaaua

SEQ ID NO: 11267 - RNA, 22 nt, Homo sapiens
augugcaacugcuggaacaguc

SEQ ID NO: 11268 - RNA, 22 nt, Homo sapiens
ugcuuugguagaaaucuuuggu

SEQ ID NO: 11269 - RNA, 22 nt, Homo sapiens
uauugcagugagauccaucugg

SEQ ID NO: 11270 - RNA, 22 nt, Homo sapiens
gucagcaucaccaugucuauga

SEQ ID NO: 11271 - RNA, 22 nt, Homo sapiens
ggacagugaaugccacuccucc

SEQ ID NO: 11272 - RNA, 21 nt, Homo sapiens
uaucauggccauccucuucuc

SEQ ID NO: 11273 - RNA, 22 nt, Homo sapiens
uagguaggauagucuuuauuuu

SEQ ID NO: 11274 - RNA, 22 nt, Homo sapiens
agcagcaugaggggacuucugc

SEQ ID NO: 11275 - RNA, 18 nt, Homo sapiens
ugagaacauguguacaca

SEQ ID NO: 11276 - RNA, 22 nt, Homo sapiens
cuguugcaguuauggcugcagg

SEQ ID NO: 11277 - RNA, 22 nt, Homo sapiens
uauugcauuugagguugguuga

SEQ ID NO: 11278 - RNA, 22 nt, Homo sapiens
acugcauuugucccuuuugaac

SEQ ID NO: 11279 - RNA, 22 nt, Homo sapiens
uaagccuaggucugugcucuuc

SEQ ID NO: 11280 - RNA, 22 nt, Homo sapiens
gggggagugugguacccagcau

SEQ ID NO: 11281 - RNA, 22 nt, Homo sapiens
ggauuuguuggcauuagugaug

SEQ ID NO: 11282 - RNA, 20 nt, Homo sapiens
uugugcauugggccauuggg

SEQ ID NO: 11283 - RNA, 22 nt, Homo sapiens
uacuuagagauuccaggaacuc

SEQ ID NO: 11284 - RNA, 22 nt, Homo sapiens
uccuuugguucuugucacccca

SEQ ID NO: 11285 - RNA, 22 nt, Homo sapiens
gcauguaguagauguugaauaa

SEQ ID NO: 11286 - RNA, 23 nt, Homo sapiens
agcccugugacucgaacgaggag

SEQ ID NO: 11287 - RNA, 23 nt, Homo sapiens
cagcucauuuggguccccuuguc

SEQ ID NO: 11288 - RNA, 22 nt, Homo sapiens
aacagaccuagauaguauaguc

SEQ ID NO: 11289 - RNA, 22 nt, Homo sapiens
uaucagcagagucauacuucaa

SEQ ID NO: 11290 - RNA, 22 nt, Homo sapiens
ggcuagauauucacauauggcu

SEQ ID NO: 11291 - RNA, 18 nt, Homo sapiens
uggauuguacuguguucu

SEQ ID NO: 11292 - RNA, 22 nt, Homo sapiens
auuguuccccggucauuuuugu

SEQ ID NO: 11293 - RNA, 22 nt, Homo sapiens
gugccuagugcuauugugcccu

SEQ ID NO: 11294 - RNA, 19 nt, Homo sapiens
ccacaaugguugaacuaga

SEQ ID NO: 11295 - RNA, 22 nt, Homo sapiens
auuucuacuccuguguccagaa

SEQ ID NO: 11296 - RNA, 22 nt, Homo sapiens
augaugcugcaguuguugccaa

SEQ ID NO: 11297 - RNA, 19 nt, Homo sapiens
cuguggucauuauuuugcu

SEQ ID NO: 11298 - RNA, 22 nt, Homo sapiens
uuaucucagugaacugagugga

SEQ ID NO: 11299 - RNA, 22 nt, Homo sapiens
aaucacuuugcuacaaggcagu

SEQ ID NO: 11300 - RNA, 22 nt, Homo sapiens
gugcacaacgugcagguuuguu

SEQ ID NO: 11301 - RNA, 22 nt, Homo sapiens
auauuggucuucaagaccugug

SEQ ID NO: 11302 - RNA, 22 nt, Homo sapiens
auauauguuuucugggaagaaa

SEQ ID NO: 11303 - RNA, 22 nt, Homo sapiens
auccugagacuuuucugaaguu

SEQ ID NO: 11304 - RNA, 22 nt, Homo sapiens
ugauuugucucucagcccuacu

SEQ ID NO: 11305 - RNA, 22 nt, Homo sapiens
aaugacccugauuggcaaguug

SEQ ID NO: 11306 - RNA, 22 nt, Homo sapiens
uauaugucuuuguuauguugag

SEQ ID NO: 11307 - RNA, 22 nt, Homo sapiens
uauggcuucuauaaggaagcuu

SEQ ID NO: 11308 - RNA, 22 nt, Homo sapiens
auaaaguguuuaguauaggcaa

SEQ ID NO: 11309 - RNA, 22 nt, Homo sapiens
auccucugagaucuaggcagag

SEQ ID NO: 11310 - RNA, 20 nt, Homo sapiens
ugagcuuguaaacacuguuu

SEQ ID NO: 11311 - RNA, 22 nt, Homo sapiens
gagaggucguauaugauuucug

SEQ ID NO: 11312 - RNA, 23 nt, Homo sapiens
agaaaugucuauucagggucccu

SEQ ID NO: 11313 - RNA, 22 nt, Homo sapiens
cucgagagaaaaugcuucacug

SEQ ID NO: 11314 - RNA, 22 nt, Homo sapiens
ugugaugaagaguccaagaaca

SEQ ID NO: 11315 - RNA, 22 nt, Homo sapiens
ugcuggcguuacucuccaucag

SEQ ID NO: 11316 - RNA, 15 nt, Homo sapiens
auauaugcaaugugu

SEQ ID NO: 11317 - RNA, 22 nt, Homo sapiens
gacuaguuaggucucucacaga

SEQ ID NO: 11318 - RNA, 21 nt, Homo sapiens
gagcacauuguccucuaacgc

SEQ ID NO: 11319 - RNA, 22 nt, Homo sapiens
auauggcuaugugagcauacca

SEQ ID NO: 11320 - RNA, 22 nt, Homo sapiens
auugccuaacauagauguucag

SEQ ID NO: 11321 - RNA, 22 nt, Homo sapiens
ccaaggaauacccucccuuuuu

SEQ ID NO: 11322 - RNA, 22 nt, Homo sapiens
guggaaagaacacaaaauuagg

SEQ ID NO: 11323 - RNA, 22 nt, Homo sapiens
cugacuuauguggacuauuuca

SEQ ID NO: 11324 - RNA, 22 nt, Homo sapiens
augaaagugauaaaugucucua

SEQ ID NO: 11325 - RNA, 22 nt, Homo sapiens
uaagugacuuugagauuccuca

SEQ ID NO: 11326 - RNA, 22 nt, Homo sapiens
uuagguaggugcuuuuuucaca

SEQ ID NO: 11327 - RNA, 22 nt, Homo sapiens
uugagggaggcagggcuugucu

SEQ ID NO: 11328 - RNA, 22 nt, Homo sapiens
guggagacaaaggcugagugag

SEQ ID NO: 11329 - RNA, 20 nt, Homo sapiens
aaccccuauagagaaaccau

SEQ ID NO: 11330 - RNA, 22 nt, Homo sapiens
uugcuccucugccaggaccugu

SEQ ID NO: 11331 - RNA, 22 nt, Homo sapiens
ugagaacagcagcuugggacac

SEQ ID NO: 11332 - RNA, 22 nt, Homo sapiens
uugucccauggggucuuccuuu

SEQ ID NO: 11333 - RNA, 22 nt, Homo sapiens
uuaacagcacaugcugucccuu

SEQ ID NO: 11334 - RNA, 22 nt, Homo sapiens
caauacuguuaccugaaauagg

SEQ ID NO: 11335 - RNA, 22 nt, Homo sapiens
ggcauguuuaguagaauguggu

SEQ ID NO: 11336 - RNA, 21 nt, Homo sapiens
uaauaaugucucagacaccua

SEQ ID NO: 11337 - RNA, 22 nt, Homo sapiens
ugaccaaugacauugaagagcu

SEQ ID NO: 11338 - RNA, 22 nt, Homo sapiens
ccccagguuucaauaaagccca

SEQ ID NO: 11339 - RNA, 22 nt, Homo sapiens
ugugagaucucagaauugaacu

SEQ ID NO: 11340 - RNA, 22 nt, Homo sapiens
agccauacaacguaugcaugua

SEQ ID NO: 11341 - RNA, 22 nt, Homo sapiens
ugcaaaucuuguguaguuguga

SEQ ID NO: 11342 - RNA, 22 nt, Homo sapiens
ugagaugacgacacaccucagu

SEQ ID NO: 11343 - RNA, 22 nt, Homo sapiens
uagguuguguucugagccucag

SEQ ID NO: 11344 - RNA, 22 nt, Homo sapiens
ugaaggccgggcaugguggcuc

SEQ ID NO: 11345 - RNA, 22 nt, Homo sapiens
uugaaguagguaccguucaauu

SEQ ID NO: 11346 - RNA, 20 nt, Homo sapiens
gugagaacaugugguauuug

SEQ ID NO: 11347 - RNA, 22 nt, Homo sapiens
agcggguuuuagauuucuccug

SEQ ID NO: 11348 - RNA, 22 nt, Homo sapiens
gcuaugucuguugcucuugggc

SEQ ID NO: 11349 - RNA, 22 nt, Homo sapiens
ugcauaggcuaaaauccuggcc

SEQ ID NO: 11350 - RNA, 22 nt, Homo sapiens
uuaagagugggaguuggccaca

SEQ ID NO: 11351 - RNA, 22 nt, Homo sapiens
ugaacagcacguuuauucagaa

SEQ ID NO: 11352 - RNA, 22 nt, Homo sapiens
gggcacgugugugcugugcuca

SEQ ID NO: 11353 - RNA, 23 nt, Homo sapiens
ucaguagucauugggaaagugug

SEQ ID NO: 11354 - RNA, 22 nt, Homo sapiens
ugccugagcccagcccuguagu

SEQ ID NO: 11355 - RNA, 22 nt, Homo sapiens
auacuccugucucagcugagau

SEQ ID NO: 11356 - RNA, 22 nt, Homo sapiens
uuccacaaugguugaacuaguu

SEQ ID NO: 11357 - RNA, 22 nt, Homo sapiens
agaugauguuuacugagcauca

SEQ ID NO: 11358 - RNA, 22 nt, Homo sapiens
uauacacgugugcauauauaca

SEQ ID NO: 11359 - RNA, 22 nt, Homo sapiens
aaugugcuuucuuucacacagu

SEQ ID NO: 11360 - RNA, 22 nt, Homo sapiens
uagcaguaagaaacugacauug

SEQ ID NO: 11361 - RNA, 22 nt, Homo sapiens
uugugccacugaagcccuccag

SEQ ID NO: 11362 - RNA, 23 nt, Homo sapiens
cccaguuaauccuuaaucuccac

SEQ ID NO: 11363 - RNA, 22 nt, Homo sapiens
auacaguguucugggaagaagu

SEQ ID NO: 11364 - RNA, 22 nt, Homo sapiens
augugcacaacgugcagguuug

SEQ ID NO: 11365 - RNA, 22 nt, Homo sapiens
auggucuuuucccuggauuaua

SEQ ID NO: 11366 - RNA, 22 nt, Homo sapiens
augaucuguuuggugaucuugu

SEQ ID NO: 11367 - RNA, 22 nt, Homo sapiens
ggaaugcagugagcauuagaua

SEQ ID NO: 11368 - RNA, 22 nt, Homo sapiens
cucaaguacaugggauuacagg

SEQ ID NO: 11369 - RNA, 22 nt, Homo sapiens
uggcaaaugugagaugagaacu

SEQ ID NO: 11370 - RNA, 22 nt, Homo sapiens
uaguaaacauaguucuuuugcu

SEQ ID NO: 11371 - RNA, 22 nt, Homo sapiens
uggcaauaaggacuccuuaggu

SEQ ID NO: 11372 - RNA, 22 nt, Homo sapiens
ugacaguuuccagggcugucuc

SEQ ID NO: 11373 - RNA, 20 nt, Homo sapiens
guucccuguaggugugcgga

SEQ ID NO: 11374 - RNA, 22 nt, Homo sapiens
augaacgugugcauauaagcag

SEQ ID NO: 11375 - RNA, 22 nt, Homo sapiens
ugcaagacuaaaccuuccccuc

SEQ ID NO: 11376 - RNA, 22 nt, Homo sapiens
gugcagaugucuuuauaguagc

SEQ ID NO: 11377 - RNA, 21 nt, Homo sapiens
acugagagaucuggggcacau

SEQ ID NO: 11378 - RNA, 22 nt, Homo sapiens
ggucacauuggacuaucaaguu

SEQ ID NO: 11379 - RNA, 22 nt, Homo sapiens
gcaauacugacagcauuaguuu

SEQ ID NO: 11380 - RNA, 19 nt, Homo sapiens
aauggcuuuuccuguuccc

SEQ ID NO: 11381 - RNA, 22 nt, Homo sapiens
uggauauguuuauauguugucu

SEQ ID NO: 11382 - RNA, 22 nt, Homo sapiens
ugccuacucucugccaggaaug

SEQ ID NO: 11383 - RNA, 22 nt, Homo sapiens
cucaggcacucugauuccagug

SEQ ID NO: 11384 - RNA, 22 nt, Homo sapiens
uuggaagcacauuguuuaauua

SEQ ID NO: 11385 - RNA, 22 nt, Homo sapiens
uaagccaccgugccuggccuaa

SEQ ID NO: 11386 - RNA, 22 nt, Homo sapiens
uggcaguuucacauggcucaac

SEQ ID NO: 11387 - RNA, 22 nt, Homo sapiens
uggaaugcucuccccacggacu

SEQ ID NO: 11388 - RNA, 22 nt, Homo sapiens
uuuuccagugggacucccauua

SEQ ID NO: 11389 - RNA, 22 nt, Homo sapiens
uaggucacugcucugugucuaa

SEQ ID NO: 11390 - RNA, 22 nt, Homo sapiens
ucagguauuuauagcaaugcaa

SEQ ID NO: 11391 - RNA, 22 nt, Homo sapiens
uccccugagaacuugcuagaaa

SEQ ID NO: 11392 - RNA, 22 nt, Homo sapiens
gucuuuggaaaaaaugucuguu

SEQ ID NO: 11393 - RNA, 15 nt, Homo sapiens
cucugguuuuucuuc

SEQ ID NO: 11394 - RNA, 22 nt, Homo sapiens
ucacaguccuguuuaggagagg

SEQ ID NO: 11395 - RNA, 21 nt, Homo sapiens
uacuugagacagggucuugcu

SEQ ID NO: 11396 - RNA, 22 nt, Homo sapiens
agcugugucuucuuaaagauuu

SEQ ID NO: 11397 - RNA, 22 nt, Homo sapiens
ucaagcaauucuccugccucag

SEQ ID NO: 11398 - RNA, 22 nt, Homo sapiens
aggucccauguccucccugacc

SEQ ID NO: 11399 - RNA, 22 nt, Homo sapiens
uuauagacacguuguaacaaac

SEQ ID NO: 11400 - RNA, 22 nt, Homo sapiens
ugaguaggauugguauuucuuc

SEQ ID NO: 11401 - RNA, 22 nt, Homo sapiens
cuacagugggucuguaguccuu

SEQ ID NO: 11402 - RNA, 22 nt, Homo sapiens
caccauguguucagaaggauug

SEQ ID NO: 11403 - RNA, 22 nt, Homo sapiens
gggauguuuuauacugagccug

SEQ ID NO: 11404 - RNA, 22 nt, Homo sapiens
uguggcauugaauaaccuugga

SEQ ID NO: 11405 - RNA, 22 nt, Homo sapiens
ugagcagaguuguuucuccuga

SEQ ID NO: 11406 - RNA, 22 nt, Homo sapiens
gugagaauauuuuaaauacuaa

SEQ ID NO: 11407 - RNA, 22 nt, Homo sapiens
uucaguccauuuccuuggucac

SEQ ID NO: 11408 - RNA, 22 nt, Homo sapiens
ugcaagucaucuguccuucaga

SEQ ID NO: 11409 - RNA, 22 nt, Homo sapiens
ugaaaugcagaacuuuaggucu

SEQ ID NO: 11410 - RNA, 22 nt, Homo sapiens
uuggcaacauagugagaccccc

SEQ ID NO: 11411 - RNA, 22 nt, Homo sapiens
ucagcaaugaccuaagcaaaua

SEQ ID NO: 11412 - RNA, 22 nt, Homo sapiens
uuauagcagugcccaacuccug

SEQ ID NO: 11413 - RNA, 22 nt, Homo sapiens
ccgagguaggaggaucacuuga

SEQ ID NO: 11414 - RNA, 22 nt, Homo sapiens
uuagguauuuuguuaugucagc

SEQ ID NO: 11415 - RNA, 22 nt, Homo sapiens
aaggaguagaauagaugcaccu

SEQ ID NO: 11416 - RNA, 22 nt, Homo sapiens
uuugggccauggcuuuuccacg

SEQ ID NO: 11417 - RNA, 19 nt, Homo sapiens
augcugguguugcucaaac

SEQ ID NO: 11418 - RNA, 22 nt, Homo sapiens
auaaaguucugcuggcauauau

SEQ ID NO: 11419 - RNA, 22 nt, Homo sapiens
ugaauuguuuacgagaugugag

SEQ ID NO: 11420 - RNA, 22 nt, Homo sapiens
ucuugcaauuuccuuaguggug

SEQ ID NO: 11421 - RNA, 22 nt, Homo sapiens
ggagcugugauuugaguccaga

SEQ ID NO: 11422 - RNA, 22 nt, Homo sapiens
auguaaacauuuggucuaaauu

SEQ ID NO: 11423 - RNA, 22 nt, Homo sapiens
aggugguauuuaaaauuauuug

SEQ ID NO: 11424 - RNA, 22 nt, Homo sapiens
cuacaguuauguuuuaaaugug

SEQ ID NO: 11425 - RNA, 22 nt, Homo sapiens
uaucccuuagagcggggugguu

SEQ ID NO: 11426 - RNA, 22 nt, Homo sapiens
uuguacuggguuuucuggaauu

SEQ ID NO: 11427 - RNA, 22 nt, Homo sapiens
agugguuuuaaguagagcauac

SEQ ID NO: 11428 - RNA, 20 nt, Homo sapiens
agagguuuugauagguucug

SEQ ID NO: 11429 - RNA, 22 nt, Homo sapiens
uugggaauguccuaauaucucg

SEQ ID NO: 11430 - RNA, 22 nt, Homo sapiens
auuuggguaaugagugcaaggg

SEQ ID NO: 11431 - RNA, 17 nt, Homo sapiens
gagguaguuuacuuuca

SEQ ID NO: 11432 - RNA, 22 nt, Homo sapiens
auugcacuccagccugggcgac

SEQ ID NO: 11433 - RNA, 22 nt, Homo sapiens
gaguucauaucuaugagugugc

SEQ ID NO: 11434 - RNA, 22 nt, Homo sapiens
ugccugcugucuaauauauucu

SEQ ID NO: 11435 - RNA, 22 nt, Homo sapiens
uugagugaaugaaugauuaaau

SEQ ID NO: 11436 - RNA, 22 nt, Homo sapiens
guuauguaucuugauugggugg

SEQ ID NO: 11437 - RNA, 22 nt, Homo sapiens
gacuagaggcaggcaccgcugc

SEQ ID NO: 11438 - RNA, 22 nt, Homo sapiens
ucccugagcaaaguuuucugua

SEQ ID NO: 11439 - RNA, 22 nt, Homo sapiens
acugcacuccagacucugucuc

SEQ ID NO: 11440 - RNA, 22 nt, Homo sapiens
ucugaguggcagaaugagcuga

SEQ ID NO: 11441 - RNA, 22 nt, Homo sapiens
aaguaaacauugagagacaaga

SEQ ID NO: 11442 - RNA, 22 nt, Homo sapiens
ugauugcacaccugcacucaag

SEQ ID NO: 11443 - RNA, 22 nt, Homo sapiens
ugcauauucgaguuauuuuggg

SEQ ID NO: 11444 - RNA, 22 nt, Homo sapiens
uagcuccagugggguuacugcu

SEQ ID NO: 11445 - RNA, 22 nt, Homo sapiens
ggccuguaggguauugguaggg

SEQ ID NO: 11446 - RNA, 22 nt, Homo sapiens
gacuauaucaggaauggggauu

SEQ ID NO: 11447 - RNA, 22 nt, Homo sapiens
cucugauggagauauacaagga

SEQ ID NO: 11448 - RNA, 22 nt, Homo sapiens
cuuucugaggagaauagagaac

SEQ ID NO: 11449 - RNA, 22 nt, Homo sapiens
gagguaugauugacauauaaaa

SEQ ID NO: 11450 - RNA, 19 nt, Homo sapiens
agcuuuggcuaacuuucuc

SEQ ID NO: 11451 - RNA, 22 nt, Homo sapiens
auguauggcagguuugggguuu

SEQ ID NO: 11452 - RNA, 22 nt, Homo sapiens
accuuguagcaaaccuaacaua

SEQ ID NO: 11453 - RNA, 19 nt, Homo sapiens
uuccuagugguugggaagu

SEQ ID NO: 11454 - RNA, 21 nt, Homo sapiens
uugcaaaugcugcugccugau

SEQ ID NO: 11455 - RNA, 22 nt, Homo sapiens
uuaugcuuauugguguacggua

SEQ ID NO: 11456 - RNA, 22 nt, Homo sapiens
uagcaucagauuccauauucua

SEQ ID NO: 11457 - RNA, 22 nt, Homo sapiens
gagcacauguggagagucuggg

SEQ ID NO: 11458 - RNA, 22 nt, Homo sapiens
uuuggucacugccgccgccagc

SEQ ID NO: 11459 - RNA, 22 nt, Homo sapiens
agucauggcagaaggcaccucu

SEQ ID NO: 11460 - RNA, 22 nt, Homo sapiens
auggucuuuguuucuaauucug

SEQ ID NO: 11461 - RNA, 23 nt, Homo sapiens
augaauguaaagaaugugggaag

SEQ ID NO: 11462 - RNA, 16 nt, Homo sapiens
gcuguuguuuuguccu

SEQ ID NO: 11463 - RNA, 20 nt, Homo sapiens
cagucauagacaucagaguc

SEQ ID NO: 11464 - RNA, 22 nt, Homo sapiens
ucuugguuuauugugguaugaa

SEQ ID NO: 11465 - RNA, 22 nt, Homo sapiens
ucaugaccaugguauagaccac

SEQ ID NO: 11466 - RNA, 22 nt, Homo sapiens
uggaugaagagaugguaguugc

SEQ ID NO: 11467 - RNA, 22 nt, Homo sapiens
ucugguguuacugagccuccca

SEQ ID NO: 11468 - RNA, 23 nt, Homo sapiens
aaucugucuuuguuauagggguc

SEQ ID NO: 11469 - RNA, 22 nt, Homo sapiens
auaugcaaauccauagagacag

SEQ ID NO: 11470 - RNA, 22 nt, Homo sapiens
uaacgcuaguaucaccaggcua

SEQ ID NO: 11471 - RNA, 22 nt, Homo sapiens
aaucagcacacugugcuuucca

SEQ ID NO: 11472 - RNA, 17 nt, Homo sapiens
ugauauuuucccagaua

SEQ ID NO: 11473 - RNA, 22 nt, Homo sapiens
auguaauugagguuuuugccau

SEQ ID NO: 11474 - RNA, 22 nt, Homo sapiens
uuagcacugucuacucuggauu

SEQ ID NO: 11475 - RNA, 22 nt, Homo sapiens
ggugcagcacaccaacauggca

SEQ ID NO: 11476 - RNA, 22 nt, Homo sapiens
auagguuauuagagcaaagcuu

SEQ ID NO: 11477 - RNA, 22 nt, Homo sapiens
gucacagcacuuuuaguaagug

SEQ ID NO: 11478 - RNA, 21 nt, Homo sapiens
uugagacggagucucacucug

SEQ ID NO: 11479 - RNA, 22 nt, Homo sapiens
cauggagcuaggcuugaucccu

SEQ ID NO: 11480 - RNA, 22 nt, Homo sapiens
gccaguauuuuguugagaauuu

SEQ ID NO: 11481 - RNA, 22 nt, Homo sapiens
gugguuuuuuucugccuuauag

SEQ ID NO: 11482 - RNA, 22 nt, Homo sapiens
ugaauauuugcuacucacucuu

SEQ ID NO: 11483 - RNA, 22 nt, Homo sapiens
auuggucuauuaaaccuaaguu

SEQ ID NO: 11484 - RNA, 21 nt, Homo sapiens
uauggauuugccuauucugga

SEQ ID NO: 11485 - RNA, 22 nt, Homo sapiens
augaggugaggucaguaaggua

SEQ ID NO: 11486 - RNA, 22 nt, Homo sapiens
uauggauguuaagguucacagc

SEQ ID NO: 11487 - RNA, 22 nt, Homo sapiens
ucaagcaauucgccugucucag

SEQ ID NO: 11488 - RNA, 22 nt, Homo sapiens
gguaacaguggggcuaugcuua

SEQ ID NO: 11489 - RNA, 22 nt, Homo sapiens
ucugacucuggagucucagguu

SEQ ID NO: 11490 - RNA, 22 nt, Homo sapiens
uuccaguauuugggcaagcgca

SEQ ID NO: 11491 - RNA, 21 nt, Homo sapiens
ugugacuguugcauuugucgu

SEQ ID NO: 11492 - RNA, 22 nt, Homo sapiens
ggauggcauuucuuuagcuuuu

SEQ ID NO: 11493 - RNA, 22 nt, Homo sapiens
auugcuauuauuugaccauugu

SEQ ID NO: 11494 - RNA, 21 nt, Homo sapiens
aagaaagcuggacuugccgcu

SEQ ID NO: 11495 - RNA, 22 nt, Homo sapiens
uuaugaaguagguuaagagcag

SEQ ID NO: 11496 - RNA, 22 nt, Homo sapiens
ucaggugcaguggcucugaccu

SEQ ID NO: 11497 - RNA, 22 nt, Homo sapiens
uaagugaauguuggcuacugaa

SEQ ID NO: 11498 - RNA, 22 nt, Homo sapiens
acaguaugcuuuaaacuuuguu

SEQ ID NO: 11499 - RNA, 22 nt, Homo sapiens
aaggcuguucauuuagcacagu

SEQ ID NO: 11500 - RNA, 22 nt, Homo sapiens
cucacugggaccacucugaagu

SEQ ID NO: 11501 - RNA, 22 nt, Homo sapiens
auuggcuauuuggugagugauu

SEQ ID NO: 11502 - RNA, 18 nt, Homo sapiens
ucagucacugccuggcuu

SEQ ID NO: 11503 - RNA, 22 nt, Homo sapiens
auagcaaugcaagaauggcuua

SEQ ID NO: 11504 - RNA, 22 nt, Homo sapiens
cuuugguugugcucuccacuuu

SEQ ID NO: 11505 - RNA, 22 nt, Homo sapiens
uugagaucuugauauguuugaa

SEQ ID NO: 11506 - RNA, 22 nt, Homo sapiens
aaugcaucuagaaaggugaauu

SEQ ID NO: 11507 - RNA, 20 nt, Homo sapiens
uuuguaucucuggguacugg

SEQ ID NO: 11508 - RNA, 22 nt, Homo sapiens
uacccgucuacuuugaacaaaa

SEQ ID NO: 11509 - RNA, 22 nt, Homo sapiens
agguagucuuuuccuauuguca

SEQ ID NO: 11510 - RNA, 22 nt, Homo sapiens
gugaaagcaucugacugugcca

SEQ ID NO: 11511 - RNA, 22 nt, Homo sapiens
aaagggcuugaauacucuuuuu

SEQ ID NO: 11512 - RNA, 22 nt, Homo sapiens
ucaguacgugggcaguuccuuc

SEQ ID NO: 11513 - RNA, 22 nt, Homo sapiens
ccuucauucauuaauuuagccc

SEQ ID NO: 11514 - RNA, 18 nt, Homo sapiens
aaggugcuucuguucuga

SEQ ID NO: 11515 - RNA, 19 nt, Homo sapiens
uacuggcucgggaauuuuc

SEQ ID NO: 11516 - RNA, 22 nt, Homo sapiens
uccugagaauagaguugcaugu

SEQ ID NO: 11517 - RNA, 22 nt, Homo sapiens
uccuugcacuaacuuaaggagg

SEQ ID NO: 11518 - RNA, 22 nt, Homo sapiens
uuuaaguguuuguuccugaaaa

SEQ ID NO: 11519 - RNA, 22 nt, Homo sapiens
agaaccauuagagggagauauu

SEQ ID NO: 11520 - RNA, 22 nt, Homo sapiens
ucucugguuaugucauuaagca

SEQ ID NO: 11521 - RNA, 22 nt, Homo sapiens
aaugcuaucuggaacauuguug

SEQ ID NO: 11522 - RNA, 22 nt, Homo sapiens
uggagugcgugucugaguuuuu

SEQ ID NO: 11523 - RNA, 22 nt, Homo sapiens
uuugcuauagugaauagugcug

SEQ ID NO: 11524 - RNA, 22 nt, Homo sapiens
ggagagcuaggcagagguuugu

SEQ ID NO: 11525 - RNA, 22 nt, Homo sapiens
caagguacuuuuacaauuuccc

SEQ ID NO: 11526 - RNA, 22 nt, Homo sapiens
cccagaguucuuaaauacugag

SEQ ID NO: 11527 - RNA, 22 nt, Homo sapiens
augaggauagguuucuauuagg

SEQ ID NO: 11528 - RNA, 22 nt, Homo sapiens
uguacuucaagauuaugguuua

SEQ ID NO: 11529 - RNA, 22 nt, Homo sapiens
gagcuaguagauuuuaaauauu

SEQ ID NO: 11530 - RNA, 22 nt, Homo sapiens
ugggaugugagucuucgcuuuc

SEQ ID NO: 11531 - RNA, 22 nt, Homo sapiens
gaaugugcuguuggcugggcgu

SEQ ID NO: 11532 - RNA, 21 nt, Homo sapiens
uucucagaggcaggggauaaa

SEQ ID NO: 11533 - RNA, 22 nt, Homo sapiens
cucugguucugcagugcacccu

SEQ ID NO: 11534 - RNA, 22 nt, Homo sapiens
ccaggguuccacgccuggcugu

SEQ ID NO: 11535 - RNA, 22 nt, Homo sapiens
ucuuuggguagauauguagcug

SEQ ID NO: 11536 - RNA, 22 nt, Homo sapiens
uucauguaauuccauaagguaa

SEQ ID NO: 11537 - RNA, 22 nt, Homo sapiens
acaagacuucuuguauucuagu

SEQ ID NO: 11538 - RNA, 22 nt, Homo sapiens
uuguaguagcauuauuuauaau

SEQ ID NO: 11539 - RNA, 22 nt, Homo sapiens
uugugacacagcugggccuaua

SEQ ID NO: 11540 - RNA, 22 nt, Homo sapiens
ggaguguuccauuugucacauu

SEQ ID NO: 11541 - RNA, 22 nt, Homo sapiens
ugcauauuuuauaaagauggaa

SEQ ID NO: 11542 - RNA, 23 nt, Homo sapiens
ugagacauuggaaaguuaggcag

SEQ ID NO: 11543 - RNA, 22 nt, Homo sapiens
agugccuauugauggaaagaua

SEQ ID NO: 11544 - RNA, 22 nt, Homo sapiens
aauacuuccaaaucuagucauu

SEQ ID NO: 11545 - RNA, 22 nt, Homo sapiens
uuaaggcuuucccuauguaaaa

SEQ ID NO: 11546 - RNA, 22 nt, Homo sapiens
uugcaguagucugaaagcaaua

SEQ ID NO: 11547 - RNA, 22 nt, Homo sapiens
auggugugugaauuaaauguua

SEQ ID NO: 11548 - RNA, 22 nt, Homo sapiens
ucacaagcuccugccuuugcuu

SEQ ID NO: 11549 - RNA, 22 nt, Homo sapiens
augugccaauuaggauuccaag

SEQ ID NO: 11550 - RNA, 22 nt, Homo sapiens
auucccuuagcugccucagccu

SEQ ID NO: 11551 - RNA, 22 nt, Homo sapiens
cugccaguuugauucgggccac

SEQ ID NO: 11552 - RNA, 19 nt, Homo sapiens
cugcaugagacaguugguu

SEQ ID NO: 11553 - RNA, 22 nt, Homo sapiens
cugcccguaauccucuccccag

SEQ ID NO: 11554 - RNA, 22 nt, Homo sapiens
auggacauuaaagcgauguaga

SEQ ID NO: 11555 - RNA, 22 nt, Homo sapiens
uugauaauguuaacuuugguca

SEQ ID NO: 11556 - RNA, 23 nt, Homo sapiens
ugucaucaagaugaggucacacu

SEQ ID NO: 11557 - RNA, 22 nt, Homo sapiens
ucucccauccaugaacuucugu

SEQ ID NO: 11558 - RNA, 21 nt, Homo sapiens
gaggauauuuuuauguuugga

SEQ ID NO: 11559 - RNA, 22 nt, Homo sapiens
agagaacugauuggaguugggc

SEQ ID NO: 11560 - RNA, 22 nt, Homo sapiens
gggaugaagaagaauaguucgu

SEQ ID NO: 11561 - RNA, 21 nt, Homo sapiens
auggaaagacugccucuucaa

SEQ ID NO: 11562 - RNA, 22 nt, Homo sapiens
ucccugagugauugaaaauaaa

SEQ ID NO: 11563 - RNA, 22 nt, Homo sapiens
uugacagagaaaagugugacuu

SEQ ID NO: 11564 - RNA, 22 nt, Homo sapiens
gauguguuuaucacccaguccu

SEQ ID NO: 11565 - RNA, 22 nt, Homo sapiens
gcugaguaguauuucauuguau

SEQ ID NO: 11566 - RNA, 22 nt, Homo sapiens
uuacagcugcuccccaucacuc

SEQ ID NO: 11567 - RNA, 21 nt, Homo sapiens
uagugcugaggcaguauggga

SEQ ID NO: 11568 - RNA, 22 nt, Homo sapiens
ucacauuaagcuguuauuucuu

SEQ ID NO: 11569 - RNA, 19 nt, Homo sapiens
ugugaacaucacagagugu

SEQ ID NO: 11570 - RNA, 22 nt, Homo sapiens
auuugggaaugugcauuauacu

SEQ ID NO: 11571 - RNA, 22 nt, Homo sapiens
acguaguagguuuauaauauua

SEQ ID NO: 11572 - RNA, 22 nt, Homo sapiens
ugggcagugggacagcuuugug

SEQ ID NO: 11573 - RNA, 22 nt, Homo sapiens
ggcaagaaccucaauuaccuuu

SEQ ID NO: 11574 - RNA, 22 nt, Homo sapiens
auggcucuuauuauuuugaggu

SEQ ID NO: 11575 - RNA, 20 nt, Homo sapiens
cuugccuagcccuuugccuc

SEQ ID NO: 11576 - RNA, 22 nt, Homo sapiens
ugcauauguauacaugugccau

SEQ ID NO: 11577 - RNA, 22 nt, Homo sapiens
ugagaucucauuaugguuuuaa

SEQ ID NO: 11578 - RNA, 20 nt, Homo sapiens
uuuuggacuaaaggcauccc

SEQ ID NO: 11579 - RNA, 22 nt, Homo sapiens
auggcagugucuagggguguuu

SEQ ID NO: 11580 - RNA, 22 nt, Homo sapiens
ggaucauaugauagcucaauuu

SEQ ID NO: 11581 - RNA, 22 nt, Homo sapiens
cuggcaaauguuuucuguaaag

SEQ ID NO: 11582 - RNA, 22 nt, Homo sapiens
gcaaaguaauuguuguuuuugc

SEQ ID NO: 11583 - RNA, 22 nt, Homo sapiens
uguggcuuuguaaccauggguc

SEQ ID NO: 11584 - RNA, 21 nt, Homo sapiens
gaccacagcagggaaugucag

SEQ ID NO: 11585 - RNA, 23 nt, Homo sapiens
uggcauuuuuggcaaugccuucu

SEQ ID NO: 11586 - RNA, 23 nt, Homo sapiens
uuucuugggcaugcuaugucagu

SEQ ID NO: 11587 - RNA, 21 nt, Homo sapiens
guaugguugaagugacaagcc

SEQ ID NO: 11588 - RNA, 19 nt, Homo sapiens
ucuuugcuuuucuaagagg

SEQ ID NO: 11589 - RNA, 22 nt, Homo sapiens
gcuuugguucaaccaggcaauu

SEQ ID NO: 11590 - RNA, 22 nt, Homo sapiens
augacucagaucuguuccuggu

SEQ ID NO: 11591 - RNA, 22 nt, Homo sapiens
gugguagaaauguagaugcuag

SEQ ID NO: 11592 - RNA, 18 nt, Homo sapiens
ucugugguguaaauacgu

SEQ ID NO: 11593 - RNA, 22 nt, Homo sapiens
gauggaguugacuaagacaaca

SEQ ID NO: 11594 - RNA, 22 nt, Homo sapiens
uuggaaauauguuaagugucau

SEQ ID NO: 11595 - RNA, 22 nt, Homo sapiens
uuggauggugauaugguuugga

SEQ ID NO: 11596 - RNA, 22 nt, Homo sapiens
aauucacuuguggcagauccuu

SEQ ID NO: 11597 - RNA, 22 nt, Homo sapiens
uuggcuuuuaugcagcuuaggu

SEQ ID NO: 11598 - RNA, 18 nt, Homo sapiens
cuaguguuucuugaauca

SEQ ID NO: 11599 - RNA, 22 nt, Homo sapiens
gagcacccuuuguugauugcaa

SEQ ID NO: 11600 - RNA, 22 nt, Homo sapiens
aucacuuugcucuccagugugg

SEQ ID NO: 11601 - RNA, 22 nt, Homo sapiens
gagaaugagaggggaaggccac

SEQ ID NO: 11602 - RNA, 22 nt, Homo sapiens
accuugcacugagccgagauug

SEQ ID NO: 11603 - RNA, 22 nt, Homo sapiens
ccacaaccucaacagcaucuau

SEQ ID NO: 11604 - RNA, 22 nt, Homo sapiens
gagcucaccuuaccucuggagc

SEQ ID NO: 11605 - RNA, 22 nt, Homo sapiens
guuuggauuuucuaauuucugu

SEQ ID NO: 11606 - RNA, 22 nt, Homo sapiens
guuggugaccugaagagaguaa

SEQ ID NO: 11607 - RNA, 22 nt, Homo sapiens
uagcacuauguuaucacauacu

SEQ ID NO: 11608 - RNA, 20 nt, Homo sapiens
uaaaugccucaugcuuuauu

SEQ ID NO: 11609 - RNA, 22 nt, Homo sapiens
uuaguagagacgagcguuccac

SEQ ID NO: 11610 - RNA, 20 nt, Homo sapiens
ccccguguuuagcauaucau

SEQ ID NO: 11611 - RNA, 22 nt, Homo sapiens
aucagcauucccaaaugaugug

SEQ ID NO: 11612 - RNA, 22 nt, Homo sapiens
gcaggaauuucucugcagaccc

SEQ ID NO: 11613 - RNA, 22 nt, Homo sapiens
cuagauuauccaacuuauuagc

SEQ ID NO: 11614 - RNA, 22 nt, Homo sapiens
uuguccacugcuagccucugca

SEQ ID NO: 11615 - RNA, 22 nt, Homo sapiens
ggacauuaacugcaagauagau

SEQ ID NO: 11616 - RNA, 20 nt, Homo sapiens
auugcagcaugauuuauaau

SEQ ID NO: 11617 - RNA, 22 nt, Homo sapiens
agagguaugccugggcuggagc

SEQ ID NO: 11618 - RNA, 22 nt, Homo sapiens
gugugcaaauguguaccuacau

SEQ ID NO: 11619 - RNA, 22 nt, Homo sapiens
uuggaauauuauuauugggcag

SEQ ID NO: 11620 - RNA, 22 nt, Homo sapiens
agugcagugguuaggagccagg

SEQ ID NO: 11621 - RNA, 22 nt, Homo sapiens
guggcagugugaggauccugcu

SEQ ID NO: 11622 - RNA, 17 nt, Homo sapiens
uuauugcuauaagcuga

SEQ ID NO: 11623 - RNA, 22 nt, Homo sapiens
guggaaugauaucucauugugg

SEQ ID NO: 11624 - RNA, 22 nt, Homo sapiens
uagguugucucuucacucugau

SEQ ID NO: 11625 - RNA, 22 nt, Homo sapiens
aaugucaucuucaguuguacag

SEQ ID NO: 11626 - RNA, 18 nt, Homo sapiens
ucacagguaauuaggauu

SEQ ID NO: 11627 - RNA, 22 nt, Homo sapiens
gcaguagugcgaucucagcuca

SEQ ID NO: 11628 - RNA, 22 nt, Homo sapiens
auaguggcaugaucauagcuca

SEQ ID NO: 11629 - RNA, 22 nt, Homo sapiens
ugggguaggcuguauacucugu

SEQ ID NO: 11630 - RNA, 22 nt, Homo sapiens
agguuuucagccccagccuagg

SEQ ID NO: 11631 - RNA, 22 nt, Homo sapiens
ugacuugaguaacuggcucagg

SEQ ID NO: 11632 - RNA, 22 nt, Homo sapiens
acugcaauuacuguuguaccaa

SEQ ID NO: 11633 - RNA, 23 nt, Homo sapiens
uggccaagauaaucucaguuuuc

SEQ ID NO: 11634 - RNA, 22 nt, Homo sapiens
ucaguaaaugcuguucucuuuu

SEQ ID NO: 11635 - RNA, 22 nt, Homo sapiens
uaugucuucuuuagagaaaugu

SEQ ID NO: 11636 - RNA, 23 nt, Homo sapiens
caucacagagccuuccuugacuc

SEQ ID NO: 11637 - RNA, 22 nt, Homo sapiens
cagugcuuuaucaaguccucca

SEQ ID NO: 11638 - RNA, 22 nt, Homo sapiens
cuaaaguauugagugguaaaga

SEQ ID NO: 11639 - RNA, 22 nt, Homo sapiens
uuagcauccauaggagauuggu

SEQ ID NO: 11640 - RNA, 22 nt, Homo sapiens
uaagugcaugauuacaugcaua

SEQ ID NO: 11641 - RNA, 18 nt, Homo sapiens
ucccuuuguagaugaccc

SEQ ID NO: 11642 - RNA, 22 nt, Homo sapiens
auagcauaucccacaugucaga

SEQ ID NO: 11643 - RNA, 22 nt, Homo sapiens
caggcauagucuugaguuuuau

SEQ ID NO: 11644 - RNA, 22 nt, Homo sapiens
uuaagcaaagguaacaugagaa

SEQ ID NO: 11645 - RNA, 22 nt, Homo sapiens
uuccaguugugagcuauccggg

SEQ ID NO: 11646 - RNA, 22 nt, Homo sapiens
guucaucagggauacuggccuu

SEQ ID NO: 11647 - RNA, 22 nt, Homo sapiens
ucccuugagccuggcuucucac

SEQ ID NO: 11648 - RNA, 22 nt, Homo sapiens
uccaguguuucuuccacuauuu

SEQ ID NO: 11649 - RNA, 22 nt, Homo sapiens
ggagcucaucuagcauagaggu

SEQ ID NO: 11650 - RNA, 22 nt, Homo sapiens
ggugagguaggaaaaguuagga

SEQ ID NO: 11651 - RNA, 22 nt, Homo sapiens
uugccaauauuuuacugagaag

SEQ ID NO: 11652 - RNA, 22 nt, Homo sapiens
ugaagggcauuguuuugccaaa

SEQ ID NO: 11653 - RNA, 22 nt, Homo sapiens
ggauaacagccaggucaaacaa

SEQ ID NO: 11654 - RNA, 22 nt, Homo sapiens
aauuguacucccaucauuccua

SEQ ID NO: 11655 - RNA, 22 nt, Homo sapiens
uuaggcuaguugauauaguuug

SEQ ID NO: 11656 - RNA, 22 nt, Homo sapiens
augacaaugaaucccuguuuca

SEQ ID NO: 11657 - RNA, 22 nt, Homo sapiens
acaugcauauguuggaagaaag

SEQ ID NO: 11658 - RNA, 22 nt, Homo sapiens
cugaucuggaggugucugggga

SEQ ID NO: 11659 - RNA, 22 nt, Homo sapiens
uuugcagugucagcuucugugu

SEQ ID NO: 11660 - RNA, 20 nt, Homo sapiens
uuugaauguaaagcauguca

SEQ ID NO: 11661 - RNA, 22 nt, Homo sapiens
agugaauuguucaacaggagga

SEQ ID NO: 11662 - RNA, 22 nt, Homo sapiens
acacugucucuugcugaccaug

SEQ ID NO: 11663 - RNA, 22 nt, Homo sapiens
auaaguauuuggacuuuacugu

SEQ ID NO: 11664 - RNA, 22 nt, Homo sapiens
agcugaguguuccaagagcgag

SEQ ID NO: 11665 - RNA, 22 nt, Homo sapiens
ugugccacuccaggaggcuguu

SEQ ID NO: 11666 - RNA, 18 nt, Homo sapiens
ucaccuugaugcuggguc

SEQ ID NO: 11667 - RNA, 21 nt, Homo sapiens
ucuaccuacugcucacaggcu

SEQ ID NO: 11668 - RNA, 22 nt, Homo sapiens
uugcugguuuucauaugagcag

SEQ ID NO: 11669 - RNA, 22 nt, Homo sapiens
uauuucccuuaacuuuccugca

SEQ ID NO: 11670 - RNA, 22 nt, Homo sapiens
uaaggcuuugguagguuugguc

SEQ ID NO: 11671 - RNA, 16 nt, Homo sapiens
uuaggcagugugauac

SEQ ID NO: 11672 - RNA, 22 nt, Homo sapiens
ugagcagagaagugcccugcgc

SEQ ID NO: 11673 - RNA, 22 nt, Homo sapiens
acugccuaaugacuuauguuuu

SEQ ID NO: 11674 - RNA, 22 nt, Homo sapiens
uugaaagaaaggagacugaguu

SEQ ID NO: 11675 - RNA, 22 nt, Homo sapiens
uuggaaaguuguuguaguuauu

SEQ ID NO: 11676 - RNA, 22 nt, Homo sapiens
aucauacuguuuugauuacugu

SEQ ID NO: 11677 - RNA, 22 nt, Homo sapiens
ggaagagugaauuaucuugacu

SEQ ID NO: 11678 - RNA, 22 nt, Homo sapiens
auccugagacuuugcugaaguu

SEQ ID NO: 11679 - RNA, 22 nt, Homo sapiens
uauagcccuugguguggaaaug

SEQ ID NO: 11680 - RNA, 22 nt, Homo sapiens
ucauuggaugucugaaaugauu

SEQ ID NO: 11681 - RNA, 22 nt, Homo sapiens
auggcuguuuaagaguuucauu

SEQ ID NO: 11682 - RNA, 22 nt, Homo sapiens
augauuguucucacucaagaga

SEQ ID NO: 11683 - RNA, 22 nt, Homo sapiens
gucuuuguuuggucuguaucag

SEQ ID NO: 11684 - RNA, 22 nt, Homo sapiens
augcaagaaauaucucuuuuuc

SEQ ID NO: 11685 - RNA, 22 nt, Homo sapiens
gaugguguuuugauaggaauug

SEQ ID NO: 11686 - RNA, 18 nt, Homo sapiens
gggaauauggggaguuga

SEQ ID NO: 11687 - RNA, 22 nt, Homo sapiens
cuacaguucuuaauuaaguagu

SEQ ID NO: 11688 - RNA, 22 nt, Homo sapiens
cugacaugcagccacugcaccu

SEQ ID NO: 11689 - RNA, 22 nt, Homo sapiens
uaagcaguaaaugaagucuugc

SEQ ID NO: 11690 - RNA, 22 nt, Homo sapiens
aucucauggagguagagaguaa

SEQ ID NO: 11691 - RNA, 23 nt, Homo sapiens
augaauguaaggaguguaagaaa

SEQ ID NO: 11692 - RNA, 22 nt, Homo sapiens
uagguugucuucccagaguuuu

SEQ ID NO: 11693 - RNA, 20 nt, Homo sapiens
agguaguuauacaaaugugu

SEQ ID NO: 11694 - RNA, 22 nt, Homo sapiens
caccuugugauccacccgccuu

SEQ ID NO: 11695 - RNA, 17 nt, Homo sapiens
gcauauguugaaccagu

SEQ ID NO: 11696 - RNA, 17 nt, Homo sapiens
gcauaugucgaaccagc

SEQ ID NO: 11697 - RNA, 22 nt, Homo sapiens
uagagcaugugccauacguaca

SEQ ID NO: 11698 - RNA, 18 nt, Homo sapiens
augaagucaucacuuuua

SEQ ID NO: 11699 - RNA, 19 nt, Homo sapiens
acagugcuuugucagaagc

SEQ ID NO: 11700 - RNA, 22 nt, Homo sapiens
uggcagauggugacaccauuag

SEQ ID NO: 11701 - RNA, 20 nt, Homo sapiens
auuccacuuguuugagguac

SEQ ID NO: 11702 - RNA, 22 nt, Homo sapiens
uuuugguuuuauccagggucuc

SEQ ID NO: 11703 - RNA, 22 nt, Homo sapiens
uguauaacucacauugaaguuu

SEQ ID NO: 11704 - RNA, 22 nt, Homo sapiens
auacccugucgugagucagaga

SEQ ID NO: 11705 - RNA, 22 nt, Homo sapiens
ugaauucuguccaaaauaacug

SEQ ID NO: 11706 - RNA, 22 nt, Homo sapiens
guacacauacauauaugugugu

SEQ ID NO: 11707 - RNA, 22 nt, Homo sapiens
ugagaucaaggugggcccuggg

SEQ ID NO: 11708 - RNA, 22 nt, Homo sapiens
guguagagaaauagccugaagg

SEQ ID NO: 11709 - RNA, 19 nt, Homo sapiens
aguggguguuuucuguuug

SEQ ID NO: 11710 - RNA, 22 nt, Homo sapiens
auauggucccuguucucaagga

SEQ ID NO: 11711 - RNA, 22 nt, Homo sapiens
ugucccguuuucgaggcugcag

SEQ ID NO: 11712 - RNA, 22 nt, Homo sapiens
aucagauuccagaggcagcacc

SEQ ID NO: 11713 - RNA, 22 nt, Homo sapiens
agcagugugaaaauggacuaau

SEQ ID NO: 11714 - RNA, 22 nt, Homo sapiens
ggcauguugauagguagaugua

SEQ ID NO: 11715 - RNA, 22 nt, Homo sapiens
gaaugauacuguuaacgaaaga

SEQ ID NO: 11716 - RNA, 22 nt, Homo sapiens
augaggaagucaggcccagggg

SEQ ID NO: 11717 - RNA, 22 nt, Homo sapiens
gucauugaaguggaaucaucca

SEQ ID NO: 11718 - RNA, 22 nt, Homo sapiens
ugacuugauccauggggcucca

SEQ ID NO: 11719 - RNA, 22 nt, Homo sapiens
cugugcauaucuuggacugugu

SEQ ID NO: 11720 - RNA, 22 nt, Homo sapiens
agaacuguccauucagcaugaa

SEQ ID NO: 11721 - RNA, 22 nt, Homo sapiens
gucuggcuuaucucacuuacca

SEQ ID NO: 11722 - RNA, 22 nt, Homo sapiens
agaggaguacuacuccaagucu

SEQ ID NO: 11723 - RNA, 22 nt, Homo sapiens
ucaccguguaucauuucauccg

SEQ ID NO: 11724 - RNA, 22 nt, Homo sapiens
ucuggaauguaaaguuuauggg

SEQ ID NO: 11725 - RNA, 22 nt, Homo sapiens
uuguguacuacaguaugccaca

SEQ ID NO: 11726 - RNA, 22 nt, Homo sapiens
gucaguggauacugucucuguc

SEQ ID NO: 11727 - RNA, 20 nt, Homo sapiens
ugccagugugucaauuuaua

SEQ ID NO: 11728 - RNA, 20 nt, Homo sapiens
aucacuggagaaggaaaccu

SEQ ID NO: 11729 - RNA, 22 nt, Homo sapiens
ucuuuguuuucugauccugaag

SEQ ID NO: 11730 - RNA, 22 nt, Homo sapiens
cagcaaaucauccuauuugagc

SEQ ID NO: 11731 - RNA, 19 nt, Homo sapiens
auagggcuagcauauacug

SEQ ID NO: 11732 - RNA, 22 nt, Homo sapiens
cagaaguauugguaugcucugu

SEQ ID NO: 11733 - RNA, 22 nt, Homo sapiens
ugcguaggcuagagugcagugg

SEQ ID NO: 11734 - RNA, 21 nt, Homo sapiens
gagaggauucgccagccucuu

SEQ ID NO: 11735 - RNA, 22 nt, Homo sapiens
cuagguucucaaaccagcguca

SEQ ID NO: 11736 - RNA, 22 nt, Homo sapiens
augacuauugcacuuuccuggu

SEQ ID NO: 11737 - RNA, 22 nt, Homo sapiens
uauggcauuuuguaagggcuug

SEQ ID NO: 11738 - RNA, 22 nt, Homo sapiens
uagcagaauaacuugccagccu

SEQ ID NO: 11739 - RNA, 22 nt, Homo sapiens
auccagaugggcuuaauguaau

SEQ ID NO: 11740 - RNA, 22 nt, Homo sapiens
uagucaaaucugaaggaaauuu

SEQ ID NO: 11741 - RNA, 22 nt, Homo sapiens
gugugcauggagggggcaguga

SEQ ID NO: 11742 - RNA, 22 nt, Homo sapiens
uccagugugcaggcaaguuuga

SEQ ID NO: 11743 - RNA, 22 nt, Homo sapiens
auccguugcaagggaagaauga

SEQ ID NO: 11744 - RNA, 22 nt, Homo sapiens
uugaggaggcagucuguccguu

SEQ ID NO: 11745 - RNA, 23 nt, Homo sapiens
acugagcaauguuuacauacuug

SEQ ID NO: 11746 - RNA, 22 nt, Homo sapiens
ugaaacacaccuccucuccauc

SEQ ID NO: 11747 - RNA, 22 nt, Homo sapiens
caugcacugaguccaccucugg

SEQ ID NO: 11748 - RNA, 15 nt, Homo sapiens
augguaguguucucu

SEQ ID NO: 11749 - RNA, 23 nt, Homo sapiens
ugaguaggugguuuuccccucac

SEQ ID NO: 11750 - RNA, 22 nt, Homo sapiens
uuuguaauaccugaggcugggu

SEQ ID NO: 11751 - RNA, 22 nt, Homo sapiens
cugcaauguuugaaauggcaaa

SEQ ID NO: 11752 - RNA, 21 nt, Homo sapiens
auugcacuccagccugggcga

SEQ ID NO: 11753 - RNA, 21 nt, Homo sapiens
ucaaggaguauacguaugcca

SEQ ID NO: 11754 - RNA, 22 nt, Homo sapiens
cugugcaaagcgcucucggggu

SEQ ID NO: 11755 - RNA, 22 nt, Homo sapiens
gggucauggaugugaagcuaga

SEQ ID NO: 11756 - RNA, 22 nt, Homo sapiens
cagguaagaugcuuucucuuau

SEQ ID NO: 11757 - RNA, 22 nt, Homo sapiens
auuaucacaguuuugcauaugg

SEQ ID NO: 11758 - RNA, 22 nt, Homo sapiens
uugcuagaugaaaaugguaccu

SEQ ID NO: 11759 - RNA, 22 nt, Homo sapiens
auggcuugugacccaugcuuca

SEQ ID NO: 11760 - RNA, 22 nt, Homo sapiens
aguguuuuuaacaagaaagggu

SEQ ID NO: 11761 - RNA, 22 nt, Homo sapiens
ucugagaugagacuuugaauuu

SEQ ID NO: 11762 - RNA, 22 nt, Homo sapiens
auugagcaauuccuaugugcuu

SEQ ID NO: 11763 - RNA, 22 nt, Homo sapiens
gagugcaauggcaccgucucgg

SEQ ID NO: 11764 - RNA, 22 nt, Homo sapiens
ugguaagaucagaacuggaguc

SEQ ID NO: 11765 - RNA, 22 nt, Homo sapiens
uaagugguguucauucuuuuga

SEQ ID NO: 11766 - RNA, 22 nt, Homo sapiens
gggauauguagauuuuuaucuu

SEQ ID NO: 11767 - RNA, 22 nt, Homo sapiens
uucagguaucccuugucuauag

SEQ ID NO: 11768 - RNA, 22 nt, Homo sapiens
gagcucauuaaaguaggaccua

SEQ ID NO: 11769 - RNA, 22 nt, Homo sapiens
caaucugucuuuuagggggcca

SEQ ID NO: 11770 - RNA, 20 nt, Homo sapiens
ugaauguaauuacagaugua

SEQ ID NO: 11771 - RNA, 22 nt, Homo sapiens
uuuuaugggcuauuugcauuag

SEQ ID NO: 11772 - RNA, 22 nt, Homo sapiens
aaagagaucuaugggcacuaug

SEQ ID NO: 11773 - RNA, 22 nt, Homo sapiens
aagugccauguggaugggcccu

SEQ ID NO: 11774 - RNA, 22 nt, Homo sapiens
ugguauguuuauaaguauagga

SEQ ID NO: 11775 - RNA, 22 nt, Homo sapiens
ucucaaguggucgcaguuagau

SEQ ID NO: 11776 - RNA, 20 nt, Homo sapiens
ugaguagaggaguucuauca

SEQ ID NO: 11777 - RNA, 23 nt, Homo sapiens
uggaacugaauuucuuagcauuu

SEQ ID NO: 11778 - RNA, 22 nt, Homo sapiens
ugugcucaucucagucaacugu

SEQ ID NO: 11779 - RNA, 22 nt, Homo sapiens
gcaguguuggggccggaggcug

SEQ ID NO: 11780 - RNA, 22 nt, Homo sapiens
ugccuaggcuggagugcagugg

SEQ ID NO: 11781 - RNA, 20 nt, Homo sapiens
ucagugauugguuuaguuau

SEQ ID NO: 11782 - RNA, 22 nt, Homo sapiens
uauuaagcuaguugucagugcu

SEQ ID NO: 11783 - RNA, 22 nt, Homo sapiens
caauggcaaugaaauagugaga

SEQ ID NO: 11784 - RNA, 22 nt, Homo sapiens
uucagcacaguguggaucauuc

SEQ ID NO: 11785 - RNA, 22 nt, Homo sapiens
uuacagucucaagagugcugca

SEQ ID NO: 11786 - RNA, 22 nt, Homo sapiens
uuagaguacaggggaaucaagg

SEQ ID NO: 11787 - RNA, 22 nt, Homo sapiens
gauggauuuuuuaggcagagcu

SEQ ID NO: 11788 - RNA, 20 nt, Homo sapiens
uauaacaguuuggacccagu

SEQ ID NO: 11789 - RNA, 22 nt, Homo sapiens
uugcacauggcuggggaggccu

SEQ ID NO: 11790 - RNA, 20 nt, Homo sapiens
uuggugaccuacagaugugg

SEQ ID NO: 11791 - RNA, 21 nt, Homo sapiens
cgauaacagcccuuucccaaa

SEQ ID NO: 11792 - RNA, 22 nt, Homo sapiens
ugagacugaguuuugcucuugu

SEQ ID NO: 11793 - RNA, 22 nt, Homo sapiens
uuauuagguugguggaaaagua

SEQ ID NO: 11794 - RNA, 22 nt, Homo sapiens
ugaggugaaguaauauucuaag

SEQ ID NO: 11795 - RNA, 22 nt, Homo sapiens
caguccuaugauaaccauuuac

SEQ ID NO: 11796 - RNA, 22 nt, Homo sapiens
gagaugaagugucaauaaggau

SEQ ID NO: 11797 - RNA, 22 nt, Homo sapiens
uccccgaggcuggagugcagug

SEQ ID NO: 11798 - RNA, 19 nt, Homo sapiens
augccuggagaugguuaua

SEQ ID NO: 11799 - RNA, 22 nt, Homo sapiens
gaccacauuccacacaggcuuu

SEQ ID NO: 11800 - RNA, 22 nt, Homo sapiens
uacugcacuccagccuggguga

SEQ ID NO: 11801 - RNA, 22 nt, Homo sapiens
gaauagugcugcaauaaacaua

SEQ ID NO: 11802 - RNA, 22 nt, Homo sapiens
ugaguucuuccuaucucugccu

SEQ ID NO: 11803 - RNA, 21 nt, Homo sapiens
uguauacauauguuaggugca

SEQ ID NO: 11804 - RNA, 22 nt, Homo sapiens
ugacuaguuugaggacauuaua

SEQ ID NO: 11805 - RNA, 22 nt, Homo sapiens
ugaauaguuugacagaacucuu

SEQ ID NO: 11806 - RNA, 22 nt, Homo sapiens
agauggugugcuaggaaaugua

SEQ ID NO: 11807 - RNA, 22 nt, Homo sapiens
uuuugcuccuggcaaacucaua

SEQ ID NO: 11808 - RNA, 20 nt, Homo sapiens
uuucaguacuuucuacuggc

SEQ ID NO: 11809 - RNA, 19 nt, Homo sapiens
uguccuagaggaguucaca

SEQ ID NO: 11810 - RNA, 22 nt, Homo sapiens
augagauauguuaaaaguuaaa

SEQ ID NO: 11811 - RNA, 20 nt, Homo sapiens
agacaguguggagauuccuu

SEQ ID NO: 11812 - RNA, 22 nt, Homo sapiens
auggaaugguugggucauaagg

SEQ ID NO: 11813 - RNA, 22 nt, Homo sapiens
ugagauagcauaagggacagaa

SEQ ID NO: 11814 - RNA, 23 nt, Homo sapiens
ugaauguuuauucucggugcaga

SEQ ID NO: 11815 - RNA, 22 nt, Homo sapiens
uaacuaguagauggcugacaua

SEQ ID NO: 11816 - RNA, 22 nt, Homo sapiens
uguccugcagagguguuugccu

SEQ ID NO: 11817 - RNA, 22 nt, Homo sapiens
uggacagaaacauguuuucagu

SEQ ID NO: 11818 - RNA, 22 nt, Homo sapiens
uaggucuuuuagcauaggagcu

SEQ ID NO: 11819 - RNA, 22 nt, Homo sapiens
gggagugucuaaccuguuaaca

SEQ ID NO: 11820 - RNA, 20 nt, Homo sapiens
augugcuaauauuaauaugu

SEQ ID NO: 11821 - RNA, 22 nt, Homo sapiens
guauuagguuggugcaaaauaa

SEQ ID NO: 11822 - RNA, 18 nt, Homo sapiens
ugugcaauauuaaccacc

SEQ ID NO: 11823 - RNA, 22 nt, Homo sapiens
cacaguugccuaucuccugaag

SEQ ID NO: 11824 - RNA, 19 nt, Homo sapiens
cugugcauuucuguggaag

SEQ ID NO: 11825 - RNA, 22 nt, Homo sapiens
uuugagaaugcuaccagagaag

SEQ ID NO: 11826 - RNA, 20 nt, Homo sapiens
ccccaguuuuucuauuagcu

SEQ ID NO: 11827 - RNA, 22 nt, Homo sapiens
gaaguaggugcuguuauuaucu

SEQ ID NO: 11828 - RNA, 22 nt, Homo sapiens
auugagcaaggucuccuaguau

SEQ ID NO: 11829 - RNA, 22 nt, Homo sapiens
augaauacugcugcaaugaaca

SEQ ID NO: 11830 - RNA, 22 nt, Homo sapiens
ugucauucaggaaauucuaagu

SEQ ID NO: 11831 - RNA, 22 nt, Homo sapiens
uccagguuuugugaguuuaaau

SEQ ID NO: 11832 - RNA, 22 nt, Homo sapiens
auacaguguauguauaguacau

SEQ ID NO: 11833 - RNA, 22 nt, Homo sapiens
augguacuggguaaaagugggg

SEQ ID NO: 11834 - RNA, 22 nt, Homo sapiens
auggcaguuucacucugggauu

SEQ ID NO: 11835 - RNA, 22 nt, Homo sapiens
uaaauugcauaaguacaaauga

SEQ ID NO: 11836 - RNA, 22 nt, Homo sapiens
guuguggagucuucuguucugg

SEQ ID NO: 11837 - RNA, 22 nt, Homo sapiens
uucaguagucuccauagaaccg

SEQ ID NO: 11838 - RNA, 22 nt, Homo sapiens
ucuggcuccaaagucuauuuuu

SEQ ID NO: 11839 - RNA, 20 nt, Homo sapiens
uggcucuuugcugcuaaagu

SEQ ID NO: 11840 - RNA, 22 nt, Homo sapiens
ugcauuguggaucuaaaugcau

SEQ ID NO: 11841 - RNA, 22 nt, Homo sapiens
ugagaucuuaucagaaauggug

SEQ ID NO: 11842 - RNA, 23 nt, Homo sapiens
aaagacuagucaggugcaguggu

SEQ ID NO: 11843 - RNA, 22 nt, Homo sapiens
ugaauacagcacacccaugggu

SEQ ID NO: 11844 - RNA, 22 nt, Homo sapiens
uaacagcucuacagcugcucuu

SEQ ID NO: 11845 - RNA, 21 nt, Homo sapiens
uugucuagagaaauauaucuc

SEQ ID NO: 11846 - RNA, 22 nt, Homo sapiens
gccaagaugcugcccacagaca

SEQ ID NO: 11847 - RNA, 22 nt, Homo sapiens
gcacaggguuacauucuaaggu

SEQ ID NO: 11848 - RNA, 22 nt, Homo sapiens
uguuacaguguaggccuugggu

SEQ ID NO: 11849 - RNA, 20 nt, Homo sapiens
uggaaggcaucugcauuauu

SEQ ID NO: 11850 - RNA, 23 nt, Homo sapiens
acugcaauuacguuugcaccaac

SEQ ID NO: 11851 - RNA, 19 nt, Homo sapiens
agcaucauuauuguuuugg

SEQ ID NO: 11852 - RNA, 22 nt, Homo sapiens
ucagcaaugcugcacucuacug

SEQ ID NO: 11853 - RNA, 22 nt, Homo sapiens
guaggcacuggcucagcuuauc

SEQ ID NO: 11854 - RNA, 20 nt, Homo sapiens
uuggcauuuagacaagaguu

SEQ ID NO: 11855 - RNA, 20 nt, Homo sapiens
cuuuguccuccugcugugcu

SEQ ID NO: 11856 - RNA, 22 nt, Homo sapiens
auugauagaucauaugguaggu

SEQ ID NO: 11857 - RNA, 22 nt, Homo sapiens
cagcacauagcaguugcucagu

SEQ ID NO: 11858 - RNA, 22 nt, Homo sapiens
augagcaucaccagaaucaaua

SEQ ID NO: 11859 - RNA, 18 nt, Homo sapiens
uuagaugguuuuaaaacu

SEQ ID NO: 11860 - RNA, 22 nt, Homo sapiens
ugagaacaugugauauuuggug

SEQ ID NO: 11861 - RNA, 22 nt, Homo sapiens
uggcaagcuuuaauugacucuu

SEQ ID NO: 11862 - RNA, 22 nt, Homo sapiens
ugagacugauaggacauuuucu

SEQ ID NO: 11863 - RNA, 21 nt, Homo sapiens
aggcaagauuacuuacgagca

SEQ ID NO: 11864 - RNA, 22 nt, Homo sapiens
uugugcaaaguugugguuucug

SEQ ID NO: 11865 - RNA, 22 nt, Homo sapiens
uuaagaugcauuuugaaguuaa

SEQ ID NO: 11866 - RNA, 23 nt, Homo sapiens
ucaguacuccacuuucaauagug

SEQ ID NO: 11867 - RNA, 22 nt, Homo sapiens
uagugcugagauugagaagccc

SEQ ID NO: 11868 - RNA, 22 nt, Homo sapiens
gcacaaugccugacgaguccug

SEQ ID NO: 11869 - RNA, 22 nt, Homo sapiens
augccacugcgcucuagccugg

SEQ ID NO: 11870 - RNA, 20 nt, Homo sapiens
gaaugguuucgggguucuug

SEQ ID NO: 11871 - RNA, 22 nt, Homo sapiens
uaauaguuucagaaguuguuuu

SEQ ID NO: 11872 - RNA, 22 nt, Homo sapiens
ggaaauguuuagcauccacuuu

SEQ ID NO: 11873 - RNA, 22 nt, Homo sapiens
agcuuguuuuccugcaacuaga

SEQ ID NO: 11874 - RNA, 20 nt, Homo sapiens
uaagugcauaggauauuucu

SEQ ID NO: 11875 - RNA, 22 nt, Homo sapiens
cugccugagaaaauggagggca

SEQ ID NO: 11876 - RNA, 22 nt, Homo sapiens
cacagucuugcaauauugagau

SEQ ID NO: 11877 - RNA, 21 nt, Homo sapiens
uuaaguaauuacccaacucuc

SEQ ID NO: 11878 - RNA, 19 nt, Homo sapiens
acuguacuccagucugggc

SEQ ID NO: 11879 - RNA, 22 nt, Homo sapiens
uagcagucucagaaugcauggu

SEQ ID NO: 11880 - RNA, 22 nt, Homo sapiens
uuccauguaguugaacgguuuu

SEQ ID NO: 11881 - RNA, 22 nt, Homo sapiens
ugccaacugguuucuuuuaguu

SEQ ID NO: 11882 - RNA, 22 nt, Homo sapiens
uagaucauauucagugcuuacu

SEQ ID NO: 11883 - RNA, 22 nt, Homo sapiens
ugucauguugguguacugcacc

SEQ ID NO: 11884 - RNA, 22 nt, Homo sapiens
uugagguauuuugucaacugua

SEQ ID NO: 11885 - RNA, 22 nt, Homo sapiens
gacuagagagccaaccgucagg

SEQ ID NO: 11886 - RNA, 18 nt, Homo sapiens
uaagaugcagccuauucc

SEQ ID NO: 11887 - RNA, 20 nt, Homo sapiens
uguggcacuguaucucucag

SEQ ID NO: 11888 - RNA, 22 nt, Homo sapiens
cugguaguguuuauaaggguau

SEQ ID NO: 11889 - RNA, 22 nt, Homo sapiens
uucauggaacaaguggguucaa

SEQ ID NO: 11890 - RNA, 22 nt, Homo sapiens
uugaaguguguauacauugugg

SEQ ID NO: 11891 - RNA, 22 nt, Homo sapiens
guaaucucagcuucuugggagg

SEQ ID NO: 11892 - RNA, 18 nt, Homo sapiens
uuaccagcauaccuacac

SEQ ID NO: 11893 - RNA, 22 nt, Homo sapiens
guggaagaccagacuuuccaac

SEQ ID NO: 11894 - RNA, 22 nt, Homo sapiens
uuuuugagguauaguguggcua

SEQ ID NO: 11895 - RNA, 22 nt, Homo sapiens
uguaaaaagcccagccgcugag

SEQ ID NO: 11896 - RNA, 20 nt, Homo sapiens
uacugcacuccaaccuaggc

SEQ ID NO: 11897 - RNA, 22 nt, Homo sapiens
ucucaauggguuguagacaaag

SEQ ID NO: 11898 - RNA, 23 nt, Homo sapiens
aguggucuccugggcccagcugu

SEQ ID NO: 11899 - RNA, 22 nt, Homo sapiens
agagauaauuagguuaaaugag

SEQ ID NO: 11900 - RNA, 20 nt, Homo sapiens
aucagguagggccccauuau

SEQ ID NO: 11901 - RNA, 22 nt, Homo sapiens
gugaggcuuuuccuguuagacu

SEQ ID NO: 11902 - RNA, 22 nt, Homo sapiens
uucaguagucaaaagauaaggg

SEQ ID NO: 11903 - RNA, 22 nt, Homo sapiens
gaaagugcugcaaggccaugca

SEQ ID NO: 11904 - RNA, 22 nt, Homo sapiens
augaccauuucaauugauaugg

SEQ ID NO: 11905 - RNA, 22 nt, Homo sapiens
gaggaguagggcacaaagccuu

SEQ ID NO: 11906 - RNA, 22 nt, Homo sapiens
caggcagucuggggguguaucc

SEQ ID NO: 11907 - RNA, 18 nt, Homo sapiens
acaucccaugcuggggug

SEQ ID NO: 11908 - RNA, 20 nt, Homo sapiens
ugugauuauuuaguugcaug

SEQ ID NO: 11909 - RNA, 22 nt, Homo sapiens
cugugguguaacucuuggggcg

SEQ ID NO: 11910 - RNA, 22 nt, Homo sapiens
gacauguuuuuuaagguuuaug

SEQ ID NO: 11911 - RNA, 22 nt, Homo sapiens
augacaagaguguucagggaga

SEQ ID NO: 11912 - RNA, 20 nt, Homo sapiens
uggcaugaaauuuuccaagc

SEQ ID NO: 11913 - RNA, 22 nt, Homo sapiens
acugaauguaaacacggagugu

SEQ ID NO: 11914 - RNA, 22 nt, Homo sapiens
uuauugaguaaaaagaaugguu

SEQ ID NO: 11915 - RNA, 22 nt, Homo sapiens
ugguccacuaacccucaguauc

SEQ ID NO: 11916 - RNA, 22 nt, Homo sapiens
guaccugggugacaggauuauu

SEQ ID NO: 11917 - RNA, 22 nt, Homo sapiens
gugagagaaugacuauguguuu

SEQ ID NO: 11918 - RNA, 21 nt, Homo sapiens
ucagugcugugggcaaggugc

SEQ ID NO: 11919 - RNA, 22 nt, Homo sapiens
agucaacaucaugaaguggaaa

SEQ ID NO: 11920 - RNA, 22 nt, Homo sapiens
acacaguaagcacaguguagau

SEQ ID NO: 11921 - RNA, 22 nt, Homo sapiens
gagcgcauugauguuggaugcu

SEQ ID NO: 11922 - RNA, 22 nt, Homo sapiens
uugggauggaacuuuucaguga

SEQ ID NO: 11923 - RNA, 19 nt, Homo sapiens
ugugaagaaaugcugcaag

SEQ ID NO: 11924 - RNA, 22 nt, Homo sapiens
agaugguguuggcugaguguau

SEQ ID NO: 11925 - RNA, 22 nt, Homo sapiens
ggcaguuuguucuugcuccuuu

SEQ ID NO: 11926 - RNA, 22 nt, Homo sapiens
guguauauccuauuaguucugu

SEQ ID NO: 11927 - RNA, 22 nt, Homo sapiens
gaaugcuaagcaugugggaauu

SEQ ID NO: 11928 - RNA, 22 nt, Homo sapiens
uaguaacacauugaacgaucgc

SEQ ID NO: 11929 - RNA, 19 nt, Homo sapiens
uggcacuugacguccggau

SEQ ID NO: 11930 - RNA, 21 nt, Homo sapiens
uuggcacucuucucuccuuau

SEQ ID NO: 11931 - RNA, 22 nt, Homo sapiens
gaggcacucuguacaaaucugc

SEQ ID NO: 11932 - RNA, 22 nt, Homo sapiens
uguagcaaaucgauacuauugg

SEQ ID NO: 11933 - RNA, 22 nt, Homo sapiens
gauguguuuuaggaucucagca

SEQ ID NO: 11934 - RNA, 22 nt, Homo sapiens
ugcagguacuugacaacuuggg

SEQ ID NO: 11935 - RNA, 22 nt, Homo sapiens
auauuguacugcuacugguucu

SEQ ID NO: 11936 - RNA, 16 nt, Homo sapiens
uggagucauccuugac

SEQ ID NO: 11937 - RNA, 22 nt, Homo sapiens
acuaugcuuuucuuagaauuaa

SEQ ID NO: 11938 - RNA, 22 nt, Homo sapiens
gucuggcuccugucuaaucacu

SEQ ID NO: 11939 - RNA, 22 nt, Homo sapiens
uugccuaggcuggaguguggug

SEQ ID NO: 11940 - RNA, 22 nt, Homo sapiens
gugaucauuguauugggguuau

SEQ ID NO: 11941 - RNA, 22 nt, Homo sapiens
aggugcuauauuucgaggauag

SEQ ID NO: 11942 - RNA, 22 nt, Homo sapiens
aggaccccucaucagcaccagu

SEQ ID NO: 11943 - RNA, 22 nt, Homo sapiens
aguggauuuuauuugacaacua

SEQ ID NO: 11944 - RNA, 22 nt, Homo sapiens
aucuuuggugaguucuuugguc

SEQ ID NO: 11945 - RNA, 22 nt, Homo sapiens
uuugcaucuuuugcuuccugga

SEQ ID NO: 11946 - RNA, 22 nt, Homo sapiens
uucacuguagccucagccucuu

SEQ ID NO: 11947 - RNA, 22 nt, Homo sapiens
gucuuggagacauugccauuga

SEQ ID NO: 11948 - RNA, 22 nt, Homo sapiens
ugcauauucaaggcaggccauu

SEQ ID NO: 11949 - RNA, 22 nt, Homo sapiens
uauuauuguccuucuauaccca

SEQ ID NO: 11950 - RNA, 22 nt, Homo sapiens
agugcaguggcauggucauaac

SEQ ID NO: 11951 - RNA, 22 nt, Homo sapiens
uucagguucauuugcugcuauu

SEQ ID NO: 11952 - RNA, 22 nt, Homo sapiens
ucuguacuccuugaguagugcu

SEQ ID NO: 11953 - RNA, 22 nt, Homo sapiens
uguccuagagggaugucacccc

SEQ ID NO: 11954 - RNA, 22 nt, Homo sapiens
ucccaagaugagaugggggcug

SEQ ID NO: 11955 - RNA, 22 nt, Homo sapiens
ugagauucucugauuguagguc

SEQ ID NO: 11956 - RNA, 22 nt, Homo sapiens
gcuuugcaauggcauugaccau

SEQ ID NO: 11957 - RNA, 22 nt, Homo sapiens
uuuuggcuuuuccucagcaagc

SEQ ID NO: 11958 - RNA, 22 nt, Homo sapiens
uagaauggaagguugagaagaa

SEQ ID NO: 11959 - RNA, 21 nt, Homo sapiens
guggaaauggaauuuacuaau

SEQ ID NO: 11960 - RNA, 22 nt, Homo sapiens
agccuguagugagcugugauug

SEQ ID NO: 11961 - RNA, 22 nt, Homo sapiens
ccaagccucaguuucccucugu

SEQ ID NO: 11962 - RNA, 22 nt, Homo sapiens
ugagcuauguucuucuuguuuu

SEQ ID NO: 11963 - RNA, 22 nt, Homo sapiens
agaugccucauguucuagguuc

SEQ ID NO: 11964 - RNA, 22 nt, Homo sapiens
ucucaugaagauagagaauaga

SEQ ID NO: 11965 - RNA, 22 nt, Homo sapiens
ugaauagugucacaauaaacau

SEQ ID NO: 11966 - RNA, 18 nt, Homo sapiens
gaguggugcuucccuugu

SEQ ID NO: 11967 - RNA, 22 nt, Homo sapiens
guugagcaagcuuuggagccua

SEQ ID NO: 11968 - RNA, 22 nt, Homo sapiens
ccagcaccauuuauuaaauagg

SEQ ID NO: 11969 - RNA, 22 nt, Homo sapiens
uauugacuugagaagggauuag

SEQ ID NO: 11970 - RNA, 22 nt, Homo sapiens
uacccucuggauacccuuguuc

SEQ ID NO: 11971 - RNA, 22 nt, Homo sapiens
guagcagcuacuaaguugcugu

SEQ ID NO: 11972 - RNA, 16 nt, Homo sapiens
ucuggcucuacaguuc

SEQ ID NO: 11973 - RNA, 23 nt, Homo sapiens
ggcauuguggcucacaucuguaa

SEQ ID NO: 11974 - RNA, 22 nt, Homo sapiens
cacuaccucuacaggcagcugg

SEQ ID NO: 11975 - RNA, 22 nt, Homo sapiens
guggacagagacuaaauguugu

SEQ ID NO: 11976 - RNA, 22 nt, Homo sapiens
aaauggcuuugaggguaggaca

SEQ ID NO: 11977 - RNA, 22 nt, Homo sapiens
guucacaguuucuaaucccagc

SEQ ID NO: 11978 - RNA, 22 nt, Homo sapiens
aagugcuguccuaccuuuggga

SEQ ID NO: 11979 - RNA, 22 nt, Homo sapiens
aaacugucuucugacaguuucc

SEQ ID NO: 11980 - RNA, 22 nt, Homo sapiens
uccaguguuccucagucacccc

SEQ ID NO: 11981 - RNA, 22 nt, Homo sapiens
auugcuaacugaaauaagacca

SEQ ID NO: 11982 - RNA, 19 nt, Homo sapiens
acugcacuccaaccuccug

SEQ ID NO: 11983 - RNA, 22 nt, Homo sapiens
cugaucuguagcagccaccaca

SEQ ID NO: 11984 - RNA, 22 nt, Homo sapiens
uugucaaacucauucuccaucc

SEQ ID NO: 11985 - RNA, 22 nt, Homo sapiens
caugccauugcucuccugggug

SEQ ID NO: 11986 - RNA, 22 nt, Homo sapiens
uaagcuaauguguuuucucuua

SEQ ID NO: 11987 - RNA, 22 nt, Homo sapiens
uacaguggugugaucucagcuc

SEQ ID NO: 11988 - RNA, 22 nt, Homo sapiens
uacgccuguaauaucagcauuu

SEQ ID NO: 11989 - RNA, 22 nt, Homo sapiens
uugacaaggagugggguugaga

SEQ ID NO: 11990 - RNA, 22 nt, Homo sapiens
aucauggaguauuugcaagucu

SEQ ID NO: 11991 - RNA, 22 nt, Homo sapiens
cuuaacagugguauugaugacc

SEQ ID NO: 11992 - RNA, 22 nt, Homo sapiens
gagaugcaccuugucacguuuc

SEQ ID NO: 11993 - RNA, 22 nt, Homo sapiens
acaguguacaauagccuuuuaa

SEQ ID NO: 11994 - RNA, 22 nt, Homo sapiens
gugacauuauuucagcuacaug

SEQ ID NO: 11995 - RNA, 22 nt, Homo sapiens
accccugagaucgaaucaugcu

SEQ ID NO: 11996 - RNA, 17 nt, Homo sapiens
auaaacucaucauuuuu

SEQ ID NO: 11997 - RNA, 22 nt, Homo sapiens
guacaguacugaaugaauguau

SEQ ID NO: 11998 - RNA, 22 nt, Homo sapiens
uaucagcgugcaaaucuuugga

SEQ ID NO: 11999 - RNA, 22 nt, Homo sapiens
guugggcccauagacugccagu

SEQ ID NO: 12000 - RNA, 22 nt, Homo sapiens
ugcugcacuuauggcucugagg

SEQ ID NO: 12001 - RNA, 23 nt, Homo sapiens
ugacuuguccagugauaguucgu

SEQ ID NO: 12002 - RNA, 22 nt, Homo sapiens
aguaccauuugacaugggaccc

SEQ ID NO: 12003 - RNA, 20 nt, Homo sapiens
agcuaguauuuccaugguua

SEQ ID NO: 12004 - RNA, 22 nt, Homo sapiens
gagagcauuaagccaucaucau

SEQ ID NO: 12005 - RNA, 22 nt, Homo sapiens
gugguaguagaauuucggaaau

SEQ ID NO: 12006 - RNA, 22 nt, Homo sapiens
cauugguuuuucaggaguauau

SEQ ID NO: 12007 - RNA, 22 nt, Homo sapiens
guggaaguuaagugacuuucug

SEQ ID NO: 12008 - RNA, 22 nt, Homo sapiens
uggaaaacaugcacauuggauu

SEQ ID NO: 12009 - RNA, 22 nt, Homo sapiens
ucucugacacugaccccaaaaa

SEQ ID NO: 12010 - RNA, 22 nt, Homo sapiens
ugggaugaugaaaaggcuuucu

SEQ ID NO: 12011 - RNA, 19 nt, Homo sapiens
gauaucuagggggagguuc

SEQ ID NO: 12012 - RNA, 22 nt, Homo sapiens
ggcaaguugcuauucuuuaaug

SEQ ID NO: 12013 - RNA, 22 nt, Homo sapiens
gauagugaaccaagggguaauu

SEQ ID NO: 12014 - RNA, 22 nt, Homo sapiens
caggaaugugaggguucccugc

SEQ ID NO: 12015 - RNA, 22 nt, Homo sapiens
cugugcaugcgcggagcugaaa

SEQ ID NO: 12016 - RNA, 22 nt, Homo sapiens
uuuugcacuagaaccagagguu

SEQ ID NO: 12017 - RNA, 22 nt, Homo sapiens
uucaggcuuuuauuuacugaua

SEQ ID NO: 12018 - RNA, 22 nt, Homo sapiens
gcaugauuuuauaucuauguaa

SEQ ID NO: 12019 - RNA, 22 nt, Homo sapiens
cacagucugggcuuguuuguac

SEQ ID NO: 12020 - RNA, 22 nt, Homo sapiens
acuagaugauuauguuccauug

SEQ ID NO: 12021 - RNA, 22 nt, Homo sapiens
auugccuaugauugagguacua

SEQ ID NO: 12022 - RNA, 22 nt, Homo sapiens
gucaucaucaguccucugugca

SEQ ID NO: 12023 - RNA, 21 nt, Homo sapiens
ucuguguugaucucacuggga

SEQ ID NO: 12024 - RNA, 22 nt, Homo sapiens
uggguaggcccucauuggacag

SEQ ID NO: 12025 - RNA, 22 nt, Homo sapiens
ucauguacuuguagucccggcu

SEQ ID NO: 12026 - RNA, 22 nt, Homo sapiens
uuaaaguauaguuccucugguu

SEQ ID NO: 12027 - RNA, 22 nt, Homo sapiens
ggacuagaggugaaaagaagac

SEQ ID NO: 12028 - RNA, 22 nt, Homo sapiens
uugguaguaaucccucacaaaa

SEQ ID NO: 12029 - RNA, 21 nt, Homo sapiens
uaucacaguagaauaggaucu

SEQ ID NO: 12030 - RNA, 22 nt, Homo sapiens
uugccauggaguagaauugaag

SEQ ID NO: 12031 - RNA, 22 nt, Homo sapiens
augcauagugggaugcucugug

SEQ ID NO: 12032 - RNA, 22 nt, Homo sapiens
ucuuuguguucaggagccacgu

SEQ ID NO: 12033 - RNA, 22 nt, Homo sapiens
uuggcaagaaccuucuuccaag

SEQ ID NO: 12034 - RNA, 15 nt, Homo sapiens
uaaguaguuggcugu

SEQ ID NO: 12035 - RNA, 22 nt, Homo sapiens
ugugcaaaaguaauugcgguuu

SEQ ID NO: 12036 - RNA, 23 nt, Homo sapiens
ugagauuauaaucuuuuacuucu

SEQ ID NO: 12037 - RNA, 22 nt, Homo sapiens
guggcagaaaagagaagcaaug

SEQ ID NO: 12038 - RNA, 22 nt, Homo sapiens
ugagacuguuuuggggaacuuc

SEQ ID NO: 12039 - RNA, 22 nt, Homo sapiens
uaacauuguugauuauacuaag

SEQ ID NO: 12040 - RNA, 22 nt, Homo sapiens
ugcugguguggucuagccgcuu

SEQ ID NO: 12041 - RNA, 22 nt, Homo sapiens
aauuguacucccauaauucccu

SEQ ID NO: 12042 - RNA, 22 nt, Homo sapiens
gugcaaacuccaggucucuuca

SEQ ID NO: 12043 - RNA, 22 nt, Homo sapiens
uauggcuucuuuaaauugaggu

SEQ ID NO: 12044 - RNA, 22 nt, Homo sapiens
ugugaugcagggccugggccuc

SEQ ID NO: 12045 - RNA, 21 nt, Homo sapiens
augucauggaugacuaauuca

SEQ ID NO: 12046 - RNA, 22 nt, Homo sapiens
agugcaauggcgugaucuuggc

SEQ ID NO: 12047 - RNA, 22 nt, Homo sapiens
uuagcagccuucaagcuccaag

SEQ ID NO: 12048 - RNA, 22 nt, Homo sapiens
ucuuugaguuauugugcagacu

SEQ ID NO: 12049 - RNA, 19 nt, Homo sapiens
gcaucauuaguugcuuuuc

SEQ ID NO: 12050 - RNA, 22 nt, Homo sapiens
uuaugcaucuuccacacucauu

SEQ ID NO: 12051 - RNA, 22 nt, Homo sapiens
ucacugugguuugggaaagugc

SEQ ID NO: 12052 - RNA, 22 nt, Homo sapiens
gauaauucuagcagauacaggc

SEQ ID NO: 12053 - RNA, 22 nt, Homo sapiens
guacaugcauacaugcacaucu

SEQ ID NO: 12054 - RNA, 22 nt, Homo sapiens
ugagguaacaaacuaugaguua

SEQ ID NO: 12055 - RNA, 22 nt, Homo sapiens
cauggcacaucuuuucugacua

SEQ ID NO: 12056 - RNA, 20 nt, Homo sapiens
gcuaaggcacgggaauuacu

SEQ ID NO: 12057 - RNA, 21 nt, Homo sapiens
cuaggaccaguucuguaauuc

SEQ ID NO: 12058 - RNA, 22 nt, Homo sapiens
cugaggugggaggauuggcuug

SEQ ID NO: 12059 - RNA, 20 nt, Homo sapiens
gacuucagaagcuucagagu

SEQ ID NO: 12060 - RNA, 22 nt, Homo sapiens
gugugauuauuucaauugaugc

SEQ ID NO: 12061 - RNA, 22 nt, Homo sapiens
uggucauggggcagcugacacu

SEQ ID NO: 12062 - RNA, 22 nt, Homo sapiens
auugcacuccagccuugggcaa

SEQ ID NO: 12063 - RNA, 21 nt, Homo sapiens
augagguguacuguggugaaa

SEQ ID NO: 12064 - RNA, 22 nt, Homo sapiens
cugaaaagcaucugcauagcug

SEQ ID NO: 12065 - RNA, 22 nt, Homo sapiens
cuggauagagauugaugaugcu

SEQ ID NO: 12066 - RNA, 22 nt, Homo sapiens
aacaggguggugccugguccau

SEQ ID NO: 12067 - RNA, 22 nt, Homo sapiens
uauuggcucuguuucucugaag

SEQ ID NO: 12068 - RNA, 19 nt, Homo sapiens
uacccuaguauauacagaa

SEQ ID NO: 12069 - RNA, 22 nt, Homo sapiens
uauugcaauuggggaaacuggg

SEQ ID NO: 12070 - RNA, 22 nt, Homo sapiens
ggugucaguuggccccuacugg

SEQ ID NO: 12071 - RNA, 22 nt, Homo sapiens
guugcagcacacaggcugucag

SEQ ID NO: 12072 - RNA, 18 nt, Homo sapiens
cuggaaggcuacuacagu

SEQ ID NO: 12073 - RNA, 22 nt, Homo sapiens
agguacuugagauucugaacug

SEQ ID NO: 12074 - RNA, 22 nt, Homo sapiens
ugugcaaggcucucaaccugug

SEQ ID NO: 12075 - RNA, 22 nt, Homo sapiens
uuguaacaguuuauugacucga

SEQ ID NO: 12076 - RNA, 22 nt, Homo sapiens
uucaugucuuggcuguuagagu

SEQ ID NO: 12077 - RNA, 22 nt, Homo sapiens
uguuuuggaggccagaagucca

SEQ ID NO: 12078 - RNA, 22 nt, Homo sapiens
gagauuauugucucccucacca

SEQ ID NO: 12079 - RNA, 22 nt, Homo sapiens
uaucacagcgggguguacaccc

SEQ ID NO: 12080 - RNA, 22 nt, Homo sapiens
guucacaguuaggacaacugcu

SEQ ID NO: 12081 - RNA, 22 nt, Homo sapiens
ugggucaguagcauguaugucu

SEQ ID NO: 12082 - RNA, 22 nt, Homo sapiens
gugauuauuaugcacugcaugc

SEQ ID NO: 12083 - RNA, 22 nt, Homo sapiens
aaugcacuccagccugggcgac

SEQ ID NO: 12084 - RNA, 22 nt, Homo sapiens
guauugacuaucaaucaugugc

SEQ ID NO: 12085 - RNA, 22 nt, Homo sapiens
uuuggcauuugaguuuguagga

SEQ ID NO: 12086 - RNA, 23 nt, Homo sapiens
uacuaguaagcguguucuuugca

SEQ ID NO: 12087 - RNA, 22 nt, Homo sapiens
uguuugcuguuuucuccaauga

SEQ ID NO: 12088 - RNA, 22 nt, Homo sapiens
gggaaugaagagaaccuuccca

SEQ ID NO: 12089 - RNA, 22 nt, Homo sapiens
cauggcacuggugggagugucu

SEQ ID NO: 12090 - RNA, 22 nt, Homo sapiens
ugagauggaguuucgcucuugu

SEQ ID NO: 12091 - RNA, 22 nt, Homo sapiens
ugagacggaguuuugcucuugu

SEQ ID NO: 12092 - RNA, 22 nt, Homo sapiens
gagacggagucucgcucuguca

SEQ ID NO: 12093 - RNA, 22 nt, Homo sapiens
ugucuguuugcgaaauugcuuc

SEQ ID NO: 12094 - RNA, 22 nt, Homo sapiens
guguucauggaauuugcaauug

SEQ ID NO: 12095 - RNA, 22 nt, Homo sapiens
ucccagugcuaugcaaaagccu

SEQ ID NO: 12096 - RNA, 22 nt, Homo sapiens
gugaguggacgugaccaauaaa

SEQ ID NO: 12097 - RNA, 22 nt, Homo sapiens
ucccuugguaauucuguuccuu

SEQ ID NO: 12098 - RNA, 22 nt, Homo sapiens
uucuuuggauaaaguuuuaugc

SEQ ID NO: 12099 - RNA, 19 nt, Homo sapiens
uccuugauugcaccacugc

SEQ ID NO: 12100 - RNA, 22 nt, Homo sapiens
uacaguauuaugagugauugaa

SEQ ID NO: 12101 - RNA, 22 nt, Homo sapiens
ugacucagauagguguguauuc

SEQ ID NO: 12102 - RNA, 22 nt, Homo sapiens
augagagugagagcagccccuu

SEQ ID NO: 12103 - RNA, 22 nt, Homo sapiens
uguaugagagacauggcugcuu

SEQ ID NO: 12104 - RNA, 22 nt, Homo sapiens
ggacugagaggacuacagugua

SEQ ID NO: 12105 - RNA, 22 nt, Homo sapiens
gauggugucccaggcucaggcu

SEQ ID NO: 12106 - RNA, 22 nt, Homo sapiens
uacagucuggaggccuguguug

SEQ ID NO: 12107 - RNA, 22 nt, Homo sapiens
uaugaucauuauguuauugcag

SEQ ID NO: 12108 - RNA, 22 nt, Homo sapiens
uuugagguguauggcaaguuga

SEQ ID NO: 12109 - RNA, 22 nt, Homo sapiens
gggcaugugugugcacacacau

SEQ ID NO: 12110 - RNA, 22 nt, Homo sapiens
aucacagguacuauggcugaca

SEQ ID NO: 12111 - RNA, 22 nt, Homo sapiens
gugaaagacagcauuaauggcu

SEQ ID NO: 12112 - RNA, 22 nt, Homo sapiens
uauugucaccaucccuguuuua

SEQ ID NO: 12113 - RNA, 22 nt, Homo sapiens
ugcauaugucuuuauagcagca

SEQ ID NO: 12114 - RNA, 22 nt, Homo sapiens
acauguaauugauuuuguguua

SEQ ID NO: 12115 - RNA, 22 nt, Homo sapiens
uuuaucaggccuuuggaaaaau

SEQ ID NO: 12116 - RNA, 18 nt, Homo sapiens
ucacugugugucuugggu

SEQ ID NO: 12117 - RNA, 21 nt, Homo sapiens
agguaguuuuccuuuuggagu

SEQ ID NO: 12118 - RNA, 22 nt, Homo sapiens
ggacuagaacugagaaucauau

SEQ ID NO: 12119 - RNA, 22 nt, Homo sapiens
gcauggccuuuaaaugucacag

SEQ ID NO: 12120 - RNA, 22 nt, Homo sapiens
auugcuuaagucccuguauuag

SEQ ID NO: 12121 - RNA, 22 nt, Homo sapiens
uagugguauuagcgauacuacu

SEQ ID NO: 12122 - RNA, 18 nt, Homo sapiens
ugggaagaaauucuucuc

SEQ ID NO: 12123 - RNA, 18 nt, Homo sapiens
augaacucaucaguucuu

SEQ ID NO: 12124 - RNA, 22 nt, Homo sapiens
uggacuguaaauuggggacucu

SEQ ID NO: 12125 - RNA, 22 nt, Homo sapiens
uagcagacuauuuugugauaau

SEQ ID NO: 12126 - RNA, 22 nt, Homo sapiens
uugagauaucuuggccuuugca

SEQ ID NO: 12127 - RNA, 19 nt, Homo sapiens
ugauuguaagcuuggugag

SEQ ID NO: 12128 - RNA, 19 nt, Homo sapiens
ugcauaggguuacauacuc

SEQ ID NO: 12129 - RNA, 22 nt, Homo sapiens
ucuaaagcauccagauugcuuc

SEQ ID NO: 12130 - RNA, 22 nt, Homo sapiens
uacaagcacaggcagcaggcug

SEQ ID NO: 12131 - RNA, 22 nt, Homo sapiens
uuagcacuugggaguauuuauu

SEQ ID NO: 12132 - RNA, 22 nt, Homo sapiens
uuuguacucccuuuagauaaaa

SEQ ID NO: 12133 - RNA, 22 nt, Homo sapiens
cugagguacccacuucaucuca

SEQ ID NO: 12134 - RNA, 23 nt, Homo sapiens
agagugcaauggugccaucucgg

SEQ ID NO: 12135 - RNA, 22 nt, Homo sapiens
ugacaagugauuaaggcauauu

SEQ ID NO: 12136 - RNA, 20 nt, Homo sapiens
uuccuuaggcauuggaagaa

SEQ ID NO: 12137 - RNA, 22 nt, Homo sapiens
agauaugucugcuauuugcugu

SEQ ID NO: 12138 - RNA, 22 nt, Homo sapiens
cucaauuuggaauugucaguaa

SEQ ID NO: 12139 - RNA, 22 nt, Homo sapiens
uaccacaggcuggguaaucuau

SEQ ID NO: 12140 - RNA, 22 nt, Homo sapiens
auaagagcaggcuucuggccag

SEQ ID NO: 12141 - RNA, 22 nt, Homo sapiens
uguagucauuccuuuuugcuuu

SEQ ID NO: 12142 - RNA, 22 nt, Homo sapiens
gaguugagagaguuguuauuuc

SEQ ID NO: 12143 - RNA, 22 nt, Homo sapiens
auuaagugaaugaaguuguucc

SEQ ID NO: 12144 - RNA, 22 nt, Homo sapiens
uuugaguuugaggugcugauga

SEQ ID NO: 12145 - RNA, 22 nt, Homo sapiens
ggaugcauuuuugguugucaca

SEQ ID NO: 12146 - RNA, 22 nt, Homo sapiens
agugguguugccuguugaccua

SEQ ID NO: 12147 - RNA, 22 nt, Homo sapiens
ugagaugaggucucgcucuguc

SEQ ID NO: 12148 - RNA, 22 nt, Homo sapiens
gcuguugcuauuauuccgagaa

SEQ ID NO: 12149 - RNA, 22 nt, Homo sapiens
uaucagugaaucuuauuuugcc

SEQ ID NO: 12150 - RNA, 22 nt, Homo sapiens
auccauugcucaagagaaguca

SEQ ID NO: 12151 - RNA, 22 nt, Homo sapiens
acccugucaaaauggaccaauc

SEQ ID NO: 12152 - RNA, 22 nt, Homo sapiens
ugguugaucccaucacccaggu

SEQ ID NO: 12153 - RNA, 22 nt, Homo sapiens
gcaagacaugucuaagguuuaa

SEQ ID NO: 12154 - RNA, 22 nt, Homo sapiens
uuugucaauaacuaccaacagg

SEQ ID NO: 12155 - RNA, 22 nt, Homo sapiens
uccauagugagcagucaaugua

SEQ ID NO: 12156 - RNA, 22 nt, Homo sapiens
uauuucaguugcguuucccgag

SEQ ID NO: 12157 - RNA, 22 nt, Homo sapiens
gaaaacugcuucucuggguuuc

SEQ ID NO: 12158 - RNA, 22 nt, Homo sapiens
gauggaguugucgccugggcug

SEQ ID NO: 12159 - RNA, 21 nt, Homo sapiens
uuuagguagcuuuucugggag

SEQ ID NO: 12160 - RNA, 22 nt, Homo sapiens
auagcaucauuucuugaaaaga

SEQ ID NO: 12161 - RNA, 22 nt, Homo sapiens
gauauguaguaguugaaaaaga

SEQ ID NO: 12162 - RNA, 22 nt, Homo sapiens
uggagauguuuaaaauccacug

SEQ ID NO: 12163 - RNA, 22 nt, Homo sapiens
gaagguauauucuguuaaugcu

SEQ ID NO: 12164 - RNA, 22 nt, Homo sapiens
gauuagcacuucaguuacagua

SEQ ID NO: 12165 - RNA, 22 nt, Homo sapiens
gugacuacaggccacaguuugg

SEQ ID NO: 12166 - RNA, 22 nt, Homo sapiens
uccuuggugacauuucuugucu

SEQ ID NO: 12167 - RNA, 22 nt, Homo sapiens
uccuggcuccacuguuuauucc

SEQ ID NO: 12168 - RNA, 22 nt, Homo sapiens
ucgugcugugucaucuuguggc

SEQ ID NO: 12169 - RNA, 22 nt, Homo sapiens
uaagacacuuaaaauguuacau

SEQ ID NO: 12170 - RNA, 23 nt, Homo sapiens
ggaaauguuuaagggguugggag

SEQ ID NO: 12171 - RNA, 22 nt, Homo sapiens
aaagugcugagauuguaggcau

SEQ ID NO: 12172 - RNA, 21 nt, Homo sapiens
uacaagcuguagcacaugcca

SEQ ID NO: 12173 - RNA, 22 nt, Homo sapiens
ggcauguauucuuauuauuccu

SEQ ID NO: 12174 - RNA, 23 nt, Homo sapiens
ucuuguacuuugagugagcaugg

SEQ ID NO: 12175 - RNA, 22 nt, Homo sapiens
uugaaugaauggaaagaagggu

SEQ ID NO: 12176 - RNA, 22 nt, Homo sapiens
ugacauguauuagcucagugcu

SEQ ID NO: 12177 - RNA, 22 nt, Homo sapiens
ugggaccccuacucuuuccaca

SEQ ID NO: 12178 - RNA, 22 nt, Homo sapiens
augugcaaagcacuguucagca

SEQ ID NO: 12179 - RNA, 22 nt, Homo sapiens
gaagauucaaccaaaccagaac

SEQ ID NO: 12180 - RNA, 22 nt, Homo sapiens
uaagugaauuugacagguaaug

SEQ ID NO: 12181 - RNA, 22 nt, Homo sapiens
cacugcacuccagucccgucuc

SEQ ID NO: 12182 - RNA, 22 nt, Homo sapiens
auuggacagcauuucuagacuu

SEQ ID NO: 12183 - RNA, 21 nt, Homo sapiens
agaaaaucuuaugggaaacau

SEQ ID NO: 12184 - RNA, 22 nt, Homo sapiens
auugcacuccagccugggugac

SEQ ID NO: 12185 - RNA, 19 nt, Homo sapiens
uuugaauauaaugcagcua

SEQ ID NO: 12186 - RNA, 22 nt, Homo sapiens
ucaugucuuguuguauuuauuu

SEQ ID NO: 12187 - RNA, 22 nt, Homo sapiens
agcugguaugaaaaucucccca

SEQ ID NO: 12188 - RNA, 22 nt, Homo sapiens
auucaagggauuucaggaggcu

SEQ ID NO: 12189 - RNA, 22 nt, Homo sapiens
ugacuauaguaaucacuucaca

SEQ ID NO: 12190 - RNA, 23 nt, Homo sapiens
aucagguuguagaauguguuugc

SEQ ID NO: 12191 - RNA, 18 nt, Homo sapiens
ugcaccaguuuacacuuc

SEQ ID NO: 12192 - RNA, 22 nt, Homo sapiens
ucugacaaugaacaaucuauag

SEQ ID NO: 12193 - RNA, 22 nt, Homo sapiens
uauggguuuuugucuguuuacu

SEQ ID NO: 12194 - RNA, 22 nt, Homo sapiens
auaugucuauuauuagggcagg

SEQ ID NO: 12195 - RNA, 18 nt, Homo sapiens
uucagugaauucuuuuga

SEQ ID NO: 12196 - RNA, 22 nt, Homo sapiens
guaguagcacgagcucugucuc

SEQ ID NO: 12197 - RNA, 22 nt, Homo sapiens
augaggaaggagccuuugucug

SEQ ID NO: 12198 - RNA, 22 nt, Homo sapiens
ugccuaggcuggaaugcaaugg

SEQ ID NO: 12199 - RNA, 22 nt, Homo sapiens
aaugucacugugguccuccagu

SEQ ID NO: 12200 - RNA, 22 nt, Homo sapiens
auauuacuggccauaucgcagg

SEQ ID NO: 12201 - RNA, 22 nt, Homo sapiens
ccaaaguauuuucacugauauc

SEQ ID NO: 12202 - RNA, 22 nt, Homo sapiens
uucagaugcacacuguagucua

SEQ ID NO: 12203 - RNA, 22 nt, Homo sapiens
gcagagaaacaggucuaaggag

SEQ ID NO: 12204 - RNA, 22 nt, Homo sapiens
ucaaugcaugugacaaagagua

SEQ ID NO: 12205 - RNA, 22 nt, Homo sapiens
uuuagcaauggagggugacuuu

SEQ ID NO: 12206 - RNA, 22 nt, Homo sapiens
gcuuuguuaaaacacagccaca

SEQ ID NO: 12207 - RNA, 22 nt, Homo sapiens
gugagguaauuagcucccuuag

SEQ ID NO: 12208 - RNA, 22 nt, Homo sapiens
uucacaguguuucucacgguua

SEQ ID NO: 12209 - RNA, 22 nt, Homo sapiens
cauugcacucugcauuccaguc

SEQ ID NO: 12210 - RNA, 22 nt, Homo sapiens
gcuguugugaacuauacaucua

SEQ ID NO: 12211 - RNA, 22 nt, Homo sapiens
ucuugggugaguuugugaauaa

SEQ ID NO: 12212 - RNA, 22 nt, Homo sapiens
ugagcagagaucacggcauugu

SEQ ID NO: 12213 - RNA, 22 nt, Homo sapiens
auggcaaaaaaugcaauuacuu

SEQ ID NO: 12214 - RNA, 22 nt, Homo sapiens
uaccacccuuuuuccagaagcc

SEQ ID NO: 12215 - RNA, 18 nt, Homo sapiens
guugagcuuuuccuuuag

SEQ ID NO: 12216 - RNA, 22 nt, Homo sapiens
uagcaccuuagcauuucuagug

SEQ ID NO: 12217 - RNA, 22 nt, Homo sapiens
uugagauggaguuuugcucuug

SEQ ID NO: 12218 - RNA, 22 nt, Homo sapiens
ugugaugauuugauaaacguau

SEQ ID NO: 12219 - RNA, 22 nt, Homo sapiens
accuguauaacaagugggaaau

SEQ ID NO: 12220 - RNA, 22 nt, Homo sapiens
gugucaugggcauguccuuaac

SEQ ID NO: 12221 - RNA, 22 nt, Homo sapiens
gggauuauugugauuucauguu

SEQ ID NO: 12222 - RNA, 22 nt, Homo sapiens
uaaggaaggcugugugcuuuua

SEQ ID NO: 12223 - RNA, 22 nt, Homo sapiens
uugcacauugauuuuguaucuu

SEQ ID NO: 12224 - RNA, 21 nt, Homo sapiens
uggaaucuauagaggcaguag

SEQ ID NO: 12225 - RNA, 22 nt, Homo sapiens
ugugucuuuuaucacacaaugu

SEQ ID NO: 12226 - RNA, 22 nt, Homo sapiens
ugaauacuucaaaaaaauagcu

SEQ ID NO: 12227 - RNA, 22 nt, Homo sapiens
uggaaaguacugagguccaccu

SEQ ID NO: 12228 - RNA, 22 nt, Homo sapiens
ggaucacagccagcucccagaa

SEQ ID NO: 12229 - RNA, 19 nt, Homo sapiens
ggugcuugaauauuccucc

SEQ ID NO: 12230 - RNA, 22 nt, Homo sapiens
agagguuuaacuggcuuauggu

SEQ ID NO: 12231 - RNA, 22 nt, Homo sapiens
guggacggagguugcagugagc

SEQ ID NO: 12232 - RNA, 22 nt, Homo sapiens
ugucaugucaacuauggaauuu

SEQ ID NO: 12233 - RNA, 22 nt, Homo sapiens
guauacgugcaggucacagggg

SEQ ID NO: 12234 - RNA, 19 nt, Homo sapiens
aaguaguugugacagaugc

SEQ ID NO: 12235 - RNA, 22 nt, Homo sapiens
cacuggguuagaacaugcuccu

SEQ ID NO: 12236 - RNA, 22 nt, Homo sapiens
uuguaauguuaggguguccaug

SEQ ID NO: 12237 - RNA, 22 nt, Homo sapiens
uuccaguaauagcacagcauug

SEQ ID NO: 12238 - RNA, 22 nt, Homo sapiens
uucuaaguaagucuguggggaa

SEQ ID NO: 12239 - RNA, 22 nt, Homo sapiens
ugagaugcauauucuggcuccu

SEQ ID NO: 12240 - RNA, 22 nt, Homo sapiens
gagaacaguguuguauuuuuuc

SEQ ID NO: 12241 - RNA, 22 nt, Homo sapiens
gagguaguuaaugcauucacua

SEQ ID NO: 12242 - RNA, 20 nt, Homo sapiens
gccacaguuaagcuucugcc

SEQ ID NO: 12243 - RNA, 22 nt, Homo sapiens
augaccaaugggcagagcuaga

SEQ ID NO: 12244 - RNA, 22 nt, Homo sapiens
acccugucaaaacggaccaauc

SEQ ID NO: 12245 - RNA, 22 nt, Homo sapiens
ucuaauguaaccugcaaauauu

SEQ ID NO: 12246 - RNA, 22 nt, Homo sapiens
gugaucuuucaggcuugaccau

SEQ ID NO: 12247 - RNA, 22 nt, Homo sapiens
guguauguuucucccugucccu

SEQ ID NO: 12248 - RNA, 22 nt, Homo sapiens
ugcagaaucccuucagauccga

SEQ ID NO: 12249 - RNA, 22 nt, Homo sapiens
gucuaugagucccugaauuuaa

SEQ ID NO: 12250 - RNA, 22 nt, Homo sapiens
gacagacacaauugauccauga

SEQ ID NO: 12251 - RNA, 22 nt, Homo sapiens
gucacugagcagaaggaagcga

SEQ ID NO: 12252 - RNA, 21 nt, Homo sapiens
ugcaugguagucacaugauuc

SEQ ID NO: 12253 - RNA, 22 nt, Homo sapiens
aaagcuacaggaccugcucauu

SEQ ID NO: 12254 - RNA, 22 nt, Homo sapiens
uaucaaguuggaagagaaguaa

SEQ ID NO: 12255 - RNA, 22 nt, Homo sapiens
uaggcuuuucugggaugugggc

SEQ ID NO: 12256 - RNA, 22 nt, Homo sapiens
auugcacuccagccuggcaaua

SEQ ID NO: 12257 - RNA, 22 nt, Homo sapiens
uacccuguaaucugaaacauga

SEQ ID NO: 12258 - RNA, 22 nt, Homo sapiens
augaaacuggagcgccuggagg

SEQ ID NO: 12259 - RNA, 22 nt, Homo sapiens
gagaccauuuacugccuacuua

SEQ ID NO: 12260 - RNA, 22 nt, Homo sapiens
aucugguguuuuucucccucgu

SEQ ID NO: 12261 - RNA, 22 nt, Homo sapiens
accccugugacggguauuugag

SEQ ID NO: 12262 - RNA, 22 nt, Homo sapiens
agcaggucuuaacuugugaggu

SEQ ID NO: 12263 - RNA, 22 nt, Homo sapiens
acagugucugacacguaggaag

SEQ ID NO: 12264 - RNA, 22 nt, Homo sapiens
uguguuugauaaguccauaguu

SEQ ID NO: 12265 - RNA, 16 nt, Homo sapiens
ucagcgagggagccag

SEQ ID NO: 12266 - RNA, 22 nt, Homo sapiens
auugcuuacuaaucaucuucag

SEQ ID NO: 12267 - RNA, 22 nt, Homo sapiens
uugagauuuuccucaaauauuu

SEQ ID NO: 12268 - RNA, 23 nt, Homo sapiens
uuuuuguguuucauggaaauagg

SEQ ID NO: 12269 - RNA, 22 nt, Homo sapiens
ggcucaguugcaaaucaguuca

SEQ ID NO: 12270 - RNA, 22 nt, Homo sapiens
aaaugcuguuccaggaccuauc

SEQ ID NO: 12271 - RNA, 23 nt, Homo sapiens
uggguucccuaagcgcaugcugc

SEQ ID NO: 12272 - RNA, 21 nt, Homo sapiens
ggaaaguuaaggaaauacccc

SEQ ID NO: 12273 - RNA, 22 nt, Homo sapiens
auuggaguuguacgcacgcuca

SEQ ID NO: 12274 - RNA, 22 nt, Homo sapiens
caauggcacgaucucgucucac

SEQ ID NO: 12275 - RNA, 22 nt, Homo sapiens
gcugauguugaccuugaucacc

SEQ ID NO: 12276 - RNA, 22 nt, Homo sapiens
aguaacacaccugcauggugug

SEQ ID NO: 12277 - RNA, 22 nt, Homo sapiens
accuggacacuuugggcuccuc

SEQ ID NO: 12278 - RNA, 20 nt, Homo sapiens
auagcagcaugauuuauagu

SEQ ID NO: 12279 - RNA, 22 nt, Homo sapiens
cuugucuugcacacgguugcca

SEQ ID NO: 12280 - RNA, 22 nt, Homo sapiens
auuccacuuagugacucauuug

SEQ ID NO: 12281 - RNA, 22 nt, Homo sapiens
ugacaguguccuccuccugaga

SEQ ID NO: 12282 - RNA, 23 nt, Homo sapiens
uggaggacaagcauggauaguga

SEQ ID NO: 12283 - RNA, 22 nt, Homo sapiens
ucagguauuuuaucacaugaag

SEQ ID NO: 12284 - RNA, 22 nt, Homo sapiens
uugagcaaugaacgauucaggg

SEQ ID NO: 12285 - RNA, 20 nt, Homo sapiens
ugugagacugguuuugaacu

SEQ ID NO: 12286 - RNA, 21 nt, Homo sapiens
gcaaaguggcuaccuugcucc

SEQ ID NO: 12287 - RNA, 22 nt, Homo sapiens
aaauucaucaaaugguuuguau

SEQ ID NO: 12288 - RNA, 22 nt, Homo sapiens
guaaaugcagaugcaugaccuu

SEQ ID NO: 12289 - RNA, 22 nt, Homo sapiens
auugcaugucauguuuagugua

SEQ ID NO: 12290 - RNA, 22 nt, Homo sapiens
augcuacuggacaauggugacu

SEQ ID NO: 12291 - RNA, 22 nt, Homo sapiens
uauaugucuucuuguaauuggc

SEQ ID NO: 12292 - RNA, 22 nt, Homo sapiens
ggaaguauaaacuuaguggagu

SEQ ID NO: 12293 - RNA, 22 nt, Homo sapiens
gacuggauagauaaaguuaguu

SEQ ID NO: 12294 - RNA, 22 nt, Homo sapiens
auucaagucaucucuccgcauu

SEQ ID NO: 12295 - RNA, 23 nt, Homo sapiens
uaugucuauucuaaugccagcac

SEQ ID NO: 12296 - RNA, 21 nt, Homo sapiens
uagaugguguucuagagagaa

SEQ ID NO: 12297 - RNA, 22 nt, Homo sapiens
uaggaaguacaucucagaaucu

SEQ ID NO: 12298 - RNA, 22 nt, Homo sapiens
auacacuagggcuccugcagaa

SEQ ID NO: 12299 - RNA, 22 nt, Homo sapiens
gccauugcacuacagccuaggc

SEQ ID NO: 12300 - RNA, 22 nt, Homo sapiens
uucccugaguaucuuaccaugg

SEQ ID NO: 12301 - RNA, 22 nt, Homo sapiens
aacuggcacuacaucaagagcu

SEQ ID NO: 12302 - RNA, 22 nt, Homo sapiens
auaauguuugauugagcagaua

SEQ ID NO: 12303 - RNA, 22 nt, Homo sapiens
auuaagugcuugccagugcugg

SEQ ID NO: 12304 - RNA, 22 nt, Homo sapiens
guagcagaauaucagauaauuu

SEQ ID NO: 12305 - RNA, 22 nt, Homo sapiens
agcuccaucuucagggguucag

SEQ ID NO: 12306 - RNA, 22 nt, Homo sapiens
auaucagugucuuacuguuuuu

SEQ ID NO: 12307 - RNA, 22 nt, Homo sapiens
cuacugauuaaaagaacagguc

SEQ ID NO: 12308 - RNA, 22 nt, Homo sapiens
gcagaucuucgcgguaaguguu

SEQ ID NO: 12309 - RNA, 22 nt, Homo sapiens
ugucccaguuggguauugaauu

SEQ ID NO: 12310 - RNA, 22 nt, Homo sapiens
ugacaagacuacauaucccauu

SEQ ID NO: 12311 - RNA, 22 nt, Homo sapiens
aguggauguuguggccugggag

SEQ ID NO: 12312 - RNA, 22 nt, Homo sapiens
uuugagcauguaguuuaacccu

SEQ ID NO: 12313 - RNA, 22 nt, Homo sapiens
uuugaaccauuugaagaaugau

SEQ ID NO: 12314 - RNA, 22 nt, Homo sapiens
uucuagagagaagacuuaagcu

SEQ ID NO: 12315 - RNA, 22 nt, Homo sapiens
aacugggcaagcauuacauggu

SEQ ID NO: 12316 - RNA, 22 nt, Homo sapiens
auagcagugucccacuccuugg

SEQ ID NO: 12317 - RNA, 19 nt, Homo sapiens
aaaugugcacuguuuucca

SEQ ID NO: 12318 - RNA, 22 nt, Homo sapiens
uugguuauccugucgguaauuc

SEQ ID NO: 12319 - RNA, 17 nt, Homo sapiens
ugcaccauuugauuuuu

SEQ ID NO: 12320 - RNA, 22 nt, Homo sapiens
ggaagaauauuaggggauuucg

SEQ ID NO: 12321 - RNA, 22 nt, Homo sapiens
gccaguauuuuauugagaauuu

SEQ ID NO: 12322 - RNA, 22 nt, Homo sapiens
ucaccuguagcuaagaccuaau

SEQ ID NO: 12323 - RNA, 22 nt, Homo sapiens
ugcauuaguaaguaauuuuaau

SEQ ID NO: 12324 - RNA, 22 nt, Homo sapiens
uucacuggagcccaggaguugg

SEQ ID NO: 12325 - RNA, 22 nt, Homo sapiens
ugaaugcuaaaggaaaacagua

SEQ ID NO: 12326 - RNA, 23 nt, Homo sapiens
ugcagcuacauguggccaugugc

SEQ ID NO: 12327 - RNA, 18 nt, Homo sapiens
agguuauuucccaagacu

SEQ ID NO: 12328 - RNA, 22 nt, Homo sapiens
gacauguaaggcucucucuguu

SEQ ID NO: 12329 - RNA, 22 nt, Homo sapiens
auauggguauuaagaaucaaaa

SEQ ID NO: 12330 - RNA, 22 nt, Homo sapiens
cuggcaccauuuugaucaaagg

SEQ ID NO: 12331 - RNA, 22 nt, Homo sapiens
ggagauuauugaaucaugaggg

SEQ ID NO: 12332 - RNA, 19 nt, Homo sapiens
agcuguguugccugugaga

SEQ ID NO: 12333 - RNA, 22 nt, Homo sapiens
gugucacuguauaauauuuauu

SEQ ID NO: 12334 - RNA, 22 nt, Homo sapiens
uuacaguugugagccaccaugc

SEQ ID NO: 12335 - RNA, 22 nt, Homo sapiens
acagauugcugggccccagccc

SEQ ID NO: 12336 - RNA, 22 nt, Homo sapiens
ggugagguaguaagguacaaua

SEQ ID NO: 12337 - RNA, 22 nt, Homo sapiens
uugaggacugagacagaccaag

SEQ ID NO: 12338 - RNA, 22 nt, Homo sapiens
uuuggcuguuucuggacuaaga

SEQ ID NO: 12339 - RNA, 22 nt, Homo sapiens
gguggcaaaucugaguggcgcu

SEQ ID NO: 12340 - RNA, 22 nt, Homo sapiens
augugaugguuaauuuuaugug

SEQ ID NO: 12341 - RNA, 22 nt, Homo sapiens
ucuuuggugaauggucauccag

SEQ ID NO: 12342 - RNA, 22 nt, Homo sapiens
uuggaauauaaccuguuucuaa

SEQ ID NO: 12343 - RNA, 22 nt, Homo sapiens
cuuuuggugguucugaugcagg

SEQ ID NO: 12344 - RNA, 22 nt, Homo sapiens
uuuugggggugauucacacagu

SEQ ID NO: 12345 - RNA, 20 nt, Homo sapiens
uuggcagagucuuuagggua

SEQ ID NO: 12346 - RNA, 22 nt, Homo sapiens
uggauuguuucucuugguauga

SEQ ID NO: 12347 - RNA, 22 nt, Homo sapiens
uugagauggagucuugcucuug

SEQ ID NO: 12348 - RNA, 23 nt, Homo sapiens
ggacuguaagggauauaaagguu

SEQ ID NO: 12349 - RNA, 22 nt, Homo sapiens
aucucagcaacuaaagauccuu

SEQ ID NO: 12350 - RNA, 22 nt, Homo sapiens
guugaucuauguugcuggcagu

SEQ ID NO: 12351 - RNA, 22 nt, Homo sapiens
augccacagaaauaaccaaaau

SEQ ID NO: 12352 - RNA, 22 nt, Homo sapiens
uacuagaggcgggguuucgcca

SEQ ID NO: 12353 - RNA, 22 nt, Homo sapiens
uaugcacacguguccaugugca

SEQ ID NO: 12354 - RNA, 18 nt, Homo sapiens
gauaacaguggacuaugc

SEQ ID NO: 12355 - RNA, 17 nt, Homo sapiens
ucuggcuuucacaccug

SEQ ID NO: 12356 - RNA, 22 nt, Homo sapiens
aaagugcaguauuugggcagaa

SEQ ID NO: 12357 - RNA, 19 nt, Homo sapiens
aucaaacugcucuuugagg

SEQ ID NO: 12358 - RNA, 22 nt, Homo sapiens
gagauggagucuuuuucuguca

SEQ ID NO: 12359 - RNA, 22 nt, Homo sapiens
aggcuuauuaagauucccuuau

SEQ ID NO: 12360 - RNA, 22 nt, Homo sapiens
acuucauucucuggaucagaau

SEQ ID NO: 12361 - RNA, 22 nt, Homo sapiens
ucagagugguuguaccauuuga

SEQ ID NO: 12362 - RNA, 22 nt, Homo sapiens
auggauugucuccuugugccau

SEQ ID NO: 12363 - RNA, 22 nt, Homo sapiens
uguauguuuaaggccaguggaa

SEQ ID NO: 12364 - RNA, 18 nt, Homo sapiens
gccaacauguaaacaggu

SEQ ID NO: 12365 - RNA, 22 nt, Homo sapiens
cugagguaggugaucagugcuu

SEQ ID NO: 12366 - RNA, 19 nt, Homo sapiens
uaacacaguuguguuugag

SEQ ID NO: 12367 - RNA, 22 nt, Homo sapiens
auugcaaucuccgccuccgggg

SEQ ID NO: 12368 - RNA, 22 nt, Homo sapiens
aagagcauuauuuaguaauuuc

SEQ ID NO: 12369 - RNA, 22 nt, Homo sapiens
aaagugcaguacuucguauauu

SEQ ID NO: 12370 - RNA, 22 nt, Homo sapiens
guuauguguuuccuuaauugcu

SEQ ID NO: 12371 - RNA, 22 nt, Homo sapiens
uuuagguuacauauaauccaaa

SEQ ID NO: 12372 - RNA, 22 nt, Homo sapiens
ucuguuguuguuuuaagagaca

SEQ ID NO: 12373 - RNA, 22 nt, Homo sapiens
aaucgcuuuugguaggcaagga

SEQ ID NO: 12374 - RNA, 22 nt, Homo sapiens
gagaucauugugggccaagcug

SEQ ID NO: 12375 - RNA, 22 nt, Homo sapiens
uaaucucagcugagcugagauu

SEQ ID NO: 12376 - RNA, 20 nt, Homo sapiens
agagugcugucuguccugag

SEQ ID NO: 12377 - RNA, 22 nt, Homo sapiens
gcuguauugacuuuguaucaua

SEQ ID NO: 12378 - RNA, 22 nt, Homo sapiens
gugauuguuaaacugccucucu

SEQ ID NO: 12379 - RNA, 22 nt, Homo sapiens
auaugcuaauuuuuagucgagc

SEQ ID NO: 12380 - RNA, 22 nt, Homo sapiens
uggaaaguccaagccaaccggg

SEQ ID NO: 12381 - RNA, 22 nt, Homo sapiens
ucauagaucaaguaauaagaca

SEQ ID NO: 12382 - RNA, 22 nt, Homo sapiens
ugcaccacugcaccccagucug

SEQ ID NO: 12383 - RNA, 19 nt, Homo sapiens
ugagaacaugugguauuug

SEQ ID NO: 12384 - RNA, 22 nt, Homo sapiens
gggccagaugcauuuguuauuu

SEQ ID NO: 12385 - RNA, 22 nt, Homo sapiens
uaugacuuuggaaaaauuacuu

SEQ ID NO: 12386 - RNA, 22 nt, Homo sapiens
auugcccaggcuggagugcagu

SEQ ID NO: 12387 - RNA, 22 nt, Homo sapiens
ugccaguauuuuauugaggauu

SEQ ID NO: 12388 - RNA, 22 nt, Homo sapiens
aauggcucugauguuguuguga

SEQ ID NO: 12389 - RNA, 22 nt, Homo sapiens
uagauuauuccuuugaauggcc

SEQ ID NO: 12390 - RNA, 22 nt, Homo sapiens
uuacagcugggugugucuggua

SEQ ID NO: 12391 - RNA, 22 nt, Homo sapiens
guaaggaguaguguaacagugc

SEQ ID NO: 12392 - RNA, 22 nt, Homo sapiens
aacacuaucugccuuacaggga

SEQ ID NO: 12393 - RNA, 20 nt, Homo sapiens
aagugcuuccuuuuagaggg

SEQ ID NO: 12394 - RNA, 22 nt, Homo sapiens
gucagaugcagauuccaguucu

SEQ ID NO: 12395 - RNA, 22 nt, Homo sapiens
cugagagaggagcuaaaacugc

SEQ ID NO: 12396 - RNA, 22 nt, Homo sapiens
ucauuagucaccuagccagcuu

SEQ ID NO: 12397 - RNA, 22 nt, Homo sapiens
caacacuguuuauuggauagcc

SEQ ID NO: 12398 - RNA, 22 nt, Homo sapiens
augacugucagggcagucauug

SEQ ID NO: 12399 - RNA, 22 nt, Homo sapiens
gccccugagacuugccucgggc

SEQ ID NO: 12400 - RNA, 22 nt, Homo sapiens
agagguuuuggggcugagagcu

SEQ ID NO: 12401 - RNA, 22 nt, Homo sapiens
ggaaauguuggugucaugaguu

SEQ ID NO: 12402 - RNA, 22 nt, Homo sapiens
cuggacaaaucuggaaagaacc

SEQ ID NO: 12403 - RNA, 22 nt, Homo sapiens
cccugagaaaacuuuguccuua

SEQ ID NO: 12404 - RNA, 22 nt, Homo sapiens
uagauaauuagaggguuuuaag

SEQ ID NO: 12405 - RNA, 22 nt, Homo sapiens
ugacaugaagucucccucuguu

SEQ ID NO: 12406 - RNA, 17 nt, Homo sapiens
uugggcaagguagguga

SEQ ID NO: 12407 - RNA, 22 nt, Homo sapiens
uuagguaauauauugcugcuuu

SEQ ID NO: 12408 - RNA, 20 nt, Homo sapiens
ucacuggagcucauuugauu

SEQ ID NO: 12409 - RNA, 22 nt, Homo sapiens
uucauggauggaaaugauuuug

SEQ ID NO: 12410 - RNA, 22 nt, Homo sapiens
ugaggcaggagaacggcuugaa

SEQ ID NO: 12411 - RNA, 23 nt, Homo sapiens
uuucauggggauuuacucauucc

SEQ ID NO: 12412 - RNA, 22 nt, Homo sapiens
uguuugcuuaacguggagccag

SEQ ID NO: 12413 - RNA, 22 nt, Homo sapiens
gaugauguuggaaacuuggugc

SEQ ID NO: 12414 - RNA, 22 nt, Homo sapiens
gcagaauugacucuguuuuuuc

SEQ ID NO: 12415 - RNA, 22 nt, Homo sapiens
uuuugguuguuggguaagagua

SEQ ID NO: 12416 - RNA, 22 nt, Homo sapiens
gcaacugguuucaguuuuucag

SEQ ID NO: 12417 - RNA, 22 nt, Homo sapiens
guaaugcacucccaaagaucca

SEQ ID NO: 12418 - RNA, 22 nt, Homo sapiens
uggagguagggccuaggaaucu

SEQ ID NO: 12419 - RNA, 22 nt, Homo sapiens
agugaacaaagaagugcagaua

SEQ ID NO: 12420 - RNA, 19 nt, Homo sapiens
agugcaauugccuuugugc

SEQ ID NO: 12421 - RNA, 17 nt, Homo sapiens
uagcacagugccuggua

SEQ ID NO: 12422 - RNA, 22 nt, Homo sapiens
guacaugcaugcaugggugugc

SEQ ID NO: 12423 - RNA, 22 nt, Homo sapiens
ugacuauaaauaagcaagggcu

SEQ ID NO: 12424 - RNA, 22 nt, Homo sapiens
guuaugcagcaauugauaaucu

SEQ ID NO: 12425 - RNA, 22 nt, Homo sapiens
auaaauucauuuaagcuccuua

SEQ ID NO: 12426 - RNA, 22 nt, Homo sapiens
cacuuugguucaccugaguuuc

SEQ ID NO: 12427 - RNA, 20 nt, Homo sapiens
uggcauguugguaugcaccc

SEQ ID NO: 12428 - RNA, 22 nt, Homo sapiens
uaugcacuaggcacuguguuug

SEQ ID NO: 12429 - RNA, 22 nt, Homo sapiens
uuaauacugcuuaacuuuagga

SEQ ID NO: 12430 - RNA, 18 nt, Homo sapiens
guguauggauggaggcca

SEQ ID NO: 12431 - RNA, 22 nt, Homo sapiens
cuuuuugcaaauacaacucuga

SEQ ID NO: 12432 - RNA, 22 nt, Homo sapiens
cacugcacuccaguuucgguaa

SEQ ID NO: 12433 - RNA, 18 nt, Homo sapiens
ugucuuagagcuugaccc

SEQ ID NO: 12434 - RNA, 22 nt, Homo sapiens
uuggucuucuaauguaccuguu

SEQ ID NO: 12435 - RNA, 22 nt, Homo sapiens
uuacguaguuuuggagaucaua

SEQ ID NO: 12436 - RNA, 22 nt, Homo sapiens
gucacaggaaacuaauaugcgc

SEQ ID NO: 12437 - RNA, 22 nt, Homo sapiens
gugagaugguaucucauugugg

SEQ ID NO: 12438 - RNA, 22 nt, Homo sapiens
caugccacugcacgccauccug

SEQ ID NO: 12439 - RNA, 19 nt, Homo sapiens
gugagcaaugcauugcacu

SEQ ID NO: 12440 - RNA, 22 nt, Homo sapiens
guggaagauaguguguuaaugu

SEQ ID NO: 12441 - RNA, 22 nt, Homo sapiens
auacuagucaagaauguaugag

SEQ ID NO: 12442 - RNA, 22 nt, Homo sapiens
ucagguauuucuuuuagcugug

SEQ ID NO: 12443 - RNA, 20 nt, Homo sapiens
cauuccacuuuccugucagu

SEQ ID NO: 12444 - RNA, 22 nt, Homo sapiens
aaucucagcauuuugggcugag

SEQ ID NO: 12445 - RNA, 22 nt, Homo sapiens
uauagcuagucacugcuggauu

SEQ ID NO: 12446 - RNA, 22 nt, Homo sapiens
cuuugcguugaacaaagccaua

SEQ ID NO: 12447 - RNA, 22 nt, Homo sapiens
guugcucaggcugaagugcagu

SEQ ID NO: 12448 - RNA, 22 nt, Homo sapiens
uguggcacuguguccagagaaa

SEQ ID NO: 12449 - RNA, 22 nt, Homo sapiens
uguaguuugaaagcucccucug

SEQ ID NO: 12450 - RNA, 22 nt, Homo sapiens
uuaggcaaugcucucaaauuug

SEQ ID NO: 12451 - RNA, 22 nt, Homo sapiens
auuggauagucuuuaucuguug

SEQ ID NO: 12452 - RNA, 17 nt, Homo sapiens
ugcagcacacugauggg

SEQ ID NO: 12453 - RNA, 21 nt, Homo sapiens
auguaacugggaaugugagag

SEQ ID NO: 12454 - RNA, 22 nt, Homo sapiens
uugagguggugucuugcucugu

SEQ ID NO: 12455 - RNA, 20 nt, Homo sapiens
cucaccagguguaggcugag

SEQ ID NO: 12456 - RNA, 22 nt, Homo sapiens
guggguaaaucucuguucgagg

SEQ ID NO: 12457 - RNA, 22 nt, Homo sapiens
ucacuggacagaaauaaaggug

SEQ ID NO: 12458 - RNA, 22 nt, Homo sapiens
aucuggcuccuuuugacaaugc

SEQ ID NO: 12459 - RNA, 22 nt, Homo sapiens
uggaauaugagacgggguuguc

SEQ ID NO: 12460 - RNA, 22 nt, Homo sapiens
gugagcauauuaguauugcacu

SEQ ID NO: 12461 - RNA, 22 nt, Homo sapiens
accacguagaugagagaguuaa

SEQ ID NO: 12462 - RNA, 22 nt, Homo sapiens
aaagaguucagguagauuucaa

SEQ ID NO: 12463 - RNA, 22 nt, Homo sapiens
ugcgccauugcacuccagucuu

SEQ ID NO: 12464 - RNA, 22 nt, Homo sapiens
accacuguuucaagaagcuugu

SEQ ID NO: 12465 - RNA, 22 nt, Homo sapiens
uggaaguagauagauuguguca

SEQ ID NO: 12466 - RNA, 22 nt, Homo sapiens
ucaggcacucagcuuagagucu

SEQ ID NO: 12467 - RNA, 22 nt, Homo sapiens
ggcaacaaagacauuucaacau

SEQ ID NO: 12468 - RNA, 22 nt, Homo sapiens
guaacuggccuucaauuucuuc

SEQ ID NO: 12469 - RNA, 22 nt, Homo sapiens
gacacagugaagucucuacuug

SEQ ID NO: 12470 - RNA, 22 nt, Homo sapiens
ucauugcuuauuuguuggugga

SEQ ID NO: 12471 - RNA, 22 nt, Homo sapiens
gauuauagaaguaauggguuua

SEQ ID NO: 12472 - RNA, 22 nt, Homo sapiens
cagcuguuguuccagucuuuua

SEQ ID NO: 12473 - RNA, 22 nt, Homo sapiens
ugcauaugcagcauuuaugauu

SEQ ID NO: 12474 - RNA, 22 nt, Homo sapiens
uggcuagaccugcauaacagcu

SEQ ID NO: 12475 - RNA, 22 nt, Homo sapiens
ggcagcauugccuuugcaguga

SEQ ID NO: 12476 - RNA, 22 nt, Homo sapiens
uguugcacuccauccugggcga

SEQ ID NO: 12477 - RNA, 22 nt, Homo sapiens
ggauacauuuuuccuccucuuc

SEQ ID NO: 12478 - RNA, 22 nt, Homo sapiens
uuaguaguaguuugcauuuacc

SEQ ID NO: 12479 - RNA, 20 nt, Homo sapiens
auuguccuugauuacacaga

SEQ ID NO: 12480 - RNA, 22 nt, Homo sapiens
gaucacauuguuucauacauau

SEQ ID NO: 12481 - RNA, 22 nt, Homo sapiens
gccagauuguccaguuuuuuau

SEQ ID NO: 12482 - RNA, 22 nt, Homo sapiens
augcagagaaaucuaaaauaug

SEQ ID NO: 12483 - RNA, 22 nt, Homo sapiens
gcaagaaucugggaguaaaauu

SEQ ID NO: 12484 - RNA, 22 nt, Homo sapiens
guggcuuuauuuagaagcaggg

SEQ ID NO: 12485 - RNA, 20 nt, Homo sapiens
gcaguacuuuuaguucuaag

SEQ ID NO: 12486 - RNA, 22 nt, Homo sapiens
ugcagguaggcaguaucauuua

SEQ ID NO: 12487 - RNA, 18 nt, Homo sapiens
gacaguguggcgauuccu

SEQ ID NO: 12488 - RNA, 22 nt, Homo sapiens
ugguaagaaaaccauuauuagc

SEQ ID NO: 12489 - RNA, 21 nt, Homo sapiens
auuaaugcucugguuagaggc

SEQ ID NO: 12490 - RNA, 22 nt, Homo sapiens
uugguaaugggcugguauaacc

SEQ ID NO: 12491 - RNA, 23 nt, Homo sapiens
uauaugugucuaggagcuauggu

SEQ ID NO: 12492 - RNA, 22 nt, Homo sapiens
cuauggugauagaaaucagaau

SEQ ID NO: 12493 - RNA, 22 nt, Homo sapiens
aaggagcagagagcccuguuuc

SEQ ID NO: 12494 - RNA, 22 nt, Homo sapiens
uuugaauguaaugagcaggaag

SEQ ID NO: 12495 - RNA, 22 nt, Homo sapiens
gagcuaguguuuacuugccacu

SEQ ID NO: 12496 - RNA, 22 nt, Homo sapiens
uucuccugguggacccuaaacg

SEQ ID NO: 12497 - RNA, 22 nt, Homo sapiens
aacuacaucucuuugaggcagg

SEQ ID NO: 12498 - RNA, 22 nt, Homo sapiens
ggaaagacuauuguaaaggaug

SEQ ID NO: 12499 - RNA, 22 nt, Homo sapiens
uggacuguaagugccuugagua

SEQ ID NO: 12500 - RNA, 22 nt, Homo sapiens
auggaagacuccucuuugggua

SEQ ID NO: 12501 - RNA, 22 nt, Homo sapiens
ugcaguagugugaucuuggcuc

SEQ ID NO: 12502 - RNA, 16 nt, Homo sapiens
ugagaacaugugacau

SEQ ID NO: 12503 - RNA, 23 nt, Homo sapiens
guggccuuuggccaguccgaguc

SEQ ID NO: 12504 - RNA, 22 nt, Homo sapiens
uucaucaguugagcugguugcu

SEQ ID NO: 12505 - RNA, 19 nt, Homo sapiens
auacccacuagguuacuua

SEQ ID NO: 12506 - RNA, 22 nt, Homo sapiens
uuccacaggguugaacuaguuu

SEQ ID NO: 12507 - RNA, 22 nt, Homo sapiens
aaaggaccacauauaugguggc

SEQ ID NO: 12508 - RNA, 22 nt, Homo sapiens
uugccuaggcuggaguucagug

SEQ ID NO: 12509 - RNA, 22 nt, Homo sapiens
auagguauguaauacaaaugaa

SEQ ID NO: 12510 - RNA, 22 nt, Homo sapiens
uuccaguguuugacucaccuuu

SEQ ID NO: 12511 - RNA, 22 nt, Homo sapiens
ugaaacacacauugcccuuuau

SEQ ID NO: 12512 - RNA, 17 nt, Homo sapiens
gugaaaucaucauuuuu

SEQ ID NO: 12513 - RNA, 17 nt, Homo sapiens
uuucucagcccucuucu

SEQ ID NO: 12514 - RNA, 22 nt, Homo sapiens
uauuguccacuuugcacugugu

SEQ ID NO: 12515 - RNA, 22 nt, Homo sapiens
ugugaacagaauuagucaccua

SEQ ID NO: 12516 - RNA, 22 nt, Homo sapiens
uuguaaaguucucucccgaaaa

SEQ ID NO: 12517 - RNA, 22 nt, Homo sapiens
uggucuuuucaacaaaugguau

SEQ ID NO: 12518 - RNA, 22 nt, Homo sapiens
ugagaucaagguuaauauaauc

SEQ ID NO: 12519 - RNA, 22 nt, Homo sapiens
agugguuugaucacagcucacu

SEQ ID NO: 12520 - RNA, 22 nt, Homo sapiens
ucacauguguaugagcuuugau

SEQ ID NO: 12521 - RNA, 22 nt, Homo sapiens
uaaaguguuuguuauuaaaggu

SEQ ID NO: 12522 - RNA, 22 nt, Homo sapiens
uacagucacauuccugaccaua

SEQ ID NO: 12523 - RNA, 22 nt, Homo sapiens
aguaucaagccacacaugguca

SEQ ID NO: 12524 - RNA, 19 nt, Homo sapiens
gugcauaguuauuaaagag

SEQ ID NO: 12525 - RNA, 22 nt, Homo sapiens
uaaguggugcauuguuaaaugg

SEQ ID NO: 12526 - RNA, 22 nt, Homo sapiens
uaccaguaaugguucuagagga

SEQ ID NO: 12527 - RNA, 22 nt, Homo sapiens
augaucaucugaaagcuuuuac

SEQ ID NO: 12528 - RNA, 22 nt, Homo sapiens
ucuaaggcaccuagagucauca

SEQ ID NO: 12529 - RNA, 22 nt, Homo sapiens
gagugcaauggcaagaucuugg

SEQ ID NO: 12530 - RNA, 22 nt, Homo sapiens
aaaagugguguuguuucuaaau

SEQ ID NO: 12531 - RNA, 22 nt, Homo sapiens
gauuggccaaacuaaagaacug

SEQ ID NO: 12532 - RNA, 22 nt, Homo sapiens
ugaguuguugcauucuuggugu

SEQ ID NO: 12533 - RNA, 22 nt, Homo sapiens
augcuggugcuagaaacuggaa

SEQ ID NO: 12534 - RNA, 22 nt, Homo sapiens
uugaucaucagcuuugucaucu

SEQ ID NO: 12535 - RNA, 22 nt, Homo sapiens
cacuggucucauggcaugagag

SEQ ID NO: 12536 - RNA, 19 nt, Homo sapiens
ccauggcaaugaucugaug

SEQ ID NO: 12537 - RNA, 22 nt, Homo sapiens
aaaacgcauccucacaggucug

SEQ ID NO: 12538 - RNA, 22 nt, Homo sapiens
gaguucaaaucucagcucuguu

SEQ ID NO: 12539 - RNA, 22 nt, Homo sapiens
uaagguuacaaaggacuucaua

SEQ ID NO: 12540 - RNA, 22 nt, Homo sapiens
ugugucacugaggguuagugua

SEQ ID NO: 12541 - RNA, 21 nt, Homo sapiens
acugauguuugaaauucgcug

SEQ ID NO: 12542 - RNA, 22 nt, Homo sapiens
acccagaauucagucuuaggcc

SEQ ID NO: 12543 - RNA, 22 nt, Homo sapiens
uaucaucauuggcaggugagaa

SEQ ID NO: 12544 - RNA, 22 nt, Homo sapiens
uagugacauugcugggaaugcu

SEQ ID NO: 12545 - RNA, 20 nt, Homo sapiens
uagaugcauuuagauucauu

SEQ ID NO: 12546 - RNA, 22 nt, Homo sapiens
ugcaaucaucgcuguuggccac

SEQ ID NO: 12547 - RNA, 22 nt, Homo sapiens
uugcuagagaugagggaugugu

SEQ ID NO: 12548 - RNA, 22 nt, Homo sapiens
uuaggcaggauaguuacauauu

SEQ ID NO: 12549 - RNA, 22 nt, Homo sapiens
auugcaguuucaacuccagggc

SEQ ID NO: 12550 - RNA, 22 nt, Homo sapiens
uccuugaaacaggaagaauuca

SEQ ID NO: 12551 - RNA, 20 nt, Homo sapiens
augacuagaggacaugguaa

SEQ ID NO: 12552 - RNA, 23 nt, Homo sapiens
uggcuagacguccuuuccugaug

SEQ ID NO: 12553 - RNA, 22 nt, Homo sapiens
ucuuggguuuguccuucuccua

SEQ ID NO: 12554 - RNA, 22 nt, Homo sapiens
ugcaagauaggcaguuugcacu

SEQ ID NO: 12555 - RNA, 22 nt, Homo sapiens
gaaucacagauuaugaguaucu

SEQ ID NO: 12556 - RNA, 22 nt, Homo sapiens
uuugaauggaaguuuugugaaa

SEQ ID NO: 12557 - RNA, 22 nt, Homo sapiens
augauagguuuagguuuagaca

SEQ ID NO: 12558 - RNA, 22 nt, Homo sapiens
ucaaaguauucuucugagaacc

SEQ ID NO: 12559 - RNA, 22 nt, Homo sapiens
uggaagugaacaaccaaggcag

SEQ ID NO: 12560 - RNA, 21 nt, Homo sapiens
uugagaagaauuagcucuucc

SEQ ID NO: 12561 - RNA, 22 nt, Homo sapiens
cuguaauguaaugagacuacau

SEQ ID NO: 12562 - RNA, 21 nt, Homo sapiens
uugguccacaugucauaguua

SEQ ID NO: 12563 - RNA, 22 nt, Homo sapiens
ucaacagugggcacuguaaaug

SEQ ID NO: 12564 - RNA, 22 nt, Homo sapiens
auugucauuuucugagaaguaa

SEQ ID NO: 12565 - RNA, 22 nt, Homo sapiens
aggcaaguugcucaaaugcaaa

SEQ ID NO: 12566 - RNA, 22 nt, Homo sapiens
guuuuuggggucacuauuaccg

SEQ ID NO: 12567 - RNA, 22 nt, Homo sapiens
augagacuagaagagaauaaua

SEQ ID NO: 12568 - RNA, 22 nt, Homo sapiens
cugcaauggagaaagugagacu

SEQ ID NO: 12569 - RNA, 22 nt, Homo sapiens
ucucacauuucacagggauggg

SEQ ID NO: 12570 - RNA, 21 nt, Homo sapiens
augagauguuagacuuuagac

SEQ ID NO: 12571 - RNA, 22 nt, Homo sapiens
auacacguguauauguguaucu

SEQ ID NO: 12572 - RNA, 22 nt, Homo sapiens
augagauaaaccaucucuuaag

SEQ ID NO: 12573 - RNA, 21 nt, Homo sapiens
uuaaugcuaugcagaaaaucu

SEQ ID NO: 12574 - RNA, 22 nt, Homo sapiens
uaacuccauuuggacucaguau

SEQ ID NO: 12575 - RNA, 22 nt, Homo sapiens
ugaaagguuuaauucugugaga

SEQ ID NO: 12576 - RNA, 22 nt, Homo sapiens
cuugccuuugucuucaaaggcu

SEQ ID NO: 12577 - RNA, 22 nt, Homo sapiens
uagguagauuuaaagauuuucu

SEQ ID NO: 12578 - RNA, 22 nt, Homo sapiens
uggaagugucugugcccagcuc

SEQ ID NO: 12579 - RNA, 22 nt, Homo sapiens
auauucaagugaggauggcuaa

SEQ ID NO: 12580 - RNA, 22 nt, Homo sapiens
ggcagaucauuggccucaguuu

SEQ ID NO: 12581 - RNA, 22 nt, Homo sapiens
agcuccuuucugcaggcagguc

SEQ ID NO: 12582 - RNA, 22 nt, Homo sapiens
augagcucauaaagagugauuu

SEQ ID NO: 12583 - RNA, 22 nt, Homo sapiens
uuugugcuaacuuuaacucuua

SEQ ID NO: 12584 - RNA, 22 nt, Homo sapiens
cccagugugcugggugacagcu

SEQ ID NO: 12585 - RNA, 22 nt, Homo sapiens
auauugcuugaggccaggaggu

SEQ ID NO: 12586 - RNA, 22 nt, Homo sapiens
augacuggaacagcaauuuaca

SEQ ID NO: 12587 - RNA, 22 nt, Homo sapiens
uauuuguccccuccaaaaguca

SEQ ID NO: 12588 - RNA, 22 nt, Homo sapiens
uaucacuauucauccuagcucc

SEQ ID NO: 12589 - RNA, 22 nt, Homo sapiens
cuuguacuacuuaggaucugga

SEQ ID NO: 12590 - RNA, 22 nt, Homo sapiens
aauuggugaccaagggaaggac

SEQ ID NO: 12591 - RNA, 21 nt, Homo sapiens
uagauacuguauuaaaccuag

SEQ ID NO: 12592 - RNA, 22 nt, Homo sapiens
aauuaguaaccuaauuccaucu

SEQ ID NO: 12593 - RNA, 22 nt, Homo sapiens
auuagguauuuucuggacaggg

SEQ ID NO: 12594 - RNA, 22 nt, Homo sapiens
aacagaauccucuuuuccuggg

SEQ ID NO: 12595 - RNA, 22 nt, Homo sapiens
gauuccacuuucugucucuaug

SEQ ID NO: 12596 - RNA, 21 nt, Homo sapiens
aaugguguugccaacaaggug

SEQ ID NO: 12597 - RNA, 22 nt, Homo sapiens
ucccuagacuccugccuuucag

SEQ ID NO: 12598 - RNA, 22 nt, Homo sapiens
uccucauggagaaccucugcua

SEQ ID NO: 12599 - RNA, 22 nt, Homo sapiens
ugcaguacugucagacuucuua

SEQ ID NO: 12600 - RNA, 22 nt, Homo sapiens
uaacugucucaggccaugggcg

SEQ ID NO: 12601 - RNA, 22 nt, Homo sapiens
agcuguuguacacuuuaccuuu

SEQ ID NO: 12602 - RNA, 22 nt, Homo sapiens
guacccaguagauaguuuuuca

SEQ ID NO: 12603 - RNA, 20 nt, Homo sapiens
uugaggucaggaguuuggga

SEQ ID NO: 12604 - RNA, 22 nt, Homo sapiens
auauucacagguaucagagauu

SEQ ID NO: 12605 - RNA, 22 nt, Homo sapiens
uccugauacgguugcaguucuc

SEQ ID NO: 12606 - RNA, 22 nt, Homo sapiens
ggagguagucuuucccuuauca

SEQ ID NO: 12607 - RNA, 22 nt, Homo sapiens
uuugugauugcacacucaagau

SEQ ID NO: 12608 - RNA, 22 nt, Homo sapiens
uuaacagcacuacguggggauc

SEQ ID NO: 12609 - RNA, 22 nt, Homo sapiens
cucuuacaguguguggugaaag

SEQ ID NO: 12610 - RNA, 22 nt, Homo sapiens
cugauacugaaagcuguugguu

SEQ ID NO: 12611 - RNA, 22 nt, Homo sapiens
auguuauguucuucucuguaua

SEQ ID NO: 12612 - RNA, 22 nt, Homo sapiens
uauaacaaugcaagaauggccu

SEQ ID NO: 12613 - RNA, 22 nt, Homo sapiens
ggaacaccauuuuuccugccuu

SEQ ID NO: 12614 - RNA, 22 nt, Homo sapiens
agcccuuagauggcuccuucca

SEQ ID NO: 12615 - RNA, 22 nt, Homo sapiens
uugcauugacacaugaagcuca

SEQ ID NO: 12616 - RNA, 22 nt, Homo sapiens
uaggcaaaugcaagaguagaac

SEQ ID NO: 12617 - RNA, 22 nt, Homo sapiens
aucaccugagcaguauacacug

SEQ ID NO: 12618 - RNA, 22 nt, Homo sapiens
uggagguagacauugggaagag

SEQ ID NO: 12619 - RNA, 22 nt, Homo sapiens
uuuugugcauggcccaguggua

SEQ ID NO: 12620 - RNA, 22 nt, Homo sapiens
uugagggagcauuuguuuugag

SEQ ID NO: 12621 - RNA, 22 nt, Homo sapiens
gucuggcuccuucuacuacaug

SEQ ID NO: 12622 - RNA, 15 nt, Homo sapiens
ucuggcucugucacu

SEQ ID NO: 12623 - RNA, 22 nt, Homo sapiens
guagagguagauucuguuuuga

SEQ ID NO: 12624 - RNA, 22 nt, Homo sapiens
uggacauguacauauguguaug

SEQ ID NO: 12625 - RNA, 22 nt, Homo sapiens
uggaaugucuuuuccccaaagc

SEQ ID NO: 12626 - RNA, 22 nt, Homo sapiens
uaauccuagcacuuuggaagac

SEQ ID NO: 12627 - RNA, 23 nt, Homo sapiens
aauugcuuuugaggacuuaguug

SEQ ID NO: 12628 - RNA, 22 nt, Homo sapiens
uuguacuauuuuuaucagugau

SEQ ID NO: 12629 - RNA, 22 nt, Homo sapiens
uucaggcaccauugucauugau

SEQ ID NO: 12630 - RNA, 22 nt, Homo sapiens
acccgggaggcaggagucauag

SEQ ID NO: 12631 - RNA, 22 nt, Homo sapiens
augacauguauuuccaggauuu

SEQ ID NO: 12632 - RNA, 22 nt, Homo sapiens
uugaugauguuucugccuugcc

SEQ ID NO: 12633 - RNA, 22 nt, Homo sapiens
ggcauugugauccaccagccuu

SEQ ID NO: 12634 - RNA, 21 nt, Homo sapiens
ugucuuggagccagacgccag

SEQ ID NO: 12635 - RNA, 22 nt, Homo sapiens
auccacagugucaauguuguga

SEQ ID NO: 12636 - RNA, 22 nt, Homo sapiens
ugccaguguuuuguugaagauu

SEQ ID NO: 12637 - RNA, 20 nt, Homo sapiens
uuauagcuacaucuugacug

SEQ ID NO: 12638 - RNA, 22 nt, Homo sapiens
acauaaagaagcaggacauugu

SEQ ID NO: 12639 - RNA, 22 nt, Homo sapiens
uuggaauguacucuagccuaug

SEQ ID NO: 12640 - RNA, 22 nt, Homo sapiens
uaucauagucacuuccaguuug

SEQ ID NO: 12641 - RNA, 22 nt, Homo sapiens
auggagcaaaacagauuuggga

SEQ ID NO: 12642 - RNA, 22 nt, Homo sapiens
uacuuuguagagugugagaauu

SEQ ID NO: 12643 - RNA, 22 nt, Homo sapiens
uugaguccauucgaugcugauu

SEQ ID NO: 12644 - RNA, 22 nt, Homo sapiens
auggcguggagauauggucagc

SEQ ID NO: 12645 - RNA, 21 nt, Homo sapiens
ucacugagcaucaugguuuca

SEQ ID NO: 12646 - RNA, 19 nt, Homo sapiens
ggcucagucaacugacugu

SEQ ID NO: 12647 - RNA, 22 nt, Homo sapiens
ccuuggcacuuugccacagugc

SEQ ID NO: 12648 - RNA, 22 nt, Homo sapiens
gugcaaaucucugaguaucuuu

SEQ ID NO: 12649 - RNA, 22 nt, Homo sapiens
ugaugguguuaccaucuuuacu

SEQ ID NO: 12650 - RNA, 22 nt, Homo sapiens
cuuucacacuguuggugggaau

SEQ ID NO: 12651 - RNA, 22 nt, Homo sapiens
uuggccauggagcacuuuucua

SEQ ID NO: 12652 - RNA, 17 nt, Homo sapiens
ugugacccugggcuacc

SEQ ID NO: 12653 - RNA, 22 nt, Homo sapiens
cugugcuugagagaugacacag

SEQ ID NO: 12654 - RNA, 22 nt, Homo sapiens
cugucucagccucuccaguagc

SEQ ID NO: 12655 - RNA, 22 nt, Homo sapiens
gugauaucugagccugccccag

SEQ ID NO: 12656 - RNA, 22 nt, Homo sapiens
uuggcagcacgcaguccagagg

SEQ ID NO: 12657 - RNA, 22 nt, Homo sapiens
cgaguagcacaaugugugugau

SEQ ID NO: 12658 - RNA, 22 nt, Homo sapiens
uuccugaggccuccccagaagc

SEQ ID NO: 12659 - RNA, 20 nt, Homo sapiens
cagucaugaagaacugugag

SEQ ID NO: 12660 - RNA, 22 nt, Homo sapiens
ugaggguauagccagcccuuag

SEQ ID NO: 12661 - RNA, 22 nt, Homo sapiens
uuucauccggcuguguauuaug

SEQ ID NO: 12662 - RNA, 20 nt, Homo sapiens
ucuuuuuguggccccagagu

SEQ ID NO: 12663 - RNA, 22 nt, Homo sapiens
acauucagcuguuguuucaaug

SEQ ID NO: 12664 - RNA, 22 nt, Homo sapiens
gucuuugcuuuuaaccagaggu

SEQ ID NO: 12665 - RNA, 22 nt, Homo sapiens
uauagcacugcaauauuucccu

SEQ ID NO: 12666 - RNA, 22 nt, Homo sapiens
uucuacaugggucgucggugag

SEQ ID NO: 12667 - RNA, 22 nt, Homo sapiens
uuaaaugcacauacuugagaaa

SEQ ID NO: 12668 - RNA, 22 nt, Homo sapiens
aguuggcacugagcugugauug

SEQ ID NO: 12669 - RNA, 17 nt, Homo sapiens
ucccauguuucuucuac

SEQ ID NO: 12670 - RNA, 22 nt, Homo sapiens
auggcuuguuaugcauuaguac

SEQ ID NO: 12671 - RNA, 22 nt, Homo sapiens
aagagguuuaacugacucacag

SEQ ID NO: 12672 - RNA, 22 nt, Homo sapiens
auugcacuccauccugggcaau

SEQ ID NO: 12673 - RNA, 22 nt, Homo sapiens
gauauguguaucuauguacaug

SEQ ID NO: 12674 - RNA, 22 nt, Homo sapiens
uucauggaauauugaccauuuu

SEQ ID NO: 12675 - RNA, 17 nt, Homo sapiens
gguacguuuuguucugu

SEQ ID NO: 12676 - RNA, 22 nt, Homo sapiens
aagugagugacaaaaacugggc

SEQ ID NO: 12677 - RNA, 22 nt, Homo sapiens
ugccuacagaaggggcucagca

SEQ ID NO: 12678 - RNA, 22 nt, Homo sapiens
ugaggauaguguugaaggcagg

SEQ ID NO: 12679 - RNA, 22 nt, Homo sapiens
uucgcagcucaguucaacuagg

SEQ ID NO: 12680 - RNA, 22 nt, Homo sapiens
caggugcauuggcugacaccug

SEQ ID NO: 12681 - RNA, 22 nt, Homo sapiens
agucauuguugagaugguguca

SEQ ID NO: 12682 - RNA, 22 nt, Homo sapiens
uuuggauagugugguccuuuua

SEQ ID NO: 12683 - RNA, 22 nt, Homo sapiens
guuuaacugguacuucaagucu

SEQ ID NO: 12684 - RNA, 22 nt, Homo sapiens
ucagucauucaauuguugaaug

SEQ ID NO: 12685 - RNA, 22 nt, Homo sapiens
gagaucuauuccucacccuucu

SEQ ID NO: 12686 - RNA, 22 nt, Homo sapiens
ugaacacagccugccucugcca

SEQ ID NO: 12687 - RNA, 22 nt, Homo sapiens
guguaaguccugaguuuggaua

SEQ ID NO: 12688 - RNA, 22 nt, Homo sapiens
cuagcagacacuuccagagagu

SEQ ID NO: 12689 - RNA, 22 nt, Homo sapiens
cugacauggggauccaccuuag

SEQ ID NO: 12690 - RNA, 22 nt, Homo sapiens
aaugacuaagaugguacauuuu

SEQ ID NO: 12691 - RNA, 22 nt, Homo sapiens
uugcaugguggaacuuggagcu

SEQ ID NO: 12692 - RNA, 22 nt, Homo sapiens
uggaauguagcguugacacgag

SEQ ID NO: 12693 - RNA, 22 nt, Homo sapiens
ucuguacuuccguaccuaaagu

SEQ ID NO: 12694 - RNA, 22 nt, Homo sapiens
gauacuguauccuaaaagcuuu

SEQ ID NO: 12695 - RNA, 22 nt, Homo sapiens
uaaagcuauuauaguuauguuu

SEQ ID NO: 12696 - RNA, 22 nt, Homo sapiens
gagcuagugcuuaugcaccacu

SEQ ID NO: 12697 - RNA, 19 nt, Homo sapiens
acuaggccuacaaagcuau

SEQ ID NO: 12698 - RNA, 22 nt, Homo sapiens
ugagucaugcuggagucauggc

SEQ ID NO: 12699 - RNA, 22 nt, Homo sapiens
cagugguuuucucaguucagca

SEQ ID NO: 12700 - RNA, 22 nt, Homo sapiens
uggcacuggagauacauuaaua

SEQ ID NO: 12701 - RNA, 22 nt, Homo sapiens
cugagaucuuauuagaaaugca

SEQ ID NO: 12702 - RNA, 22 nt, Homo sapiens
uuaggcuaguuucuuaaacucu

SEQ ID NO: 12703 - RNA, 22 nt, Homo sapiens
uaagacuuuuugggaauauaga

SEQ ID NO: 12704 - RNA, 22 nt, Homo sapiens
acaauguauauuuuacuguagg

SEQ ID NO: 12705 - RNA, 22 nt, Homo sapiens
ggugaauuguaccccauaggau

SEQ ID NO: 12706 - RNA, 22 nt, Homo sapiens
uuacacaguaggucccuaguaa

SEQ ID NO: 12707 - RNA, 22 nt, Homo sapiens
ucaaggacucagagagggauua

SEQ ID NO: 12708 - RNA, 22 nt, Homo sapiens
cauugcacuccagcuugggcaa

SEQ ID NO: 12709 - RNA, 17 nt, Homo sapiens
uauguaguacuuauaaa

SEQ ID NO: 12710 - RNA, 22 nt, Homo sapiens
uugagacugagucucgcccugu

SEQ ID NO: 12711 - RNA, 22 nt, Homo sapiens
ugauaucucuugccuccaaaug

SEQ ID NO: 12712 - RNA, 22 nt, Homo sapiens
cacagggcuaacauuuuugccc

SEQ ID NO: 12713 - RNA, 22 nt, Homo sapiens
aguaaagcaucagcuagaugug

SEQ ID NO: 12714 - RNA, 22 nt, Homo sapiens
uccucugaacuccagacccaua

SEQ ID NO: 12715 - RNA, 22 nt, Homo sapiens
ugcauuguauuguugacucgcc

SEQ ID NO: 12716 - RNA, 22 nt, Homo sapiens
aauccuguagauucuaauuccu

SEQ ID NO: 12717 - RNA, 18 nt, Homo sapiens
uagcagacaucauugggg

SEQ ID NO: 12718 - RNA, 22 nt, Homo sapiens
ucaugggagcccccaucaugag

SEQ ID NO: 12719 - RNA, 22 nt, Homo sapiens
uuugcauauguugaaccagccu

SEQ ID NO: 12720 - RNA, 22 nt, Homo sapiens
cccugaagacuccaccgucaug

SEQ ID NO: 12721 - RNA, 22 nt, Homo sapiens
cuaaagucacgauuugugggua

SEQ ID NO: 12722 - RNA, 22 nt, Homo sapiens
uuauauguuucuguuuggaggc

SEQ ID NO: 12723 - RNA, 22 nt, Homo sapiens
acccagaguuccuugucuuuca

SEQ ID NO: 12724 - RNA, 21 nt, Homo sapiens
aucugugagaccuuggggguu

SEQ ID NO: 12725 - RNA, 22 nt, Homo sapiens
uacaauagugacaaaucagcau

SEQ ID NO: 12726 - RNA, 21 nt, Homo sapiens
ucaucaagcuguagacaugau

SEQ ID NO: 12727 - RNA, 22 nt, Homo sapiens
auaagaugaaggaagccauauc

SEQ ID NO: 12728 - RNA, 22 nt, Homo sapiens
uguaaugaucaaaucagaguaa

SEQ ID NO: 12729 - RNA, 22 nt, Homo sapiens
uaugaccuuggacaaguuacuu

SEQ ID NO: 12730 - RNA, 19 nt, Homo sapiens
cuguuguacuccaggcauu

SEQ ID NO: 12731 - RNA, 22 nt, Homo sapiens
auggcucuguuccaugugucuu

SEQ ID NO: 12732 - RNA, 22 nt, Homo sapiens
ugagacugagucucgcucuugu

SEQ ID NO: 12733 - RNA, 22 nt, Homo sapiens
aucagugaaagugaaaucuccg

SEQ ID NO: 12734 - RNA, 22 nt, Homo sapiens
ugagcacuguacuuuaucaggu

SEQ ID NO: 12735 - RNA, 22 nt, Homo sapiens
aaagagcugagaccugguggag

SEQ ID NO: 12736 - RNA, 22 nt, Homo sapiens
aauucuguauuguuuagggacu

SEQ ID NO: 12737 - RNA, 22 nt, Homo sapiens
gagcacugauuuauuuuugucu

SEQ ID NO: 12738 - RNA, 22 nt, Homo sapiens
gacucgagggcauaagagcuuu

SEQ ID NO: 12739 - RNA, 20 nt, Homo sapiens
uaagacaugguccacaugcc

SEQ ID NO: 12740 - RNA, 22 nt, Homo sapiens
guaucacacuuauugaccugca

SEQ ID NO: 12741 - RNA, 22 nt, Homo sapiens
gaggucaggacauuuuugcuuu

SEQ ID NO: 12742 - RNA, 22 nt, Homo sapiens
ggucaguguuaucaccgaagga

SEQ ID NO: 12743 - RNA, 22 nt, Homo sapiens
agcacgaaaccaaauucuguga

SEQ ID NO: 12744 - RNA, 22 nt, Homo sapiens
guguaaaucaaucuguugucuu

SEQ ID NO: 12745 - RNA, 22 nt, Homo sapiens
uuagcccagugggugcuucucu

SEQ ID NO: 12746 - RNA, 21 nt, Homo sapiens
acuuuguugggggcugaggca

SEQ ID NO: 12747 - RNA, 22 nt, Homo sapiens
guugcucaggcuggagugcagu

SEQ ID NO: 12748 - RNA, 22 nt, Homo sapiens
aagcacccagccucacgccugc

SEQ ID NO: 12749 - RNA, 22 nt, Homo sapiens
aggaucauugacuauuauaagg

SEQ ID NO: 12750 - RNA, 22 nt, Homo sapiens
uuaucagcagugcgaaaacaga

SEQ ID NO: 12751 - RNA, 22 nt, Homo sapiens
agcuaguggucauucaauccuu

SEQ ID NO: 12752 - RNA, 22 nt, Homo sapiens
acuccauuucauuuuagcucuu

SEQ ID NO: 12753 - RNA, 22 nt, Homo sapiens
ucguucuugucaguuuauaaag

SEQ ID NO: 12754 - RNA, 22 nt, Homo sapiens
uuucauagaucaugcuuuugga

SEQ ID NO: 12755 - RNA, 22 nt, Homo sapiens
uuguauguuguuugucagagaa

SEQ ID NO: 12756 - RNA, 22 nt, Homo sapiens
uaugccuuucucacuaagcuua

SEQ ID NO: 12757 - RNA, 22 nt, Homo sapiens
agcagugucauuuucuggugag

SEQ ID NO: 12758 - RNA, 22 nt, Homo sapiens
auaggagcacaaacuauuguga

SEQ ID NO: 12759 - RNA, 22 nt, Homo sapiens
aaugugcuucuggcugugguca

SEQ ID NO: 12760 - RNA, 22 nt, Homo sapiens
ggaaaguccuucuguaggcucc

SEQ ID NO: 12761 - RNA, 20 nt, Homo sapiens
ugguguuugaacagugaaug

SEQ ID NO: 12762 - RNA, 22 nt, Homo sapiens
uguaaaucuuucacaguugaug

SEQ ID NO: 12763 - RNA, 22 nt, Homo sapiens
cauugcaguggaguggggaaga

SEQ ID NO: 12764 - RNA, 22 nt, Homo sapiens
gcaaagaaugcagauuugccuc

SEQ ID NO: 12765 - RNA, 23 nt, Homo sapiens
uuaagcaacggcugcuuuucaga

SEQ ID NO: 12766 - RNA, 22 nt, Homo sapiens
uugugcuucaucaccuagcaga

SEQ ID NO: 12767 - RNA, 22 nt, Homo sapiens
uguuuugguugucccuggccag

SEQ ID NO: 12768 - RNA, 22 nt, Homo sapiens
aagcaucacauaauggaucaug

SEQ ID NO: 12769 - RNA, 22 nt, Homo sapiens
ucuuugguuagguuuaguugau

SEQ ID NO: 12770 - RNA, 22 nt, Homo sapiens
uuuaauacugcaucuuuacucu

SEQ ID NO: 12771 - RNA, 22 nt, Homo sapiens
agcuagugugauucuuuggggu

SEQ ID NO: 12772 - RNA, 22 nt, Homo sapiens
uuguucaggagguuggggaugc

SEQ ID NO: 12773 - RNA, 22 nt, Homo sapiens
ucuuaguuuagauuagcaauuc

SEQ ID NO: 12774 - RNA, 22 nt, Homo sapiens
uaggccuuuuucagauggguag

SEQ ID NO: 12775 - RNA, 22 nt, Homo sapiens
uggcucuuucuagacuuaauua

SEQ ID NO: 12776 - RNA, 22 nt, Homo sapiens
guggaaaaguaguugcgguuuu

SEQ ID NO: 12777 - RNA, 22 nt, Homo sapiens
uugaaaguaaacaucacaaaga

SEQ ID NO: 12778 - RNA, 22 nt, Homo sapiens
uaaguaguauaagguuuuuuga

SEQ ID NO: 12779 - RNA, 22 nt, Homo sapiens
auucaugggagcuacuuuaaaa

SEQ ID NO: 12780 - RNA, 21 nt, Homo sapiens
ugagugcugagugaggguuga

SEQ ID NO: 12781 - RNA, 22 nt, Homo sapiens
auggaagucucuguuaaguuuc

SEQ ID NO: 12782 - RNA, 22 nt, Homo sapiens
acuuugcuuagagggcauuaaa

SEQ ID NO: 12783 - RNA, 22 nt, Homo sapiens
gugucacuguugagaaguccac

SEQ ID NO: 12784 - RNA, 22 nt, Homo sapiens
ugccagagacguagggaauauu

SEQ ID NO: 12785 - RNA, 19 nt, Homo sapiens
uguugcacauaucaauaug

SEQ ID NO: 12786 - RNA, 22 nt, Homo sapiens
ucggcucagugcaagcucugcc

SEQ ID NO: 12787 - RNA, 22 nt, Homo sapiens
agcuucacaaugcagagggcag

SEQ ID NO: 12788 - RNA, 22 nt, Homo sapiens
gucauugagucagggaguaucu

SEQ ID NO: 12789 - RNA, 22 nt, Homo sapiens
guacauggaaugaaauucaaaa

SEQ ID NO: 12790 - RNA, 23 nt, Homo sapiens
uccccgggagcaccagcuuguug

SEQ ID NO: 12791 - RNA, 22 nt, Homo sapiens
acuguguguuugucuagcacag

SEQ ID NO: 12792 - RNA, 22 nt, Homo sapiens
gugaugguaguuuguauuucug

SEQ ID NO: 12793 - RNA, 17 nt, Homo sapiens
uauggcuauguuuagau

SEQ ID NO: 12794 - RNA, 22 nt, Homo sapiens
augauccagugaguuucaguuc

SEQ ID NO: 12795 - RNA, 22 nt, Homo sapiens
uauaugcaacauaguguaugug

SEQ ID NO: 12796 - RNA, 22 nt, Homo sapiens
aucaucaugcacuacagccugg

SEQ ID NO: 12797 - RNA, 22 nt, Homo sapiens
agacaucauuugauggugggag

SEQ ID NO: 12798 - RNA, 22 nt, Homo sapiens
cuaucugcacaggguggaaauu

SEQ ID NO: 12799 - RNA, 22 nt, Homo sapiens
uuccacuuuuuccuugugcucc

SEQ ID NO: 12800 - RNA, 22 nt, Homo sapiens
uggaauaucaugagaguuuguu

SEQ ID NO: 12801 - RNA, 22 nt, Homo sapiens
aauugcauaaaauucaacucug

SEQ ID NO: 12802 - RNA, 22 nt, Homo sapiens
uguguauaucacugcaugagug

SEQ ID NO: 12803 - RNA, 22 nt, Homo sapiens
ugcagcauugcacuccagccug

SEQ ID NO: 12804 - RNA, 22 nt, Homo sapiens
uacagugcuugguaucuaguaa

SEQ ID NO: 12805 - RNA, 22 nt, Homo sapiens
uauugcaauuggcagagugcua

SEQ ID NO: 12806 - RNA, 20 nt, Homo sapiens
uucuugaguuaacaaguuac

SEQ ID NO: 12807 - RNA, 22 nt, Homo sapiens
cuaggaaguauguguuauugcu

SEQ ID NO: 12808 - RNA, 22 nt, Homo sapiens
gauuagugacguugagcacugu

SEQ ID NO: 12809 - RNA, 22 nt, Homo sapiens
ccagugauggcugccucauuug

SEQ ID NO: 12810 - RNA, 22 nt, Homo sapiens
ugagacggaguuauuuauaaua

SEQ ID NO: 12811 - RNA, 22 nt, Homo sapiens
ggaaagaucagcuaaauguaag

SEQ ID NO: 12812 - RNA, 22 nt, Homo sapiens
cuuuagcaauugauuaugccau

SEQ ID NO: 12813 - RNA, 22 nt, Homo sapiens
ugagauggcugaauucagaaua

SEQ ID NO: 12814 - RNA, 22 nt, Homo sapiens
gucacaguguuuguucauccca

SEQ ID NO: 12815 - RNA, 22 nt, Homo sapiens
uaucauggggacugcagccuag

SEQ ID NO: 12816 - RNA, 22 nt, Homo sapiens
cuagccuggagugcaguggugc

SEQ ID NO: 12817 - RNA, 22 nt, Homo sapiens
uuugguuauuugaaacuagcau

SEQ ID NO: 12818 - RNA, 22 nt, Homo sapiens
uguucauggauccaguggcuuc

SEQ ID NO: 12819 - RNA, 22 nt, Homo sapiens
ugaguucaugcuuguaguucua

SEQ ID NO: 12820 - RNA, 22 nt, Homo sapiens
uggucccucugaaaauugggug

SEQ ID NO: 12821 - RNA, 23 nt, Homo sapiens
uuucaguaguuguauccuguugc

SEQ ID NO: 12822 - RNA, 22 nt, Homo sapiens
uaguuaguagacucugauuauu

SEQ ID NO: 12823 - RNA, 22 nt, Homo sapiens
uaaguauuaggccccaggcugg

SEQ ID NO: 12824 - RNA, 22 nt, Homo sapiens
ggaaugagaaauauuacacaau

SEQ ID NO: 12825 - RNA, 20 nt, Homo sapiens
uucacggaggccgcgccccc

SEQ ID NO: 12826 - RNA, 22 nt, Homo sapiens
auauguucucauucauaugugg

SEQ ID NO: 12827 - RNA, 22 nt, Homo sapiens
ugaggaauguguguuaaagaua

SEQ ID NO: 12828 - RNA, 22 nt, Homo sapiens
aaugugccuacuggagcuugca

SEQ ID NO: 12829 - RNA, 22 nt, Homo sapiens
uaagcucauuccagccaugucc

SEQ ID NO: 12830 - RNA, 22 nt, Homo sapiens
uuugugcuccuguugagaaucu

SEQ ID NO: 12831 - RNA, 22 nt, Homo sapiens
ucacuuuguauagcgacuggcu

SEQ ID NO: 12832 - RNA, 22 nt, Homo sapiens
uugagccaaggauugucuuucc

SEQ ID NO: 12833 - RNA, 22 nt, Homo sapiens
aagcuagugagacagugguacu

SEQ ID NO: 12834 - RNA, 22 nt, Homo sapiens
gccuuuggugacaggcaugugu

SEQ ID NO: 12835 - RNA, 20 nt, Homo sapiens
ggcaagacccaaagugugug

SEQ ID NO: 12836 - RNA, 22 nt, Homo sapiens
ucccuuuguccaacggauccac

SEQ ID NO: 12837 - RNA, 22 nt, Homo sapiens
ugaaugcauggggccaagaagg

SEQ ID NO: 12838 - RNA, 22 nt, Homo sapiens
uuacuagaacauuuagggaacu

SEQ ID NO: 12839 - RNA, 22 nt, Homo sapiens
ucaccuggagccuucacauucu

SEQ ID NO: 12840 - RNA, 22 nt, Homo sapiens
ugagcaagaucuuuauaauuag

SEQ ID NO: 12841 - RNA, 22 nt, Homo sapiens
guaucccuugcuaucugaaucu

SEQ ID NO: 12842 - RNA, 22 nt, Homo sapiens
auggcaguuucagcuauaguuu

SEQ ID NO: 12843 - RNA, 22 nt, Homo sapiens
cagcugguguuacaaaccagag

SEQ ID NO: 12844 - RNA, 22 nt, Homo sapiens
ugaauguaacuaaaccugugaa

SEQ ID NO: 12845 - RNA, 22 nt, Homo sapiens
uuucauaguuugcauagggcau

SEQ ID NO: 12846 - RNA, 22 nt, Homo sapiens
gacagguuuucuguuucugaaa

SEQ ID NO: 12847 - RNA, 21 nt, Homo sapiens
acuggaccccuuccauacacc

SEQ ID NO: 12848 - RNA, 22 nt, Homo sapiens
auacuguuucugaacuuugauu

SEQ ID NO: 12849 - RNA, 22 nt, Homo sapiens
uuaaucucaggaguuugggacc

SEQ ID NO: 12850 - RNA, 22 nt, Homo sapiens
ugugccacuccaaccuggguga

SEQ ID NO: 12851 - RNA, 22 nt, Homo sapiens
aaggcuguuguguaauaggauu

SEQ ID NO: 12852 - RNA, 22 nt, Homo sapiens
auguuugguagugaauauggua

SEQ ID NO: 12853 - RNA, 20 nt, Homo sapiens
uggcuucuuaauugcaggca

SEQ ID NO: 12854 - RNA, 16 nt, Homo sapiens
aauccauuggcccugc

SEQ ID NO: 12855 - RNA, 22 nt, Homo sapiens
uauggccuuuuuaaugauauug

SEQ ID NO: 12856 - RNA, 20 nt, Homo sapiens
ugccugacacucuuugcuuc

SEQ ID NO: 12857 - RNA, 22 nt, Homo sapiens
uugaaggaggugcucacucucg

SEQ ID NO: 12858 - RNA, 22 nt, Homo sapiens
aucacaauuguacguaggagcc

SEQ ID NO: 12859 - RNA, 22 nt, Homo sapiens
uacaaguauuuuuauuagugcc

SEQ ID NO: 12860 - RNA, 22 nt, Homo sapiens
ucuuugucuacauccuguuaaa

SEQ ID NO: 12861 - RNA, 23 nt, Homo sapiens
aauugcacauuccuugcuggcag

SEQ ID NO: 12862 - RNA, 22 nt, Homo sapiens
uguggcucuucuguucuccacu

SEQ ID NO: 12863 - RNA, 22 nt, Homo sapiens
cugcagguaggggcagcuuugg

SEQ ID NO: 12864 - RNA, 17 nt, Homo sapiens
augggguuguagcccca

SEQ ID NO: 12865 - RNA, 22 nt, Homo sapiens
guguggaacucaauacaacgca

SEQ ID NO: 12866 - RNA, 22 nt, Homo sapiens
auucacuguggguccuuuggau

SEQ ID NO: 12867 - RNA, 21 nt, Homo sapiens
uuccagugagccuagaugccu

SEQ ID NO: 12868 - RNA, 22 nt, Homo sapiens
agguaauagcacaugauaccuu

SEQ ID NO: 12869 - RNA, 22 nt, Homo sapiens
aggugcacucagaaaacagaua

SEQ ID NO: 12870 - RNA, 20 nt, Homo sapiens
uaggagcaaugagaguagaa

SEQ ID NO: 12871 - RNA, 23 nt, Homo sapiens
gaaauguaagugaugccccacag

SEQ ID NO: 12872 - RNA, 22 nt, Homo sapiens
uugcaugcacaguucucaauag

SEQ ID NO: 12873 - RNA, 22 nt, Homo sapiens
ugacuugagcuggagccugccu

SEQ ID NO: 12874 - RNA, 22 nt, Homo sapiens
auucagaggggcagcugucuug

SEQ ID NO: 12875 - RNA, 16 nt, Homo sapiens
gacuaauacaaaggaa

SEQ ID NO: 12876 - RNA, 22 nt, Homo sapiens
ugauuagaggaaugguagauua

SEQ ID NO: 12877 - RNA, 22 nt, Homo sapiens
cucuuugaggugagcugcccau

SEQ ID NO: 12878 - RNA, 22 nt, Homo sapiens
uucucauggaacaucuguacug

SEQ ID NO: 12879 - RNA, 22 nt, Homo sapiens
uuggcucugcgucucgcggacg

SEQ ID NO: 12880 - RNA, 22 nt, Homo sapiens
uucaguggguggaugaauauga

SEQ ID NO: 12881 - RNA, 22 nt, Homo sapiens
cuaacaacacagcagauuagaa

SEQ ID NO: 12882 - RNA, 22 nt, Homo sapiens
agauguuguucaucugauuguu

SEQ ID NO: 12883 - RNA, 22 nt, Homo sapiens
cauaaagauggaggaggccagg

SEQ ID NO: 12884 - RNA, 22 nt, Homo sapiens
uuugcaugcuccuuaugagaau

SEQ ID NO: 12885 - RNA, 22 nt, Homo sapiens
cccagcguucggcauggcugag

SEQ ID NO: 12886 - RNA, 22 nt, Homo sapiens
uuguccauggacagcaccacag

SEQ ID NO: 12887 - RNA, 22 nt, Homo sapiens
uguauguagugaccagggccag

SEQ ID NO: 12888 - RNA, 22 nt, Homo sapiens
ggucauagagcaagcaaacagc

SEQ ID NO: 12889 - RNA, 15 nt, Homo sapiens
uggugguguugagac

SEQ ID NO: 12890 - RNA, 22 nt, Homo sapiens
uuacuagaaacagggcuucgcc

SEQ ID NO: 12891 - RNA, 22 nt, Homo sapiens
ugaugcuaccuaaagcaaccau

SEQ ID NO: 12892 - RNA, 22 nt, Homo sapiens
ucgcagcucacuggagccucga

SEQ ID NO: 12893 - RNA, 22 nt, Homo sapiens
aggauuagagacuucucuaccu

SEQ ID NO: 12894 - RNA, 22 nt, Homo sapiens
auuacacuuucuauucaaugag

SEQ ID NO: 12895 - RNA, 22 nt, Homo sapiens
augugacugauguaaucagaca

SEQ ID NO: 12896 - RNA, 22 nt, Homo sapiens
uucccuguaucuucugccaugu

SEQ ID NO: 12897 - RNA, 22 nt, Homo sapiens
ucaaggcaguggccuuccuucu

SEQ ID NO: 12898 - RNA, 22 nt, Homo sapiens
gugagaugaggucucacucugu

SEQ ID NO: 12899 - RNA, 22 nt, Homo sapiens
gggcaaaacuguacugccaagg

SEQ ID NO: 12900 - RNA, 22 nt, Homo sapiens
aggcauguugcuucgggcuuug

SEQ ID NO: 12901 - RNA, 22 nt, Homo sapiens
uuuuaacagccaggggacggcc

SEQ ID NO: 12902 - RNA, 22 nt, Homo sapiens
uuauguccuuuaacuucaucac

SEQ ID NO: 12903 - RNA, 20 nt, Homo sapiens
uguaaucuaaguuuuaagcc

SEQ ID NO: 12904 - RNA, 22 nt, Homo sapiens
ugucugagacuguuuuacuuuc

SEQ ID NO: 12905 - RNA, 22 nt, Homo sapiens
agcaacauagugagacccccau

SEQ ID NO: 12906 - RNA, 22 nt, Homo sapiens
gucaaguguuuucaaggcuucc

SEQ ID NO: 12907 - RNA, 22 nt, Homo sapiens
uugaaguaggaaaggaggaggu

SEQ ID NO: 12908 - RNA, 22 nt, Homo sapiens
ucucagagccuaggguuuuuca

SEQ ID NO: 12909 - RNA, 22 nt, Homo sapiens
ucaacagugauggaaaguuaua

SEQ ID NO: 12910 - RNA, 22 nt, Homo sapiens
uucacugcacuccagccugggu

SEQ ID NO: 12911 - RNA, 22 nt, Homo sapiens
gagguagagaguuuugauucug

SEQ ID NO: 12912 - RNA, 19 nt, Homo sapiens
ggaaaugucuauuaagauc

SEQ ID NO: 12913 - RNA, 22 nt, Homo sapiens
uguauguuucuuaggccugaga

SEQ ID NO: 12914 - RNA, 19 nt, Homo sapiens
augagaacagacuccauuu

SEQ ID NO: 12915 - RNA, 22 nt, Homo sapiens
cauggcauuugcagaguugaaa

SEQ ID NO: 12916 - RNA, 20 nt, Homo sapiens
uacugcacuccauccugggu

SEQ ID NO: 12917 - RNA, 22 nt, Homo sapiens
cccacaguggccucauauccuu

SEQ ID NO: 12918 - RNA, 22 nt, Homo sapiens
uacccaguaacaaguauuuugg

SEQ ID NO: 12919 - RNA, 22 nt, Homo sapiens
aucagagccugugugcccugaa

SEQ ID NO: 12920 - RNA, 22 nt, Homo sapiens
acugcacuccagcuugggugac

SEQ ID NO: 12921 - RNA, 22 nt, Homo sapiens
cuucaaguuggaagggaccuaa

SEQ ID NO: 12922 - RNA, 22 nt, Homo sapiens
uagagguaggucuucgagucuc

SEQ ID NO: 12923 - RNA, 22 nt, Homo sapiens
aucauauccuagauauaacuuc

SEQ ID NO: 12924 - RNA, 22 nt, Homo sapiens
ugagaugaguugcuggcucuga

SEQ ID NO: 12925 - RNA, 22 nt, Homo sapiens
aagagccgcaagggugaagggu

SEQ ID NO: 12926 - RNA, 21 nt, Homo sapiens
ucuggcccccucaaaucucau

SEQ ID NO: 12927 - RNA, 22 nt, Homo sapiens
aauggcauuugccagggcaaag

SEQ ID NO: 12928 - RNA, 22 nt, Homo sapiens
agaccacuuuagagauuguuca

SEQ ID NO: 12929 - RNA, 22 nt, Homo sapiens
aaagggcuguuucuugacuugg

SEQ ID NO: 12930 - RNA, 17 nt, Homo sapiens
acagugucuaugaaaug

SEQ ID NO: 12931 - RNA, 22 nt, Homo sapiens
cuggaaagcaaguccauugcuc

SEQ ID NO: 12932 - RNA, 20 nt, Homo sapiens
uuaguucauuuagaagguuu

SEQ ID NO: 12933 - RNA, 22 nt, Homo sapiens
gugaaauauuuaacguccaggu

SEQ ID NO: 12934 - RNA, 22 nt, Homo sapiens
caguacaauguggaaaaggagu

SEQ ID NO: 12935 - RNA, 22 nt, Homo sapiens
ugagucagucucacucugcugc

SEQ ID NO: 12936 - RNA, 22 nt, Homo sapiens
ugucaugguguuaauuuuccug

SEQ ID NO: 12937 - RNA, 21 nt, Homo sapiens
cacugcacuugccuucugggu

SEQ ID NO: 12938 - RNA, 22 nt, Homo sapiens
cuacacaugcaggcucccugcc

SEQ ID NO: 12939 - RNA, 23 nt, Homo sapiens
uugcauugcccuccauaguacuc

SEQ ID NO: 12940 - RNA, 22 nt, Homo sapiens
uucaggcuccugugagaaucua

SEQ ID NO: 12941 - RNA, 22 nt, Homo sapiens
uaaguauuuuaauuccuggcau

SEQ ID NO: 12942 - RNA, 22 nt, Homo sapiens
aaguaaaucuuaugucagggag

SEQ ID NO: 12943 - RNA, 22 nt, Homo sapiens
uagcagguguuccacaaauauu

SEQ ID NO: 12944 - RNA, 22 nt, Homo sapiens
gagaacugagauaagugauauu

SEQ ID NO: 12945 - RNA, 22 nt, Homo sapiens
ugucaaugggaauuuguuuuag

SEQ ID NO: 12946 - RNA, 19 nt, Homo sapiens
auugauuaaguuugcuguc

SEQ ID NO: 12947 - RNA, 22 nt, Homo sapiens
uaguuauggaguaauuuuaagc

SEQ ID NO: 12948 - RNA, 22 nt, Homo sapiens
cuuggcauuguguugauagaag

SEQ ID NO: 12949 - RNA, 22 nt, Homo sapiens
aagggaaugcgcugccuguguu

SEQ ID NO: 12950 - RNA, 22 nt, Homo sapiens
ugguaccuuuuaaugacuaauu

SEQ ID NO: 12951 - RNA, 22 nt, Homo sapiens
aggcaaugugagaguuuauuca

SEQ ID NO: 12952 - RNA, 22 nt, Homo sapiens
gaauucugucgcuuacuagaug

SEQ ID NO: 12953 - RNA, 22 nt, Homo sapiens
auccauugcacuauggaaagug

SEQ ID NO: 12954 - RNA, 22 nt, Homo sapiens
ugccuaggcccaguccucagaa

SEQ ID NO: 12955 - RNA, 22 nt, Homo sapiens
ucaaauguucccuguacuggcc

SEQ ID NO: 12956 - RNA, 22 nt, Homo sapiens
uacuuagagacaugcagcacug

SEQ ID NO: 12957 - RNA, 22 nt, Homo sapiens
ucacugagcacaggagaugugc

SEQ ID NO: 12958 - RNA, 22 nt, Homo sapiens
aucaagguaggacuugaacccu

SEQ ID NO: 12959 - RNA, 22 nt, Homo sapiens
ugagaauauuuuccaugucuca

SEQ ID NO: 12960 - RNA, 22 nt, Homo sapiens
gcagguaguuucugacuuuuac

SEQ ID NO: 12961 - RNA, 18 nt, Homo sapiens
ucccugacucaaauucuu

SEQ ID NO: 12962 - RNA, 22 nt, Homo sapiens
auugagucauuucaaauccaag

SEQ ID NO: 12963 - RNA, 22 nt, Homo sapiens
cugagcaaaguucuauuuaugg

SEQ ID NO: 12964 - RNA, 22 nt, Homo sapiens
augaucacugugccuccuguga

SEQ ID NO: 12965 - RNA, 23 nt, Homo sapiens
agcaccuuuccuccacuaucugc

SEQ ID NO: 12966 - RNA, 21 nt, Homo sapiens
ugcgauccucaauccucuguu

SEQ ID NO: 12967 - RNA, 22 nt, Homo sapiens
uuugacuacugaugguguacgc

SEQ ID NO: 12968 - RNA, 22 nt, Homo sapiens
gugagucaaucugagggguuca

SEQ ID NO: 12969 - RNA, 22 nt, Homo sapiens
aauaugucugcuaauuguuucu

SEQ ID NO: 12970 - RNA, 22 nt, Homo sapiens
uuaguaguuugaguggggguua

SEQ ID NO: 12971 - RNA, 22 nt, Homo sapiens
uugagauggagucuugcucucu

SEQ ID NO: 12972 - RNA, 22 nt, Homo sapiens
uugagauggaguguugcucugu

SEQ ID NO: 12973 - RNA, 22 nt, Homo sapiens
uucacugugaacucauauucag

SEQ ID NO: 12974 - RNA, 19 nt, Homo sapiens
caugugcacuacuggcuuc

SEQ ID NO: 12975 - RNA, 22 nt, Homo sapiens
gggaagaaggagugguuuacuc

SEQ ID NO: 12976 - RNA, 22 nt, Homo sapiens
uguuugguggucucuucacaug

SEQ ID NO: 12977 - RNA, 22 nt, Homo sapiens
uugccuaggcuggauugcagug

SEQ ID NO: 12978 - RNA, 22 nt, Homo sapiens
uacaaagugggaaacgaagguu

SEQ ID NO: 12979 - RNA, 19 nt, Homo sapiens
ugugauaguugaaccugcc

SEQ ID NO: 12980 - RNA, 22 nt, Homo sapiens
uccaagaugcuggcagcuacag

SEQ ID NO: 12981 - RNA, 18 nt, Homo sapiens
ucucacagcaaucuguca

SEQ ID NO: 12982 - RNA, 19 nt, Homo sapiens
ucccugagucuuagcuuga

SEQ ID NO: 12983 - RNA, 22 nt, Homo sapiens
caaggcacagccccuacuuccu

SEQ ID NO: 12984 - RNA, 22 nt, Homo sapiens
gcuuguguucaaggaacaccua

SEQ ID NO: 12985 - RNA, 22 nt, Homo sapiens
ugagagacagacauuaucuuau

SEQ ID NO: 12986 - RNA, 22 nt, Homo sapiens
cauuaagcuacuuagaaggugc

SEQ ID NO: 12987 - RNA, 22 nt, Homo sapiens
ccucaguguuuaucauuauuuu

SEQ ID NO: 12988 - RNA, 22 nt, Homo sapiens
agcacagccuuguguuuucuug

SEQ ID NO: 12989 - RNA, 22 nt, Homo sapiens
uuggcgugaaacagccuuacau

SEQ ID NO: 12990 - RNA, 22 nt, Homo sapiens
uugagagaaaaaauuuauuggu

SEQ ID NO: 12991 - RNA, 22 nt, Homo sapiens
cucccagugacccaggaacagg

SEQ ID NO: 12992 - RNA, 22 nt, Homo sapiens
uccaaaucucuggcacugggau

SEQ ID NO: 12993 - RNA, 22 nt, Homo sapiens
ugguaucuaagaugcacguugu

SEQ ID NO: 12994 - RNA, 22 nt, Homo sapiens
uccugcauucauccugguguug

SEQ ID NO: 12995 - RNA, 22 nt, Homo sapiens
uucagcuaccugggaugcugaa

SEQ ID NO: 12996 - RNA, 22 nt, Homo sapiens
auguggcuuuccuagaucuuag

SEQ ID NO: 12997 - RNA, 22 nt, Homo sapiens
ugagcugguacuaauauuauca

SEQ ID NO: 12998 - RNA, 22 nt, Homo sapiens
uaugagaugaggccacugggua

SEQ ID NO: 12999 - RNA, 22 nt, Homo sapiens
cugauacucuccuuuuagagag

SEQ ID NO: 13000 - RNA, 22 nt, Homo sapiens
uuggcacugagcaagaacaggg

SEQ ID NO: 13001 - RNA, 22 nt, Homo sapiens
uagagguauguauaguauucuu

SEQ ID NO: 13002 - RNA, 22 nt, Homo sapiens
acaggagugggauuugaguccu

SEQ ID NO: 13003 - RNA, 22 nt, Homo sapiens
guuuaggaaugagaauauuuag

SEQ ID NO: 13004 - RNA, 22 nt, Homo sapiens
ucagguagcuagauuaugugag

SEQ ID NO: 13005 - RNA, 22 nt, Homo sapiens
uaagcaguguggauccaccuug

SEQ ID NO: 13006 - RNA, 22 nt, Homo sapiens
uugugguaggcauguaagauga

SEQ ID NO: 13007 - RNA, 22 nt, Homo sapiens
uaucugcaucccauuuuuauca

SEQ ID NO: 13008 - RNA, 22 nt, Homo sapiens
uuagcagcaucccuggccugua

SEQ ID NO: 13009 - RNA, 22 nt, Homo sapiens
uacaguggaaguuaaccccauu

SEQ ID NO: 13010 - RNA, 22 nt, Homo sapiens
ugaguagcuaauguuuacugag

SEQ ID NO: 13011 - RNA, 22 nt, Homo sapiens
ugagucauguaauaaugcugcu

SEQ ID NO: 13012 - RNA, 22 nt, Homo sapiens
ugagaacuuugucuuuuacucu

SEQ ID NO: 13013 - RNA, 16 nt, Homo sapiens
uggaguguuuguuaga

SEQ ID NO: 13014 - RNA, 16 nt, Homo sapiens
uuugugugugacgaga

SEQ ID NO: 13015 - RNA, 18 nt, Homo sapiens
auguuauguuuguagaag

SEQ ID NO: 13016 - RNA, 22 nt, Homo sapiens
aggcauggagacuaaaauuaua

SEQ ID NO: 13017 - RNA, 22 nt, Homo sapiens
ucaucagguaugucagcggagu

SEQ ID NO: 13018 - RNA, 22 nt, Homo sapiens
cuaacacagggcaagucaggcu

SEQ ID NO: 13019 - RNA, 22 nt, Homo sapiens
uguuauguauggagugauccca

SEQ ID NO: 13020 - RNA, 22 nt, Homo sapiens
acauggcacugcgggcuucuug

SEQ ID NO: 13021 - RNA, 23 nt, Homo sapiens
gaguacauuaaaagcccagacug

SEQ ID NO: 13022 - RNA, 22 nt, Homo sapiens
uuccuugugacuaguagugacc

SEQ ID NO: 13023 - RNA, 22 nt, Homo sapiens
aagccagugugacaggaaacuu

SEQ ID NO: 13024 - RNA, 22 nt, Homo sapiens
auggcagaaucaagccgacagc

SEQ ID NO: 13025 - RNA, 22 nt, Homo sapiens
agagccacauuaaauaugggaa

SEQ ID NO: 13026 - RNA, 22 nt, Homo sapiens
uugguccacugugaaauuggga

SEQ ID NO: 13027 - RNA, 22 nt, Homo sapiens
uauugcuggcucugucuucauu

SEQ ID NO: 13028 - RNA, 19 nt, Homo sapiens
aucaccagucuuuccacug

SEQ ID NO: 13029 - RNA, 20 nt, Homo sapiens
agugguuuucaaauaugucu

SEQ ID NO: 13030 - RNA, 22 nt, Homo sapiens
aucugcauuagggugaagaccu

SEQ ID NO: 13031 - RNA, 22 nt, Homo sapiens
agaaacacagguggaauugcuu

SEQ ID NO: 13032 - RNA, 22 nt, Homo sapiens
acugcacuccagccuugauggc

SEQ ID NO: 13033 - RNA, 22 nt, Homo sapiens
ucuggcuccacacuuuauuaac

SEQ ID NO: 13034 - RNA, 22 nt, Homo sapiens
cuuaggguacuuuggugcauca

SEQ ID NO: 13035 - RNA, 22 nt, Homo sapiens
acccaguaacauaugggaggga

SEQ ID NO: 13036 - RNA, 22 nt, Homo sapiens
ucaucaguuuuuuauaugugau

SEQ ID NO: 13037 - RNA, 18 nt, Homo sapiens
acagugcuggcaugagau

SEQ ID NO: 13038 - RNA, 22 nt, Homo sapiens
guuguacuaccucucguauuag

SEQ ID NO: 13039 - RNA, 22 nt, Homo sapiens
ucaccaccugcugauuguagag

SEQ ID NO: 13040 - RNA, 22 nt, Homo sapiens
uuaugacaggcucaggagcccc

SEQ ID NO: 13041 - RNA, 22 nt, Homo sapiens
auacacuggagcaaaccuggag

SEQ ID NO: 13042 - RNA, 18 nt, Homo sapiens
ugacauugagcugagaaa

SEQ ID NO: 13043 - RNA, 22 nt, Homo sapiens
uggucaaaucugaugugagaaa

SEQ ID NO: 13044 - RNA, 22 nt, Homo sapiens
aagagcgcugauaacauguuug

SEQ ID NO: 13045 - RNA, 22 nt, Homo sapiens
ugagauguuuagauuguugucu

SEQ ID NO: 13046 - RNA, 22 nt, Homo sapiens
uuugggaaugguuugucuccca

SEQ ID NO: 13047 - RNA, 23 nt, Homo sapiens
cuuuggucucugguugacuucag

SEQ ID NO: 13048 - RNA, 22 nt, Homo sapiens
uggaacacaucuaaggaagcag

SEQ ID NO: 13049 - RNA, 22 nt, Homo sapiens
augcuguuuugaauucucuaga

SEQ ID NO: 13050 - RNA, 22 nt, Homo sapiens
uagaagcugagaauguccucag

SEQ ID NO: 13051 - RNA, 22 nt, Homo sapiens
uuuaaugcgucucugaguuuug

SEQ ID NO: 13052 - RNA, 22 nt, Homo sapiens
agguauauuggacagauguaaa

SEQ ID NO: 13053 - RNA, 22 nt, Homo sapiens
aagcuaggguuaauuuauuauu

SEQ ID NO: 13054 - RNA, 22 nt, Homo sapiens
aucaaaguuucccagaaguugu

SEQ ID NO: 13055 - RNA, 21 nt, Homo sapiens
auaugugcuguggaagucagc

SEQ ID NO: 13056 - RNA, 22 nt, Homo sapiens
uagaugauucacuuuacuucca

SEQ ID NO: 13057 - RNA, 22 nt, Homo sapiens
gucccagagauauugugucuuu

SEQ ID NO: 13058 - RNA, 22 nt, Homo sapiens
aaugcacauaaaauccuccagg

SEQ ID NO: 13059 - RNA, 22 nt, Homo sapiens
uccacaauggagaagaguauga

SEQ ID NO: 13060 - RNA, 22 nt, Homo sapiens
uaucauuguguuauuucuucca

SEQ ID NO: 13061 - RNA, 18 nt, Homo sapiens
aucauugcacugucuugc

SEQ ID NO: 13062 - RNA, 21 nt, Homo sapiens
caagugaugcuucugcuuuaa

SEQ ID NO: 13063 - RNA, 22 nt, Homo sapiens
cauaugguuuuauguucuucau

SEQ ID NO: 13064 - RNA, 22 nt, Homo sapiens
uccaugugaaaaggucgugaua

SEQ ID NO: 13065 - RNA, 22 nt, Homo sapiens
aaaugcucucuacacguuucug

SEQ ID NO: 13066 - RNA, 22 nt, Homo sapiens
cugcaguaaccacuguaggugu

SEQ ID NO: 13067 - RNA, 22 nt, Homo sapiens
ugugacugguugucccacuuuc

SEQ ID NO: 13068 - RNA, 22 nt, Homo sapiens
uucugacuggugugagauggua

SEQ ID NO: 13069 - RNA, 22 nt, Homo sapiens
ugucucagugauuggcuuucug

SEQ ID NO: 13070 - RNA, 22 nt, Homo sapiens
uagggcaugugggaaguuauaa

SEQ ID NO: 13071 - RNA, 17 nt, Homo sapiens
gacauaggaaaaggaga

SEQ ID NO: 13072 - RNA, 22 nt, Homo sapiens
caaauccucaccucaucaugaa

SEQ ID NO: 13073 - RNA, 22 nt, Homo sapiens
uggcagauagaaaugugguuaa

SEQ ID NO: 13074 - RNA, 22 nt, Homo sapiens
acccuugaguguguuucaggca

SEQ ID NO: 13075 - RNA, 22 nt, Homo sapiens
augccauugcacuccagccuag

SEQ ID NO: 13076 - RNA, 20 nt, Homo sapiens
ugauugaccagagcaguuuu

SEQ ID NO: 13077 - RNA, 22 nt, Homo sapiens
uucaagucaauuuuugaaugac

SEQ ID NO: 13078 - RNA, 22 nt, Homo sapiens
ugcaaguaauuggcgaggaguu

SEQ ID NO: 13079 - RNA, 22 nt, Homo sapiens
uggggugugagggagaaagaaa

SEQ ID NO: 13080 - RNA, 22 nt, Homo sapiens
uaugcuuauuaaaacagugugu

SEQ ID NO: 13081 - RNA, 22 nt, Homo sapiens
uggacuguaauagagaacagaa

SEQ ID NO: 13082 - RNA, 22 nt, Homo sapiens
ucaguaguuccaguggguauuu

SEQ ID NO: 13083 - RNA, 22 nt, Homo sapiens
ccacaguugaaauuuugacugu

SEQ ID NO: 13084 - RNA, 22 nt, Homo sapiens
ugaaauguguuaucugggccug

SEQ ID NO: 13085 - RNA, 22 nt, Homo sapiens
ugugacaguuaguuugguguua

SEQ ID NO: 13086 - RNA, 22 nt, Homo sapiens
ugagacaugugaacuguaguuc

SEQ ID NO: 13087 - RNA, 22 nt, Homo sapiens
gcaaaguguuuuuaggaagucu

SEQ ID NO: 13088 - RNA, 22 nt, Homo sapiens
auggcaguuuauucuaaaucaa

SEQ ID NO: 13089 - RNA, 22 nt, Homo sapiens
caacccgugcagagcgcuuagu

SEQ ID NO: 13090 - RNA, 23 nt, Homo sapiens
gcagcaaugucacagggguccgg

SEQ ID NO: 13091 - RNA, 22 nt, Homo sapiens
aaguugguguaugagacagaag

SEQ ID NO: 13092 - RNA, 22 nt, Homo sapiens
agugucaggagacagguagcug

SEQ ID NO: 13093 - RNA, 22 nt, Homo sapiens
cuggaaucuagaaaagguaagg

SEQ ID NO: 13094 - RNA, 19 nt, Homo sapiens
uagcacuacagaguuuagc

SEQ ID NO: 13095 - RNA, 22 nt, Homo sapiens
uuggagugugcucauaacugcu

SEQ ID NO: 13096 - RNA, 22 nt, Homo sapiens
uugugcuuuuuaaauagcuucc

SEQ ID NO: 13097 - RNA, 22 nt, Homo sapiens
uaggugauugaagguggaaugu

SEQ ID NO: 13098 - RNA, 22 nt, Homo sapiens
uuuuacagaggagguugcugau

SEQ ID NO: 13099 - RNA, 22 nt, Homo sapiens
uacugcaucgaaaugcuuuuau

SEQ ID NO: 13100 - RNA, 22 nt, Homo sapiens
ugucaaaugcagugauauuuga

SEQ ID NO: 13101 - RNA, 22 nt, Homo sapiens
ugaaugcaucuagaaauuuauu

SEQ ID NO: 13102 - RNA, 22 nt, Homo sapiens
ucccuguagugccuagaucaga

SEQ ID NO: 13103 - RNA, 22 nt, Homo sapiens
augaacucaucauuuuuauggc

SEQ ID NO: 13104 - RNA, 22 nt, Homo sapiens
uugacuuagacauucaguugga

SEQ ID NO: 13105 - RNA, 20 nt, Homo sapiens
gggaaugcaaauucucaucc

SEQ ID NO: 13106 - RNA, 22 nt, Homo sapiens
auugacacugauuuuucuuuaa

SEQ ID NO: 13107 - RNA, 22 nt, Homo sapiens
uacugaccugaaggccauggaa

SEQ ID NO: 13108 - RNA, 22 nt, Homo sapiens
uuaaaugcucacauaaagguag

SEQ ID NO: 13109 - RNA, 22 nt, Homo sapiens
gacucagaacuaaggguguuuc

SEQ ID NO: 13110 - RNA, 22 nt, Homo sapiens
uugaaguagaaagacgaaauuu

SEQ ID NO: 13111 - RNA, 22 nt, Homo sapiens
uuaaucaggccguuuccuaaga

SEQ ID NO: 13112 - RNA, 23 nt, Homo sapiens
ugacuuaggccucaacuaugacu

SEQ ID NO: 13113 - RNA, 22 nt, Homo sapiens
gagaucauuaugucagggguca

SEQ ID NO: 13114 - RNA, 22 nt, Homo sapiens
ggagaucuuugaaguguugugc

SEQ ID NO: 13115 - RNA, 20 nt, Homo sapiens
auuagagcuacauggcuaca

SEQ ID NO: 13116 - RNA, 20 nt, Homo sapiens
ugagaacauguggcauuugg

SEQ ID NO: 13117 - RNA, 22 nt, Homo sapiens
augcaacuugaaauuuuccgga

SEQ ID NO: 13118 - RNA, 18 nt, Homo sapiens
uaaggcacuauaggcauu

SEQ ID NO: 13119 - RNA, 18 nt, Homo sapiens
guccauuuguugguacac

SEQ ID NO: 13120 - RNA, 22 nt, Homo sapiens
uugaauaggcucaugcuuauca

SEQ ID NO: 13121 - RNA, 22 nt, Homo sapiens
cugagcacugagauccucuagc

SEQ ID NO: 13122 - RNA, 22 nt, Homo sapiens
gagcaacaguggcagugguggg

SEQ ID NO: 13123 - RNA, 22 nt, Homo sapiens
uuggcauuuauucuaaggucaa

SEQ ID NO: 13124 - RNA, 22 nt, Homo sapiens
cuuuacaguuggacucacgagg

SEQ ID NO: 13125 - RNA, 22 nt, Homo sapiens
ugauuuccaugagaacaugccu

SEQ ID NO: 13126 - RNA, 20 nt, Homo sapiens
uucagcaaaggaaugggagu

SEQ ID NO: 13127 - RNA, 22 nt, Homo sapiens
guguaauaaucguggacuaugu

SEQ ID NO: 13128 - RNA, 22 nt, Homo sapiens
uggaauuuacuuauuuaggggc

SEQ ID NO: 13129 - RNA, 21 nt, Homo sapiens
ugcaagaaucaggaagcugcc

SEQ ID NO: 13130 - RNA, 22 nt, Homo sapiens
gugaaguuuuuugcugagaguc

SEQ ID NO: 13131 - RNA, 22 nt, Homo sapiens
gcuguaguugaggauuuuaaga

SEQ ID NO: 13132 - RNA, 22 nt, Homo sapiens
aauggcuauuucaugugguagg

SEQ ID NO: 13133 - RNA, 22 nt, Homo sapiens
aagcuacauuuuauuuauguca

SEQ ID NO: 13134 - RNA, 22 nt, Homo sapiens
uuuggcauuagagagacuugca

SEQ ID NO: 13135 - RNA, 22 nt, Homo sapiens
uaaggaaccagaaguggguagc

SEQ ID NO: 13136 - RNA, 22 nt, Homo sapiens
agcaagauugauggccugcagg

SEQ ID NO: 13137 - RNA, 22 nt, Homo sapiens
gucccugcgauugugggauccu

SEQ ID NO: 13138 - RNA, 19 nt, Homo sapiens
uugauaugauuaggagcac

SEQ ID NO: 13139 - RNA, 22 nt, Homo sapiens
ugagugaaagaagcacuaagga

SEQ ID NO: 13140 - RNA, 22 nt, Homo sapiens
aggcaacgcuucuuucucaggu

SEQ ID NO: 13141 - RNA, 22 nt, Homo sapiens
cauguaguagaaggagccagac

SEQ ID NO: 13142 - RNA, 22 nt, Homo sapiens
aaugaaguuagauguugagaag

SEQ ID NO: 13143 - RNA, 22 nt, Homo sapiens
uugcacuccagccuuggggaga

SEQ ID NO: 13144 - RNA, 22 nt, Homo sapiens
aguacacuguuaaaaagaagug

SEQ ID NO: 13145 - RNA, 22 nt, Homo sapiens
agcauuacaugguacagagaag

SEQ ID NO: 13146 - RNA, 22 nt, Homo sapiens
uaggcuuuuggacccugucucu

SEQ ID NO: 13147 - RNA, 22 nt, Homo sapiens
uuagaguguagcaggaagaggc

SEQ ID NO: 13148 - RNA, 19 nt, Homo sapiens
auuugaucaucaggcacag

SEQ ID NO: 13149 - RNA, 20 nt, Homo sapiens
uggugucuuggaaagagcuc

SEQ ID NO: 13150 - RNA, 21 nt, Homo sapiens
auagcacuucacuugguuaga

SEQ ID NO: 13151 - RNA, 22 nt, Homo sapiens
ugggaaauguagccuagcugug

SEQ ID NO: 13152 - RNA, 22 nt, Homo sapiens
cuaagugaacugucacugagaa

SEQ ID NO: 13153 - RNA, 22 nt, Homo sapiens
cuguuauguucuagagggugca

SEQ ID NO: 13154 - RNA, 18 nt, Homo sapiens
uauuccucuuccucuauc

SEQ ID NO: 13155 - RNA, 22 nt, Homo sapiens
cuggugauugguuucauucagu

SEQ ID NO: 13156 - RNA, 19 nt, Homo sapiens
ucgcgccauucuccugccu

SEQ ID NO: 13157 - RNA, 22 nt, Homo sapiens
uucccaguaaacucuaucccuc

SEQ ID NO: 13158 - RNA, 22 nt, Homo sapiens
auuccagauggaguugaggguu

SEQ ID NO: 13159 - RNA, 22 nt, Homo sapiens
cuagguagcuuuucugucaugu

SEQ ID NO: 13160 - RNA, 22 nt, Homo sapiens
auagaguuagaaagaaauguuu

SEQ ID NO: 13161 - RNA, 22 nt, Homo sapiens
uucuacuccucauggcagguug

SEQ ID NO: 13162 - RNA, 22 nt, Homo sapiens
uugcagagccccugcaaggguc

SEQ ID NO: 13163 - RNA, 22 nt, Homo sapiens
ugucauguauauaccacuucca

SEQ ID NO: 13164 - RNA, 22 nt, Homo sapiens
ucuugguuaggggaaauaggca

SEQ ID NO: 13165 - RNA, 22 nt, Homo sapiens
ugggaucgucaagugaggcucg

SEQ ID NO: 13166 - RNA, 22 nt, Homo sapiens
gcuguuugccgccaucgcagac

SEQ ID NO: 13167 - RNA, 22 nt, Homo sapiens
aguaagauggcaacucuccaca

SEQ ID NO: 13168 - RNA, 22 nt, Homo sapiens
ugaggugagauggcuaccccaa

SEQ ID NO: 13169 - RNA, 22 nt, Homo sapiens
uuuuacacuucgguugugugca

SEQ ID NO: 13170 - RNA, 22 nt, Homo sapiens
gugacagucaaagacaugacuu

SEQ ID NO: 13171 - RNA, 22 nt, Homo sapiens
uacuuuguagauuguuuccuuu

SEQ ID NO: 13172 - RNA, 22 nt, Homo sapiens
uggcaacuugcaaccucauucu

SEQ ID NO: 13173 - RNA, 20 nt, Homo sapiens
cagagcaaagcaguccuggc

SEQ ID NO: 13174 - RNA, 22 nt, Homo sapiens
uaucucuguggguagugcugaa

SEQ ID NO: 13175 - RNA, 22 nt, Homo sapiens
cucugguggaagcagggggcaa

SEQ ID NO: 13176 - RNA, 22 nt, Homo sapiens
caaagugcuggccgggcgcagu

SEQ ID NO: 13177 - RNA, 22 nt, Homo sapiens
cacugcgaccuccaccucccgg

SEQ ID NO: 13178 - RNA, 22 nt, Homo sapiens
uugguuuccuuccugcuuaacu

SEQ ID NO: 13179 - RNA, 22 nt, Homo sapiens
ugugaucaugguauuaaucugc

SEQ ID NO: 13180 - RNA, 22 nt, Homo sapiens
gcacgcauuguccuucuaguca

SEQ ID NO: 13181 - RNA, 22 nt, Homo sapiens
ucacugugagaguuuauccugu

SEQ ID NO: 13182 - RNA, 22 nt, Homo sapiens
caaugcagcuuuuggagagaaa

SEQ ID NO: 13183 - RNA, 22 nt, Homo sapiens
auggauuuuggggccagaggca

SEQ ID NO: 13184 - RNA, 17 nt, Homo sapiens
accccuaccucagaagc

SEQ ID NO: 13185 - RNA, 22 nt, Homo sapiens
guaugacacaggaagcuuaacc

SEQ ID NO: 13186 - RNA, 22 nt, Homo sapiens
cucauggauggucuggcagcca

SEQ ID NO: 13187 - RNA, 22 nt, Homo sapiens
uguguaaagcuuguuccagaaa

SEQ ID NO: 13188 - RNA, 22 nt, Homo sapiens
uuucccugaaggcucugaaguc

SEQ ID NO: 13189 - RNA, 17 nt, Homo sapiens
agcauguguuugagauu

SEQ ID NO: 13190 - RNA, 22 nt, Homo sapiens
ggucagauggcagcugggccug

SEQ ID NO: 13191 - RNA, 22 nt, Homo sapiens
acugcacucccgcccgggugac

SEQ ID NO: 13192 - RNA, 22 nt, Homo sapiens
augugugcuugauguaaaaagu

SEQ ID NO: 13193 - RNA, 22 nt, Homo sapiens
gcuggcaaguggccuacuuugu

SEQ ID NO: 13194 - RNA, 22 nt, Homo sapiens
ucaucagaguuuacaagcucag

SEQ ID NO: 13195 - RNA, 22 nt, Homo sapiens
uggaagauuacuuuuuguugaa

SEQ ID NO: 13196 - RNA, 22 nt, Homo sapiens
ucucuagagagccugguguuca

SEQ ID NO: 13197 - RNA, 23 nt, Homo sapiens
gggcuagaugagagcuuccuggg

SEQ ID NO: 13198 - RNA, 22 nt, Homo sapiens
ucacugaaaccacugccuccug

SEQ ID NO: 13199 - RNA, 22 nt, Homo sapiens
uguaaaccucugaguacaagcu

SEQ ID NO: 13200 - RNA, 15 nt, Homo sapiens
aaauaugucaguucu

SEQ ID NO: 13201 - RNA, 22 nt, Homo sapiens
uuugauacuggguguggacaaa

SEQ ID NO: 13202 - RNA, 22 nt, Homo sapiens
ucaaauguuuguuuaaggcuua

SEQ ID NO: 13203 - RNA, 22 nt, Homo sapiens
aaauugcaguuaggaugauggu

SEQ ID NO: 13204 - RNA, 22 nt, Homo sapiens
uggguaggaccagaaaugcacu

SEQ ID NO: 13205 - RNA, 22 nt, Homo sapiens
aacugcucuuaccagauggguc

SEQ ID NO: 13206 - RNA, 22 nt, Homo sapiens
uuuacugugggguuucuuagag

SEQ ID NO: 13207 - RNA, 21 nt, Homo sapiens
aagguuuuuagugcuugacuu

SEQ ID NO: 13208 - RNA, 22 nt, Homo sapiens
cugacagucucauugauuugcu

SEQ ID NO: 13209 - RNA, 22 nt, Homo sapiens
augagaaugauucuguuauggu

SEQ ID NO: 13210 - RNA, 22 nt, Homo sapiens
guaacugguuuucuucccucuc

SEQ ID NO: 13211 - RNA, 18 nt, Homo sapiens
ugagauacuagaauaggu

SEQ ID NO: 13212 - RNA, 22 nt, Homo sapiens
uggcauauaaagauguguucaa

SEQ ID NO: 13213 - RNA, 22 nt, Homo sapiens
uacaguagaaugucuuucaaaa

SEQ ID NO: 13214 - RNA, 22 nt, Homo sapiens
ugagguguauugggggaaauuc

SEQ ID NO: 13215 - RNA, 22 nt, Homo sapiens
uuacaguauugcaaggacuagg

SEQ ID NO: 13216 - RNA, 22 nt, Homo sapiens
uugaggaucauuguuuucggag

SEQ ID NO: 13217 - RNA, 22 nt, Homo sapiens
aucagauaccuguugggaaaug

SEQ ID NO: 13218 - RNA, 22 nt, Homo sapiens
uguauugcuugaagagugaauu

SEQ ID NO: 13219 - RNA, 18 nt, Homo sapiens
gacucaguuucuaaggca

SEQ ID NO: 13220 - RNA, 22 nt, Homo sapiens
auggauguucuagggaugugau

SEQ ID NO: 13221 - RNA, 22 nt, Homo sapiens
caggaccucuugccuggaagcc

SEQ ID NO: 13222 - RNA, 22 nt, Homo sapiens
cugagauaggacucugcuggcu

SEQ ID NO: 13223 - RNA, 22 nt, Homo sapiens
augcuacuggauuuguauaaau

SEQ ID NO: 13224 - RNA, 22 nt, Homo sapiens
ucuacagccaguucaggaagaa

SEQ ID NO: 13225 - RNA, 22 nt, Homo sapiens
agagaucacugaaucacggggg

SEQ ID NO: 13226 - RNA, 22 nt, Homo sapiens
uuuuggcucugucuguaucuuu

SEQ ID NO: 13227 - RNA, 22 nt, Homo sapiens
auacacauuccugggccucacc

SEQ ID NO: 13228 - RNA, 22 nt, Homo sapiens
ggacagaugggcucccgggucu

SEQ ID NO: 13229 - RNA, 22 nt, Homo sapiens
uucccuuugaauuggaaaggug

SEQ ID NO: 13230 - RNA, 22 nt, Homo sapiens
aagcaccaauaggagauuuguc

SEQ ID NO: 13231 - RNA, 22 nt, Homo sapiens
gugauauuuagggggccgggau

SEQ ID NO: 13232 - RNA, 22 nt, Homo sapiens
caaugguccccauuggcaggaa

SEQ ID NO: 13233 - RNA, 22 nt, Homo sapiens
aaguaauugagguuuuugcugu

SEQ ID NO: 13234 - RNA, 17 nt, Homo sapiens
agugagaucauggcuua

SEQ ID NO: 13235 - RNA, 20 nt, Homo sapiens
gcaaauggaucccacaagcc

SEQ ID NO: 13236 - RNA, 22 nt, Homo sapiens
ugacagcugaggcccagaguac

SEQ ID NO: 13237 - RNA, 22 nt, Homo sapiens
gacuagggaccaugagcaaucc

SEQ ID NO: 13238 - RNA, 22 nt, Homo sapiens
cuggcaccauacacuguuguug

SEQ ID NO: 13239 - RNA, 22 nt, Homo sapiens
cuuggcuagucaaaccuccccg

SEQ ID NO: 13240 - RNA, 22 nt, Homo sapiens
uaaugugcuucucuaccauagg

SEQ ID NO: 13241 - RNA, 22 nt, Homo sapiens
guagaaaguuugcugucacaug

SEQ ID NO: 13242 - RNA, 22 nt, Homo sapiens
uugaggugaauuugcaggaugc

SEQ ID NO: 13243 - RNA, 22 nt, Homo sapiens
uuggcauaguugcacuuacuag

SEQ ID NO: 13244 - RNA, 22 nt, Homo sapiens
gugguaucauuuaaccauuaga

SEQ ID NO: 13245 - RNA, 22 nt, Homo sapiens
uuuugcucuucggaagagcuug

SEQ ID NO: 13246 - RNA, 22 nt, Homo sapiens
ucagugggcuauguaauuaacu

SEQ ID NO: 13247 - RNA, 22 nt, Homo sapiens
ucaguaccugagagugggcaga

SEQ ID NO: 13248 - RNA, 22 nt, Homo sapiens
augaguauguucuguauuuuca

SEQ ID NO: 13249 - RNA, 22 nt, Homo sapiens
agacagcugguagcacuuccug

SEQ ID NO: 13250 - RNA, 22 nt, Homo sapiens
uuggaugauaaagaagccuaag

SEQ ID NO: 13251 - RNA, 22 nt, Homo sapiens
uucuucaggccacaaaaauggu

SEQ ID NO: 13252 - RNA, 22 nt, Homo sapiens
uggguaguuucuuacaacucug

SEQ ID NO: 13253 - RNA, 22 nt, Homo sapiens
aaugacugugauauuuuucuuc

SEQ ID NO: 13254 - RNA, 22 nt, Homo sapiens
gggagcacaagaaauguuucau

SEQ ID NO: 13255 - RNA, 22 nt, Homo sapiens
uaggcgagauguguguuucaug

SEQ ID NO: 13256 - RNA, 22 nt, Homo sapiens
auuucacugagacaugugccca

SEQ ID NO: 13257 - RNA, 22 nt, Homo sapiens
acuaaggcacaauuuucucaua

SEQ ID NO: 13258 - RNA, 22 nt, Homo sapiens
uuugagcaggcuaaucaauaua

SEQ ID NO: 13259 - RNA, 19 nt, Homo sapiens
uuacauccauugcauuuca

SEQ ID NO: 13260 - RNA, 20 nt, Homo sapiens
aauggcauguuggacaacug

SEQ ID NO: 13261 - RNA, 22 nt, Homo sapiens
uacuuaguagcuuauccugugg

SEQ ID NO: 13262 - RNA, 22 nt, Homo sapiens
gaaagauuuccugagcuagaaa

SEQ ID NO: 13263 - RNA, 22 nt, Homo sapiens
auuugguguuguuuggagccua

SEQ ID NO: 13264 - RNA, 22 nt, Homo sapiens
uaaguaguuucuggauauucuc

SEQ ID NO: 13265 - RNA, 22 nt, Homo sapiens
ccacauuggaaaggaucccccc

SEQ ID NO: 13266 - RNA, 22 nt, Homo sapiens
gugcacaaaucuuaaauguaca

SEQ ID NO: 13267 - RNA, 22 nt, Homo sapiens
aacugcuguuuggguacuggug

SEQ ID NO: 13268 - RNA, 22 nt, Homo sapiens
uucacaugguugccuuuugauc

SEQ ID NO: 13269 - RNA, 20 nt, Homo sapiens
ugaguuccuuguucagaagc

SEQ ID NO: 13270 - RNA, 22 nt, Homo sapiens
uaucccaauguaauaucacaaa

SEQ ID NO: 13271 - RNA, 22 nt, Homo sapiens
ugacauagcuauuaagugaugc

SEQ ID NO: 13272 - RNA, 22 nt, Homo sapiens
cugcccuuucuauaugauguaa

SEQ ID NO: 13273 - RNA, 22 nt, Homo sapiens
gaaguaauaaauggauucuuaa

SEQ ID NO: 13274 - RNA, 22 nt, Homo sapiens
guugaaauccuaacccccuagu

SEQ ID NO: 13275 - RNA, 22 nt, Homo sapiens
aaguagcuggaugcaguggcac

SEQ ID NO: 13276 - RNA, 22 nt, Homo sapiens
uugagauggagucucgcucuuu

SEQ ID NO: 13277 - RNA, 22 nt, Homo sapiens
uugagacggagucuugcucuuu

SEQ ID NO: 13278 - RNA, 22 nt, Homo sapiens
uuugacuaccaggaauguucuu

SEQ ID NO: 13279 - RNA, 22 nt, Homo sapiens
cuccaggugagguuaagggacu

SEQ ID NO: 13280 - RNA, 22 nt, Homo sapiens
uagguaguugugggcuugaaug

SEQ ID NO: 13281 - RNA, 22 nt, Homo sapiens
uagggcauuuagaggcuauuaa

SEQ ID NO: 13282 - RNA, 22 nt, Homo sapiens
cuggaguaugauguuagcguug

SEQ ID NO: 13283 - RNA, 22 nt, Homo sapiens
ucagacacugagcaaacgacua

SEQ ID NO: 13284 - RNA, 22 nt, Homo sapiens
uugaguagauaccuaggaauag

SEQ ID NO: 13285 - RNA, 22 nt, Homo sapiens
augccacugcacuucagccugc

SEQ ID NO: 13286 - RNA, 22 nt, Homo sapiens
uaagaauucuguccgguauacu

SEQ ID NO: 13287 - RNA, 16 nt, Homo sapiens
uguuauggagacagcu

SEQ ID NO: 13288 - RNA, 22 nt, Homo sapiens
uugaagguagaaguucucaauu

SEQ ID NO: 13289 - RNA, 22 nt, Homo sapiens
ggaaauguaaacaauggggcua

SEQ ID NO: 13290 - RNA, 22 nt, Homo sapiens
uuguagcaaauguguaaacaaa

SEQ ID NO: 13291 - RNA, 22 nt, Homo sapiens
gggaauggaagacauuaugaug

SEQ ID NO: 13292 - RNA, 22 nt, Homo sapiens
acacuguagcugagggcaugcg

SEQ ID NO: 13293 - RNA, 20 nt, Homo sapiens
gcaaaguuuagcucccacua

SEQ ID NO: 13294 - RNA, 17 nt, Homo sapiens
auaugaauuuuggagau

SEQ ID NO: 13295 - RNA, 22 nt, Homo sapiens
augaaagguugucuuaagccau

SEQ ID NO: 13296 - RNA, 22 nt, Homo sapiens
cugugcauguaugcgugaguuc

SEQ ID NO: 13297 - RNA, 22 nt, Homo sapiens
uuguauugucuugaugaguuga

SEQ ID NO: 13298 - RNA, 22 nt, Homo sapiens
uacaagcuaaaauggaagauca

SEQ ID NO: 13299 - RNA, 22 nt, Homo sapiens
ggcugguuuucaguuacugagu

SEQ ID NO: 13300 - RNA, 22 nt, Homo sapiens
uauggauuucauuagacuugag

SEQ ID NO: 13301 - RNA, 22 nt, Homo sapiens
ugggaucaugagcaccgcuucc

SEQ ID NO: 13302 - RNA, 22 nt, Homo sapiens
caaugcauuauucucccacuuc

SEQ ID NO: 13303 - RNA, 22 nt, Homo sapiens
uugcauauguugaaccaagcgu

SEQ ID NO: 13304 - RNA, 22 nt, Homo sapiens
gcuccauuuuccauuucucuaa

SEQ ID NO: 13305 - RNA, 22 nt, Homo sapiens
ugugaacagcuccaaaugugga

SEQ ID NO: 13306 - RNA, 22 nt, Homo sapiens
cugaggucugaauccagguauc

SEQ ID NO: 13307 - RNA, 21 nt, Homo sapiens
uggguaguuuucaaggccccg

SEQ ID NO: 13308 - RNA, 22 nt, Homo sapiens
ugagaucaguuguuauaauucu

SEQ ID NO: 13309 - RNA, 21 nt, Homo sapiens
uggucccauaagauuauaaug

SEQ ID NO: 13310 - RNA, 22 nt, Homo sapiens
aauugccucaagugaucauggc

SEQ ID NO: 13311 - RNA, 22 nt, Homo sapiens
ugaaggacauucuaugguagau

SEQ ID NO: 13312 - RNA, 22 nt, Homo sapiens
ugaguauuugggggaccagaga

SEQ ID NO: 13313 - RNA, 22 nt, Homo sapiens
uuaggcucuuuaucaguuaacu

SEQ ID NO: 13314 - RNA, 22 nt, Homo sapiens
ggccagaugcaguggcucacac

SEQ ID NO: 13315 - RNA, 22 nt, Homo sapiens
ucacagacugagccaaauagag

SEQ ID NO: 13316 - RNA, 22 nt, Homo sapiens
aagggaaugugguagcugguuu

SEQ ID NO: 13317 - RNA, 22 nt, Homo sapiens
cacccuaucagauguccagaga

SEQ ID NO: 13318 - RNA, 22 nt, Homo sapiens
uuaggacacuguggguggguca

SEQ ID NO: 13319 - RNA, 22 nt, Homo sapiens
cuagcccagugcuccuggauca

SEQ ID NO: 13320 - RNA, 21 nt, Homo sapiens
ucucauugugguuuuaauugg

SEQ ID NO: 13321 - RNA, 22 nt, Homo sapiens
gaauacuguccaagagugaugg

SEQ ID NO: 13322 - RNA, 22 nt, Homo sapiens
ugaugacucuguggccccaggc

SEQ ID NO: 13323 - RNA, 22 nt, Homo sapiens
uugaggacugguugaaagcuuu

SEQ ID NO: 13324 - RNA, 22 nt, Homo sapiens
gcugugguuuaguagaaagaag

SEQ ID NO: 13325 - RNA, 22 nt, Homo sapiens
acacuguugacauuuuguagug

SEQ ID NO: 13326 - RNA, 22 nt, Homo sapiens
caaccguagauuguucugggcu

SEQ ID NO: 13327 - RNA, 22 nt, Homo sapiens
uucaccuguagcaugcccuugg

SEQ ID NO: 13328 - RNA, 22 nt, Homo sapiens
acugcacuccuccuugggugac

SEQ ID NO: 13329 - RNA, 22 nt, Homo sapiens
auggcacuaaugggaguuuacu

SEQ ID NO: 13330 - RNA, 22 nt, Homo sapiens
uucacagucacccuucuccaug

SEQ ID NO: 13331 - RNA, 19 nt, Homo sapiens
uuuuggaaaugugaacagc

SEQ ID NO: 13332 - RNA, 22 nt, Homo sapiens
guuugcauagugcugggagggg

SEQ ID NO: 13333 - RNA, 22 nt, Homo sapiens
agaaccaaucccacauggauac

SEQ ID NO: 13334 - RNA, 22 nt, Homo sapiens
aucuuuaguggcuguuuucaga

SEQ ID NO: 13335 - RNA, 23 nt, Homo sapiens
uuuguacuaugucaguuuagaua

SEQ ID NO: 13336 - RNA, 22 nt, Homo sapiens
auggcuuuuuucuugggcacuc

SEQ ID NO: 13337 - RNA, 22 nt, Homo sapiens
ggauauguagggcauaucuaca

SEQ ID NO: 13338 - RNA, 22 nt, Homo sapiens
uagcaccaaacauauacucagu

SEQ ID NO: 13339 - RNA, 22 nt, Homo sapiens
uaugucaugggguuuuugagau

SEQ ID NO: 13340 - RNA, 22 nt, Homo sapiens
uggaagacauugggugaagggu

SEQ ID NO: 13341 - RNA, 22 nt, Homo sapiens
cgccgggggaugggcaccagcg

SEQ ID NO: 13342 - RNA, 22 nt, Homo sapiens
ugccuuauuccaacugagcucu

SEQ ID NO: 13343 - RNA, 22 nt, Homo sapiens
gagacugagucuugcucuguca

SEQ ID NO: 13344 - RNA, 22 nt, Homo sapiens
ucuuugguugcacugcaggugu

SEQ ID NO: 13345 - RNA, 22 nt, Homo sapiens
gucacagaggcuaagaccccac

SEQ ID NO: 13346 - RNA, 22 nt, Homo sapiens
auagcacugguuuuucuugguu

SEQ ID NO: 13347 - RNA, 22 nt, Homo sapiens
acagguacacagaauauccaga

SEQ ID NO: 13348 - RNA, 20 nt, Homo sapiens
ugagaacaugugguauuugg

SEQ ID NO: 13349 - RNA, 22 nt, Homo sapiens
aucagucuguuggaauaucgcu

SEQ ID NO: 13350 - RNA, 22 nt, Homo sapiens
ucaccuggggaucuuguuuaca

SEQ ID NO: 13351 - RNA, 22 nt, Homo sapiens
ugagacggagucucgcuguguc

SEQ ID NO: 13352 - RNA, 22 nt, Homo sapiens
uuacauugcuucaaauucagug

SEQ ID NO: 13353 - RNA, 22 nt, Homo sapiens
guccuggagaagcguggaccgg

SEQ ID NO: 13354 - RNA, 22 nt, Homo sapiens
uugacauugcuguaguguccag

SEQ ID NO: 13355 - RNA, 22 nt, Homo sapiens
augauggagguagauuguccau

SEQ ID NO: 13356 - RNA, 20 nt, Homo sapiens
gacauguugguuugcugcac

SEQ ID NO: 13357 - RNA, 22 nt, Homo sapiens
ggagugucccaaucucagcuca

SEQ ID NO: 13358 - RNA, 22 nt, Homo sapiens
uggaauguggacucuuaugggg

SEQ ID NO: 13359 - RNA, 22 nt, Homo sapiens
uuccaguuuuauggguauagag

SEQ ID NO: 13360 - RNA, 22 nt, Homo sapiens
uuugaagacuacugggagugaa

SEQ ID NO: 13361 - RNA, 22 nt, Homo sapiens
cuggugagaugucuuuccucuu

SEQ ID NO: 13362 - RNA, 22 nt, Homo sapiens
ugacuggagaccucaguagggu

SEQ ID NO: 13363 - RNA, 22 nt, Homo sapiens
cugaaagagcauuugaaugggu

SEQ ID NO: 13364 - RNA, 22 nt, Homo sapiens
gagauucuucaauauuuauucu

SEQ ID NO: 13365 - RNA, 22 nt, Homo sapiens
agcuugugauucuccaucaugu

SEQ ID NO: 13366 - RNA, 22 nt, Homo sapiens
cuagcagcaugagaauggacca

SEQ ID NO: 13367 - RNA, 22 nt, Homo sapiens
uaucugguuuuguuacagguuc

SEQ ID NO: 13368 - RNA, 22 nt, Homo sapiens
caguugguguacauauauguau

SEQ ID NO: 13369 - RNA, 22 nt, Homo sapiens
gugagcagagaucgcgugauug

SEQ ID NO: 13370 - RNA, 22 nt, Homo sapiens
ggcuagagagcucagggauaug

SEQ ID NO: 13371 - RNA, 20 nt, Homo sapiens
uggcaagugggaauuguggg

SEQ ID NO: 13372 - RNA, 23 nt, Homo sapiens
uuuggcauuccagaaauuuucau

SEQ ID NO: 13373 - RNA, 20 nt, Homo sapiens
uucaugggagcaaagaggcc

SEQ ID NO: 13374 - RNA, 22 nt, Homo sapiens
uuaaaugcuagaauuuucuuug

SEQ ID NO: 13375 - RNA, 22 nt, Homo sapiens
auggcccugaguucaauauauu

SEQ ID NO: 13376 - RNA, 22 nt, Homo sapiens
guguaauacacacauauaugca

SEQ ID NO: 13377 - RNA, 22 nt, Homo sapiens
augcagcugaggguaguggagc

SEQ ID NO: 13378 - RNA, 22 nt, Homo sapiens
cuacaguagagaggauguagaa

SEQ ID NO: 13379 - RNA, 22 nt, Homo sapiens
uuagaaaguagaaaagcugguu

SEQ ID NO: 13380 - RNA, 22 nt, Homo sapiens
uggcaauguggaaugguccagg

SEQ ID NO: 13381 - RNA, 22 nt, Homo sapiens
acugcacuccagccuccugggu

SEQ ID NO: 13382 - RNA, 22 nt, Homo sapiens
gcugagguucaagaagguuaaa

SEQ ID NO: 13383 - RNA, 22 nt, Homo sapiens
uagugcauguugaguucccgac

SEQ ID NO: 13384 - RNA, 22 nt, Homo sapiens
uuugguccuccuacagggcagg

SEQ ID NO: 13385 - RNA, 22 nt, Homo sapiens
ccagugguugggccggagacgg

SEQ ID NO: 13386 - RNA, 20 nt, Homo sapiens
uggaaguaagaauauaggug

SEQ ID NO: 13387 - RNA, 21 nt, Homo sapiens
uacaaugcacaggagagccuc

SEQ ID NO: 13388 - RNA, 20 nt, Homo sapiens
auggaacugugagccaauua

SEQ ID NO: 13389 - RNA, 22 nt, Homo sapiens
uuacagguggagaaguaaggcu

SEQ ID NO: 13390 - RNA, 22 nt, Homo sapiens
aaauugcacaaguggugauuug

SEQ ID NO: 13391 - RNA, 22 nt, Homo sapiens
gagacagugucagccauugaaa

SEQ ID NO: 13392 - RNA, 22 nt, Homo sapiens
aguggaaucuguuauacuaacu

SEQ ID NO: 13393 - RNA, 22 nt, Homo sapiens
augcuguuuuguagcucccucu

SEQ ID NO: 13394 - RNA, 18 nt, Homo sapiens
ugacuguccagguggacc

SEQ ID NO: 13395 - RNA, 19 nt, Homo sapiens
ugaguaucuuuacacaucu

SEQ ID NO: 13396 - RNA, 22 nt, Homo sapiens
aggaccauuguguagcagacau

SEQ ID NO: 13397 - RNA, 22 nt, Homo sapiens
uagguacuuaagaucucagcua

SEQ ID NO: 13398 - RNA, 22 nt, Homo sapiens
uguaaacuaugagcugauuauu

SEQ ID NO: 13399 - RNA, 22 nt, Homo sapiens
caugguguuaggcacugggaau

SEQ ID NO: 13400 - RNA, 22 nt, Homo sapiens
ugugcauagugugugcggggcg

SEQ ID NO: 13401 - RNA, 22 nt, Homo sapiens
cauugguugaacagauuguguu

SEQ ID NO: 13402 - RNA, 22 nt, Homo sapiens
ucucuguuugucuguuacuggu

SEQ ID NO: 13403 - RNA, 22 nt, Homo sapiens
guaaggcuguuaucuucacguc

SEQ ID NO: 13404 - RNA, 22 nt, Homo sapiens
ugacaugagauuugggaggggc

SEQ ID NO: 13405 - RNA, 22 nt, Homo sapiens
auaugugacuucaugcaaggcu

SEQ ID NO: 13406 - RNA, 22 nt, Homo sapiens
ggcacugugaugugagggggua

SEQ ID NO: 13407 - RNA, 22 nt, Homo sapiens
ugucauggucacaggcauuuca

SEQ ID NO: 13408 - RNA, 22 nt, Homo sapiens
gucagcuuuuccuuacuuuagg

SEQ ID NO: 13409 - RNA, 22 nt, Homo sapiens
ucagugcgugcauagccuggau

SEQ ID NO: 13410 - RNA, 22 nt, Homo sapiens
auuugguagaguucgauaccug

SEQ ID NO: 13411 - RNA, 22 nt, Homo sapiens
gauauugacuuauucuauguuu

SEQ ID NO: 13412 - RNA, 22 nt, Homo sapiens
gcuuuguugauggugagucugu

SEQ ID NO: 13413 - RNA, 22 nt, Homo sapiens
auggaaagcuguuccuacacaa

SEQ ID NO: 13414 - RNA, 22 nt, Homo sapiens
gcucaaguaauggcaguuuugc

SEQ ID NO: 13415 - RNA, 19 nt, Homo sapiens
uugguugguuauuucuuac

SEQ ID NO: 13416 - RNA, 22 nt, Homo sapiens
aguacacuguugaacagaagug

SEQ ID NO: 13417 - RNA, 22 nt, Homo sapiens
cagucacagugacaggaugugg

SEQ ID NO: 13418 - RNA, 22 nt, Homo sapiens
uuagcacugagaauggcuugcu

SEQ ID NO: 13419 - RNA, 22 nt, Homo sapiens
uuggucagcuagauuauucccu

SEQ ID NO: 13420 - RNA, 21 nt, Homo sapiens
ggauucaucccucaugaauuu

SEQ ID NO: 13421 - RNA, 22 nt, Homo sapiens
uacuauugcaucggugauuagg

SEQ ID NO: 13422 - RNA, 22 nt, Homo sapiens
ucucaugaagguggagaguagg

SEQ ID NO: 13423 - RNA, 22 nt, Homo sapiens
uaugagacugugagugagaaau

SEQ ID NO: 13424 - RNA, 22 nt, Homo sapiens
aaggcuuuuugcugacguccuu

SEQ ID NO: 13425 - RNA, 22 nt, Homo sapiens
cuuuaguugucuccucaagggu

SEQ ID NO: 13426 - RNA, 22 nt, Homo sapiens
gauggcauuucuggaucugaca

SEQ ID NO: 13427 - RNA, 22 nt, Homo sapiens
uugagggcugaauaccaaucag

SEQ ID NO: 13428 - RNA, 22 nt, Homo sapiens
uguaaaucugguuaauuggaua

SEQ ID NO: 13429 - RNA, 22 nt, Homo sapiens
cugagcaaaaugaagacacgau

SEQ ID NO: 13430 - RNA, 22 nt, Homo sapiens
acccaguagccagauguagcug

SEQ ID NO: 13431 - RNA, 22 nt, Homo sapiens
uuacuugagauggggugucacu

SEQ ID NO: 13432 - RNA, 22 nt, Homo sapiens
gaagauguugcuuaccuuggag

SEQ ID NO: 13433 - RNA, 22 nt, Homo sapiens
aaguaagcauccaauaaauguu

SEQ ID NO: 13434 - RNA, 22 nt, Homo sapiens
aacagugccugucauuuaguag

SEQ ID NO: 13435 - RNA, 23 nt, Homo sapiens
cagugcauuguggcauucagcau

SEQ ID NO: 13436 - RNA, 22 nt, Homo sapiens
uauagcuauuguuaauggaacu

SEQ ID NO: 13437 - RNA, 22 nt, Homo sapiens
gccuagagaaguaaauauuauc

SEQ ID NO: 13438 - RNA, 22 nt, Homo sapiens
uguagcaaauaaaagucuggau

SEQ ID NO: 13439 - RNA, 22 nt, Homo sapiens
uggcuaaguuaaucaaggagau

SEQ ID NO: 13440 - RNA, 22 nt, Homo sapiens
cugagcccauucuggggagaag

SEQ ID NO: 13441 - RNA, 22 nt, Homo sapiens
ugguauguaugauuaacaugga

SEQ ID NO: 13442 - RNA, 22 nt, Homo sapiens
uagaauguauaauauuuuacuu

SEQ ID NO: 13443 - RNA, 22 nt, Homo sapiens
gacauuaucagguuuguuuucu

SEQ ID NO: 13444 - RNA, 22 nt, Homo sapiens
aaaugcagucuuuguucugggc

SEQ ID NO: 13445 - RNA, 22 nt, Homo sapiens
ggaguguguuuuccaacuuggu

SEQ ID NO: 13446 - RNA, 22 nt, Homo sapiens
aguaaauuucugugcuuucaua

SEQ ID NO: 13447 - RNA, 22 nt, Homo sapiens
gaugaggcuagagacaugugua

SEQ ID NO: 13448 - RNA, 22 nt, Homo sapiens
uuugugugugauuauaaaaggu

SEQ ID NO: 13449 - RNA, 22 nt, Homo sapiens
guguaugugagaaugcucaugu

SEQ ID NO: 13450 - RNA, 22 nt, Homo sapiens
gggcaguauggucauuuucaca

SEQ ID NO: 13451 - RNA, 22 nt, Homo sapiens
cugggaugauguaaauaggcua

SEQ ID NO: 13452 - RNA, 22 nt, Homo sapiens
uuaggacaauguucguuuuuug

SEQ ID NO: 13453 - RNA, 22 nt, Homo sapiens
aucacaguggucagguauagau

SEQ ID NO: 13454 - RNA, 19 nt, Homo sapiens
cauuggacuugcuuuugcc

SEQ ID NO: 13455 - RNA, 20 nt, Homo sapiens
uggaaaguaagucaugauau

SEQ ID NO: 13456 - RNA, 22 nt, Homo sapiens
aagguauuucuaugggaauaga

SEQ ID NO: 13457 - RNA, 22 nt, Homo sapiens
ugacuucauuuuuggccaugag

SEQ ID NO: 13458 - RNA, 22 nt, Homo sapiens
acugcacuccagccuugcgaca

SEQ ID NO: 13459 - RNA, 22 nt, Homo sapiens
auugcacuccagccuugugaca

SEQ ID NO: 13460 - RNA, 22 nt, Homo sapiens
cucagugaagggcaagaggcaa

SEQ ID NO: 13461 - RNA, 18 nt, Homo sapiens
ugaauacagcguugggaa

SEQ ID NO: 13462 - RNA, 22 nt, Homo sapiens
uuacuguauagaaucaucuuga

SEQ ID NO: 13463 - RNA, 18 nt, Homo sapiens
auugagcaugacagaccu

SEQ ID NO: 13464 - RNA, 22 nt, Homo sapiens
aucacaguggcucacaagagcc

SEQ ID NO: 13465 - RNA, 22 nt, Homo sapiens
ugagaugaagcuagaagaaugg

SEQ ID NO: 13466 - RNA, 22 nt, Homo sapiens
guggaucacuugaggucaagag

SEQ ID NO: 13467 - RNA, 17 nt, Homo sapiens
gaaguguuucagcagcu

SEQ ID NO: 13468 - RNA, 22 nt, Homo sapiens
uuagaacaguguuugccucgcu

SEQ ID NO: 13469 - RNA, 19 nt, Homo sapiens
gcuuagagacaaaacauug

SEQ ID NO: 13470 - RNA, 22 nt, Homo sapiens
gaagcagcauucugguuuuugg

SEQ ID NO: 13471 - RNA, 22 nt, Homo sapiens
auggcuucuuacucuucugcau

SEQ ID NO: 13472 - RNA, 22 nt, Homo sapiens
aagagcauuggauggggagauu

SEQ ID NO: 13473 - RNA, 22 nt, Homo sapiens
cccuuagacuacuaauaugagc

SEQ ID NO: 13474 - RNA, 21 nt, Homo sapiens
uagcaaauugcuauuaaggca

SEQ ID NO: 13475 - RNA, 22 nt, Homo sapiens
gaugagguagaagacucagcaa

SEQ ID NO: 13476 - RNA, 22 nt, Homo sapiens
uggcagcgugaauguggcugaa

SEQ ID NO: 13477 - RNA, 22 nt, Homo sapiens
aaggaguauugaaugaccaagu

SEQ ID NO: 13478 - RNA, 22 nt, Homo sapiens
gauuucaucuuuagaggaagga

SEQ ID NO: 13479 - RNA, 22 nt, Homo sapiens
cugaccuaugauuuggcucaaa

SEQ ID NO: 13480 - RNA, 22 nt, Homo sapiens
uggaucauucuuucuugcaggg

SEQ ID NO: 13481 - RNA, 22 nt, Homo sapiens
cuauuagguuggggcgaaagua

SEQ ID NO: 13482 - RNA, 22 nt, Homo sapiens
augccaguguccagaguggguu

SEQ ID NO: 13483 - RNA, 22 nt, Homo sapiens
cauggcucuuugcugcuaaagu

SEQ ID NO: 13484 - RNA, 22 nt, Homo sapiens
cacugggccaucacuuaauauu

SEQ ID NO: 13485 - RNA, 22 nt, Homo sapiens
ucaagugauucuugugccuuag

SEQ ID NO: 13486 - RNA, 22 nt, Homo sapiens
uauugcucugacugauuggaug

SEQ ID NO: 13487 - RNA, 22 nt, Homo sapiens
ugugcaaauguuaaacuaacuu

SEQ ID NO: 13488 - RNA, 20 nt, Homo sapiens
cugagguacgaggguuaaau

SEQ ID NO: 13489 - RNA, 22 nt, Homo sapiens
uuguuugguugaguauggaagu

SEQ ID NO: 13490 - RNA, 22 nt, Homo sapiens
ucagcagugccccacucuacug

SEQ ID NO: 13491 - RNA, 22 nt, Homo sapiens
ugcagugugauuuucuggcuga

SEQ ID NO: 13492 - RNA, 22 nt, Homo sapiens
ccaguuuucccagcaccauuaa

SEQ ID NO: 13493 - RNA, 22 nt, Homo sapiens
augcaagacaccacgugagaau

SEQ ID NO: 13494 - RNA, 22 nt, Homo sapiens
ugccagaugcuggugugagggg

SEQ ID NO: 13495 - RNA, 22 nt, Homo sapiens
uuauucauuaauugcuaagguu

SEQ ID NO: 13496 - RNA, 19 nt, Homo sapiens
augacauuuggggguggac

SEQ ID NO: 13497 - RNA, 20 nt, Homo sapiens
acacuggcuuugagauuuag

SEQ ID NO: 13498 - RNA, 22 nt, Homo sapiens
uuucacguuggggaguugagug

SEQ ID NO: 13499 - RNA, 22 nt, Homo sapiens
ugcgccauugcacuccagccug

SEQ ID NO: 13500 - RNA, 22 nt, Homo sapiens
gagaucaaguauucuccacuaa

SEQ ID NO: 13501 - RNA, 22 nt, Homo sapiens
caaaggauucauuuccaggagu

SEQ ID NO: 13502 - RNA, 21 nt, Homo sapiens
uggaauuaauggagagguguu

SEQ ID NO: 13503 - RNA, 22 nt, Homo sapiens
gacauguuuacaguguugagag

SEQ ID NO: 13504 - RNA, 22 nt, Homo sapiens
ggugauauguugagguuuuggg

SEQ ID NO: 13505 - RNA, 22 nt, Homo sapiens
ugcuauagcuauaucaucuccu

SEQ ID NO: 13506 - RNA, 22 nt, Homo sapiens
ggagaucuuuguuaucuuuuga

SEQ ID NO: 13507 - RNA, 22 nt, Homo sapiens
ucuuugguaugugcaugugcuu

SEQ ID NO: 13508 - RNA, 22 nt, Homo sapiens
uuagaacagugcucaccacaaa

SEQ ID NO: 13509 - RNA, 22 nt, Homo sapiens
aucacaggucaaaucauuauuu

SEQ ID NO: 13510 - RNA, 22 nt, Homo sapiens
uagcaccacaaucaagauacag

SEQ ID NO: 13511 - RNA, 16 nt, Homo sapiens
uacaacagugaguaug

SEQ ID NO: 13512 - RNA, 22 nt, Homo sapiens
acugcacuccagccuucggaca

SEQ ID NO: 13513 - RNA, 22 nt, Homo sapiens
cugaggacaucagggaagcauc

SEQ ID NO: 13514 - RNA, 22 nt, Homo sapiens
uuucaccguguuggccaggcug

SEQ ID NO: 13515 - RNA, 22 nt, Homo sapiens
aaaugguguuaguagaucuuua

SEQ ID NO: 13516 - RNA, 22 nt, Homo sapiens
uggcauguauuuuguguauuaa

SEQ ID NO: 13517 - RNA, 22 nt, Homo sapiens
gucuggguuuguuuguacuugc

SEQ ID NO: 13518 - RNA, 22 nt, Homo sapiens
ugaguucuuuuacauuuugaau

SEQ ID NO: 13519 - RNA, 22 nt, Homo sapiens
aagcuguauuguguugcuauaa

SEQ ID NO: 13520 - RNA, 22 nt, Homo sapiens
ugagccaaguucacaccauugc

SEQ ID NO: 13521 - RNA, 21 nt, Homo sapiens
aggucaugaagauguucuaau

SEQ ID NO: 13522 - RNA, 22 nt, Homo sapiens
aucauguaguaagacacauuua

SEQ ID NO: 13523 - RNA, 22 nt, Homo sapiens
uauggcuaugggaacugggagu

SEQ ID NO: 13524 - RNA, 22 nt, Homo sapiens
uggcaagaaccacaguuacuuu

SEQ ID NO: 13525 - RNA, 22 nt, Homo sapiens
uugcacuccauccuggguugac

SEQ ID NO: 13526 - RNA, 22 nt, Homo sapiens
ugagacgaagucuugcucuguu

SEQ ID NO: 13527 - RNA, 22 nt, Homo sapiens
gugagguaagaguugcuuugcu

SEQ ID NO: 13528 - RNA, 21 nt, Homo sapiens
auggacaugguuaggcuuugu

SEQ ID NO: 13529 - RNA, 22 nt, Homo sapiens
uguccuguaggaggcagaacaa

SEQ ID NO: 13530 - RNA, 22 nt, Homo sapiens
ucucagugaauugguuuugucu

SEQ ID NO: 13531 - RNA, 22 nt, Homo sapiens
acacugucaugucucacaggca

SEQ ID NO: 13532 - RNA, 22 nt, Homo sapiens
gauacuggcuuuauagaaugau

SEQ ID NO: 13533 - RNA, 22 nt, Homo sapiens
uuaaucacagugucuuccuuca

SEQ ID NO: 13534 - RNA, 17 nt, Homo sapiens
ucuugugguucuugaau

SEQ ID NO: 13535 - RNA, 22 nt, Homo sapiens
uaucaaguguuagggagaugug

SEQ ID NO: 13536 - RNA, 20 nt, Homo sapiens
cagugcacuuucccacuggu

SEQ ID NO: 13537 - RNA, 22 nt, Homo sapiens
agguccauugguauuauagcau

SEQ ID NO: 13538 - RNA, 22 nt, Homo sapiens
ccuaggcacugggguccagccc

SEQ ID NO: 13539 - RNA, 22 nt, Homo sapiens
uugcaccacugcacuccacccu

SEQ ID NO: 13540 - RNA, 20 nt, Homo sapiens
augucaggaagggagucagg

SEQ ID NO: 13541 - RNA, 22 nt, Homo sapiens
aaagugcuaggauuaccugggg

SEQ ID NO: 13542 - RNA, 22 nt, Homo sapiens
ugugucuuguuuuuucccaggc

SEQ ID NO: 13543 - RNA, 22 nt, Homo sapiens
gugcacaacaugcagguuuguu

SEQ ID NO: 13544 - RNA, 22 nt, Homo sapiens
uuugagugugauaucgauugga

SEQ ID NO: 13545 - RNA, 22 nt, Homo sapiens
uguauacugucuaauauguugu

SEQ ID NO: 13546 - RNA, 22 nt, Homo sapiens
ggcucuguugcuaccaauuaag

SEQ ID NO: 13547 - RNA, 22 nt, Homo sapiens
uuucauggacgcaaugccuuuu

SEQ ID NO: 13548 - RNA, 22 nt, Homo sapiens
uuugcagagacuuguuaggaau

SEQ ID NO: 13549 - RNA, 22 nt, Homo sapiens
auagagguagacagaggggaaa

SEQ ID NO: 13550 - RNA, 22 nt, Homo sapiens
augaguaugagaauacauuaag

SEQ ID NO: 13551 - RNA, 22 nt, Homo sapiens
gaaugguuuacaaguguaaucu

SEQ ID NO: 13552 - RNA, 22 nt, Homo sapiens
agcaccauuagcguugggccgg

SEQ ID NO: 13553 - RNA, 18 nt, Homo sapiens
gacaguguggcaauuccu

SEQ ID NO: 13554 - RNA, 17 nt, Homo sapiens
ggcaggaauuaauguca

SEQ ID NO: 13555 - RNA, 22 nt, Homo sapiens
uggaguaggccuaagaaugaca

SEQ ID NO: 13556 - RNA, 22 nt, Homo sapiens
uugaucuggagagaggcccgug

SEQ ID NO: 13557 - RNA, 22 nt, Homo sapiens
ugugaacacagaggcuauggca

SEQ ID NO: 13558 - RNA, 22 nt, Homo sapiens
guauacuucugaaaauagcuau

SEQ ID NO: 13559 - RNA, 22 nt, Homo sapiens
uaucugcacuucugucuagguc

SEQ ID NO: 13560 - RNA, 17 nt, Homo sapiens
ggcaggauccaggaucc

SEQ ID NO: 13561 - RNA, 22 nt, Homo sapiens
aagaucauucagggaaggcuga

SEQ ID NO: 13562 - RNA, 22 nt, Homo sapiens
ugagacgaagucucguucugua

SEQ ID NO: 13563 - RNA, 22 nt, Homo sapiens
auucaccauggcuaccaagggu

SEQ ID NO: 13564 - RNA, 22 nt, Homo sapiens
cuaaucuagccuuauaaguauu

SEQ ID NO: 13565 - RNA, 22 nt, Homo sapiens
cuaauucuguaccuggcacaua

SEQ ID NO: 13566 - RNA, 22 nt, Homo sapiens
auuucacuucgcaugguguccg

SEQ ID NO: 13567 - RNA, 22 nt, Homo sapiens
aauaugguuuuaugaagcaauu

SEQ ID NO: 13568 - RNA, 22 nt, Homo sapiens
uagagauccuucacuaggggca

SEQ ID NO: 13569 - RNA, 22 nt, Homo sapiens
uagauuguuuaaguggcacaca

SEQ ID NO: 13570 - RNA, 22 nt, Homo sapiens
uuacuguagugucauaucguau

SEQ ID NO: 13571 - RNA, 22 nt, Homo sapiens
cuguggguuuuacuguuuuacu

SEQ ID NO: 13572 - RNA, 22 nt, Homo sapiens
gugguuuuuagauuucuacagu

SEQ ID NO: 13573 - RNA, 22 nt, Homo sapiens
cuguggauguauugcacagucu

SEQ ID NO: 13574 - RNA, 23 nt, Homo sapiens
ugguuuguaagagauggacugga

SEQ ID NO: 13575 - RNA, 23 nt, Homo sapiens
uggcauuuuaguuagcuucagug

SEQ ID NO: 13576 - RNA, 22 nt, Homo sapiens
cugugcauggauuuuaagauug

SEQ ID NO: 13577 - RNA, 22 nt, Homo sapiens
augugcacauucugguaaauau

SEQ ID NO: 13578 - RNA, 20 nt, Homo sapiens
uggcaagauggcagaauaga

SEQ ID NO: 13579 - RNA, 22 nt, Homo sapiens
aaguggccuagagcgaccauuu

SEQ ID NO: 13580 - RNA, 22 nt, Homo sapiens
ucaaacugucagguugaccaga

SEQ ID NO: 13581 - RNA, 22 nt, Homo sapiens
ugccaagauuucaggaauuaag

SEQ ID NO: 13582 - RNA, 22 nt, Homo sapiens
uugaagacuaauuuagauaaug

SEQ ID NO: 13583 - RNA, 22 nt, Homo sapiens
uuugggcuuuuaaucuagagca

SEQ ID NO: 13584 - RNA, 22 nt, Homo sapiens
ugggcaagugacuuggcuucuc

SEQ ID NO: 13585 - RNA, 21 nt, Homo sapiens
ucacagccuaggaccugaaga

SEQ ID NO: 13586 - RNA, 22 nt, Homo sapiens
uguggcaaauggucaggaagaa

SEQ ID NO: 13587 - RNA, 22 nt, Homo sapiens
gagauaggauucacuuucaugu

SEQ ID NO: 13588 - RNA, 22 nt, Homo sapiens
gcccaguagcaguacaucccuu

SEQ ID NO: 13589 - RNA, 22 nt, Homo sapiens
ucuccaguuuccuucgucuauc

SEQ ID NO: 13590 - RNA, 22 nt, Homo sapiens
ugagcaucucuaaaaggagcaa

SEQ ID NO: 13591 - RNA, 22 nt, Homo sapiens
gaagugguaggauugcuuuuga

SEQ ID NO: 13592 - RNA, 22 nt, Homo sapiens
augccacuguccuccugccuag

SEQ ID NO: 13593 - RNA, 22 nt, Homo sapiens
acccguuacuuagcagaccagg

SEQ ID NO: 13594 - RNA, 16 nt, Homo sapiens
cacauugcugcauggc

SEQ ID NO: 13595 - RNA, 22 nt, Homo sapiens
uuauucugucuuuggucucaau

SEQ ID NO: 13596 - RNA, 22 nt, Homo sapiens
acugcacuccaaccuguugggc

SEQ ID NO: 13597 - RNA, 22 nt, Homo sapiens
cauugcccuccagccugggcaa

SEQ ID NO: 13598 - RNA, 22 nt, Homo sapiens
uugcuucauucaacauugaggg

SEQ ID NO: 13599 - RNA, 22 nt, Homo sapiens
gcuggaauuaacauagaugugc

SEQ ID NO: 13600 - RNA, 22 nt, Homo sapiens
aaguguaugaaacaguccaugg

SEQ ID NO: 13601 - RNA, 20 nt, Homo sapiens
agagugcuggacugaggagc

SEQ ID NO: 13602 - RNA, 22 nt, Homo sapiens
ggcaugaggccauaaaaguaag

SEQ ID NO: 13603 - RNA, 22 nt, Homo sapiens
cagauacucauggaacuggguu

SEQ ID NO: 13604 - RNA, 17 nt, Homo sapiens
ucucccaucccuuucuc

SEQ ID NO: 13605 - RNA, 22 nt, Homo sapiens
ugcauuguuuagaaacacuggg

SEQ ID NO: 13606 - RNA, 22 nt, Homo sapiens
uccuucaguccaguggguuuug

SEQ ID NO: 13607 - RNA, 22 nt, Homo sapiens
agugagcugcagucuggggucc

SEQ ID NO: 13608 - RNA, 22 nt, Homo sapiens
agcaagaaugaacucucccaga

SEQ ID NO: 13609 - RNA, 22 nt, Homo sapiens
aaguggaauguuuguggcacaa

SEQ ID NO: 13610 - RNA, 22 nt, Homo sapiens
uguaugguuauuuguggauggu

SEQ ID NO: 13611 - RNA, 22 nt, Homo sapiens
ugaguagauccaagacuguccu

SEQ ID NO: 13612 - RNA, 22 nt, Homo sapiens
ucugugguucuagcuacuuugg

SEQ ID NO: 13613 - RNA, 22 nt, Homo sapiens
uccuugagccuuaaauuauaaa

SEQ ID NO: 13614 - RNA, 22 nt, Homo sapiens
uaaagcuacaguauaugguauu

SEQ ID NO: 13615 - RNA, 22 nt, Homo sapiens
cuaauacaguuguccaagcugg

SEQ ID NO: 13616 - RNA, 22 nt, Homo sapiens
uuaacagugucaaucuguagua

SEQ ID NO: 13617 - RNA, 22 nt, Homo sapiens
uagucacacacucaacuuuuca

SEQ ID NO: 13618 - RNA, 22 nt, Homo sapiens
uaaugcacauuuauuuuaccuu

SEQ ID NO: 13619 - RNA, 22 nt, Homo sapiens
uuugcaucuuagaaaguucucc

SEQ ID NO: 13620 - RNA, 20 nt, Homo sapiens
auucauggaggagcaauugg

SEQ ID NO: 13621 - RNA, 22 nt, Homo sapiens
auggaacauuauagauguaaaa

SEQ ID NO: 13622 - RNA, 22 nt, Homo sapiens
aauugcaauggacaaugcagca

SEQ ID NO: 13623 - RNA, 22 nt, Homo sapiens
uacugcaucuacuuagagccag

SEQ ID NO: 13624 - RNA, 22 nt, Homo sapiens
acugaguguugauuuagauuaa

SEQ ID NO: 13625 - RNA, 22 nt, Homo sapiens
ugcaccacugcacuccagcuug

SEQ ID NO: 13626 - RNA, 22 nt, Homo sapiens
uggguucccugucuguccuuga

SEQ ID NO: 13627 - RNA, 22 nt, Homo sapiens
uauagcaaugccccacuccuga

SEQ ID NO: 13628 - RNA, 22 nt, Homo sapiens
uucauggacucaauaguuucgc

SEQ ID NO: 13629 - RNA, 22 nt, Homo sapiens
ucccaguguguagcuugucucu

SEQ ID NO: 13630 - RNA, 22 nt, Homo sapiens
ugagcugagaucuuaccacugc

SEQ ID NO: 13631 - RNA, 22 nt, Homo sapiens
cuuuuggucuaucagagaagca

SEQ ID NO: 13632 - RNA, 22 nt, Homo sapiens
augagaugauaggcguucuaac

SEQ ID NO: 13633 - RNA, 22 nt, Homo sapiens
gccauugcacuccagccugagc

SEQ ID NO: 13634 - RNA, 18 nt, Homo sapiens
uaaauugcuucaccugag

SEQ ID NO: 13635 - RNA, 22 nt, Homo sapiens
uagagguucuaagauucucaga

SEQ ID NO: 13636 - RNA, 22 nt, Homo sapiens
aucauugugugaguugauggga

SEQ ID NO: 13637 - RNA, 22 nt, Homo sapiens
cuagucacaggaguugaaggau

SEQ ID NO: 13638 - RNA, 22 nt, Homo sapiens
uuggccccuccaaaucucaugu

SEQ ID NO: 13639 - RNA, 22 nt, Homo sapiens
gguaucuuggagagagaaguga

SEQ ID NO: 13640 - RNA, 22 nt, Homo sapiens
caguacaauguugauuagaagu

SEQ ID NO: 13641 - RNA, 22 nt, Homo sapiens
ugugccaaucauagggcuuggu

SEQ ID NO: 13642 - RNA, 22 nt, Homo sapiens
ugcaagacugcaguuacuuuug

SEQ ID NO: 13643 - RNA, 22 nt, Homo sapiens
augugcaauggugucaccacau

SEQ ID NO: 13644 - RNA, 22 nt, Homo sapiens
auacacgugccuuguuggugua

SEQ ID NO: 13645 - RNA, 22 nt, Homo sapiens
ugucuggaguccauagaagugu

SEQ ID NO: 13646 - RNA, 22 nt, Homo sapiens
ugagaacagauggcuuuauuau

SEQ ID NO: 13647 - RNA, 22 nt, Homo sapiens
cagccgggugagguggcuuguu

SEQ ID NO: 13648 - RNA, 22 nt, Homo sapiens
uggcuguuuauuucacgugggu

SEQ ID NO: 13649 - RNA, 22 nt, Homo sapiens
uagcauccuucucuaaacagga

SEQ ID NO: 13650 - RNA, 22 nt, Homo sapiens
uucugugcugaaucaaagacug

SEQ ID NO: 13651 - RNA, 23 nt, Homo sapiens
gaaguauagcaugcacauggaaa

SEQ ID NO: 13652 - RNA, 22 nt, Homo sapiens
augaaaguguguggaaacuuga

SEQ ID NO: 13653 - RNA, 21 nt, Homo sapiens
ggaauguugccagcagccaga

SEQ ID NO: 13654 - RNA, 22 nt, Homo sapiens
uugugguaggaugaagagauga

SEQ ID NO: 13655 - RNA, 22 nt, Homo sapiens
uaugguuuuaagguuaaggacu

SEQ ID NO: 13656 - RNA, 22 nt, Homo sapiens
uucacagccgcaccccaucacu

SEQ ID NO: 13657 - RNA, 22 nt, Homo sapiens
ccugcauugucaaggccaagcc

SEQ ID NO: 13658 - RNA, 23 nt, Homo sapiens
aaggacacugaacacuucccagc

SEQ ID NO: 13659 - RNA, 22 nt, Homo sapiens
ucuggcacucagaggccuugcu

SEQ ID NO: 13660 - RNA, 22 nt, Homo sapiens
aucugauggagagcguguggcu

SEQ ID NO: 13661 - RNA, 22 nt, Homo sapiens
ucugugcuugucauaugcuuug

SEQ ID NO: 13662 - RNA, 22 nt, Homo sapiens
augcaagacaccgauuagcuuu

SEQ ID NO: 13663 - RNA, 23 nt, Homo sapiens
agaugcauucuuguaggauauau

SEQ ID NO: 13664 - RNA, 22 nt, Homo sapiens
uaaucucagcuacucaggaggc

SEQ ID NO: 13665 - RNA, 22 nt, Homo sapiens
aauggcacaagaguaaacuguu

SEQ ID NO: 13666 - RNA, 22 nt, Homo sapiens
agaugguguuuucucaccagau

SEQ ID NO: 13667 - RNA, 22 nt, Homo sapiens
guggcaguuuuaaauaugaaaa

SEQ ID NO: 13668 - RNA, 22 nt, Homo sapiens
uagcaguauacguacugggucc

SEQ ID NO: 13669 - RNA, 22 nt, Homo sapiens
ucuuuggauggaaauuggaguc

SEQ ID NO: 13670 - RNA, 22 nt, Homo sapiens
uguguacaucucuacacacaug

SEQ ID NO: 13671 - RNA, 22 nt, Homo sapiens
gugauguguuuguucuaucucu

SEQ ID NO: 13672 - RNA, 22 nt, Homo sapiens
uuggcuauagauacauggauua

SEQ ID NO: 13673 - RNA, 22 nt, Homo sapiens
uuaagcugaauuuaagcuucgg

SEQ ID NO: 13674 - RNA, 22 nt, Homo sapiens
uuguguuuuuaguagggaaggg

SEQ ID NO: 13675 - RNA, 18 nt, Homo sapiens
uucaguuuguaucugggg

SEQ ID NO: 13676 - RNA, 22 nt, Homo sapiens
ucagugaacgaggaggagggug

SEQ ID NO: 13677 - RNA, 22 nt, Homo sapiens
auggcucaguguguaucuauca

SEQ ID NO: 13678 - RNA, 22 nt, Homo sapiens
augcacaucagcuccagggacc

SEQ ID NO: 13679 - RNA, 22 nt, Homo sapiens
augauauguuuguagcuaucuc

SEQ ID NO: 13680 - RNA, 22 nt, Homo sapiens
gaaggcacugugugccacccug

SEQ ID NO: 13681 - RNA, 22 nt, Homo sapiens
uuugcacuggagauucaauggg

SEQ ID NO: 13682 - RNA, 21 nt, Homo sapiens
uaacccugaaggagcucugga

SEQ ID NO: 13683 - RNA, 22 nt, Homo sapiens
gagaacuaaugauguacuaggc

SEQ ID NO: 13684 - RNA, 22 nt, Homo sapiens
ucacgcugcugcaaccagccug

SEQ ID NO: 13685 - RNA, 22 nt, Homo sapiens
cauugcacuccauccuuggcaa

SEQ ID NO: 13686 - RNA, 22 nt, Homo sapiens
guuacagucuuguguaagguua

SEQ ID NO: 13687 - RNA, 22 nt, Homo sapiens
uggaaguauagauaauugaaag

SEQ ID NO: 13688 - RNA, 22 nt, Homo sapiens
auggcuguuccugggaguucua

SEQ ID NO: 13689 - RNA, 22 nt, Homo sapiens
uaagugcuugacuuugauguuu

SEQ ID NO: 13690 - RNA, 22 nt, Homo sapiens
gagauauuuagaaauguguucu

SEQ ID NO: 13691 - RNA, 22 nt, Homo sapiens
uuagcagugugagcacagacua

SEQ ID NO: 13692 - RNA, 22 nt, Homo sapiens
uaucacggaguacauguucugu

SEQ ID NO: 13693 - RNA, 22 nt, Homo sapiens
auuccaguuugugagaagcugu

SEQ ID NO: 13694 - RNA, 22 nt, Homo sapiens
ugugaucaugcuccaggcgaga

SEQ ID NO: 13695 - RNA, 22 nt, Homo sapiens
uggaaaguacuugaguuuguau

SEQ ID NO: 13696 - RNA, 22 nt, Homo sapiens
ugaauauguuucuaaaagugca

SEQ ID NO: 13697 - RNA, 22 nt, Homo sapiens
uucuuugguacaagggccgacc

SEQ ID NO: 13698 - RNA, 22 nt, Homo sapiens
gagguguaaggacaacagagac

SEQ ID NO: 13699 - RNA, 23 nt, Homo sapiens
ucugguguugucaaaugcugguu

SEQ ID NO: 13700 - RNA, 22 nt, Homo sapiens
uuucccuuugcuuugucagcca

SEQ ID NO: 13701 - RNA, 22 nt, Homo sapiens
ugacuagggcucuaaacagcuc

SEQ ID NO: 13702 - RNA, 22 nt, Homo sapiens
gaaugcuaagcaugugggaguu

SEQ ID NO: 13703 - RNA, 22 nt, Homo sapiens
uugcaacuuagaaaaaucauuu

SEQ ID NO: 13704 - RNA, 22 nt, Homo sapiens
uaaagccauugucaaguuugua

SEQ ID NO: 13705 - RNA, 22 nt, Homo sapiens
ugauagugccuuuuauaucucu

SEQ ID NO: 13706 - RNA, 22 nt, Homo sapiens
agugcaaagccgagguuucuug

SEQ ID NO: 13707 - RNA, 22 nt, Homo sapiens
gugggauaauuuuuggugcugu

SEQ ID NO: 13708 - RNA, 22 nt, Homo sapiens
ugaauauguuaaauaauguucu

SEQ ID NO: 13709 - RNA, 22 nt, Homo sapiens
guccaaauccaugggauguaca

SEQ ID NO: 13710 - RNA, 19 nt, Homo sapiens
gauagacaucacagugcca

SEQ ID NO: 13711 - RNA, 22 nt, Homo sapiens
cccugaagauacagaguuuggg

SEQ ID NO: 13712 - RNA, 22 nt, Homo sapiens
aucaccgugggagauccugccu

SEQ ID NO: 13713 - RNA, 22 nt, Homo sapiens
augauaucuuguuuuucaugca

SEQ ID NO: 13714 - RNA, 22 nt, Homo sapiens
ucacaauggcugaacuaauuua

SEQ ID NO: 13715 - RNA, 22 nt, Homo sapiens
uggagcccuaguuccucauaac

SEQ ID NO: 13716 - RNA, 22 nt, Homo sapiens
ugagggcguauccuucauuaag

SEQ ID NO: 13717 - RNA, 17 nt, Homo sapiens
ugaccacugauucuacu

SEQ ID NO: 13718 - RNA, 22 nt, Homo sapiens
uagggcuugugaucagguguag

SEQ ID NO: 13719 - RNA, 22 nt, Homo sapiens
ggcaguggaagugccaguuucu

SEQ ID NO: 13720 - RNA, 22 nt, Homo sapiens
ggagaguaauuagacugaaaga

SEQ ID NO: 13721 - RNA, 22 nt, Homo sapiens
uggcaaaaaaccgcaguugccu

SEQ ID NO: 13722 - RNA, 22 nt, Homo sapiens
gcgagcauuguaggaaguucag

SEQ ID NO: 13723 - RNA, 22 nt, Homo sapiens
uuaaacugcuugaauuggguuu

SEQ ID NO: 13724 - RNA, 22 nt, Homo sapiens
ugcuagaugaaguuugaguuuu

SEQ ID NO: 13725 - RNA, 22 nt, Homo sapiens
uaucucagaugagacuuguaac

SEQ ID NO: 13726 - RNA, 19 nt, Homo sapiens
ucuguaguuagggcuacag

SEQ ID NO: 13727 - RNA, 22 nt, Homo sapiens
uugcuuagagccaaucuugauu

SEQ ID NO: 13728 - RNA, 22 nt, Homo sapiens
agugccacugcacucuagccug

SEQ ID NO: 13729 - RNA, 22 nt, Homo sapiens
auacagucuguuagauuuccuc

SEQ ID NO: 13730 - RNA, 22 nt, Homo sapiens
aagguauuuuugucuauaucuu

SEQ ID NO: 13731 - RNA, 22 nt, Homo sapiens
ucacugaaaccgccuccaccuc

SEQ ID NO: 13732 - RNA, 22 nt, Homo sapiens
uuuggcacuguaaauuucucuu

SEQ ID NO: 13733 - RNA, 22 nt, Homo sapiens
ccagugcugugcaguguaugag

SEQ ID NO: 13734 - RNA, 22 nt, Homo sapiens
guucacaguucagccuguaaca

SEQ ID NO: 13735 - RNA, 22 nt, Homo sapiens
uucagauugcauaccgaaagua

SEQ ID NO: 13736 - RNA, 21 nt, Homo sapiens
ugcuccauuuucuagccugaa

SEQ ID NO: 13737 - RNA, 22 nt, Homo sapiens
gcuuguguucaagucacccuua

SEQ ID NO: 13738 - RNA, 17 nt, Homo sapiens
auguauacauccaugua

SEQ ID NO: 13739 - RNA, 22 nt, Homo sapiens
uaaucacagagguuuggccuca

SEQ ID NO: 13740 - RNA, 22 nt, Homo sapiens
uuuugcucuugguaaugaaaga

SEQ ID NO: 13741 - RNA, 22 nt, Homo sapiens
cucacaaccuuaugaagcauga

SEQ ID NO: 13742 - RNA, 22 nt, Homo sapiens
aagagugucuuugugcuggccc

SEQ ID NO: 13743 - RNA, 22 nt, Homo sapiens
uuauaaacaugaagauuugggg

SEQ ID NO: 13744 - RNA, 20 nt, Homo sapiens
agcaucagugguaguguugc

SEQ ID NO: 13745 - RNA, 22 nt, Homo sapiens
aaccuuuagucagcucuuagga

SEQ ID NO: 13746 - RNA, 22 nt, Homo sapiens
uucagcaaugacagccuauaua

SEQ ID NO: 13747 - RNA, 22 nt, Homo sapiens
uuauaacagagacuccugugcu

SEQ ID NO: 13748 - RNA, 22 nt, Homo sapiens
gucaggugcuuacgcggagauc

SEQ ID NO: 13749 - RNA, 20 nt, Homo sapiens
cuggaucaucaguaaaguua

SEQ ID NO: 13750 - RNA, 22 nt, Homo sapiens
ugagaucuuugcuguccucacc

SEQ ID NO: 13751 - RNA, 18 nt, Homo sapiens
guauuccagccugaguga

SEQ ID NO: 13752 - RNA, 22 nt, Homo sapiens
uuuguaagaugcauagauugca

SEQ ID NO: 13753 - RNA, 22 nt, Homo sapiens
guacaguuuagugcuuugagaa

SEQ ID NO: 13754 - RNA, 22 nt, Homo sapiens
ggugacagugguuaaaauuugu

SEQ ID NO: 13755 - RNA, 22 nt, Homo sapiens
guagcagcaauuuacuccauac

SEQ ID NO: 13756 - RNA, 22 nt, Homo sapiens
ggacuguacuccuggccagugu

SEQ ID NO: 13757 - RNA, 22 nt, Homo sapiens
gugcaaauguuauugagguuuu

SEQ ID NO: 13758 - RNA, 20 nt, Homo sapiens
ucagcagucuggagcagagg

SEQ ID NO: 13759 - RNA, 22 nt, Homo sapiens
uagaccauucuauuuccuaugc

SEQ ID NO: 13760 - RNA, 22 nt, Homo sapiens
ggacaagagacugggacacuga

SEQ ID NO: 13761 - RNA, 22 nt, Homo sapiens
uaaagugaggauggcaguaggu

SEQ ID NO: 13762 - RNA, 22 nt, Homo sapiens
uagcaggaaaccuguguugagg

SEQ ID NO: 13763 - RNA, 22 nt, Homo sapiens
agcuaguauuuucuuaaggauu

SEQ ID NO: 13764 - RNA, 22 nt, Homo sapiens
ugggcaagagagcaugacccug

SEQ ID NO: 13765 - RNA, 22 nt, Homo sapiens
agcagcuuugcauggccugugg

SEQ ID NO: 13766 - RNA, 20 nt, Homo sapiens
uacccgugaauguuuauucu

SEQ ID NO: 13767 - RNA, 22 nt, Homo sapiens
cccaguguguuguggauauuua

SEQ ID NO: 13768 - RNA, 22 nt, Homo sapiens
aauuugucaccucucucccuuu

SEQ ID NO: 13769 - RNA, 22 nt, Homo sapiens
uugugaauggugccgcaauaaa

SEQ ID NO: 13770 - RNA, 22 nt, Homo sapiens
agcagcgacacccuguggugag

SEQ ID NO: 13771 - RNA, 22 nt, Homo sapiens
ugagguuauuuguucaagaagu

SEQ ID NO: 13772 - RNA, 22 nt, Homo sapiens
agcugauuuuaaguccuugucc

SEQ ID NO: 13773 - RNA, 22 nt, Homo sapiens
ucuuagugcggcugcugcagcc

SEQ ID NO: 13774 - RNA, 22 nt, Homo sapiens
uauagcacugaaagaggugauu

SEQ ID NO: 13775 - RNA, 21 nt, Homo sapiens
uuaacagacaagugucuuccc

SEQ ID NO: 13776 - RNA, 18 nt, Homo sapiens
ugugacauugagcauguc

SEQ ID NO: 13777 - RNA, 22 nt, Homo sapiens
cuuuuugcugcagcaauacugg

SEQ ID NO: 13778 - RNA, 22 nt, Homo sapiens
cugaguauuugaggccgaagga

SEQ ID NO: 13779 - RNA, 22 nt, Homo sapiens
uugagcuccucucaaccuaagg

SEQ ID NO: 13780 - RNA, 22 nt, Homo sapiens
agugcacucuuuccucucuuac

SEQ ID NO: 13781 - RNA, 22 nt, Homo sapiens
aauaaagcaggguccuugcacu

SEQ ID NO: 13782 - RNA, 22 nt, Homo sapiens
uacugcacauaugaagguuccc

SEQ ID NO: 13783 - RNA, 22 nt, Homo sapiens
uuuggcagaaaacuaaaaggua

SEQ ID NO: 13784 - RNA, 22 nt, Homo sapiens
uucuugcacugaucccauaagc

SEQ ID NO: 13785 - RNA, 22 nt, Homo sapiens
cugguuguucuggaugggcagg

SEQ ID NO: 13786 - RNA, 22 nt, Homo sapiens
ugacuggagucuugcucugucg

SEQ ID NO: 13787 - RNA, 21 nt, Homo sapiens
uggcuauuucuguggcauaca

SEQ ID NO: 13788 - RNA, 22 nt, Homo sapiens
aaacugcuuuccaugguggcug

SEQ ID NO: 13789 - RNA, 22 nt, Homo sapiens
ucagaucauuaagguagguuua

SEQ ID NO: 13790 - RNA, 18 nt, Homo sapiens
ugacaguuucuuuauauu

SEQ ID NO: 13791 - RNA, 22 nt, Homo sapiens
acugcacuccaaccuuggugac

SEQ ID NO: 13792 - RNA, 22 nt, Homo sapiens
ucgcgccauucuccugccucag

SEQ ID NO: 13793 - RNA, 22 nt, Homo sapiens
auaacauccuuucuuaucguug

SEQ ID NO: 13794 - RNA, 22 nt, Homo sapiens
aaggagcuaagagaucauacau

SEQ ID NO: 13795 - RNA, 22 nt, Homo sapiens
uggagucuugaugauuuucaaa

SEQ ID NO: 13796 - RNA, 19 nt, Homo sapiens
uggaccccuuccuuacacc

SEQ ID NO: 13797 - RNA, 22 nt, Homo sapiens
ucauugagacuuguuuuguggc

SEQ ID NO: 13798 - RNA, 22 nt, Homo sapiens
uuaccagucugauaaacagaaa

SEQ ID NO: 13799 - RNA, 22 nt, Homo sapiens
ugcuggugauucagauucaaau

SEQ ID NO: 13800 - RNA, 22 nt, Homo sapiens
uaaggcaaaccuuggcugcagu

SEQ ID NO: 13801 - RNA, 20 nt, Homo sapiens
uugcugguguuagaggaggc

SEQ ID NO: 13802 - RNA, 22 nt, Homo sapiens
gucaguucuugugguugcauuc

SEQ ID NO: 13803 - RNA, 22 nt, Homo sapiens
uucuuagguuaaggcugagaga

SEQ ID NO: 13804 - RNA, 21 nt, Homo sapiens
ugaaguagcauaggaugucaa

SEQ ID NO: 13805 - RNA, 19 nt, Homo sapiens
ugccauguaacaggaaaau

SEQ ID NO: 13806 - RNA, 22 nt, Homo sapiens
auguaacacagugcggcugggc

SEQ ID NO: 13807 - RNA, 22 nt, Homo sapiens
uaucacuuugauaguuuaaaug

SEQ ID NO: 13808 - RNA, 22 nt, Homo sapiens
uuucaucaagcacagaguagau

SEQ ID NO: 13809 - RNA, 22 nt, Homo sapiens
cuuggcacgugauagguguuga

SEQ ID NO: 13810 - RNA, 22 nt, Homo sapiens
aucagcagcaugaaaacggacu

SEQ ID NO: 13811 - RNA, 22 nt, Homo sapiens
uccugagacucacaggcucccc

SEQ ID NO: 13812 - RNA, 21 nt, Homo sapiens
uugagguaaaauccuauggga

SEQ ID NO: 13813 - RNA, 22 nt, Homo sapiens
auagcccuuuucuaacuaugug

SEQ ID NO: 13814 - RNA, 22 nt, Homo sapiens
ugugaugguuuggaagcuucuu

SEQ ID NO: 13815 - RNA, 22 nt, Homo sapiens
uugaccuaugggaguuugacua

SEQ ID NO: 13816 - RNA, 22 nt, Homo sapiens
cacaaaguagauuagucuucca

SEQ ID NO: 13817 - RNA, 22 nt, Homo sapiens
auugcacuccagccuagguaac

SEQ ID NO: 13818 - RNA, 22 nt, Homo sapiens
cuccauuuaguccuuuuagaag

SEQ ID NO: 13819 - RNA, 22 nt, Homo sapiens
gauguguugggaagauuucaag

SEQ ID NO: 13820 - RNA, 22 nt, Homo sapiens
cugucacugggaggggcagcag

SEQ ID NO: 13821 - RNA, 22 nt, Homo sapiens
uuagguacuuuggagagauuca

SEQ ID NO: 13822 - RNA, 22 nt, Homo sapiens
uuggcaaguuucugucagcaaa

SEQ ID NO: 13823 - RNA, 22 nt, Homo sapiens
caaaggcuguuauaggccagga

SEQ ID NO: 13824 - RNA, 22 nt, Homo sapiens
cuugcacucagaagauucaguu

SEQ ID NO: 13825 - RNA, 22 nt, Homo sapiens
aauacuggcacugaagaccaug

SEQ ID NO: 13826 - RNA, 23 nt, Homo sapiens
ugacugaguauauguuuggugcu

SEQ ID NO: 13827 - RNA, 22 nt, Homo sapiens
ugaaguagguucucguaucgcc

SEQ ID NO: 13828 - RNA, 22 nt, Homo sapiens
uuagaugguucaccaugaguag

SEQ ID NO: 13829 - RNA, 22 nt, Homo sapiens
uagagguauuaacaguagaaga

SEQ ID NO: 13830 - RNA, 22 nt, Homo sapiens
uucauguaaucaaggcagcuaa

SEQ ID NO: 13831 - RNA, 22 nt, Homo sapiens
ucgguauuuuagaauugagacu

SEQ ID NO: 13832 - RNA, 22 nt, Homo sapiens
ggcaaaauggccagugggucac

SEQ ID NO: 13833 - RNA, 22 nt, Homo sapiens
ugagacggagucuugcccuguc

SEQ ID NO: 13834 - RNA, 22 nt, Homo sapiens
cucuuuuguuuagcugagaggg

SEQ ID NO: 13835 - RNA, 22 nt, Homo sapiens
auaaaugccuguuguuuuaagc

SEQ ID NO: 13836 - RNA, 22 nt, Homo sapiens
uacagaucaguuauuuuguaga

SEQ ID NO: 13837 - RNA, 22 nt, Homo sapiens
auccauguggauaaauguguau

SEQ ID NO: 13838 - RNA, 22 nt, Homo sapiens
augucuagagcaagagaugcug

SEQ ID NO: 13839 - RNA, 22 nt, Homo sapiens
ucucugaaacucuugacauccu

SEQ ID NO: 13840 - RNA, 22 nt, Homo sapiens
gguauugguugagauuaacuuu

SEQ ID NO: 13841 - RNA, 16 nt, Homo sapiens
ucccugugacaugugc

SEQ ID NO: 13842 - RNA, 22 nt, Homo sapiens
ggugccuacugugugucaggca

SEQ ID NO: 13843 - RNA, 22 nt, Homo sapiens
aucaccuggaguagcccguccc

SEQ ID NO: 13844 - RNA, 22 nt, Homo sapiens
ugaauggauccaauucuuagua

SEQ ID NO: 13845 - RNA, 21 nt, Homo sapiens
cuuuuuacucguucauaugca

SEQ ID NO: 13846 - RNA, 22 nt, Homo sapiens
uuccuaguccugagucucugcg

SEQ ID NO: 13847 - RNA, 23 nt, Homo sapiens
uuguccccuccaaagcucauguu

SEQ ID NO: 13848 - RNA, 22 nt, Homo sapiens
ggaagacaguguggugauuccu

SEQ ID NO: 13849 - RNA, 22 nt, Homo sapiens
uggcagaugcucuuggugccca

SEQ ID NO: 13850 - RNA, 21 nt, Homo sapiens
uaggccgggugcaggaugcuu

SEQ ID NO: 13851 - RNA, 21 nt, Homo sapiens
ucaugccacugcacuuuagcc

SEQ ID NO: 13852 - RNA, 22 nt, Homo sapiens
aaucugguguguggccgggcac

SEQ ID NO: 13853 - RNA, 22 nt, Homo sapiens
ugugcaccucuucacacaggga

SEQ ID NO: 13854 - RNA, 22 nt, Homo sapiens
aucuuugcugagaugcauggca

SEQ ID NO: 13855 - RNA, 22 nt, Homo sapiens
ccaaguguuuucauuguuccau

SEQ ID NO: 13856 - RNA, 22 nt, Homo sapiens
ccacaaccuccauauccugggu

SEQ ID NO: 13857 - RNA, 22 nt, Homo sapiens
guuauauguuuggaaugaggaa

SEQ ID NO: 13858 - RNA, 22 nt, Homo sapiens
auagugcuauggcagaccuuga

SEQ ID NO: 13859 - RNA, 22 nt, Homo sapiens
uaggagcacaaacccuacugug

SEQ ID NO: 13860 - RNA, 22 nt, Homo sapiens
ugaauguccauugauguuuuga

SEQ ID NO: 13861 - RNA, 22 nt, Homo sapiens
acugagaucuuuaaauaaauaa

SEQ ID NO: 13862 - RNA, 22 nt, Homo sapiens
cuggaaggaaaaacaaccacag

SEQ ID NO: 13863 - RNA, 22 nt, Homo sapiens
accgaguguucucccgcagcgg

SEQ ID NO: 13864 - RNA, 22 nt, Homo sapiens
ggagugugauuguucucuguua

SEQ ID NO: 13865 - RNA, 21 nt, Homo sapiens
uuugcauauguugaaccagcc

SEQ ID NO: 13866 - RNA, 23 nt, Homo sapiens
ugagaugucugauugcgaggguc

SEQ ID NO: 13867 - RNA, 22 nt, Homo sapiens
acagaccuauuucaaucauuua

SEQ ID NO: 13868 - RNA, 22 nt, Homo sapiens
uucuaugguuaccaggcuaguc

SEQ ID NO: 13869 - RNA, 22 nt, Homo sapiens
ucacugcgaccuccaccucccg

SEQ ID NO: 13870 - RNA, 22 nt, Homo sapiens
ccauggcuucugcauucuguca

SEQ ID NO: 13871 - RNA, 22 nt, Homo sapiens
caaagucuucucauuaugucuu

SEQ ID NO: 13872 - RNA, 19 nt, Homo sapiens
aagugguuuaaacuuguau

SEQ ID NO: 13873 - RNA, 22 nt, Homo sapiens
uuaccucuguggcucucggacu

SEQ ID NO: 13874 - RNA, 22 nt, Homo sapiens
uucgagagaaaaggcauauaug

SEQ ID NO: 13875 - RNA, 22 nt, Homo sapiens
uagcugcauccugugcacucaa

SEQ ID NO: 13876 - RNA, 22 nt, Homo sapiens
ucuuggacuuuugugagaaauc

SEQ ID NO: 13877 - RNA, 22 nt, Homo sapiens
gugagguagagcaugugaaaga

SEQ ID NO: 13878 - RNA, 22 nt, Homo sapiens
guagaggaauggcuccaccaua

SEQ ID NO: 13879 - RNA, 16 nt, Homo sapiens
accuguacagcaugug

SEQ ID NO: 13880 - RNA, 22 nt, Homo sapiens
uuugcacuugaaaacacucuca

SEQ ID NO: 13881 - RNA, 22 nt, Homo sapiens
ccccugaaacucacucauuauc

SEQ ID NO: 13882 - RNA, 22 nt, Homo sapiens
ugucucggagaucucucaaagu

SEQ ID NO: 13883 - RNA, 22 nt, Homo sapiens
ugagaugaagugauguaaaaca

SEQ ID NO: 13884 - RNA, 22 nt, Homo sapiens
uugaccacugggcacaguaagu

SEQ ID NO: 13885 - RNA, 22 nt, Homo sapiens
aaaagcuuagaugggcuuguau

SEQ ID NO: 13886 - RNA, 22 nt, Homo sapiens
caguagcaugccucagaaugag

SEQ ID NO: 13887 - RNA, 22 nt, Homo sapiens
uggcaauaaaaugcaguuacuu

SEQ ID NO: 13888 - RNA, 21 nt, Homo sapiens
uggcuuauuugaaucuggcuu

SEQ ID NO: 13889 - RNA, 22 nt, Homo sapiens
uuaugucuuuuguguucagcua

SEQ ID NO: 13890 - RNA, 22 nt, Homo sapiens
cuaacuaugucucaggaugucc

SEQ ID NO: 13891 - RNA, 22 nt, Homo sapiens
uuuggacuucuagccuccagag

SEQ ID NO: 13892 - RNA, 22 nt, Homo sapiens
aagagaacugacaguaccuggg

SEQ ID NO: 13893 - RNA, 22 nt, Homo sapiens
cacaguagaauagagcacuagg

SEQ ID NO: 13894 - RNA, 22 nt, Homo sapiens
gugagcauaggaggcuucuguu

SEQ ID NO: 13895 - RNA, 22 nt, Homo sapiens
uccauugucuagauguaacaca

SEQ ID NO: 13896 - RNA, 22 nt, Homo sapiens
aagagugcucgugggacucagc

SEQ ID NO: 13897 - RNA, 22 nt, Homo sapiens
uuguaguagucucguucuuuua

SEQ ID NO: 13898 - RNA, 22 nt, Homo sapiens
ggagaucacucuuuguagcgug

SEQ ID NO: 13899 - RNA, 23 nt, Homo sapiens
gucuggucccugguuggaaacca

SEQ ID NO: 13900 - RNA, 22 nt, Homo sapiens
aucaugcacaugcauagguaug

SEQ ID NO: 13901 - RNA, 22 nt, Homo sapiens
ucacugugguuuugaugugcau

SEQ ID NO: 13902 - RNA, 21 nt, Homo sapiens
guucaagugauccuccugucu

SEQ ID NO: 13903 - RNA, 22 nt, Homo sapiens
guacaguuuucaguguucacug

SEQ ID NO: 13904 - RNA, 22 nt, Homo sapiens
uaaugcucauuagcaggccaau

SEQ ID NO: 13905 - RNA, 22 nt, Homo sapiens
gugaugguccagggaaucucuu

SEQ ID NO: 13906 - RNA, 22 nt, Homo sapiens
uuuggcaaagaucaacauguua

SEQ ID NO: 13907 - RNA, 22 nt, Homo sapiens
auugacaguuggccaguaagug

SEQ ID NO: 13908 - RNA, 22 nt, Homo sapiens
ucacaauguaaaugaggguugg

SEQ ID NO: 13909 - RNA, 20 nt, Homo sapiens
uucacugggcucucuguugg

SEQ ID NO: 13910 - RNA, 22 nt, Homo sapiens
uugagauagaauaggaauggga

SEQ ID NO: 13911 - RNA, 22 nt, Homo sapiens
auaucacaaacaagucuguacu

SEQ ID NO: 13912 - RNA, 22 nt, Homo sapiens
ugagacugaaauuaggaaacug

SEQ ID NO: 13913 - RNA, 22 nt, Homo sapiens
auuccacagccgauaccaugac

SEQ ID NO: 13914 - RNA, 22 nt, Homo sapiens
ucaugagacacacuggaaagga

SEQ ID NO: 13915 - RNA, 22 nt, Homo sapiens
augaggugcagaggaaaugagu

SEQ ID NO: 13916 - RNA, 21 nt, Homo sapiens
gcugguaaucacuuugccaaa

SEQ ID NO: 13917 - RNA, 22 nt, Homo sapiens
ugauccagugcucaguuggagu

SEQ ID NO: 13918 - RNA, 22 nt, Homo sapiens
aaagugauugcgguuuuugcca

SEQ ID NO: 13919 - RNA, 23 nt, Homo sapiens
cuguacacauauacaucuaagua

SEQ ID NO: 13920 - RNA, 22 nt, Homo sapiens
uuacaguguuuguucuguuacu

SEQ ID NO: 13921 - RNA, 22 nt, Homo sapiens
aauugcucuccuccaaggucuu

SEQ ID NO: 13922 - RNA, 22 nt, Homo sapiens
uaaguagcugggaguacaggca

SEQ ID NO: 13923 - RNA, 22 nt, Homo sapiens
uacaguacagugacaccauuau

SEQ ID NO: 13924 - RNA, 22 nt, Homo sapiens
uagcacuauuuauugaaaagga

SEQ ID NO: 13925 - RNA, 22 nt, Homo sapiens
ugaauacugugcaaaggauuug

SEQ ID NO: 13926 - RNA, 22 nt, Homo sapiens
uggauagugauaagguagauga

SEQ ID NO: 13927 - RNA, 22 nt, Homo sapiens
uauuauagugauaggucuacug

SEQ ID NO: 13928 - RNA, 22 nt, Homo sapiens
uggcauuuugugugaauuagaa

SEQ ID NO: 13929 - RNA, 22 nt, Homo sapiens
ucucuggauaucuacuuauguu

SEQ ID NO: 13930 - RNA, 22 nt, Homo sapiens
agugcauugcaucucugcuuca

SEQ ID NO: 13931 - RNA, 22 nt, Homo sapiens
uucaauacuguugauccuuaug

SEQ ID NO: 13932 - RNA, 22 nt, Homo sapiens
ugaggaguguauuucauucgcu

SEQ ID NO: 13933 - RNA, 22 nt, Homo sapiens
cauggcaucuguguggccucca

SEQ ID NO: 13934 - RNA, 22 nt, Homo sapiens
ugagccaugggguaaaugugau

SEQ ID NO: 13935 - RNA, 22 nt, Homo sapiens
cuggcagucugccucuucacug

SEQ ID NO: 13936 - RNA, 22 nt, Homo sapiens
uagaacaauugcuggauccgaa

SEQ ID NO: 13937 - RNA, 22 nt, Homo sapiens
cugacugugcaugcccagcccc

SEQ ID NO: 13938 - RNA, 23 nt, Homo sapiens
uggaaguauggaggaggcagaau

SEQ ID NO: 13939 - RNA, 22 nt, Homo sapiens
aaauucauuucagcucugggua

SEQ ID NO: 13940 - RNA, 22 nt, Homo sapiens
auguccuggacccagacaaagc

SEQ ID NO: 13941 - RNA, 22 nt, Homo sapiens
caggugcuuacuuaauagccau

SEQ ID NO: 13942 - RNA, 22 nt, Homo sapiens
uaggaaugaacgauuuauuggu

SEQ ID NO: 13943 - RNA, 22 nt, Homo sapiens
acugcacuccagcuuuggugac

SEQ ID NO: 13944 - RNA, 22 nt, Homo sapiens
gggcauguggacuuguauguuu

SEQ ID NO: 13945 - RNA, 22 nt, Homo sapiens
auggccuuuacaauuugguaug

SEQ ID NO: 13946 - RNA, 22 nt, Homo sapiens
cuugcauuuuggagaaugcuga

SEQ ID NO: 13947 - RNA, 22 nt, Homo sapiens
aggaaugucaaugguaguuuaa

SEQ ID NO: 13948 - RNA, 23 nt, Homo sapiens
aagugguuuugaacccggacccu

SEQ ID NO: 13949 - RNA, 22 nt, Homo sapiens
ggugagaaagggauuccuguuc

SEQ ID NO: 13950 - RNA, 22 nt, Homo sapiens
uugguccccacuccccugccaa

SEQ ID NO: 13951 - RNA, 22 nt, Homo sapiens
uuggacuacagauuacuucauc

SEQ ID NO: 13952 - RNA, 22 nt, Homo sapiens
ucucacagaguugaauguuucu

SEQ ID NO: 13953 - RNA, 22 nt, Homo sapiens
uaucagcagcaggggcugcaga

SEQ ID NO: 13954 - RNA, 22 nt, Homo sapiens
ugugguuuuucacauuuagaga

SEQ ID NO: 13955 - RNA, 17 nt, Homo sapiens
auguaauccucaucucu

SEQ ID NO: 13956 - RNA, 22 nt, Homo sapiens
uuucauggcgaggcuucauggg

SEQ ID NO: 13957 - RNA, 22 nt, Homo sapiens
auguguauuaccucgauuguga

SEQ ID NO: 13958 - RNA, 22 nt, Homo sapiens
uugauguaggcauucaaggcua

SEQ ID NO: 13959 - RNA, 22 nt, Homo sapiens
guauugccacuuuugaacaguu

SEQ ID NO: 13960 - RNA, 22 nt, Homo sapiens
ggaguaaaagaguaggaggaau

SEQ ID NO: 13961 - RNA, 22 nt, Homo sapiens
gucagugugauaucugcagggg

SEQ ID NO: 13962 - RNA, 22 nt, Homo sapiens
ucacugcacucuccgccuugcg

SEQ ID NO: 13963 - RNA, 21 nt, Homo sapiens
ccugaguacaacccacuccac

SEQ ID NO: 13964 - RNA, 22 nt, Homo sapiens
ugagucauuuccuuaugcuacu

SEQ ID NO: 13965 - RNA, 22 nt, Homo sapiens
augcaagcacacaagaggaaau

SEQ ID NO: 13966 - RNA, 22 nt, Homo sapiens
uaccacagucauuacacuugua

SEQ ID NO: 13967 - RNA, 22 nt, Homo sapiens
ucauaguagucacuuaauaaau

SEQ ID NO: 13968 - RNA, 22 nt, Homo sapiens
aaaaugcugauauugggcccca

SEQ ID NO: 13969 - RNA, 22 nt, Homo sapiens
aaaugcauggacagcuggucuu

SEQ ID NO: 13970 - RNA, 22 nt, Homo sapiens
ggucauggauugucuuuucuug

SEQ ID NO: 13971 - RNA, 20 nt, Homo sapiens
cccuaagccagaugcugggg

SEQ ID NO: 13972 - RNA, 22 nt, Homo sapiens
uugauaugacuaucuuuuaugu

SEQ ID NO: 13973 - RNA, 22 nt, Homo sapiens
uaacccuuacaacuacacucgu

SEQ ID NO: 13974 - RNA, 22 nt, Homo sapiens
aucugguguauuggugcugggu

SEQ ID NO: 13975 - RNA, 22 nt, Homo sapiens
uagguagaacuuuagacccugu

SEQ ID NO: 13976 - RNA, 22 nt, Homo sapiens
uguaaccauccagagucccagg

SEQ ID NO: 13977 - RNA, 22 nt, Homo sapiens
cuugacacugguuuucugaaua

SEQ ID NO: 13978 - RNA, 22 nt, Homo sapiens
acuguacuccagccugggugac

SEQ ID NO: 13979 - RNA, 22 nt, Homo sapiens
ucacaguaaauccagaagaaau

SEQ ID NO: 13980 - RNA, 17 nt, Homo sapiens
uugaaugcauuacuugg

SEQ ID NO: 13981 - RNA, 22 nt, Homo sapiens
gaaaguguugagauuacaggca

SEQ ID NO: 13982 - RNA, 15 nt, Homo sapiens
guuuuuggauacaau

SEQ ID NO: 13983 - RNA, 22 nt, Homo sapiens
gggaaauguaaagucauaagau

SEQ ID NO: 13984 - RNA, 22 nt, Homo sapiens
gugugcauaugucuuuauagua

SEQ ID NO: 13985 - RNA, 22 nt, Homo sapiens
uuuauugcucuaaaguugccau

SEQ ID NO: 13986 - RNA, 22 nt, Homo sapiens
ugagaugugaagaucacaugaa

SEQ ID NO: 13987 - RNA, 21 nt, Homo sapiens
augaacucaucauuuuuuaug

SEQ ID NO: 13988 - RNA, 20 nt, Homo sapiens
aauaacagccccagggaggu

SEQ ID NO: 13989 - RNA, 22 nt, Homo sapiens
uagguagucagcagugcuuaca

SEQ ID NO: 13990 - RNA, 22 nt, Homo sapiens
gagguagugagcagcugaacua

SEQ ID NO: 13991 - RNA, 23 nt, Homo sapiens
ugccuagaugcugcccugggaca

SEQ ID NO: 13992 - RNA, 20 nt, Homo sapiens
uauucacucuccagucuugc

SEQ ID NO: 13993 - RNA, 22 nt, Homo sapiens
uagcacugucuugcaccugugc

SEQ ID NO: 13994 - RNA, 22 nt, Homo sapiens
auagcagugugaaaauggacua

SEQ ID NO: 13995 - RNA, 22 nt, Homo sapiens
auuauuaguuguugaaugaagu

SEQ ID NO: 13996 - RNA, 22 nt, Homo sapiens
aauggcaaauguuuucuguuga

SEQ ID NO: 13997 - RNA, 22 nt, Homo sapiens
uggauugcaaaaucuuuuugag

SEQ ID NO: 13998 - RNA, 22 nt, Homo sapiens
ugaaauguaaguugucuagucu

SEQ ID NO: 13999 - RNA, 22 nt, Homo sapiens
caccacauuccauugaucaggc

SEQ ID NO: 14000 - RNA, 22 nt, Homo sapiens
ugcaccauugcauacuuaauua

SEQ ID NO: 14001 - RNA, 22 nt, Homo sapiens
auggacucauugaauuaagucc

SEQ ID NO: 14002 - RNA, 22 nt, Homo sapiens
gauggcaucugagaguguuaga

SEQ ID NO: 14003 - RNA, 22 nt, Homo sapiens
uguuacagugacuaauguuuua

SEQ ID NO: 14004 - RNA, 22 nt, Homo sapiens
cauugguuaguuaacuuuaaga

SEQ ID NO: 14005 - RNA, 22 nt, Homo sapiens
aacaccauuuuucugcagccuu

SEQ ID NO: 14006 - RNA, 22 nt, Homo sapiens
uagacuguaagauccaggagag

SEQ ID NO: 14007 - RNA, 22 nt, Homo sapiens
auuccauaguacagugaugagu

SEQ ID NO: 14008 - RNA, 22 nt, Homo sapiens
uagguaguuacacagcaaugua

SEQ ID NO: 14009 - RNA, 22 nt, Homo sapiens
ggacagaaaggguucaccaaac

SEQ ID NO: 14010 - RNA, 22 nt, Homo sapiens
ggcaauauuauuaacccucugu

SEQ ID NO: 14011 - RNA, 22 nt, Homo sapiens
uugacuuuuauucacucugcua

SEQ ID NO: 14012 - RNA, 22 nt, Homo sapiens
cuuguguuacauauuuaagaga

SEQ ID NO: 14013 - RNA, 22 nt, Homo sapiens
ggagucuugcuauguugccaag

SEQ ID NO: 14014 - RNA, 22 nt, Homo sapiens
uuauacacugugggaguguaaa

SEQ ID NO: 14015 - RNA, 22 nt, Homo sapiens
aaaggcaucugcucggcucccu

SEQ ID NO: 14016 - RNA, 22 nt, Homo sapiens
ccuugucacugaguggaaugaa

SEQ ID NO: 14017 - RNA, 22 nt, Homo sapiens
gucugguuggaguaguuuucag

SEQ ID NO: 14018 - RNA, 22 nt, Homo sapiens
cuggcucugagguguuuagggc

SEQ ID NO: 14019 - RNA, 21 nt, Homo sapiens
ucauugggugcagcccacccu

SEQ ID NO: 14020 - RNA, 22 nt, Homo sapiens
uugugcuccugugagaaucuag

SEQ ID NO: 14021 - RNA, 22 nt, Homo sapiens
uucaucuggcaauucagagauu

SEQ ID NO: 14022 - RNA, 22 nt, Homo sapiens
augggcacugauguauucugug

SEQ ID NO: 14023 - RNA, 22 nt, Homo sapiens
uagcaugacacuuguugaaugc

SEQ ID NO: 14024 - RNA, 22 nt, Homo sapiens
uuaccaguggugcuguaaacuu

SEQ ID NO: 14025 - RNA, 22 nt, Homo sapiens
agcuugugcuguaugaagggcc

SEQ ID NO: 14026 - RNA, 22 nt, Homo sapiens
uaucucagaguguacaagauua

SEQ ID NO: 14027 - RNA, 22 nt, Homo sapiens
uugauaagaaaugccaguuugg

SEQ ID NO: 14028 - RNA, 22 nt, Homo sapiens
gugagcuccucuucugcugcag

SEQ ID NO: 14029 - RNA, 21 nt, Homo sapiens
caugucacugcacucuagccu

SEQ ID NO: 14030 - RNA, 22 nt, Homo sapiens
ugugccacugcacucugggcaa

SEQ ID NO: 14031 - RNA, 22 nt, Homo sapiens
guagcagucacauagcagauug

SEQ ID NO: 14032 - RNA, 19 nt, Homo sapiens
acugagcuaccugggggca

SEQ ID NO: 14033 - RNA, 22 nt, Homo sapiens
cucaguuuugccuuguuuaagg

SEQ ID NO: 14034 - RNA, 22 nt, Homo sapiens
cuugggccccacccaaaucuua

SEQ ID NO: 14035 - RNA, 22 nt, Homo sapiens
ugagcuaugaucccaccucugu

SEQ ID NO: 14036 - RNA, 22 nt, Homo sapiens
acagugcuuuuguuccucuccu

SEQ ID NO: 14037 - RNA, 22 nt, Homo sapiens
aauaagcugagagaauucuaca

SEQ ID NO: 14038 - RNA, 22 nt, Homo sapiens
cacugggugccauauguuugcu

SEQ ID NO: 14039 - RNA, 22 nt, Homo sapiens
augucugguagccaccuggagg

SEQ ID NO: 14040 - RNA, 22 nt, Homo sapiens
gucagggagggauagaugauua

SEQ ID NO: 14041 - RNA, 22 nt, Homo sapiens
gagugcaucguggccauuuuaa

SEQ ID NO: 14042 - RNA, 22 nt, Homo sapiens
cacuagagaauagguaguucug

SEQ ID NO: 14043 - RNA, 19 nt, Homo sapiens
accagauugcauucuugga

SEQ ID NO: 14044 - RNA, 20 nt, Homo sapiens
ucuggccccuccaaaucuca

SEQ ID NO: 14045 - RNA, 22 nt, Homo sapiens
aauaugucuugaaauuggguaa

SEQ ID NO: 14046 - RNA, 22 nt, Homo sapiens
uuuagugcaucagacacccucu

SEQ ID NO: 14047 - RNA, 22 nt, Homo sapiens
ugaaugcaucauguagggcuca

SEQ ID NO: 14048 - RNA, 22 nt, Homo sapiens
agagauccucauuuuauagaca

SEQ ID NO: 14049 - RNA, 22 nt, Homo sapiens
ucuaguaaugagaggcaggaga

SEQ ID NO: 14050 - RNA, 22 nt, Homo sapiens
ugggcaaauugugagggaggua

SEQ ID NO: 14051 - RNA, 22 nt, Homo sapiens
uugggacuggaaggaguaaggg

SEQ ID NO: 14052 - RNA, 22 nt, Homo sapiens
uccuacugucuucggggcacug

SEQ ID NO: 14053 - RNA, 22 nt, Homo sapiens
ucaagguacguugccucagauu

SEQ ID NO: 14054 - RNA, 22 nt, Homo sapiens
auuggccaaugggacgucagca

SEQ ID NO: 14055 - RNA, 22 nt, Homo sapiens
uuggagagaaaggcaguuccug

SEQ ID NO: 14056 - RNA, 17 nt, Homo sapiens
acagugcuuugcuuucc

SEQ ID NO: 14057 - RNA, 22 nt, Homo sapiens
auaugacuuuccucuacuuccu

SEQ ID NO: 14058 - RNA, 20 nt, Homo sapiens
ucacccugacaucugcccag

SEQ ID NO: 14059 - RNA, 22 nt, Homo sapiens
ugagauuauauuucuuaacaga

SEQ ID NO: 14060 - RNA, 22 nt, Homo sapiens
uugcauuuucuaggagggcaaa

SEQ ID NO: 14061 - RNA, 22 nt, Homo sapiens
uguaugucuucuuuagauaagu

SEQ ID NO: 14062 - RNA, 22 nt, Homo sapiens
uaguaucacauggucuuaauua

SEQ ID NO: 14063 - RNA, 19 nt, Homo sapiens
gucaaagucgguauucaaa

SEQ ID NO: 14064 - RNA, 22 nt, Homo sapiens
aagugcauguauuaguguaguc

SEQ ID NO: 14065 - RNA, 22 nt, Homo sapiens
ucacugggagaccaaagccauc

SEQ ID NO: 14066 - RNA, 22 nt, Homo sapiens
uaccaccauuguaguuuggaaa

SEQ ID NO: 14067 - RNA, 22 nt, Homo sapiens
gcugcuuuugaugacaaaaaca

SEQ ID NO: 14068 - RNA, 22 nt, Homo sapiens
ccauugcacuucagccuaggug

SEQ ID NO: 14069 - RNA, 22 nt, Homo sapiens
gcccuguaguauaguuugaagu

SEQ ID NO: 14070 - RNA, 22 nt, Homo sapiens
ggucaaguaauccuggguguca

SEQ ID NO: 14071 - RNA, 22 nt, Homo sapiens
guugccuaggcuggcgugcagu

SEQ ID NO: 14072 - RNA, 22 nt, Homo sapiens
gacagugagaugucaugugaaa

SEQ ID NO: 14073 - RNA, 23 nt, Homo sapiens
uucugccacugaaaaugccucag

SEQ ID NO: 14074 - RNA, 22 nt, Homo sapiens
ugagaucaugccacugcacuuc

SEQ ID NO: 14075 - RNA, 22 nt, Homo sapiens
uuugcuuaaaguccuuguggga

SEQ ID NO: 14076 - RNA, 22 nt, Homo sapiens
gaugagguaguguaccuagucu

SEQ ID NO: 14077 - RNA, 22 nt, Homo sapiens
gucaggaccucgguggcauucu

SEQ ID NO: 14078 - RNA, 22 nt, Homo sapiens
gaugagcuaaguucucacagca

SEQ ID NO: 14079 - RNA, 22 nt, Homo sapiens
augagacaguucccuuuaucuu

SEQ ID NO: 14080 - RNA, 22 nt, Homo sapiens
auuagaugguuauaggugugag

SEQ ID NO: 14081 - RNA, 22 nt, Homo sapiens
ucauuggaugagaccccugucc

SEQ ID NO: 14082 - RNA, 22 nt, Homo sapiens
ugauugacauucuuuggaguau

SEQ ID NO: 14083 - RNA, 18 nt, Homo sapiens
ucccucagaauuauagaa

SEQ ID NO: 14084 - RNA, 22 nt, Homo sapiens
gugagauaucuagacuagggaa

SEQ ID NO: 14085 - RNA, 20 nt, Homo sapiens
ugagcuauauauguccuuga

SEQ ID NO: 14086 - RNA, 22 nt, Homo sapiens
cauugucccucaaugucuauga

SEQ ID NO: 14087 - RNA, 22 nt, Homo sapiens
uacaguagagaucagcaaacua

SEQ ID NO: 14088 - RNA, 18 nt, Homo sapiens
cccagugacuuauggccu

SEQ ID NO: 14089 - RNA, 22 nt, Homo sapiens
cuggcucauuucauuuagcaua

SEQ ID NO: 14090 - RNA, 22 nt, Homo sapiens
guaagugauagaauuaggauuc

SEQ ID NO: 14091 - RNA, 22 nt, Homo sapiens
gacucgugagguccccaggagg

SEQ ID NO: 14092 - RNA, 19 nt, Homo sapiens
uccacagugguugaacuag

SEQ ID NO: 14093 - RNA, 22 nt, Homo sapiens
ucaccuggagacaugaagacug

SEQ ID NO: 14094 - RNA, 22 nt, Homo sapiens
agcugguauuuguuagggaguu

SEQ ID NO: 14095 - RNA, 19 nt, Homo sapiens
uguuuggcuauaggucuaa

SEQ ID NO: 14096 - RNA, 22 nt, Homo sapiens
augacugucuugcagaggcuau

SEQ ID NO: 14097 - RNA, 22 nt, Homo sapiens
uuccuugagagcuugauaucac

SEQ ID NO: 14098 - RNA, 22 nt, Homo sapiens
uuaacaguuaauucuuuggcaa

SEQ ID NO: 14099 - RNA, 22 nt, Homo sapiens
cuucaagucuuuggauaauuag

SEQ ID NO: 14100 - RNA, 22 nt, Homo sapiens
uaugccuuuugguucaagcaac

SEQ ID NO: 14101 - RNA, 21 nt, Homo sapiens
cgucauggagauguguuguac

SEQ ID NO: 14102 - RNA, 20 nt, Homo sapiens
aaucuacuugcccauuuagc

SEQ ID NO: 14103 - RNA, 22 nt, Homo sapiens
gugauugucuaaucaagauaca

SEQ ID NO: 14104 - RNA, 22 nt, Homo sapiens
gugggguaggugacuugaugag

SEQ ID NO: 14105 - RNA, 22 nt, Homo sapiens
uaguuuaucuucuggauggaca

SEQ ID NO: 14106 - RNA, 22 nt, Homo sapiens
gagugcuguuagcccuggguuu

SEQ ID NO: 14107 - RNA, 20 nt, Homo sapiens
agcuguuguuaaaaaggagg

SEQ ID NO: 14108 - RNA, 22 nt, Homo sapiens
uauggcuacuacgaauaaugcu

SEQ ID NO: 14109 - RNA, 22 nt, Homo sapiens
uugguuaucaucauuucagcaa

SEQ ID NO: 14110 - RNA, 22 nt, Homo sapiens
uguggcagugcuuuaugaaacc

SEQ ID NO: 14111 - RNA, 22 nt, Homo sapiens
ucaguguugauggcugcugacu

SEQ ID NO: 14112 - RNA, 22 nt, Homo sapiens
caagugcucuaggauccugagu

SEQ ID NO: 14113 - RNA, 22 nt, Homo sapiens
uuacuguacugcucuuaaccug

SEQ ID NO: 14114 - RNA, 22 nt, Homo sapiens
gucaaugcauccaugaauggcu

SEQ ID NO: 14115 - RNA, 22 nt, Homo sapiens
ucaccaccugcugaucauagag

SEQ ID NO: 14116 - RNA, 22 nt, Homo sapiens
ugugcugaucgggcacgguguc

SEQ ID NO: 14117 - RNA, 20 nt, Homo sapiens
acugcacuucagccugcugg

SEQ ID NO: 14118 - RNA, 22 nt, Homo sapiens
ugugauuauuuauagacaguca

SEQ ID NO: 14119 - RNA, 22 nt, Homo sapiens
cuuuggugauagauaccccaua

SEQ ID NO: 14120 - RNA, 22 nt, Homo sapiens
caccuagacuggagugcagugg

SEQ ID NO: 14121 - RNA, 22 nt, Homo sapiens
cuaacacagagguuuauuucuc

SEQ ID NO: 14122 - RNA, 22 nt, Homo sapiens
uuuacaguuuucuaggcuacca

SEQ ID NO: 14123 - RNA, 22 nt, Homo sapiens
cagagaacauucagagcuguag

SEQ ID NO: 14124 - RNA, 22 nt, Homo sapiens
uacaggauagacaauuuauuaa

SEQ ID NO: 14125 - RNA, 22 nt, Homo sapiens
cuuuggguauucucccuugggg

SEQ ID NO: 14126 - RNA, 22 nt, Homo sapiens
acccgugcugaauauguaggug

SEQ ID NO: 14127 - RNA, 21 nt, Homo sapiens
uaagacugccaguagggcugu

SEQ ID NO: 14128 - RNA, 22 nt, Homo sapiens
ugggccgcugcaggaugguccc

SEQ ID NO: 14129 - RNA, 22 nt, Homo sapiens
uuggaagagaagggagauaaac

SEQ ID NO: 14130 - RNA, 22 nt, Homo sapiens
uggcaugauauauauucguuug

SEQ ID NO: 14131 - RNA, 22 nt, Homo sapiens
ugagaccugaucuugguacugc

SEQ ID NO: 14132 - RNA, 22 nt, Homo sapiens
cagguaguguguagcacagcag

SEQ ID NO: 14133 - RNA, 22 nt, Homo sapiens
augggcaaauguuggaaauucc

SEQ ID NO: 14134 - RNA, 22 nt, Homo sapiens
uuaagcaguggauuagaauuuu

SEQ ID NO: 14135 - RNA, 22 nt, Homo sapiens
ugucuuggagaauccuggguuu

SEQ ID NO: 14136 - RNA, 17 nt, Homo sapiens
ugaguuaaucuuugugc

SEQ ID NO: 14137 - RNA, 22 nt, Homo sapiens
aucuuuggcgggaauaucacag

SEQ ID NO: 14138 - RNA, 22 nt, Homo sapiens
auugcacaaagagggaaacuga

SEQ ID NO: 14139 - RNA, 18 nt, Homo sapiens
uaguacuguucucaugau

SEQ ID NO: 14140 - RNA, 22 nt, Homo sapiens
auuggcuuuugaaagucugcga

SEQ ID NO: 14141 - RNA, 22 nt, Homo sapiens
auuuuugguuucaccugcacgc

SEQ ID NO: 14142 - RNA, 22 nt, Homo sapiens
ugucuaaagaauggcagacuca

SEQ ID NO: 14143 - RNA, 23 nt, Homo sapiens
cacugggcagcagguguucccag

SEQ ID NO: 14144 - RNA, 22 nt, Homo sapiens
uauggauuuuggaauauguggg

SEQ ID NO: 14145 - RNA, 22 nt, Homo sapiens
aagacuguaauccaucuugagu

SEQ ID NO: 14146 - RNA, 22 nt, Homo sapiens
agcuggucugauacuuaccucc

SEQ ID NO: 14147 - RNA, 20 nt, Homo sapiens
uuagucuccucugcccuguc

SEQ ID NO: 14148 - RNA, 22 nt, Homo sapiens
ugaaaugguuaugugaggagau

SEQ ID NO: 14149 - RNA, 22 nt, Homo sapiens
agugcuuaauagauguccagca

SEQ ID NO: 14150 - RNA, 22 nt, Homo sapiens
aggagcacaggacuuugauuau

SEQ ID NO: 14151 - RNA, 22 nt, Homo sapiens
gcuaaggcaggagcauugcuug

SEQ ID NO: 14152 - RNA, 22 nt, Homo sapiens
aucaagccaaagaaaguccuug

SEQ ID NO: 14153 - RNA, 22 nt, Homo sapiens
ucccaguuuuucugaauaguca

SEQ ID NO: 14154 - RNA, 22 nt, Homo sapiens
uaagucacuccagguuaaagug

SEQ ID NO: 14155 - RNA, 22 nt, Homo sapiens
ugaucuguguaacauaggaguc

SEQ ID NO: 14156 - RNA, 22 nt, Homo sapiens
acaugguacugauuuacgaaau

SEQ ID NO: 14157 - RNA, 22 nt, Homo sapiens
uuucaggcaagggugacccuga

SEQ ID NO: 14158 - RNA, 22 nt, Homo sapiens
aauuaguugucgugagaguggu

SEQ ID NO: 14159 - RNA, 22 nt, Homo sapiens
uauagcuaugggauguauuugc

SEQ ID NO: 14160 - RNA, 22 nt, Homo sapiens
uccugagacugaggagcuuugg

SEQ ID NO: 14161 - RNA, 22 nt, Homo sapiens
agcagcaauuuuguaugguuua

SEQ ID NO: 14162 - RNA, 22 nt, Homo sapiens
ugagaugaaagcagaaagacuu

SEQ ID NO: 14163 - RNA, 22 nt, Homo sapiens
agcuaugucugaugccugauua

SEQ ID NO: 14164 - RNA, 22 nt, Homo sapiens
gugcaaugagaaggggcucugg

SEQ ID NO: 14165 - RNA, 22 nt, Homo sapiens
auuguacuccagccugggugac

SEQ ID NO: 14166 - RNA, 22 nt, Homo sapiens
uuaugguacaugugcacaaugu

SEQ ID NO: 14167 - RNA, 22 nt, Homo sapiens
uuagaucaacauggaacucuau

SEQ ID NO: 14168 - RNA, 22 nt, Homo sapiens
uaucuacauguagguauguaug

SEQ ID NO: 14169 - RNA, 19 nt, Homo sapiens
ucucaguguuggucaggug

SEQ ID NO: 14170 - RNA, 22 nt, Homo sapiens
gaguaucuuuaaggugguuugg

SEQ ID NO: 14171 - RNA, 22 nt, Homo sapiens
cacccaguaagcaugaggcccu

SEQ ID NO: 14172 - RNA, 22 nt, Homo sapiens
auuagguuguugcaaaaguaau

SEQ ID NO: 14173 - RNA, 22 nt, Homo sapiens
uugagauagggucuaccucugu

SEQ ID NO: 14174 - RNA, 22 nt, Homo sapiens
acaguguagugacugccaacuu

SEQ ID NO: 14175 - RNA, 20 nt, Homo sapiens
auuugcauuauggagcaccc

SEQ ID NO: 14176 - RNA, 22 nt, Homo sapiens
guggagucaucacucagagugg

SEQ ID NO: 14177 - RNA, 22 nt, Homo sapiens
uaaggauuuuggugauuacacu

SEQ ID NO: 14178 - RNA, 22 nt, Homo sapiens
cagagguauugcaaaagccuag

SEQ ID NO: 14179 - RNA, 22 nt, Homo sapiens
agcuggcuguggagaaaccccu

SEQ ID NO: 14180 - RNA, 22 nt, Homo sapiens
ucacuugguggcaaaguuuaug

SEQ ID NO: 14181 - RNA, 18 nt, Homo sapiens
uugaauaguguccaaucu

SEQ ID NO: 14182 - RNA, 22 nt, Homo sapiens
guucaguuugcugaugcguuga

SEQ ID NO: 14183 - RNA, 19 nt, Homo sapiens
auaccucugugaaccccug

SEQ ID NO: 14184 - RNA, 22 nt, Homo sapiens
aaaguguuucugcaguagguuu

SEQ ID NO: 14185 - RNA, 22 nt, Homo sapiens
aggaauguuaguacuucuuagu

SEQ ID NO: 14186 - RNA, 22 nt, Homo sapiens
acuuggcaaaguuuuaaacagc

SEQ ID NO: 14187 - RNA, 22 nt, Homo sapiens
augaggagauauuaaauaccau

SEQ ID NO: 14188 - RNA, 22 nt, Homo sapiens
augggguagguagcucggggaa

SEQ ID NO: 14189 - RNA, 22 nt, Homo sapiens
aaaggcacugugacuuuauagg

SEQ ID NO: 14190 - RNA, 16 nt, Homo sapiens
augagauccugucuca

SEQ ID NO: 14191 - RNA, 22 nt, Homo sapiens
uuucccuuacuuaaacuuacuc

SEQ ID NO: 14192 - RNA, 22 nt, Homo sapiens
guauuagguuggugcaaaauug

SEQ ID NO: 14193 - RNA, 22 nt, Homo sapiens
uugcaugucauaacugauggaa

SEQ ID NO: 14194 - RNA, 21 nt, Homo sapiens
uuaggcagugucagaggugag

SEQ ID NO: 14195 - RNA, 22 nt, Homo sapiens
cauaaaucuuguugaauagcac

SEQ ID NO: 14196 - RNA, 22 nt, Homo sapiens
cuuugaugagaaaauacuuugu

SEQ ID NO: 14197 - RNA, 22 nt, Homo sapiens
ccuuuguuuaguugaauuguau

SEQ ID NO: 14198 - RNA, 22 nt, Homo sapiens
gucagugauugauuuaaagacg

SEQ ID NO: 14199 - RNA, 22 nt, Homo sapiens
guggcuagaaugaagguagcug

SEQ ID NO: 14200 - RNA, 16 nt, Homo sapiens
gcucauguuuguguag

SEQ ID NO: 14201 - RNA, 22 nt, Homo sapiens
cauugcaguuuuugguguaucu

SEQ ID NO: 14202 - RNA, 22 nt, Homo sapiens
agcuuguagugauuugugguaa

SEQ ID NO: 14203 - RNA, 22 nt, Homo sapiens
acugggauauuauugguaauau

SEQ ID NO: 14204 - RNA, 22 nt, Homo sapiens
uuggagcacuggggcacugaca

SEQ ID NO: 14205 - RNA, 22 nt, Homo sapiens
uuccauagucauagugcugaug

SEQ ID NO: 14206 - RNA, 23 nt, Homo sapiens
gugaucauuguuguggguugaau

SEQ ID NO: 14207 - RNA, 22 nt, Homo sapiens
auaugcauacccucaccaacua

SEQ ID NO: 14208 - RNA, 23 nt, Homo sapiens
ugaguagguccacguaugugagu

SEQ ID NO: 14209 - RNA, 19 nt, Homo sapiens
ucauagucuaagaugagaa

SEQ ID NO: 14210 - RNA, 22 nt, Homo sapiens
aucccagaaacucggguuucuc

SEQ ID NO: 14211 - RNA, 22 nt, Homo sapiens
uguuuuggaguggacuuugcau

SEQ ID NO: 14212 - RNA, 22 nt, Homo sapiens
uuucauggaggcauuuuagauu

SEQ ID NO: 14213 - RNA, 22 nt, Homo sapiens
cuuugguucuguuuauaugcug

SEQ ID NO: 14214 - RNA, 22 nt, Homo sapiens
uugagauauccauaaaugggaa

SEQ ID NO: 14215 - RNA, 22 nt, Homo sapiens
acccgcccagguguggccggga

SEQ ID NO: 14216 - RNA, 22 nt, Homo sapiens
uaaagauaaggcucgcuuggau

SEQ ID NO: 14217 - RNA, 21 nt, Homo sapiens
gagaaucuuuucagggcaaac

SEQ ID NO: 14218 - RNA, 22 nt, Homo sapiens
uaucaaucuagggaaacuccaa

SEQ ID NO: 14219 - RNA, 22 nt, Homo sapiens
ugcuugagacacauaugaauuu

SEQ ID NO: 14220 - RNA, 20 nt, Homo sapiens
cugagguugggguccuuccc

SEQ ID NO: 14221 - RNA, 22 nt, Homo sapiens
auacacgugcagaacaugcagg

SEQ ID NO: 14222 - RNA, 22 nt, Homo sapiens
gcaauguuacugaauguguuuu

SEQ ID NO: 14223 - RNA, 22 nt, Homo sapiens
cauugcacuccagccuggccaa

SEQ ID NO: 14224 - RNA, 22 nt, Homo sapiens
aaaaggcuagcuaguaacagaa

SEQ ID NO: 14225 - RNA, 22 nt, Homo sapiens
auaagcuaagaguuucugggcu

SEQ ID NO: 14226 - RNA, 22 nt, Homo sapiens
uauggauuuucagauucuuauc

SEQ ID NO: 14227 - RNA, 22 nt, Homo sapiens
aucuguguuuaaggucccagaa

SEQ ID NO: 14228 - RNA, 22 nt, Homo sapiens
cagcgaggucugcgucacauug

SEQ ID NO: 14229 - RNA, 22 nt, Homo sapiens
uggcaugugugaagugcccagc

SEQ ID NO: 14230 - RNA, 22 nt, Homo sapiens
uggccaguguuuuuccugggcu

SEQ ID NO: 14231 - RNA, 22 nt, Homo sapiens
ucacugcgaccucugccucccg

SEQ ID NO: 14232 - RNA, 22 nt, Homo sapiens
agaguaguuuauuaugcuaagg

SEQ ID NO: 14233 - RNA, 22 nt, Homo sapiens
uucccuuugugcauaggauuug

SEQ ID NO: 14234 - RNA, 22 nt, Homo sapiens
uuuguagcucacucugagcuga

SEQ ID NO: 14235 - RNA, 22 nt, Homo sapiens
ggagaauguaauugguauuuug

SEQ ID NO: 14236 - RNA, 22 nt, Homo sapiens
ugaauauguuaauuagcaucau

SEQ ID NO: 14237 - RNA, 22 nt, Homo sapiens
uuugagcuagagucucacucug

SEQ ID NO: 14238 - RNA, 18 nt, Homo sapiens
uacugcacucuccagccu

SEQ ID NO: 14239 - RNA, 19 nt, Homo sapiens
uggaauggauuuaaaugug

SEQ ID NO: 14240 - RNA, 18 nt, Homo sapiens
cuuggcgaugccaacaua

SEQ ID NO: 14241 - RNA, 22 nt, Homo sapiens
uuacaugcaugacaaggugcca

SEQ ID NO: 14242 - RNA, 22 nt, Homo sapiens
gaugguuuuuuaagaagagccu

SEQ ID NO: 14243 - RNA, 22 nt, Homo sapiens
ugagauaaucaugugauuucau

SEQ ID NO: 14244 - RNA, 22 nt, Homo sapiens
ucacuuuguuuuuggauaaguu

SEQ ID NO: 14245 - RNA, 22 nt, Homo sapiens
uuagaugaaugucucuuaaaca

SEQ ID NO: 14246 - RNA, 21 nt, Homo sapiens
ccugaagaagugaccucugag

SEQ ID NO: 14247 - RNA, 22 nt, Homo sapiens
ugaggaaugaccccgugugguc

SEQ ID NO: 14248 - RNA, 22 nt, Homo sapiens
uuuggcuauguuguaucuuucc

SEQ ID NO: 14249 - RNA, 22 nt, Homo sapiens
agcaccaccguugcucuauccc

SEQ ID NO: 14250 - RNA, 22 nt, Homo sapiens
uuuggcauauuuuaagcugguu

SEQ ID NO: 14251 - RNA, 22 nt, Homo sapiens
uugcaaaguuugccuccuguag

SEQ ID NO: 14252 - RNA, 19 nt, Homo sapiens
augaacucauucuuuuuau

SEQ ID NO: 14253 - RNA, 22 nt, Homo sapiens
guggcagaacagguaggguucu

SEQ ID NO: 14254 - RNA, 20 nt, Homo sapiens
cagggcaaugaggagguaaa

SEQ ID NO: 14255 - RNA, 22 nt, Homo sapiens
ugacucaguuguuagucuucau

SEQ ID NO: 14256 - RNA, 22 nt, Homo sapiens
ugucauguagaaauuguccauu

SEQ ID NO: 14257 - RNA, 22 nt, Homo sapiens
aucucaguuaaugacccuaugc

SEQ ID NO: 14258 - RNA, 22 nt, Homo sapiens
ucaccagugucagggaacugcu

SEQ ID NO: 14259 - RNA, 22 nt, Homo sapiens
caugucacuuccucucugaugg

SEQ ID NO: 14260 - RNA, 22 nt, Homo sapiens
cauugcacucuagccucggcaa

SEQ ID NO: 14261 - RNA, 22 nt, Homo sapiens
uuugugcuauguuauauauucu

SEQ ID NO: 14262 - RNA, 22 nt, Homo sapiens
acccuguaggacuauucuaauc

SEQ ID NO: 14263 - RNA, 22 nt, Homo sapiens
ucugucacugguggacgaucac

SEQ ID NO: 14264 - RNA, 23 nt, Homo sapiens
ugcagcacacugaugggucuuga

SEQ ID NO: 14265 - RNA, 22 nt, Homo sapiens
cuauucacaauagccaagauuu

SEQ ID NO: 14266 - RNA, 19 nt, Homo sapiens
ucaccaguacacaauacaa

SEQ ID NO: 14267 - RNA, 22 nt, Homo sapiens
cuugaucaaugugguacuugau

SEQ ID NO: 14268 - RNA, 22 nt, Homo sapiens
uugagauggagucucacgcauu

SEQ ID NO: 14269 - RNA, 22 nt, Homo sapiens
ccaaaucucauguugaaaugug

SEQ ID NO: 14270 - RNA, 22 nt, Homo sapiens
ugcccguaauuccagcacuuug

SEQ ID NO: 14271 - RNA, 22 nt, Homo sapiens
ggaagacuggcuuguuuaccca

SEQ ID NO: 14272 - RNA, 22 nt, Homo sapiens
augagcacuuguuuugggcaca

SEQ ID NO: 14273 - RNA, 22 nt, Homo sapiens
uugagauggagucuuguucucu

SEQ ID NO: 14274 - RNA, 22 nt, Homo sapiens
gugaaagauuaaaccagugugu

SEQ ID NO: 14275 - RNA, 22 nt, Homo sapiens
auacacgugccauguuggugug

SEQ ID NO: 14276 - RNA, 22 nt, Homo sapiens
accugugguuacagucugucuc

SEQ ID NO: 14277 - RNA, 22 nt, Homo sapiens
gcuggguugccagguuacuuaa

SEQ ID NO: 14278 - RNA, 22 nt, Homo sapiens
uaacuacuucugcuucagagua

SEQ ID NO: 14279 - RNA, 22 nt, Homo sapiens
ugacuaaggaaggauuaugugc

SEQ ID NO: 14280 - RNA, 22 nt, Homo sapiens
uugcauauucucugaggcagga

SEQ ID NO: 14281 - RNA, 22 nt, Homo sapiens
ucuggugugcucuggacuugca

SEQ ID NO: 14282 - RNA, 22 nt, Homo sapiens
uuuggccauguuggucaggcug

SEQ ID NO: 14283 - RNA, 23 nt, Homo sapiens
cagguaguucuuuauaguagugu

SEQ ID NO: 14284 - RNA, 19 nt, Homo sapiens
uugugggaggacagagggg

SEQ ID NO: 14285 - RNA, 22 nt, Homo sapiens
ugcugguguuuaggaauaagaa

SEQ ID NO: 14286 - RNA, 22 nt, Homo sapiens
cuguguaguacuagauugagca

SEQ ID NO: 14287 - RNA, 22 nt, Homo sapiens
cguugcacuccagccugggcaa

SEQ ID NO: 14288 - RNA, 22 nt, Homo sapiens
ucucaagaugguagaugggaau

SEQ ID NO: 14289 - RNA, 22 nt, Homo sapiens
ugugaugguuuagcauuuucuu

SEQ ID NO: 14290 - RNA, 22 nt, Homo sapiens
gcacgugcacccacaugcacgu

SEQ ID NO: 14291 - RNA, 22 nt, Homo sapiens
acaggguuauuguaauaaugua

SEQ ID NO: 14292 - RNA, 22 nt, Homo sapiens
uguccuggugaugcccaaauuc

SEQ ID NO: 14293 - RNA, 22 nt, Homo sapiens
uuuguuugaagucgagacaacu

SEQ ID NO: 14294 - RNA, 20 nt, Homo sapiens
ucacugaguaucuacgauua

SEQ ID NO: 14295 - RNA, 23 nt, Homo sapiens
uuggcaucugggacacaagcuga

SEQ ID NO: 14296 - RNA, 22 nt, Homo sapiens
agagcaauguuaucagucucug

SEQ ID NO: 14297 - RNA, 22 nt, Homo sapiens
aagcccauuguaaguugaggag

SEQ ID NO: 14298 - RNA, 22 nt, Homo sapiens
uccccaguaggcaauuaacacc

SEQ ID NO: 14299 - RNA, 19 nt, Homo sapiens
cuaguaccacuucuucuga

SEQ ID NO: 14300 - RNA, 22 nt, Homo sapiens
agcuagcauucauaguuugagg

SEQ ID NO: 14301 - RNA, 22 nt, Homo sapiens
uauugcucaugcauuuaauuuc

SEQ ID NO: 14302 - RNA, 22 nt, Homo sapiens
gacauguuucucucuguuuacu

SEQ ID NO: 14303 - RNA, 22 nt, Homo sapiens
guagcagccacacuugauaacu

SEQ ID NO: 14304 - RNA, 22 nt, Homo sapiens
uuccuacuguucaucaggaacc

SEQ ID NO: 14305 - RNA, 22 nt, Homo sapiens
ucuugcuuguuguucccuucau

SEQ ID NO: 14306 - RNA, 22 nt, Homo sapiens
cuaccuggguggcucaugacuu

SEQ ID NO: 14307 - RNA, 20 nt, Homo sapiens
uucuaguacuucuguuucca

SEQ ID NO: 14308 - RNA, 22 nt, Homo sapiens
ugcaaugucuucugaggggagc

SEQ ID NO: 14309 - RNA, 22 nt, Homo sapiens
aguacugucugguuaccugaca

SEQ ID NO: 14310 - RNA, 22 nt, Homo sapiens
cucuuugcuucuggcaucauug

SEQ ID NO: 14311 - RNA, 22 nt, Homo sapiens
agucacagugaccuugucugac

SEQ ID NO: 14312 - RNA, 21 nt, Homo sapiens
ugagaguaguguauuauucuc

SEQ ID NO: 14313 - RNA, 21 nt, Homo sapiens
ggaauuuagggaaugauuuag

SEQ ID NO: 14314 - RNA, 22 nt, Homo sapiens
uaucauggaaagauguugaaau

SEQ ID NO: 14315 - RNA, 18 nt, Homo sapiens
uagaauauaggucauucu

SEQ ID NO: 14316 - RNA, 22 nt, Homo sapiens
guauagaucguagaccaauaaa

SEQ ID NO: 14317 - RNA, 22 nt, Homo sapiens
uggcaauauccacaauuacuuu

SEQ ID NO: 14318 - RNA, 22 nt, Homo sapiens
aaaggauucuaauggaaaugcu

SEQ ID NO: 14319 - RNA, 22 nt, Homo sapiens
ugugaaugauggagugucgaau

SEQ ID NO: 14320 - RNA, 22 nt, Homo sapiens
uucuauguuugaaaaugccaaa

SEQ ID NO: 14321 - RNA, 22 nt, Homo sapiens
augucuguuugcugagcccggc

SEQ ID NO: 14322 - RNA, 22 nt, Homo sapiens
uggauaguaaagucagauuccc

SEQ ID NO: 14323 - RNA, 22 nt, Homo sapiens
uaugagguagguaugacuauca

SEQ ID NO: 14324 - RNA, 22 nt, Homo sapiens
auucauagugcuaagguguauc

SEQ ID NO: 14325 - RNA, 22 nt, Homo sapiens
acucuguauaaacauugcugua

SEQ ID NO: 14326 - RNA, 21 nt, Homo sapiens
uccuuggugaugcccugcagu

SEQ ID NO: 14327 - RNA, 22 nt, Homo sapiens
guuaggcagugugguauagcag

SEQ ID NO: 14328 - RNA, 22 nt, Homo sapiens
augcaaacagcuaucuggcugg

SEQ ID NO: 14329 - RNA, 22 nt, Homo sapiens
auugcuuuuacugggagcuuug

SEQ ID NO: 14330 - RNA, 23 nt, Homo sapiens
uagcuucucccagaccugcuccc

SEQ ID NO: 14331 - RNA, 22 nt, Homo sapiens
auccuuuagacuguccaguuga

SEQ ID NO: 14332 - RNA, 22 nt, Homo sapiens
acacaguaaauauguauugaau

SEQ ID NO: 14333 - RNA, 22 nt, Homo sapiens
aaagcugucaaggcaggaggcu

SEQ ID NO: 14334 - RNA, 22 nt, Homo sapiens
ggagugcuguuguuacacaagg

SEQ ID NO: 14335 - RNA, 22 nt, Homo sapiens
uucauaguaacaguaacuaugg

SEQ ID NO: 14336 - RNA, 22 nt, Homo sapiens
uugugcuuaaugaguguaaggu

SEQ ID NO: 14337 - RNA, 22 nt, Homo sapiens
uuagcagcaugagaauggacua

SEQ ID NO: 14338 - RNA, 22 nt, Homo sapiens
aaccacauggcucaguggacau

SEQ ID NO: 14339 - RNA, 22 nt, Homo sapiens
gugggauggaaaugggcuucag

SEQ ID NO: 14340 - RNA, 22 nt, Homo sapiens
caugggcacugacuugcauucg

SEQ ID NO: 14341 - RNA, 22 nt, Homo sapiens
cucaguguuucagcugcucaga

SEQ ID NO: 14342 - RNA, 21 nt, Homo sapiens
gaauggcaccauuagcauaua

SEQ ID NO: 14343 - RNA, 22 nt, Homo sapiens
uuugauguugauacuaccuuca

SEQ ID NO: 14344 - RNA, 22 nt, Homo sapiens
uaaacugucuuuggagcuuugc

SEQ ID NO: 14345 - RNA, 22 nt, Homo sapiens
uaguaguuuuguguauaauaau

SEQ ID NO: 14346 - RNA, 22 nt, Homo sapiens
ugagauuaucguaauguaucuc

SEQ ID NO: 14347 - RNA, 22 nt, Homo sapiens
cugguuguuacaugcuugccag

SEQ ID NO: 14348 - RNA, 22 nt, Homo sapiens
gucacugccugaggcugaugca

SEQ ID NO: 14349 - RNA, 22 nt, Homo sapiens
gacuaggagagcagcugcccau

SEQ ID NO: 14350 - RNA, 22 nt, Homo sapiens
ucucauuggucugagucaccug

SEQ ID NO: 14351 - RNA, 22 nt, Homo sapiens
ugugccugagguuaacauuguu

SEQ ID NO: 14352 - RNA, 22 nt, Homo sapiens
auaaggcuaaggacuugaguua

SEQ ID NO: 14353 - RNA, 22 nt, Homo sapiens
caggugguauuugguuuucugu

SEQ ID NO: 14354 - RNA, 22 nt, Homo sapiens
aaggcaugcaguacguuucuau

SEQ ID NO: 14355 - RNA, 19 nt, Homo sapiens
gcugguuguccacucucuc

SEQ ID NO: 14356 - RNA, 22 nt, Homo sapiens
auacauguucaagggcauauau

SEQ ID NO: 14357 - RNA, 22 nt, Homo sapiens
gaaugcuaaguuuccucccuau

SEQ ID NO: 14358 - RNA, 22 nt, Homo sapiens
agacuagaaaucauuuguugag

SEQ ID NO: 14359 - RNA, 22 nt, Homo sapiens
uuaagacaccaaucauuggauu

SEQ ID NO: 14360 - RNA, 22 nt, Homo sapiens
acuggcucugcuuuacaaacag

SEQ ID NO: 14361 - RNA, 22 nt, Homo sapiens
ucuguguugaucacacugggag

SEQ ID NO: 14362 - RNA, 22 nt, Homo sapiens
agcgguguuaggaaggugaggg

SEQ ID NO: 14363 - RNA, 22 nt, Homo sapiens
ucacugugcacauaugauaggu

SEQ ID NO: 14364 - RNA, 22 nt, Homo sapiens
auaacucuguuuuuuucaugca

SEQ ID NO: 14365 - RNA, 22 nt, Homo sapiens
uauugugcauguugaauaacua

SEQ ID NO: 14366 - RNA, 22 nt, Homo sapiens
uuagacucauuuuggucaagga

SEQ ID NO: 14367 - RNA, 22 nt, Homo sapiens
auaucaaggccauuuucuaaau

SEQ ID NO: 14368 - RNA, 22 nt, Homo sapiens
uuaugcuugugugaauuuuccc

SEQ ID NO: 14369 - RNA, 15 nt, Homo sapiens
aaccuggaggagcuu

SEQ ID NO: 14370 - RNA, 22 nt, Homo sapiens
cuuagguuaugauaaauuuagu

SEQ ID NO: 14371 - RNA, 22 nt, Homo sapiens
cauugcacuccagccugaguga

SEQ ID NO: 14372 - RNA, 22 nt, Homo sapiens
cuucaucugguuugugaacuuu

SEQ ID NO: 14373 - RNA, 22 nt, Homo sapiens
ggcaguguauuacuuaggguuc

SEQ ID NO: 14374 - RNA, 18 nt, Homo sapiens
gugcaaugaauagcagag

SEQ ID NO: 14375 - RNA, 22 nt, Homo sapiens
acauaguagacacugaaaauau

SEQ ID NO: 14376 - RNA, 22 nt, Homo sapiens
cuaaugcagucaggagaaggaa

SEQ ID NO: 14377 - RNA, 22 nt, Homo sapiens
uaguugcaucuuaggucuguga

SEQ ID NO: 14378 - RNA, 22 nt, Homo sapiens
augagcuccucaaggucagaga

SEQ ID NO: 14379 - RNA, 22 nt, Homo sapiens
uuuaaugcacuaggugguguuc

SEQ ID NO: 14380 - RNA, 21 nt, Homo sapiens
ugucugagagaggagaucuac

SEQ ID NO: 14381 - RNA, 19 nt, Homo sapiens
ggcaccuuuuccaaaaaug

SEQ ID NO: 14382 - RNA, 22 nt, Homo sapiens
ugcaaccauuguuaagugugca

SEQ ID NO: 14383 - RNA, 22 nt, Homo sapiens
uagcauggagucaugcacggcu

SEQ ID NO: 14384 - RNA, 22 nt, Homo sapiens
agcaucacguagacuuuaccau

SEQ ID NO: 14385 - RNA, 22 nt, Homo sapiens
uggcaugauccuagauucaaca

SEQ ID NO: 14386 - RNA, 22 nt, Homo sapiens
auucaucagggauauugguuga

SEQ ID NO: 14387 - RNA, 22 nt, Homo sapiens
guccuguuuuuaagguucauag

SEQ ID NO: 14388 - RNA, 22 nt, Homo sapiens
uugucuagugaauacauuaaug

SEQ ID NO: 14389 - RNA, 22 nt, Homo sapiens
guggaaaacauaugcuuguuga

SEQ ID NO: 14390 - RNA, 22 nt, Homo sapiens
cuuugcuaauccaacccucauc

SEQ ID NO: 14391 - RNA, 19 nt, Homo sapiens
ccaguguucugauugcacu

SEQ ID NO: 14392 - RNA, 22 nt, Homo sapiens
ugagguaaaacaaggauuggau

SEQ ID NO: 14393 - RNA, 22 nt, Homo sapiens
ucacaguagagcuucuuucaga

SEQ ID NO: 14394 - RNA, 22 nt, Homo sapiens
aggugguuuuaggcagagacau

SEQ ID NO: 14395 - RNA, 22 nt, Homo sapiens
uaucacaggucaggaaccuugu

SEQ ID NO: 14396 - RNA, 21 nt, Homo sapiens
auuugguggcugugugacacu

SEQ ID NO: 14397 - RNA, 22 nt, Homo sapiens
ccccauuguugugguuuuaucu

SEQ ID NO: 14398 - RNA, 22 nt, Homo sapiens
gcagcagugcccuggauggaaa

SEQ ID NO: 14399 - RNA, 22 nt, Homo sapiens
cacugcauccuccaccugccag

SEQ ID NO: 14400 - RNA, 22 nt, Homo sapiens
uaguugcauucaggauaugacg

SEQ ID NO: 14401 - RNA, 19 nt, Homo sapiens
uagguacauucaagucucc

SEQ ID NO: 14402 - RNA, 22 nt, Homo sapiens
ggcaugaaguagcccacaggca

SEQ ID NO: 14403 - RNA, 22 nt, Homo sapiens
uugggcuugagggugcccaguc

SEQ ID NO: 14404 - RNA, 22 nt, Homo sapiens
ucucagugaaauaaauuauuuu

SEQ ID NO: 14405 - RNA, 20 nt, Homo sapiens
auuccacuuauaugaggucc

SEQ ID NO: 14406 - RNA, 22 nt, Homo sapiens
aaaagagcugagagguauucuu

SEQ ID NO: 14407 - RNA, 22 nt, Homo sapiens
uucacugugcuuaaauucugcu

SEQ ID NO: 14408 - RNA, 22 nt, Homo sapiens
uguagcacauuugaagagaagc

SEQ ID NO: 14409 - RNA, 20 nt, Homo sapiens
cucagguauuugaggcugca

SEQ ID NO: 14410 - RNA, 22 nt, Homo sapiens
uuucucaguguuucaggguagg

SEQ ID NO: 14411 - RNA, 22 nt, Homo sapiens
ugguagguuuauaaagaauuua

SEQ ID NO: 14412 - RNA, 22 nt, Homo sapiens
guugguauuacagaaauuaguu

SEQ ID NO: 14413 - RNA, 22 nt, Homo sapiens
uggguagucauuggaggguuuu

SEQ ID NO: 14414 - RNA, 22 nt, Homo sapiens
cucugguuaaggcugaacuaua

SEQ ID NO: 14415 - RNA, 22 nt, Homo sapiens
uaggcaguggagaaauaaacag

SEQ ID NO: 14416 - RNA, 22 nt, Homo sapiens
auagaccuggagaguagauaua

SEQ ID NO: 14417 - RNA, 22 nt, Homo sapiens
acagaucagagauauuuagguu

SEQ ID NO: 14418 - RNA, 22 nt, Homo sapiens
gaugaucucuggugguaaagac

SEQ ID NO: 14419 - RNA, 22 nt, Homo sapiens
ugaauguauuuauuaccauuca

SEQ ID NO: 14420 - RNA, 21 nt, Homo sapiens
augaauguaaagaauguggga

SEQ ID NO: 14421 - RNA, 23 nt, Homo sapiens
uaccugagacuggguaauuaaua

SEQ ID NO: 14422 - RNA, 21 nt, Homo sapiens
ccucuuugagggaagaaaggg

SEQ ID NO: 14423 - RNA, 22 nt, Homo sapiens
augaaaucuuuccugugaggau

SEQ ID NO: 14424 - RNA, 22 nt, Homo sapiens
uuugaugcaucucuacuuuguu

SEQ ID NO: 14425 - RNA, 22 nt, Homo sapiens
auagugcuuuuuagaaccugga

SEQ ID NO: 14426 - RNA, 22 nt, Homo sapiens
auuguaguacauuuggugguca

SEQ ID NO: 14427 - RNA, 19 nt, Homo sapiens
auaagugaaucacgggggc

SEQ ID NO: 14428 - RNA, 22 nt, Homo sapiens
uuggaauuagacaagugguggu

SEQ ID NO: 14429 - RNA, 22 nt, Homo sapiens
ucauugguucuggguguuguug

SEQ ID NO: 14430 - RNA, 20 nt, Homo sapiens
uccaguuuuggagacauucu

SEQ ID NO: 14431 - RNA, 19 nt, Homo sapiens
uagcagcaugauuuauaau

SEQ ID NO: 14432 - RNA, 22 nt, Homo sapiens
gagacauugacuuuguuccaga

SEQ ID NO: 14433 - RNA, 22 nt, Homo sapiens
ucagugucugugcaccgcugga

SEQ ID NO: 14434 - RNA, 18 nt, Homo sapiens
uuugguccuuuauaaaca

SEQ ID NO: 14435 - RNA, 22 nt, Homo sapiens
uuagggaguaaucuaaaaaugg

SEQ ID NO: 14436 - RNA, 22 nt, Homo sapiens
ggcaugguggugugugccuaua

SEQ ID NO: 14437 - RNA, 22 nt, Homo sapiens
aggagguugguaccaucuguuu

SEQ ID NO: 14438 - RNA, 22 nt, Homo sapiens
agguucccuuuuggccugggau

SEQ ID NO: 14439 - RNA, 22 nt, Homo sapiens
ugagguagguaccauuaucacu

SEQ ID NO: 14440 - RNA, 22 nt, Homo sapiens
gugugcucaucacaugcaauag

SEQ ID NO: 14441 - RNA, 22 nt, Homo sapiens
auaggcaagaugagguuuuuau

SEQ ID NO: 14442 - RNA, 22 nt, Homo sapiens
ugccuaggcuggaguguagugg

SEQ ID NO: 14443 - RNA, 22 nt, Homo sapiens
uuagccccuuugagccucaacu

SEQ ID NO: 14444 - RNA, 22 nt, Homo sapiens
cacugggugagauccauguuua

SEQ ID NO: 14445 - RNA, 22 nt, Homo sapiens
uuggcauuguggauggaaucau

SEQ ID NO: 14446 - RNA, 22 nt, Homo sapiens
uuugugagguggauagauugca

SEQ ID NO: 14447 - RNA, 22 nt, Homo sapiens
gugaaagacauauaugguuuga

SEQ ID NO: 14448 - RNA, 22 nt, Homo sapiens
ugcauguucuuacucauacaug

SEQ ID NO: 14449 - RNA, 19 nt, Homo sapiens
ggucccucucaagucauuc

SEQ ID NO: 14450 - RNA, 21 nt, Homo sapiens
ugaaguguaaccgugcagggc

SEQ ID NO: 14451 - RNA, 22 nt, Homo sapiens
augaguaguugcuaaauauuga

SEQ ID NO: 14452 - RNA, 21 nt, Homo sapiens
caaugacacuguagcugugcu

SEQ ID NO: 14453 - RNA, 22 nt, Homo sapiens
gugagaaucaaacuacauaaau

SEQ ID NO: 14454 - RNA, 22 nt, Homo sapiens
uuccccgugaaacuuucucauu

SEQ ID NO: 14455 - RNA, 20 nt, Homo sapiens
uacugcacuuuccucauggu

SEQ ID NO: 14456 - RNA, 22 nt, Homo sapiens
caagagaccugagugucauucu

SEQ ID NO: 14457 - RNA, 21 nt, Homo sapiens
ucaguuacugagagagaagug

SEQ ID NO: 14458 - RNA, 22 nt, Homo sapiens
ugaguucaauuguauuuuauua

SEQ ID NO: 14459 - RNA, 22 nt, Homo sapiens
gcaguggugugugccagccuag

SEQ ID NO: 14460 - RNA, 22 nt, Homo sapiens
uuuugguguauuguauaaggua

SEQ ID NO: 14461 - RNA, 22 nt, Homo sapiens
aagugguucuaugaguuugcaa

SEQ ID NO: 14462 - RNA, 22 nt, Homo sapiens
uugauaguuuaauuaaugcuag

SEQ ID NO: 14463 - RNA, 22 nt, Homo sapiens
ugacagagaagcauugaguuca

SEQ ID NO: 14464 - RNA, 22 nt, Homo sapiens
auguccuagagagauggugguc

SEQ ID NO: 14465 - RNA, 22 nt, Homo sapiens
aggaaauguuggucccauuucu

SEQ ID NO: 14466 - RNA, 22 nt, Homo sapiens
aagucaguuugggagaagcuau

SEQ ID NO: 14467 - RNA, 22 nt, Homo sapiens
auguggugguagccaggacagg

SEQ ID NO: 14468 - RNA, 22 nt, Homo sapiens
uugaguagugugaugcaugucu

SEQ ID NO: 14469 - RNA, 21 nt, Homo sapiens
uagcagcguuguugcaaaugu

SEQ ID NO: 14470 - RNA, 17 nt, Homo sapiens
guucccaguggcauuug

SEQ ID NO: 14471 - RNA, 22 nt, Homo sapiens
auacaugugccauguugguuug

SEQ ID NO: 14472 - RNA, 22 nt, Homo sapiens
cucaguggauuagauaaugcac

SEQ ID NO: 14473 - RNA, 22 nt, Homo sapiens
auugagcacugacucugugcca

SEQ ID NO: 14474 - RNA, 22 nt, Homo sapiens
ccgugcacggaaaggcauauuu

SEQ ID NO: 14475 - RNA, 23 nt, Homo sapiens
ucagugaaggaacaacuaaauag

SEQ ID NO: 14476 - RNA, 22 nt, Homo sapiens
cuauaacagugugguuuggaga

SEQ ID NO: 14477 - RNA, 22 nt, Homo sapiens
acauguauauaaugcauagcga

SEQ ID NO: 14478 - RNA, 22 nt, Homo sapiens
cacuggucagugaaacaguauu

SEQ ID NO: 14479 - RNA, 23 nt, Homo sapiens
ggaguguaaugacucgaucucgg

SEQ ID NO: 14480 - RNA, 22 nt, Homo sapiens
uugagcaaaacauuaauauuag

SEQ ID NO: 14481 - RNA, 22 nt, Homo sapiens
cagcugguggcaagaagacaga

SEQ ID NO: 14482 - RNA, 18 nt, Homo sapiens
uucuuguguugauauuuu

SEQ ID NO: 14483 - RNA, 22 nt, Homo sapiens
aacuaggccuagaaguugagua

SEQ ID NO: 14484 - RNA, 22 nt, Homo sapiens
uugagauggagucuugcucugu

SEQ ID NO: 14485 - RNA, 19 nt, Homo sapiens
uugcauauguugaaccagg

SEQ ID NO: 14486 - RNA, 21 nt, Homo sapiens
gucuuacagccagaugccucu

SEQ ID NO: 14487 - RNA, 22 nt, Homo sapiens
uacugcuuaagggcaugggccc

SEQ ID NO: 14488 - RNA, 22 nt, Homo sapiens
auguuagcaucuggcacuaugg

SEQ ID NO: 14489 - RNA, 22 nt, Homo sapiens
uuccugucuuccaagagagauu

SEQ ID NO: 14490 - RNA, 22 nt, Homo sapiens
gauuguguucauaggcauguua

SEQ ID NO: 14491 - RNA, 22 nt, Homo sapiens
augucuuucauagagacccaga

SEQ ID NO: 14492 - RNA, 22 nt, Homo sapiens
augaagcuagcugauugcugau

SEQ ID NO: 14493 - RNA, 23 nt, Homo sapiens
ugugguauuauuccauuuauagg

SEQ ID NO: 14494 - RNA, 22 nt, Homo sapiens
aucacaguuaagaggugaugaa

SEQ ID NO: 14495 - RNA, 22 nt, Homo sapiens
uugcuagucucuguuucaggau

SEQ ID NO: 14496 - RNA, 22 nt, Homo sapiens
ugacaucaccaccuccgucauc

SEQ ID NO: 14497 - RNA, 22 nt, Homo sapiens
cuuugugcccuucugcccauca

SEQ ID NO: 14498 - RNA, 22 nt, Homo sapiens
uugauauguaguuggacuugau

SEQ ID NO: 14499 - RNA, 22 nt, Homo sapiens
auugcagauucgcuuuguguug

SEQ ID NO: 14500 - RNA, 18 nt, Homo sapiens
gaagaaguaggcauggca

SEQ ID NO: 14501 - RNA, 22 nt, Homo sapiens
cucuuugaguuccuccuggugu

SEQ ID NO: 14502 - RNA, 22 nt, Homo sapiens
ucaguggagccucacucugugg

SEQ ID NO: 14503 - RNA, 22 nt, Homo sapiens
aagagguaggaaauggucauuu

SEQ ID NO: 14504 - RNA, 22 nt, Homo sapiens
uacugcauucuccgccuccggg

SEQ ID NO: 14505 - RNA, 22 nt, Homo sapiens
uagggcaaggaacaguuaaaaa

SEQ ID NO: 14506 - RNA, 22 nt, Homo sapiens
agcuguuguuuuaagauacuaa

SEQ ID NO: 14507 - RNA, 22 nt, Homo sapiens
ucaaaugaucugcccgccuugg

SEQ ID NO: 14508 - RNA, 20 nt, Homo sapiens
uggaguuugaguucuuggag

SEQ ID NO: 14509 - RNA, 22 nt, Homo sapiens
uuguccccaucugcugccagaa

SEQ ID NO: 14510 - RNA, 22 nt, Homo sapiens
uaggccuuuuuaugucaauauc

SEQ ID NO: 14511 - RNA, 22 nt, Homo sapiens
auugagguauaauugcuaugca

SEQ ID NO: 14512 - RNA, 22 nt, Homo sapiens
uugagaaucuuucgaauguucu

SEQ ID NO: 14513 - RNA, 20 nt, Homo sapiens
cagcuagugguaggagucgg

SEQ ID NO: 14514 - RNA, 22 nt, Homo sapiens
uuagcacuaauucguuggggca

SEQ ID NO: 14515 - RNA, 21 nt, Homo sapiens
gugcacaguaguguuuaauag

SEQ ID NO: 14516 - RNA, 22 nt, Homo sapiens
uguuuguuugagauggagucuc

SEQ ID NO: 14517 - RNA, 23 nt, Homo sapiens
accugugguuauuuuacucuucc

SEQ ID NO: 14518 - RNA, 20 nt, Homo sapiens
ugacaagugagaauuauggg

SEQ ID NO: 14519 - RNA, 22 nt, Homo sapiens
cacaguguuccagcuauuugaa

SEQ ID NO: 14520 - RNA, 22 nt, Homo sapiens
agcaugacauauuguagagaaa

SEQ ID NO: 14521 - RNA, 22 nt, Homo sapiens
cuucacggugccuacuuguguc

SEQ ID NO: 14522 - RNA, 22 nt, Homo sapiens
uggauagauacuauccaggacu

SEQ ID NO: 14523 - RNA, 22 nt, Homo sapiens
uuaguccacuggaacuguuaua

SEQ ID NO: 14524 - RNA, 16 nt, Homo sapiens
gggcaugugaagccua

SEQ ID NO: 14525 - RNA, 22 nt, Homo sapiens
auggcagcugguuuuacccuag

SEQ ID NO: 14526 - RNA, 23 nt, Homo sapiens
uucaccugguuauuaauagccuc

SEQ ID NO: 14527 - RNA, 22 nt, Homo sapiens
guugauguugcagucuugagga

SEQ ID NO: 14528 - RNA, 22 nt, Homo sapiens
agcaccguucaaacccagguua

SEQ ID NO: 14529 - RNA, 22 nt, Homo sapiens
uacuccccuuguucugugagcu

SEQ ID NO: 14530 - RNA, 22 nt, Homo sapiens
auagaucuauuuauguaucccu

SEQ ID NO: 14531 - RNA, 22 nt, Homo sapiens
gcaccacugcacucucagcuug

SEQ ID NO: 14532 - RNA, 22 nt, Homo sapiens
aaccuauaguauugaaaucaag

SEQ ID NO: 14533 - RNA, 19 nt, Homo sapiens
ggugagaaauuaugggucu

SEQ ID NO: 14534 - RNA, 22 nt, Homo sapiens
acugcacuccagccucguggac

SEQ ID NO: 14535 - RNA, 22 nt, Homo sapiens
uagugcaguggcuccaucucag

SEQ ID NO: 14536 - RNA, 22 nt, Homo sapiens
aguaacauuucuaguagagagu

SEQ ID NO: 14537 - RNA, 22 nt, Homo sapiens
uagguugucuguucacucugau

SEQ ID NO: 14538 - RNA, 22 nt, Homo sapiens
uagcaguauaugagagcuauug

SEQ ID NO: 14539 - RNA, 22 nt, Homo sapiens
gagcucauuguugcuaaagaga

SEQ ID NO: 14540 - RNA, 22 nt, Homo sapiens
cgcuggugucuaagcgacagcu

SEQ ID NO: 14541 - RNA, 22 nt, Homo sapiens
ucucugagaaaaguuucuccca

SEQ ID NO: 14542 - RNA, 22 nt, Homo sapiens
aucagauggcuaaaacagaaga

SEQ ID NO: 14543 - RNA, 22 nt, Homo sapiens
uuacaccuguaauccagcacuu

SEQ ID NO: 14544 - RNA, 22 nt, Homo sapiens
ggauugugauaauuguugcaaa

SEQ ID NO: 14545 - RNA, 22 nt, Homo sapiens
auggcuuucaggacguggcgag

SEQ ID NO: 14546 - RNA, 22 nt, Homo sapiens
uaggcauuuuucugauaaacua

SEQ ID NO: 14547 - RNA, 22 nt, Homo sapiens
uauugcuuuugauucaaggcag

SEQ ID NO: 14548 - RNA, 22 nt, Homo sapiens
gauauguuagggggagaaguua

SEQ ID NO: 14549 - RNA, 22 nt, Homo sapiens
aucauugugcaucuucauucca

SEQ ID NO: 14550 - RNA, 22 nt, Homo sapiens
aagcuguugguggaucuaccau

SEQ ID NO: 14551 - RNA, 22 nt, Homo sapiens
uugaaagucauuucuucuaagu

SEQ ID NO: 14552 - RNA, 22 nt, Homo sapiens
uggaguguagaagccagccucc

SEQ ID NO: 14553 - RNA, 22 nt, Homo sapiens
cuugggauauguguuacucugu

SEQ ID NO: 14554 - RNA, 22 nt, Homo sapiens
gaaugaauguuuauccuuagau

SEQ ID NO: 14555 - RNA, 22 nt, Homo sapiens
ucaggugccuuggcuaauuguu

SEQ ID NO: 14556 - RNA, 22 nt, Homo sapiens
cagguauagucacuugcccaag

SEQ ID NO: 14557 - RNA, 22 nt, Homo sapiens
caccgagugugccaucuucuca

SEQ ID NO: 14558 - RNA, 22 nt, Homo sapiens
uaccuuaucccuaacuucccau

SEQ ID NO: 14559 - RNA, 22 nt, Homo sapiens
uguggcuuuacagcaugguuca

SEQ ID NO: 14560 - RNA, 22 nt, Homo sapiens
gugagcuccucucuauguguca

SEQ ID NO: 14561 - RNA, 22 nt, Homo sapiens
ggaugcauucaacuuccaguuc

SEQ ID NO: 14562 - RNA, 22 nt, Homo sapiens
uucaguacacguguucucauuu

SEQ ID NO: 14563 - RNA, 22 nt, Homo sapiens
ugagguaugugaugucuuuuag

SEQ ID NO: 14564 - RNA, 22 nt, Homo sapiens
acacgugcagauuuauauaaau

SEQ ID NO: 14565 - RNA, 19 nt, Homo sapiens
ucugugcuugucccccugu

SEQ ID NO: 14566 - RNA, 22 nt, Homo sapiens
ugggagugugcacaauuucagc

SEQ ID NO: 14567 - RNA, 22 nt, Homo sapiens
aucuuguguugaauggugcaga

SEQ ID NO: 14568 - RNA, 22 nt, Homo sapiens
uagcaguagacagacuuuggcu

SEQ ID NO: 14569 - RNA, 22 nt, Homo sapiens
ugaaauggaagaagucccuuuu

SEQ ID NO: 14570 - RNA, 22 nt, Homo sapiens
ucuuuggagacaaccccagucu

SEQ ID NO: 14571 - RNA, 22 nt, Homo sapiens
ugagguugucagugucauucuu

SEQ ID NO: 14572 - RNA, 22 nt, Homo sapiens
ugccuaguggccuuaugaguau

SEQ ID NO: 14573 - RNA, 22 nt, Homo sapiens
cuguaguuagcagaugaugaau

SEQ ID NO: 14574 - RNA, 22 nt, Homo sapiens
uucugaguggcuuucaacacug

SEQ ID NO: 14575 - RNA, 22 nt, Homo sapiens
gcaguacacuguugguaggaau

SEQ ID NO: 14576 - RNA, 22 nt, Homo sapiens
uugcacauugcaccuuuuguau

SEQ ID NO: 14577 - RNA, 22 nt, Homo sapiens
gucuccggauguuguuuuuggg

SEQ ID NO: 14578 - RNA, 22 nt, Homo sapiens
uugugcaaaaguaauugcgguu

SEQ ID NO: 14579 - RNA, 22 nt, Homo sapiens
cucucaguugucuaauuaguuu

SEQ ID NO: 14580 - RNA, 22 nt, Homo sapiens
ucagacacugcccuccaccugu

SEQ ID NO: 14581 - RNA, 22 nt, Homo sapiens
uggagauccuucauuuuggugu

SEQ ID NO: 14582 - RNA, 20 nt, Homo sapiens
cagugcaccuggcguguuga

SEQ ID NO: 14583 - RNA, 22 nt, Homo sapiens
aucacagaacuuugagcagaga

SEQ ID NO: 14584 - RNA, 22 nt, Homo sapiens
auugcaacaguguugagaggug

SEQ ID NO: 14585 - RNA, 22 nt, Homo sapiens
ucccuguuguuucauaauuuua

SEQ ID NO: 14586 - RNA, 22 nt, Homo sapiens
ucacuuugacggccaacuucua

SEQ ID NO: 14587 - RNA, 22 nt, Homo sapiens
cauugcauuccagucugggcaa

SEQ ID NO: 14588 - RNA, 22 nt, Homo sapiens
ugagaugaucaaaguauaggcu

SEQ ID NO: 14589 - RNA, 22 nt, Homo sapiens
gcucaugggcagugugauuguu

SEQ ID NO: 14590 - RNA, 22 nt, Homo sapiens
ugaugacauugucacagucuga

SEQ ID NO: 14591 - RNA, 22 nt, Homo sapiens
uaguaccauucccaaaccaacu

SEQ ID NO: 14592 - RNA, 22 nt, Homo sapiens
auacguacauaugcacauaugg

SEQ ID NO: 14593 - RNA, 22 nt, Homo sapiens
guagaauguauacaguauacag

SEQ ID NO: 14594 - RNA, 22 nt, Homo sapiens
gugagcaauugauacuugaagu

SEQ ID NO: 14595 - RNA, 22 nt, Homo sapiens
aaucacaguuaguaagggagaa

SEQ ID NO: 14596 - RNA, 22 nt, Homo sapiens
aucucaaugcuuuuguaggcca

SEQ ID NO: 14597 - RNA, 22 nt, Homo sapiens
auuauaugucaucacagacacc

SEQ ID NO: 14598 - RNA, 20 nt, Homo sapiens
aguauucacuuuuuucaugg

SEQ ID NO: 14599 - RNA, 22 nt, Homo sapiens
agcuuguggugaauacugcuag

SEQ ID NO: 14600 - RNA, 20 nt, Homo sapiens
gacauaggcugguaucuggc

SEQ ID NO: 14601 - RNA, 22 nt, Homo sapiens
uaggcuguguggccguggggcu

SEQ ID NO: 14602 - RNA, 23 nt, Homo sapiens
ugagucacuuugcuggggucucu

SEQ ID NO: 14603 - RNA, 22 nt, Homo sapiens
cuagaagcauauucagaacaga

SEQ ID NO: 14604 - RNA, 22 nt, Homo sapiens
ggauaucauuauuucuagggcu

SEQ ID NO: 14605 - RNA, 22 nt, Homo sapiens
aaauuguccuacugguuugagu

SEQ ID NO: 14606 - RNA, 22 nt, Homo sapiens
gucucccagccuacaucuuucu

SEQ ID NO: 14607 - RNA, 19 nt, Homo sapiens
uagagguuuaagaaaagaa

SEQ ID NO: 14608 - RNA, 18 nt, Homo sapiens
uggcaauaugguucuacc

SEQ ID NO: 14609 - RNA, 22 nt, Homo sapiens
uguaacacacacuguuuacucc

SEQ ID NO: 14610 - RNA, 22 nt, Homo sapiens
ggugcuugaggaacggaggcug

SEQ ID NO: 14611 - RNA, 22 nt, Homo sapiens
augguaguagaugugugguuuu

SEQ ID NO: 14612 - RNA, 21 nt, Homo sapiens
guggccuuuggagcaugucag

SEQ ID NO: 14613 - RNA, 22 nt, Homo sapiens
caaagucuucaguugauucuga

SEQ ID NO: 14614 - RNA, 21 nt, Homo sapiens
uguagcagcaugauucauagu

SEQ ID NO: 14615 - RNA, 22 nt, Homo sapiens
aaacugucuggaugcuugugga

SEQ ID NO: 14616 - RNA, 22 nt, Homo sapiens
uugcuaagucaagagaaaugau

SEQ ID NO: 14617 - RNA, 22 nt, Homo sapiens
cugaaggcagguagaauagaga

SEQ ID NO: 14618 - RNA, 22 nt, Homo sapiens
uauagcagugaguauugacuaa

SEQ ID NO: 14619 - RNA, 20 nt, Homo sapiens
uccacugagcgucacggcag

SEQ ID NO: 14620 - RNA, 22 nt, Homo sapiens
augaugaaguaagugcuuagga

SEQ ID NO: 14621 - RNA, 22 nt, Homo sapiens
ugccaaggagucagucccuaga

SEQ ID NO: 14622 - RNA, 22 nt, Homo sapiens
gucugguuuuuuauauccucac

SEQ ID NO: 14623 - RNA, 22 nt, Homo sapiens
uuuacagucuuuugugugaguc

SEQ ID NO: 14624 - RNA, 22 nt, Homo sapiens
cauugcacuccagcuugggcga

SEQ ID NO: 14625 - RNA, 18 nt, Homo sapiens
aaacugcuuccuuggccu

SEQ ID NO: 14626 - RNA, 22 nt, Homo sapiens
uuagcgccuuucuuccucuccu

SEQ ID NO: 14627 - RNA, 22 nt, Homo sapiens
ggagguaauaaguuccagugua

SEQ ID NO: 14628 - RNA, 22 nt, Homo sapiens
uugguaguuucugucuuuagau

SEQ ID NO: 14629 - RNA, 22 nt, Homo sapiens
auuacccuuagacuccagagug

SEQ ID NO: 14630 - RNA, 22 nt, Homo sapiens
gucucccagccuacauauuucu

SEQ ID NO: 14631 - RNA, 22 nt, Homo sapiens
gucaggcaccgauacaguuuuu

SEQ ID NO: 14632 - RNA, 22 nt, Homo sapiens
auugccuagccuggucucaaaa

SEQ ID NO: 14633 - RNA, 19 nt, Homo sapiens
auuuccuggagcuggucuc

SEQ ID NO: 14634 - RNA, 22 nt, Homo sapiens
auuggugaccugcggcaguaug

SEQ ID NO: 14635 - RNA, 22 nt, Homo sapiens
caucacuuuuccuuuuacagau

SEQ ID NO: 14636 - RNA, 19 nt, Homo sapiens
ugugacugggccagccuag

SEQ ID NO: 14637 - RNA, 22 nt, Homo sapiens
ucuugaacuucauaggucuaga

SEQ ID NO: 14638 - RNA, 21 nt, Homo sapiens
ggcaugaauggaaaagugaga

SEQ ID NO: 14639 - RNA, 22 nt, Homo sapiens
uuguguuugaugcugacacgca

SEQ ID NO: 14640 - RNA, 22 nt, Homo sapiens
uaaagccagugauuaugucucu

SEQ ID NO: 14641 - RNA, 22 nt, Homo sapiens
auuggggaaugguggcuuuagu

SEQ ID NO: 14642 - RNA, 22 nt, Homo sapiens
uuggaaagagguguuuaugacu

SEQ ID NO: 14643 - RNA, 22 nt, Homo sapiens
augggacugggugccguggagc

SEQ ID NO: 14644 - RNA, 22 nt, Homo sapiens
ccacugcacuccagcccggcaa

SEQ ID NO: 14645 - RNA, 22 nt, Homo sapiens
aucaaguacuguacugaaagug

SEQ ID NO: 14646 - RNA, 22 nt, Homo sapiens
aaucacacuugauguugagcaa

SEQ ID NO: 14647 - RNA, 19 nt, Homo sapiens
guaaugugcuucaguagca

SEQ ID NO: 14648 - RNA, 19 nt, Homo sapiens
aucagcacaagugugcuuu

SEQ ID NO: 14649 - RNA, 21 nt, Homo sapiens
uguggcaauggccucacagau

SEQ ID NO: 14650 - RNA, 22 nt, Homo sapiens
ucacccuguguuuugcguuugc

SEQ ID NO: 14651 - RNA, 22 nt, Homo sapiens
uucagaucaucccagcuccacu

SEQ ID NO: 14652 - RNA, 22 nt, Homo sapiens
auccaguuuuaggagauuucua

SEQ ID NO: 14653 - RNA, 22 nt, Homo sapiens
aagguaguuuucuuuaaugcug

SEQ ID NO: 14654 - RNA, 22 nt, Homo sapiens
uggcuacugacugaugauuaua

SEQ ID NO: 14655 - RNA, 22 nt, Homo sapiens
agagguuuaauugauucacagu

SEQ ID NO: 14656 - RNA, 22 nt, Homo sapiens
uguuuuggagguccucacuaga

SEQ ID NO: 14657 - RNA, 22 nt, Homo sapiens
ccuugguggccacaagacauug

SEQ ID NO: 14658 - RNA, 22 nt, Homo sapiens
uugauaguuuuaaaauuaaucu

SEQ ID NO: 14659 - RNA, 17 nt, Homo sapiens
acaugagacuggauucu

SEQ ID NO: 14660 - RNA, 22 nt, Homo sapiens
ugugucuugcuggugccugcau

SEQ ID NO: 14661 - RNA, 22 nt, Homo sapiens
uugacaguggcuuaaauugguu

SEQ ID NO: 14662 - RNA, 22 nt, Homo sapiens
uaugaggaguauaacccgguga

SEQ ID NO: 14663 - RNA, 22 nt, Homo sapiens
uuggaagacaaugcugauucuc

SEQ ID NO: 14664 - RNA, 22 nt, Homo sapiens
ugugccuaguaauguguccaga

SEQ ID NO: 14665 - RNA, 22 nt, Homo sapiens
uuucgugucuggucugugaugg

SEQ ID NO: 14666 - RNA, 22 nt, Homo sapiens
uauguguuuuauggucagggag

SEQ ID NO: 14667 - RNA, 21 nt, Homo sapiens
ggauagaaaacuuggcuguau

SEQ ID NO: 14668 - RNA, 22 nt, Homo sapiens
aggaggauugcuuucaucuuuu

SEQ ID NO: 14669 - RNA, 22 nt, Homo sapiens
agcugcaauguuuaguauaaua

SEQ ID NO: 14670 - RNA, 21 nt, Homo sapiens
aaacuggcccaauuguuccau

SEQ ID NO: 14671 - RNA, 22 nt, Homo sapiens
ugccuaguguguugagaguuuu

SEQ ID NO: 14672 - RNA, 22 nt, Homo sapiens
gcaaaaaguagugcugguuagg

SEQ ID NO: 14673 - RNA, 15 nt, Homo sapiens
uuucaguacagauuc

SEQ ID NO: 14674 - RNA, 22 nt, Homo sapiens
gaggcaaguggccaccgagucu

SEQ ID NO: 14675 - RNA, 22 nt, Homo sapiens
ugagcaacauuucaaaacucca

SEQ ID NO: 14676 - RNA, 22 nt, Homo sapiens
ugcugcaaacaugagaggaagu

SEQ ID NO: 14677 - RNA, 22 nt, Homo sapiens
ucacuggacagaaauaaaggug

SEQ ID NO: 14678 - RNA, 22 nt, Homo sapiens
ucacuggagguuccugaaguuc

SEQ ID NO: 14679 - RNA, 22 nt, Homo sapiens
ucacugggagcauuugagccuu

SEQ ID NO: 14680 - RNA, 22 nt, Homo sapiens
ucaggcacucagcuuagagucu

SEQ ID NO: 14681 - RNA, 22 nt, Homo sapiens
ucaguaccugagagugggcaga

SEQ ID NO: 14682 - RNA, 22 nt, Homo sapiens
ucauacgucuccuugugccacc

SEQ ID NO: 14683 - RNA, 22 nt, Homo sapiens
ucauggggugcuuugcuagauu

SEQ ID NO: 14684 - RNA, 22 nt, Homo sapiens
uccagguacucagggggcugag

SEQ ID NO: 14685 - RNA, 22 nt, Homo sapiens
aagugcuuuuuagauaugguuu

SEQ ID NO: 14686 - RNA, 22 nt, Homo sapiens
accccauuugcacugagcccuu

SEQ ID NO: 14687 - RNA, 22 nt, Homo sapiens
acucagagagaacugucauuug

SEQ ID NO: 14688 - RNA, 19 nt, Homo sapiens
acugagcuaccugggggca

SEQ ID NO: 14689 - RNA, 22 nt, Homo sapiens
acuguguguuugucuagcacag

SEQ ID NO: 14690 - RNA, 17 nt, Homo sapiens
agcauguguuugagauu

SEQ ID NO: 14691 - RNA, 22 nt, Homo sapiens
agcggcuguuccccuggucuau

SEQ ID NO: 14692 - RNA, 22 nt, Homo sapiens
aggugguuuugaugagcaggua

SEQ ID NO: 14693 - RNA, 22 nt, Homo sapiens
agugagcugcagucuggggucc

SEQ ID NO: 14694 - RNA, 22 nt, Homo sapiens
aguggaauuaagaaacugaauu

SEQ ID NO: 14695 - RNA, 22 nt, Homo sapiens
auauucaagugaggauggcuaa

SEQ ID NO: 14696 - RNA, 22 nt, Homo sapiens
auccauugcucaagagaaguca

SEQ ID NO: 14697 - RNA, 22 nt, Homo sapiens
aucccaguucagccucugacac

SEQ ID NO: 14698 - RNA, 22 nt, Homo sapiens
augacacugcagagauguccca

SEQ ID NO: 14699 - RNA, 22 nt, Homo sapiens
augaccuuggggaaccaugucu

SEQ ID NO: 14700 - RNA, 20 nt, Homo sapiens
augagguguaugacacugaa

SEQ ID NO: 14701 - RNA, 22 nt, Homo sapiens
augagguguuuauuguauccug

SEQ ID NO: 14702 - RNA, 20 nt, Homo sapiens
augccacugagcagugguga

SEQ ID NO: 14703 - RNA, 20 nt, Homo sapiens
auguucuggaggacagaagc

SEQ ID NO: 14704 - RNA, 22 nt, Homo sapiens
caagugcuugaugaaugaucaa

SEQ ID NO: 14705 - RNA, 22 nt, Homo sapiens
caagugcuuucuuggggauuua

SEQ ID NO: 14706 - RNA, 22 nt, Homo sapiens
cacauguucaggagcacuuaga

SEQ ID NO: 14707 - RNA, 22 nt, Homo sapiens
cacccaguaagcaugaggcccu

SEQ ID NO: 14708 - RNA, 22 nt, Homo sapiens
cagagaacauucagagcuguag

SEQ ID NO: 14709 - RNA, 22 nt, Homo sapiens
cagccggguggcuccuagggua

SEQ ID NO: 14710 - RNA, 22 nt, Homo sapiens
cagugcaaagccucugcccaga

SEQ ID NO: 14711 - RNA, 22 nt, Homo sapiens
cuaggcuguagagaaguucagu

SEQ ID NO: 14712 - RNA, 22 nt, Homo sapiens
cucagagcacaguuuaugacag

SEQ ID NO: 14713 - RNA, 22 nt, Homo sapiens
cucauugcaaucuccaccuccc

SEQ ID NO: 14714 - RNA, 19 nt, Homo sapiens
cucuuuggugucucuucuu

SEQ ID NO: 14715 - RNA, 22 nt, Homo sapiens
cugaccucugucaaagacaccc

SEQ ID NO: 14716 - RNA, 22 nt, Homo sapiens
cugagugcaagugauccuccca

SEQ ID NO: 14717 - RNA, 22 nt, Homo sapiens
cuggagaucuugacauugaagu

SEQ ID NO: 14718 - RNA, 22 nt, Homo sapiens
cuggcagugcuuguuauccugg

SEQ ID NO: 14719 - RNA, 22 nt, Homo sapiens
cuggcaguguuucuugugggcu

SEQ ID NO: 14720 - RNA, 22 nt, Homo sapiens
cuuggcacgugauagguguuga

SEQ ID NO: 14721 - RNA, 22 nt, Homo sapiens
cuuggcacucuguggaguuagg

SEQ ID NO: 14722 - RNA, 22 nt, Homo sapiens
gagaacugagugugcuggcgga

SEQ ID NO: 14723 - RNA, 22 nt, Homo sapiens
gagacugagucucgcucugccg

SEQ ID NO: 14724 - RNA, 22 nt, Homo sapiens
gagaugauuugccccauguauu

SEQ ID NO: 14725 - RNA, 22 nt, Homo sapiens
gagcaaugauugagccacugua

SEQ ID NO: 14726 - RNA, 22 nt, Homo sapiens
gagcacauguggagagucuggg

SEQ ID NO: 14727 - RNA, 22 nt, Homo sapiens
gagcacugaauacugugguggu

SEQ ID NO: 14728 - RNA, 22 nt, Homo sapiens
gagcuuggguuaaaguugccuu

SEQ ID NO: 14729 - RNA, 21 nt, Homo sapiens
gagguaccucauguaagugga

SEQ ID NO: 14730 - RNA, 22 nt, Homo sapiens
gaggugguagguucacagcagc

SEQ ID NO: 14731 - RNA, 22 nt, Homo sapiens
gagugcaauggcagaucuccgc

SEQ ID NO: 14732 - RNA, 22 nt, Homo sapiens
gagugcaauggcgcgaucucgg

SEQ ID NO: 14733 - RNA, 22 nt, Homo sapiens
gagugcaauggugcuaucucgg

SEQ ID NO: 14734 - RNA, 22 nt, Homo sapiens
gauggcacuuaagagcaagagc

SEQ ID NO: 14735 - RNA, 22 nt, Homo sapiens
gauggcagugcagccccuggcu

SEQ ID NO: 14736 - RNA, 22 nt, Homo sapiens
gauggugucccaggcucaggcu

SEQ ID NO: 14737 - RNA, 22 nt, Homo sapiens
gcacugagagaagccccaagua

SEQ ID NO: 14738 - RNA, 22 nt, Homo sapiens
gcaguggugugugccagccuag

SEQ ID NO: 14739 - RNA, 22 nt, Homo sapiens
gcaguguuggggccggaggcug

SEQ ID NO: 14740 - RNA, 22 nt, Homo sapiens
gcuaggagauccacugcucucu

SEQ ID NO: 14741 - RNA, 22 nt, Homo sapiens
gcucaugagacaagcaggagua

SEQ ID NO: 14742 - RNA, 22 nt, Homo sapiens
gcugcuguggcagauuggauuc

SEQ ID NO: 14743 - RNA, 22 nt, Homo sapiens
ggagagcuaggcagagguuugu

SEQ ID NO: 14744 - RNA, 22 nt, Homo sapiens
ggagaugugccugcucugcucu

SEQ ID NO: 14745 - RNA, 22 nt, Homo sapiens
ggauaacagccaggucaaacaa

SEQ ID NO: 14746 - RNA, 17 nt, Homo sapiens
ggcaggauccaggaucc

SEQ ID NO: 14747 - RNA, 22 nt, Homo sapiens
ggccuguaggguauugguaggg

SEQ ID NO: 14748 - RNA, 22 nt, Homo sapiens
gggguaggcuacacugaguucc

SEQ ID NO: 14749 - RNA, 22 nt, Homo sapiens
gguaaacauacugcugucuucu

SEQ ID NO: 14750 - RNA, 22 nt, Homo sapiens
gucacggaauguaaguggaagu

SEQ ID NO: 14751 - RNA, 22 nt, Homo sapiens
gucuuggcaugugcagcuggga

SEQ ID NO: 14752 - RNA, 22 nt, Homo sapiens
gugagaugauggguauguuaau

SEQ ID NO: 14753 - RNA, 22 nt, Homo sapiens
gugcacaacaugcaguuuuguu

SEQ ID NO: 14754 - RNA, 22 nt, Homo sapiens
gugcagugugauccuuccguau

SEQ ID NO: 14755 - RNA, 22 nt, Homo sapiens
guggacggagguugcagugagc

SEQ ID NO: 14756 - RNA, 22 nt, Homo sapiens
gugggauggaaaugggcuucag

SEQ ID NO: 14757 - RNA, 22 nt, Homo sapiens
guguucaaacccaggucugucu

SEQ ID NO: 14758 - RNA, 22 nt, Homo sapiens
uacaggcagguguucccugguu

SEQ ID NO: 14759 - RNA, 21 nt, Homo sapiens
uacuggagauacagucugcaa

SEQ ID NO: 14760 - RNA, 22 nt, Homo sapiens
uagcacugucuugcaccugugc

SEQ ID NO: 14761 - RNA, 22 nt, Homo sapiens
uaggagcacaaaccccauugug

SEQ ID NO: 14762 - RNA, 22 nt, Homo sapiens
uaggagcacaaacccuacugug

SEQ ID NO: 14763 - RNA, 20 nt, Homo sapiens
uaguggaaaucagguccucu

SEQ ID NO: 14764 - RNA, 22 nt, Homo sapiens
aaagugcugagacagacuggga

SEQ ID NO: 14765 - RNA, 22 nt, Homo sapiens
aaagugcugggauuuuaggcau

SEQ ID NO: 14766 - RNA, 22 nt, Homo sapiens
aaagugcuuacuaaguugccaa

SEQ ID NO: 14767 - RNA, 22 nt, Homo sapiens
aaaugccucccauucuacugac

SEQ ID NO: 14768 - RNA, 22 nt, Homo sapiens
aaggcauucucaaacuaguucu

SEQ ID NO: 14769 - RNA, 22 nt, Homo sapiens
aagugcuuacagggaacaugau

SEQ ID NO: 14770 - RNA, 22 nt, Homo sapiens
aagugcuuaggauagugugugg

SEQ ID NO: 14771 - RNA, 22 nt, Homo sapiens
aagugguguuugggagcuggac

SEQ ID NO: 14772 - RNA, 22 nt, Homo sapiens
acaguguuccuuuguugugacu

SEQ ID NO: 14773 - RNA, 22 nt, Homo sapiens
acccauguaggugggauuacag

SEQ ID NO: 14774 - RNA, 22 nt, Homo sapiens
acugguguaugggaggucccaa

SEQ ID NO: 14775 - RNA, 23 nt, Homo sapiens
agagugcaauggugccaucucgg

SEQ ID NO: 14776 - RNA, 17 nt, Homo sapiens
agcuggaauuacgggag

SEQ ID NO: 14777 - RNA, 20 nt, Homo sapiens
agcuggguguguuggugcau

SEQ ID NO: 14778 - RNA, 22 nt, Homo sapiens
aggcuguguggauaauauuggg

SEQ ID NO: 14779 - RNA, 22 nt, Homo sapiens
agugagcuggagaaaagaaacu

SEQ ID NO: 14780 - RNA, 22 nt, Homo sapiens
auacagugaauacuuacagugu

SEQ ID NO: 14781 - RNA, 22 nt, Homo sapiens
auagcacaugugcaaauggcug

SEQ ID NO: 14782 - RNA, 22 nt, Homo sapiens
aucacagcuacuccucugucuu

SEQ ID NO: 14783 - RNA, 19 nt, Homo sapiens
aucaccagucuuuccacug

SEQ ID NO: 14784 - RNA, 22 nt, Homo sapiens
aucccagaaacucggguuucuc

SEQ ID NO: 14785 - RNA, 22 nt, Homo sapiens
augacuaaaggguuuauguuga

SEQ ID NO: 14786 - RNA, 18 nt, Homo sapiens
augacucuggguguuccu

SEQ ID NO: 14787 - RNA, 17 nt, Homo sapiens
augagcucaucauuuuu

SEQ ID NO: 14788 - RNA, 22 nt, Homo sapiens
auguaguagauauuuauggaaa

SEQ ID NO: 14789 - RNA, 22 nt, Homo sapiens
augucaacauagacaguagagu

SEQ ID NO: 14790 - RNA, 22 nt, Homo sapiens
augugacagcaacccccagccc

SEQ ID NO: 14791 - RNA, 22 nt, Homo sapiens
auugcuuuuacugggagcuuug

SEQ ID NO: 14792 - RNA, 22 nt, Homo sapiens
caaaagugguucuuauccuuuu

SEQ ID NO: 14793 - RNA, 22 nt, Homo sapiens
caaaugaucugcuggccucagc

SEQ ID NO: 14794 - RNA, 22 nt, Homo sapiens
caacucuguaggauccaggugg

SEQ ID NO: 14795 - RNA, 22 nt, Homo sapiens
cacagggcuaacauuuuugccc

SEQ ID NO: 14796 - RNA, 22 nt, Homo sapiens
cacauguuugcuacauuuuucu

SEQ ID NO: 14797 - RNA, 23 nt, Homo sapiens
cacugggcagcagguguucccag

SEQ ID NO: 14798 - RNA, 22 nt, Homo sapiens
cagccgggugagguggcuuguu

SEQ ID NO: 14799 - RNA, 22 nt, Homo sapiens
caugccacugcacgccauccug

SEQ ID NO: 14800 - RNA, 22 nt, Homo sapiens
cauggcccugggcugggcgaac

SEQ ID NO: 14801 - RNA, 19 nt, Homo sapiens
ccaguguucugauugcacu

SEQ ID NO: 14802 - RNA, 22 nt, Homo sapiens
ccaguguucuggaaggcugagu

SEQ ID NO: 14803 - RNA, 22 nt, Homo sapiens
cgccgggggaugggcaccagcg

SEQ ID NO: 14804 - RNA, 22 nt, Homo sapiens
cucauugcaaucucugccuccc

SEQ ID NO: 14805 - RNA, 22 nt, Homo sapiens
cuugcagaggcccuggggagag

SEQ ID NO: 14806 - RNA, 22 nt, Homo sapiens
gacauguuuacaguguugagag

SEQ ID NO: 14807 - RNA, 22 nt, Homo sapiens
gacugcagugcagcuguuaggc

SEQ ID NO: 14808 - RNA, 22 nt, Homo sapiens
gacuggagcuguaugugguuac

SEQ ID NO: 14809 - RNA, 22 nt, Homo sapiens
gacuuugguaaacucgguggca

SEQ ID NO: 14810 - RNA, 22 nt, Homo sapiens
gagacugagucuugcucugucg

SEQ ID NO: 14811 - RNA, 22 nt, Homo sapiens
gagaugugguucaaggguguuu

SEQ ID NO: 14812 - RNA, 22 nt, Homo sapiens
gagauguuuguuucacugucac

SEQ ID NO: 14813 - RNA, 21 nt, Homo sapiens
gagugcaaauaaagagagggc

SEQ ID NO: 14814 - RNA, 22 nt, Homo sapiens
gagugcaagguuuuucugagug

SEQ ID NO: 14815 - RNA, 22 nt, Homo sapiens
gagugcugagcccacuuccuug

SEQ ID NO: 14816 - RNA, 22 nt, Homo sapiens
gcaccccuuaccgggcuggguu

SEQ ID NO: 14817 - RNA, 22 nt, Homo sapiens
gcuaggagaucugcugcucucu

SEQ ID NO: 14818 - RNA, 22 nt, Homo sapiens
gcugcuguaccagaugugguua

SEQ ID NO: 14819 - RNA, 22 nt, Homo sapiens
gcugcuguuucucuuucagcau

SEQ ID NO: 14820 - RNA, 22 nt, Homo sapiens
gcugguguagagugcagaaagg

SEQ ID NO: 14821 - RNA, 18 nt, Homo sapiens
gcuguugucagagcacau

SEQ ID NO: 14822 - RNA, 22 nt, Homo sapiens
ggaaagacaccuuacuauguua

SEQ ID NO: 14823 - RNA, 22 nt, Homo sapiens
ggacuggaagcauauuuauuuu

SEQ ID NO: 14824 - RNA, 22 nt, Homo sapiens
ggagugucagaaacaguguccu

SEQ ID NO: 14825 - RNA, 22 nt, Homo sapiens
gucuggcaauggcagacuggca

SEQ ID NO: 14826 - RNA, 22 nt, Homo sapiens
gugaaaagaugagcaccauaca

SEQ ID NO: 14827 - RNA, 22 nt, Homo sapiens
gugagaugguaucucauugugg

SEQ ID NO: 14828 - RNA, 22 nt, Homo sapiens
gugcacaaaucuuaaauguaca

SEQ ID NO: 14829 - RNA, 22 nt, Homo sapiens
gugcacaaucgugcauuccuug

SEQ ID NO: 14830 - RNA, 22 nt, Homo sapiens
gugcaugucuaugcgagucuaa

SEQ ID NO: 14831 - RNA, 22 nt, Homo sapiens
guggaaagaacacaaaauuagg

SEQ ID NO: 14832 - RNA, 22 nt, Homo sapiens
guggggucaucucauuugugga

SEQ ID NO: 14833 - RNA, 22 nt, Homo sapiens
guuaaagacauccacauaggag

SEQ ID NO: 14834 - RNA, 20 nt, Homo sapiens
uaagccacacagucuaaggu

SEQ ID NO: 14835 - RNA, 22 nt, Homo sapiens
uacaguggugugaucucagcuc

SEQ ID NO: 14836 - RNA, 22 nt, Homo sapiens
uagaucauauucagugcuuacu

SEQ ID NO: 14837 - RNA, 22 nt, Homo sapiens
uaugcacacacguguuuaugug

SEQ ID NO: 14838 - RNA, 22 nt, Homo sapiens
ucacugaaaccgccuccaccuc

SEQ ID NO: 14839 - RNA, 22 nt, Homo sapiens
ucacugcgaccuccaccucccg

SEQ ID NO: 14840 - RNA, 22 nt, Homo sapiens
ucacuggacucuagccugggug

SEQ ID NO: 14841 - RNA, 22 nt, Homo sapiens
ucacuggaggagaggaagugga

SEQ ID NO: 14842 - RNA, 18 nt, Homo sapiens
ucacugugugucuugggu

SEQ ID NO: 14843 - RNA, 22 nt, Homo sapiens
ucaggcaccuuccucuuaucug

SEQ ID NO: 14844 - RNA, 22 nt, Homo sapiens
ucaguguuuggaaucucaauuu

SEQ ID NO: 14845 - RNA, 22 nt, Homo sapiens
ucauggcacugaugagaguuuc

SEQ ID NO: 14846 - RNA, 22 nt, Homo sapiens
ucauggggugagcuacaggcac

SEQ ID NO: 14847 - RNA, 22 nt, Homo sapiens
ucguggccugugaguccucccc

SEQ ID NO: 14848 - RNA, 22 nt, Homo sapiens
ucuuugguauuuguggggaauu

SEQ ID NO: 14849 - RNA, 22 nt, Homo sapiens
ugacggaggcauuggaagcuug

SEQ ID NO: 14850 - RNA, 22 nt, Homo sapiens
ugacugugcagcuccaucaggg

SEQ ID NO: 14851 - RNA, 22 nt, Homo sapiens
ugagacggaguuucacucuugu

SEQ ID NO: 14852 - RNA, 22 nt, Homo sapiens
ugagacugaguuuccaucuugu

SEQ ID NO: 14853 - RNA, 22 nt, Homo sapiens
ugagaugaaagcagaaagacuu

SEQ ID NO: 14854 - RNA, 22 nt, Homo sapiens
ugagaugagggcugcacucaaa

SEQ ID NO: 14855 - RNA, 22 nt, Homo sapiens
ugagaugaggucucgcucuguc

SEQ ID NO: 14856 - RNA, 22 nt, Homo sapiens
aaaagugguguuguuucuaaau

SEQ ID NO: 14857 - RNA, 22 nt, Homo sapiens
aaagugcugggaucacacugaa

SEQ ID NO: 14858 - RNA, 22 nt, Homo sapiens
aaagugcugggauuaggccagg

SEQ ID NO: 14859 - RNA, 22 nt, Homo sapiens
aaagugcugggauuggccgggc

SEQ ID NO: 14860 - RNA, 22 nt, Homo sapiens
aaaguggugggauuccaggcau

SEQ ID NO: 14861 - RNA, 22 nt, Homo sapiens
aacacuggcugcucgaguucuc

SEQ ID NO: 14862 - RNA, 19 nt, Homo sapiens
aacuggugugagaugauau

SEQ ID NO: 14863 - RNA, 22 nt, Homo sapiens
aagagugucuuugugcuggccc

SEQ ID NO: 14864 - RNA, 21 nt, Homo sapiens
aagcacauugaguguguguga

SEQ ID NO: 14865 - RNA, 22 nt, Homo sapiens
aagugcuucuuuccucgagaag

SEQ ID NO: 14866 - RNA, 19 nt, Homo sapiens
aauauugacaguggugucu

SEQ ID NO: 14867 - RNA, 23 nt, Homo sapiens
accugugguuauuuuacucuucc

SEQ ID NO: 14868 - RNA, 22 nt, Homo sapiens
accuucauuguugccaugucca

SEQ ID NO: 14869 - RNA, 22 nt, Homo sapiens
acuauacugaagcaaauuaaca

SEQ ID NO: 14870 - RNA, 22 nt, Homo sapiens
acuggaguuuguucaagaaaua

SEQ ID NO: 14871 - RNA, 22 nt, Homo sapiens
agaaacauucucuugccuccuu

SEQ ID NO: 14872 - RNA, 22 nt, Homo sapiens
agacacuguugaaaaggcccca

SEQ ID NO: 14873 - RNA, 22 nt, Homo sapiens
agacaguguguguauauauggu

SEQ ID NO: 14874 - RNA, 22 nt, Homo sapiens
agagugcaauggcaccaucucg

SEQ ID NO: 14875 - RNA, 22 nt, Homo sapiens
agaucauaugcaguaaugaacu

SEQ ID NO: 14876 - RNA, 22 nt, Homo sapiens
agcaccauuucucuaaagcacu

SEQ ID NO: 14877 - RNA, 22 nt, Homo sapiens
agugcauuugcaucucaauaua

SEQ ID NO: 14878 - RNA, 22 nt, Homo sapiens
agugguuuuaaguagagcauac

SEQ ID NO: 14879 - RNA, 20 nt, Homo sapiens
agugguuuucaaauaugucu

SEQ ID NO: 14880 - RNA, 22 nt, Homo sapiens
auacaguguauguauaguacau

SEQ ID NO: 14881 - RNA, 22 nt, Homo sapiens
auaugcacgugcauacacacuu

SEQ ID NO: 14882 - RNA, 22 nt, Homo sapiens
aucccaguaaaaauggcuucua

SEQ ID NO: 14883 - RNA, 22 nt, Homo sapiens
auccucugagaucuaggcagag

SEQ ID NO: 14884 - RNA, 22 nt, Homo sapiens
aucuccaggugccagcugcgcc

SEQ ID NO: 14885 - RNA, 19 nt, Homo sapiens
augaccauuuccauaguau

SEQ ID NO: 14886 - RNA, 22 nt, Homo sapiens
augaccuuguccucagugucau

SEQ ID NO: 14887 - RNA, 22 nt, Homo sapiens
augacuggauaauggacacaca

SEQ ID NO: 14888 - RNA, 22 nt, Homo sapiens
augagcuguuuggaagacacuu

SEQ ID NO: 14889 - RNA, 22 nt, Homo sapiens
augcauggcagagucaggguac

SEQ ID NO: 14890 - RNA, 22 nt, Homo sapiens
auggcacagaguagaugcucaa

SEQ ID NO: 14891 - RNA, 22 nt, Homo sapiens
auggucccuguuccaugcuccu

SEQ ID NO: 14892 - RNA, 22 nt, Homo sapiens
auuccagguggcgccauucaca

SEQ ID NO: 14893 - RNA, 22 nt, Homo sapiens
caagugcucuaggauccugagu

SEQ ID NO: 14894 - RNA, 22 nt, Homo sapiens
cacaguguuacugguaugaagu

SEQ ID NO: 14895 - RNA, 22 nt, Homo sapiens
cacuguggauggaacuauguga

SEQ ID NO: 14896 - RNA, 22 nt, Homo sapiens
cagcacauagcaguugcucagu

SEQ ID NO: 14897 - RNA, 22 nt, Homo sapiens
caugaugcuagguauggaugaa

SEQ ID NO: 14898 - RNA, 22 nt, Homo sapiens
cauggcccuggguccauaggaa

SEQ ID NO: 14899 - RNA, 18 nt, Homo sapiens
ccagugcaaggaaagccc

SEQ ID NO: 14900 - RNA, 21 nt, Homo sapiens
ccaguguaaugauagcaggca

SEQ ID NO: 14901 - RNA, 20 nt, Homo sapiens
ccaguguuauuuauguucua

SEQ ID NO: 14902 - RNA, 22 nt, Homo sapiens
ccuucauccuccagcaggcuag

SEQ ID NO: 14903 - RNA, 22 nt, Homo sapiens
cucacugugguguccuuaggua

SEQ ID NO: 14904 - RNA, 22 nt, Homo sapiens
cuggagucugacugacacaagg

SEQ ID NO: 14905 - RNA, 22 nt, Homo sapiens
cugucaucauuucuaugugcca

SEQ ID NO: 14906 - RNA, 22 nt, Homo sapiens
cuuuggguauucucccuugggg

SEQ ID NO: 14907 - RNA, 22 nt, Homo sapiens
gaccacauuccacacaggcuuu

SEQ ID NO: 14908 - RNA, 16 nt, Homo sapiens
gacugggcugaggaau

SEQ ID NO: 14909 - RNA, 22 nt, Homo sapiens
gagacugagucuugcucuguca

SEQ ID NO: 14910 - RNA, 22 nt, Homo sapiens
gagacugaguuuugcucuuguu

SEQ ID NO: 14911 - RNA, 20 nt, Homo sapiens
gagcucaucuucuuuaccac

SEQ ID NO: 14912 - RNA, 22 nt, Homo sapiens
gaggagucagacugugcaaggu

SEQ ID NO: 14913 - RNA, 23 nt, Homo sapiens
gagugcaaugacaugaucucgga

SEQ ID NO: 14914 - RNA, 22 nt, Homo sapiens
gauggaguaauguaaucuugag

SEQ ID NO: 14915 - RNA, 22 nt, Homo sapiens
gauggcacuaagccauguagga

SEQ ID NO: 14916 - RNA, 22 nt, Homo sapiens
gcaguguucaaaucaugcccau

SEQ ID NO: 14917 - RNA, 22 nt, Homo sapiens
gcauggaguggaaauucuuggg

SEQ ID NO: 14918 - RNA, 21 nt, Homo sapiens
gccaguguggcaauuuuucaa

SEQ ID NO: 14919 - RNA, 22 nt, Homo sapiens
gccauggugucuuauuuuugug

SEQ ID NO: 14920 - RNA, 22 nt, Homo sapiens
gccccgggugaugcagccguca

SEQ ID NO: 14921 - RNA, 22 nt, Homo sapiens
gcugcacuuuaaggcauccccu

SEQ ID NO: 14922 - RNA, 22 nt, Homo sapiens
gcugcuguuuaguuucuccugg

SEQ ID NO: 14923 - RNA, 22 nt, Homo sapiens
gcuggauguuucaauacaaaua

SEQ ID NO: 14924 - RNA, 22 nt, Homo sapiens
gcuuguguuugcuccccagaau

SEQ ID NO: 14925 - RNA, 22 nt, Homo sapiens
ggaaagacuauuguaaaggaug

SEQ ID NO: 14926 - RNA, 22 nt, Homo sapiens
ggagucugauuuuuauguugcu

SEQ ID NO: 14927 - RNA, 23 nt, Homo sapiens
ggauggaaaguuuugagggccac

SEQ ID NO: 14928 - RNA, 22 nt, Homo sapiens
ggcaaggauuagauucuccccu

SEQ ID NO: 14929 - RNA, 22 nt, Homo sapiens
ggcacaaugucagcucacugca

SEQ ID NO: 14930 - RNA, 22 nt, Homo sapiens
ggcacaauugcagcaauaaaca

SEQ ID NO: 14931 - RNA, 22 nt, Homo sapiens
ggcaguguuauuauauuuuugg

SEQ ID NO: 14932 - RNA, 22 nt, Homo sapiens
guccaugagaugaauccacaca

SEQ ID NO: 14933 - RNA, 22 nt, Homo sapiens
gugcacaacgugcaggcuuguu

SEQ ID NO: 14934 - RNA, 22 nt, Homo sapiens
gugguucuagaauugaguaucc

SEQ ID NO: 14935 - RNA, 22 nt, Homo sapiens
guguaaaacaauuagaggauuu

SEQ ID NO: 14936 - RNA, 22 nt, Homo sapiens
uaaagcacuuuuuucugcaugg

SEQ ID NO: 14937 - RNA, 22 nt, Homo sapiens
uaagugcuguguuguuaccuaa

SEQ ID NO: 14938 - RNA, 18 nt, Homo sapiens
uaagugcuuuaaacacau

SEQ ID NO: 14939 - RNA, 20 nt, Homo sapiens
uaagugcuuuauauugauua

SEQ ID NO: 14940 - RNA, 22 nt, Homo sapiens
uacaguguuuugguauuccaca

SEQ ID NO: 14941 - RNA, 22 nt, Homo sapiens
uacauguauguguuuauggcug

SEQ ID NO: 14942 - RNA, 22 nt, Homo sapiens
uagugcugagauugagaagccc

SEQ ID NO: 14943 - RNA, 22 nt, Homo sapiens
uaugaccuuguccccucucgcc

SEQ ID NO: 14944 - RNA, 22 nt, Homo sapiens
uauggcuaugggaacugggagu

SEQ ID NO: 14945 - RNA, 22 nt, Homo sapiens
uauuguuuuucccaggagucua

SEQ ID NO: 14946 - RNA, 22 nt, Homo sapiens
ucacugaaaccuccgccuucug

SEQ ID NO: 14947 - RNA, 22 nt, Homo sapiens
aagugcuucagaagacaauauu

SEQ ID NO: 14948 - RNA, 22 nt, Homo sapiens
aaguggaauguuuguggcacaa

SEQ ID NO: 14949 - RNA, 18 nt, Homo sapiens
acagugucuuacaccugu

SEQ ID NO: 14950 - RNA, 22 nt, Homo sapiens
acaguguuacuugauaguguau

SEQ ID NO: 14951 - RNA, 21 nt, Homo sapiens
acaucagaguugugaagguag

SEQ ID NO: 14952 - RNA, 21 nt, Homo sapiens
agaggacugaccacagcccua

SEQ ID NO: 14953 - RNA, 22 nt, Homo sapiens
agagguguuaaagucucuuuua

SEQ ID NO: 14954 - RNA, 22 nt, Homo sapiens
agagugcuauagauuagauuuc

SEQ ID NO: 14955 - RNA, 18 nt, Homo sapiens
agaugguguugcuucugu

SEQ ID NO: 14956 - RNA, 23 nt, Homo sapiens
agcaaaugcucuagcacuccaac

SEQ ID NO: 14957 - RNA, 22 nt, Homo sapiens
agccuguguugaauuauagaaa

SEQ ID NO: 14958 - RNA, 22 nt, Homo sapiens
agugcauugcaucucugcuuca

SEQ ID NO: 14959 - RNA, 22 nt, Homo sapiens
agugguuugaucacagcucacu

SEQ ID NO: 14960 - RNA, 22 nt, Homo sapiens
auacuaugagauaauaaagacu

SEQ ID NO: 14961 - RNA, 22 nt, Homo sapiens
aucaucacaguuguguguaaug

SEQ ID NO: 14962 - RNA, 22 nt, Homo sapiens
aucucagcaacuaaagauccuu

SEQ ID NO: 14963 - RNA, 22 nt, Homo sapiens
aucuuuggugaguucuuugguc

SEQ ID NO: 14964 - RNA, 22 nt, Homo sapiens
augagcugauuuccuuaccaua

SEQ ID NO: 14965 - RNA, 22 nt, Homo sapiens
augcuacauucuacaauuaggc

SEQ ID NO: 14966 - RNA, 22 nt, Homo sapiens
augguguccuguuuccccagga

SEQ ID NO: 14967 - RNA, 22 nt, Homo sapiens
auguugcuugaaggcauuuugu

SEQ ID NO: 14968 - RNA, 22 nt, Homo sapiens
auugcagcccacccugggugau

SEQ ID NO: 14969 - RNA, 22 nt, Homo sapiens
auugcagcuugcagggugugua

SEQ ID NO: 14970 - RNA, 22 nt, Homo sapiens
auuuggcaacguagggaggcau

SEQ ID NO: 14971 - RNA, 22 nt, Homo sapiens
auuuggcagugaagggaucaca

SEQ ID NO: 14972 - RNA, 22 nt, Homo sapiens
caagugcuacagagaaaucuuu

SEQ ID NO: 14973 - RNA, 22 nt, Homo sapiens
cacugcauucuccaccucccag

SEQ ID NO: 14974 - RNA, 22 nt, Homo sapiens
cacugcgaccuccaccucccgg

SEQ ID NO: 14975 - RNA, 22 nt, Homo sapiens
cacugggccaucacuuaauauu

SEQ ID NO: 14976 - RNA, 21 nt, Homo sapiens
cacuggguucaggcuugugga

SEQ ID NO: 14977 - RNA, 22 nt, Homo sapiens
cagugcuuguuauuguucuauu

SEQ ID NO: 14978 - RNA, 22 nt, Homo sapiens
cagugcuuuaucaaguccucca

SEQ ID NO: 14979 - RNA, 22 nt, Homo sapiens
cauacaugugcuugucuuaugc

SEQ ID NO: 14980 - RNA, 22 nt, Homo sapiens
ccacugggcuagguguuuugga

SEQ ID NO: 14981 - RNA, 22 nt, Homo sapiens
ccagccgggugcaguggcucac

SEQ ID NO: 14982 - RNA, 19 nt, Homo sapiens
ccaguguugccagagcuga

SEQ ID NO: 14983 - RNA, 22 nt, Homo sapiens
ccauugaacaugaaggaaugug

SEQ ID NO: 14984 - RNA, 20 nt, Homo sapiens
cucaccagguguaggcugag

SEQ ID NO: 14985 - RNA, 22 nt, Homo sapiens
cuggaguaugauguuagcguug

SEQ ID NO: 14986 - RNA, 22 nt, Homo sapiens
cuggcaccauuuugaucaaagg

SEQ ID NO: 14987 - RNA, 22 nt, Homo sapiens
cuuuggcacuuccuaagugcca

SEQ ID NO: 14988 - RNA, 22 nt, Homo sapiens
gaagugcuuuuggacuaacagu

SEQ ID NO: 14989 - RNA, 22 nt, Homo sapiens
gacauguuucucucuguuuacu

SEQ ID NO: 14990 - RNA, 22 nt, Homo sapiens
gacauguuuucauguauuugga

SEQ ID NO: 14991 - RNA, 22 nt, Homo sapiens
gacugacgaccgcucuaccugc

SEQ ID NO: 14992 - RNA, 22 nt, Homo sapiens
gacugaggaagcgcucucuccu

SEQ ID NO: 14993 - RNA, 22 nt, Homo sapiens
gacuggauagauaaaguuaguu

SEQ ID NO: 14994 - RNA, 22 nt, Homo sapiens
gagaugugugugauuauauaau

SEQ ID NO: 14995 - RNA, 22 nt, Homo sapiens
gagcacugauuuauuuuugucu

SEQ ID NO: 14996 - RNA, 22 nt, Homo sapiens
gagguggauacauuaaauaaug

SEQ ID NO: 14997 - RNA, 22 nt, Homo sapiens
gauguagaaagagugggcugga

SEQ ID NO: 14998 - RNA, 22 nt, Homo sapiens
gauuccacuuacuuagcauucc

SEQ ID NO: 14999 - RNA, 22 nt, Homo sapiens
gcaauacugacagcauuaguuu

SEQ ID NO: 15000 - RNA, 22 nt, Homo sapiens
gcacugggccacauuuauuuuc

SEQ ID NO: 15001 - RNA, 22 nt, Homo sapiens
gcaguguugugauccaggucuu

SEQ ID NO: 15002 - RNA, 22 nt, Homo sapiens
gcauggagcauacauuucuguu

SEQ ID NO: 15003 - RNA, 17 nt, Homo sapiens
gcugcauucauguagaa

SEQ ID NO: 15004 - RNA, 22 nt, Homo sapiens
gcugcuguuauucaucagaacu

SEQ ID NO: 15005 - RNA, 22 nt, Homo sapiens
gcuggcaaaugguuauaaggcc

SEQ ID NO: 15006 - RNA, 22 nt, Homo sapiens
gcugguguucaggcccucaguc

SEQ ID NO: 15007 - RNA, 18 nt, Homo sapiens
ggaaaacuuuucuaagua

SEQ ID NO: 15008 - RNA, 22 nt, Homo sapiens
ggaaugggauuugaagucuggc

SEQ ID NO: 15009 - RNA, 22 nt, Homo sapiens
ggagaugauuaugaaucacuua

SEQ ID NO: 15010 - RNA, 22 nt, Homo sapiens
ggagcugugauuugaguccaga

SEQ ID NO: 15011 - RNA, 22 nt, Homo sapiens
ggcaaggaggggcacuuucacu

SEQ ID NO: 15012 - RNA, 22 nt, Homo sapiens
ggcaaggauguuuuucuggcaa

SEQ ID NO: 15013 - RNA, 22 nt, Homo sapiens
ggcacgguggcucacgccugua

SEQ ID NO: 15014 - RNA, 22 nt, Homo sapiens
ggcacuguggcucaagccugua

SEQ ID NO: 15015 - RNA, 22 nt, Homo sapiens
ggcagcgugcacuuucgccacu

SEQ ID NO: 15016 - RNA, 22 nt, Homo sapiens
ggcaguguaauaauuuauuaau

SEQ ID NO: 15017 - RNA, 22 nt, Homo sapiens
ggcccaguugcgggugguaccg

SEQ ID NO: 15018 - RNA, 22 nt, Homo sapiens
ggcucguguuuucuguccaguu

SEQ ID NO: 15019 - RNA, 22 nt, Homo sapiens
gucacugagcaauagaaaguuu

SEQ ID NO: 15020 - RNA, 22 nt, Homo sapiens
gucacugggugcugcgccuguc

SEQ ID NO: 15021 - RNA, 22 nt, Homo sapiens
gucuuuggaaaaaaugucuguu

SEQ ID NO: 15022 - RNA, 22 nt, Homo sapiens
guggaaaacauaugcuuguuga

SEQ ID NO: 15023 - RNA, 22 nt, Homo sapiens
guggaaaaguaguugcgguuuu

SEQ ID NO: 15024 - RNA, 22 nt, Homo sapiens
guggaaaauuauugcuguuuuu

SEQ ID NO: 15025 - RNA, 22 nt, Homo sapiens
guggcauuucccaaaguauucu

SEQ ID NO: 15026 - RNA, 22 nt, Homo sapiens
guguccucgaguacacaucagg

SEQ ID NO: 15027 - RNA, 22 nt, Homo sapiens
aaagugcugagucuaggcgggg

SEQ ID NO: 15028 - RNA, 22 nt, Homo sapiens
aaagugcuguagacugggcgca

SEQ ID NO: 15029 - RNA, 22 nt, Homo sapiens
aaagugcuucucuuuggugggu

SEQ ID NO: 15030 - RNA, 21 nt, Homo sapiens
aacacggugaaaucccgucuc

SEQ ID NO: 15031 - RNA, 22 nt, Homo sapiens
aagccacuguaccugucucuua

SEQ ID NO: 15032 - RNA, 22 nt, Homo sapiens
aagcuggauuucgcauccuguu

SEQ ID NO: 15033 - RNA, 22 nt, Homo sapiens
aaggaagcuagcaggaauuggu

SEQ ID NO: 15034 - RNA, 22 nt, Homo sapiens
aaggagugugauucuucaguuu

SEQ ID NO: 15035 - RNA, 22 nt, Homo sapiens
aagugcuuccuuucagaggguu

SEQ ID NO: 15036 - RNA, 20 nt, Homo sapiens
aagugcuuccuuuuagaggg

SEQ ID NO: 15037 - RNA, 22 nt, Homo sapiens
aagugcuuuacacaugcaugau

SEQ ID NO: 15038 - RNA, 22 nt, Homo sapiens
aagugcuuuguacagggguuga

SEQ ID NO: 15039 - RNA, 22 nt, Homo sapiens
ugagaugcucgccggccagcau

SEQ ID NO: 15040 - RNA, 22 nt, Homo sapiens
ugagcacuguacuuuaucaggu

SEQ ID NO: 15041 - RNA, 22 nt, Homo sapiens
ugagcuaggaucacaccugcau

SEQ ID NO: 15042 - RNA, 22 nt, Homo sapiens
ugagcugagaucacacuacugu

SEQ ID NO: 15043 - RNA, 22 nt, Homo sapiens
ugagcugagaucuuaccacugc

SEQ ID NO: 15044 - RNA, 20 nt, Homo sapiens
ugagcuuguaaacacuguuu

SEQ ID NO: 15045 - RNA, 22 nt, Homo sapiens
ugaguaauguugaucuuugaua

SEQ ID NO: 15046 - RNA, 22 nt, Homo sapiens
ugcaguguggcucacgccugua

SEQ ID NO: 15047 - RNA, 22 nt, Homo sapiens
ugcugguauuuggaccagccug

SEQ ID NO: 15048 - RNA, 22 nt, Homo sapiens
uggaaugggauuggaaauuuug

SEQ ID NO: 15049 - RNA, 22 nt, Homo sapiens
uggagauguuuaaaauccacug

SEQ ID NO: 15050 - RNA, 18 nt, Homo sapiens
uggcaaguuuaguagcac

SEQ ID NO: 15051 - RNA, 22 nt, Homo sapiens
ugucaggaggguccagagaaaa

SEQ ID NO: 15052 - RNA, 22 nt, Homo sapiens
ugugacagcacagcaucucuuu

SEQ ID NO: 15053 - RNA, 17 nt, Homo sapiens
ugugacccugggcuacc

SEQ ID NO: 15054 - RNA, 22 nt, Homo sapiens
ugugcugaucgggcacgguguc

SEQ ID NO: 15055 - RNA, 22 nt, Homo sapiens
uguggaaauuguuguauuuaau

SEQ ID NO: 15056 - RNA, 22 nt, Homo sapiens
uuaaaguguuugcagacaggug

SEQ ID NO: 15057 - RNA, 22 nt, Homo sapiens
uucaaguaguucucaugccuca

SEQ ID NO: 15058 - RNA, 22 nt, Homo sapiens
uucacuggagcccaggaguugg

SEQ ID NO: 15059 - RNA, 22 nt, Homo sapiens
uucauggaauauugaccauuuu

SEQ ID NO: 15060 - RNA, 22 nt, Homo sapiens
uuccaguauuugggcaagcgca

SEQ ID NO: 15061 - RNA, 22 nt, Homo sapiens
uugagacggagucucacucugu

SEQ ID NO: 15062 - RNA, 22 nt, Homo sapiens
uugagaugauggauaugcuaau

SEQ ID NO: 15063 - RNA, 22 nt, Homo sapiens
uugagauggagccucacucugc

SEQ ID NO: 15064 - RNA, 22 nt, Homo sapiens
uugagauggagucucacucugc

SEQ ID NO: 15065 - RNA, 22 nt, Homo sapiens
uugagauggagucucacugugu

SEQ ID NO: 15066 - RNA, 22 nt, Homo sapiens
uugagauggagucucgcacugu

SEQ ID NO: 15067 - RNA, 22 nt, Homo sapiens
uugagauggagucucgcucuuu

SEQ ID NO: 15068 - RNA, 22 nt, Homo sapiens
uugagauggagucucgcugugu

SEQ ID NO: 15069 - RNA, 22 nt, Homo sapiens
uugagauggagucucguucugu

SEQ ID NO: 15070 - RNA, 22 nt, Homo sapiens
uugagauggagucuugcucuug

SEQ ID NO: 15071 - RNA, 22 nt, Homo sapiens
uugagauguaguuucacuccug

SEQ ID NO: 15072 - RNA, 22 nt, Homo sapiens
uugagauguauguauauaaugu

SEQ ID NO: 15073 - RNA, 22 nt, Homo sapiens
uugagauguggcaguuuaugag

SEQ ID NO: 15074 - RNA, 22 nt, Homo sapiens
uugcagagccccugcaaggguc

SEQ ID NO: 15075 - RNA, 22 nt, Homo sapiens
uuggaaaaauccaccuugaucu

SEQ ID NO: 15076 - RNA, 21 nt, Homo sapiens
uuggcuacugcuucagaggga

SEQ ID NO: 15077 - RNA, 21 nt, Homo sapiens
uuguccccacccaaaucucau

SEQ ID NO: 15078 - RNA, 22 nt, Homo sapiens
uuguccccaucugcugccagaa

SEQ ID NO: 15079 - RNA, 23 nt, Homo sapiens
uuguccccuccaaagcucauguu

SEQ ID NO: 15080 - RNA, 18 nt, Homo sapiens
uuguggccccuacaaauu

SEQ ID NO: 15081 - RNA, 22 nt, Homo sapiens
uuuggcacuguaaauuucucuu

SEQ ID NO: 15082 - RNA, 22 nt, Homo sapiens
uuuggcucugugucccacccaa

SEQ ID NO: 15083 - RNA, 22 nt, Homo sapiens
aaagggcuuuguaaacuucaag

SEQ ID NO: 15084 - RNA, 22 nt, Homo sapiens
aaagugcuaggauuaccugggg

SEQ ID NO: 15085 - RNA, 22 nt, Homo sapiens
aaagugcugagaguucuaacuu

SEQ ID NO: 15086 - RNA, 22 nt, Homo sapiens
aaagugcugagauuguaggcau

SEQ ID NO: 15087 - RNA, 22 nt, Homo sapiens
aaagugcugggauuggcugggc

SEQ ID NO: 15088 - RNA, 22 nt, Homo sapiens
aaagugcuuccuuuuugagggu

SEQ ID NO: 15089 - RNA, 19 nt, Homo sapiens
aacuggugugagaugguau

SEQ ID NO: 15090 - RNA, 22 nt, Homo sapiens
aagagaugaagguccugacugu

SEQ ID NO: 15091 - RNA, 22 nt, Homo sapiens
aaggagcagagagcccuguuuc

SEQ ID NO: 15092 - RNA, 22 nt, Homo sapiens
aaggagcaguggacggguccua

SEQ ID NO: 15093 - RNA, 23 nt, Homo sapiens
aagugagcuccaauugggugaga

SEQ ID NO: 15094 - RNA, 22 nt, Homo sapiens
ucaaguacugccuugcucuggc

SEQ ID NO: 15095 - RNA, 22 nt, Homo sapiens
ucacaugugcguuuuggcaugu

SEQ ID NO: 15096 - RNA, 22 nt, Homo sapiens
ucacuagggagaaacugaggcu

SEQ ID NO: 15097 - RNA, 22 nt, Homo sapiens
ucacugaaaccacugccuccug

SEQ ID NO: 15098 - RNA, 20 nt, Homo sapiens
ucacuggguucuugaagucu

SEQ ID NO: 15099 - RNA, 22 nt, Homo sapiens
ucagacacugcccuccaccugu

SEQ ID NO: 15100 - RNA, 22 nt, Homo sapiens
ucaugggagcccccaucaugag

SEQ ID NO: 15101 - RNA, 22 nt, Homo sapiens
uccauggagacacauuuuauau

SEQ ID NO: 15102 - RNA, 22 nt, Homo sapiens
ucccauguagcuaggauuacag

SEQ ID NO: 15103 - RNA, 22 nt, Homo sapiens
ucccgaggacaucugggggcaa

SEQ ID NO: 15104 - RNA, 22 nt, Homo sapiens
uccuucacucuacaucuuuguu

SEQ ID NO: 15105 - RNA, 22 nt, Homo sapiens
ucuggcacugaugugggaugcu

SEQ ID NO: 15106 - RNA, 22 nt, Homo sapiens
ucuuugggauauucugaaaggg

SEQ ID NO: 15107 - RNA, 22 nt, Homo sapiens
ugagaagugauauagaaguuaa

SEQ ID NO: 15108 - RNA, 22 nt, Homo sapiens
ugagagcugcauucuugaaagc

SEQ ID NO: 15109 - RNA, 22 nt, Homo sapiens
ugagaugaguucucgcucuguc

SEQ ID NO: 15110 - RNA, 22 nt, Homo sapiens
ugagaugaguugcuggcucuga

SEQ ID NO: 15111 - RNA, 21 nt, Homo sapiens
ugagaugauccugcaugcaug

SEQ ID NO: 15112 - RNA, 22 nt, Homo sapiens
ugagcugguacuaauauuauca

SEQ ID NO: 15113 - RNA, 22 nt, Homo sapiens
ugaggugcagcaauccucaugu

SEQ ID NO: 15114 - RNA, 20 nt, Homo sapiens
ugauguccaggcagagguuu

SEQ ID NO: 15115 - RNA, 22 nt, Homo sapiens
ugcaagaggagacuguacucag

SEQ ID NO: 15116 - RNA, 23 nt, Homo sapiens
ugcaccacuacacacucuugggu

SEQ ID NO: 15117 - RNA, 22 nt, Homo sapiens
ugcagugugauuuucuggcuga

SEQ ID NO: 15118 - RNA, 21 nt, Homo sapiens
ugcagugugguugcccugcug

SEQ ID NO: 15119 - RNA, 22 nt, Homo sapiens
uggaaaauuaggggagguuaua

SEQ ID NO: 15120 - RNA, 22 nt, Homo sapiens
uggaagacuuuagaggcuuaua

SEQ ID NO: 15121 - RNA, 22 nt, Homo sapiens
uggcagcgugaauguggcugaa

SEQ ID NO: 15122 - RNA, 22 nt, Homo sapiens
uggugccgugguccuggggcca

SEQ ID NO: 15123 - RNA, 22 nt, Homo sapiens
ugugaacagaauuagucaccua

SEQ ID NO: 15124 - RNA, 22 nt, Homo sapiens
ugugaccaaaaucaacauaccu

SEQ ID NO: 15125 - RNA, 22 nt, Homo sapiens
ugugcaaucagcuucauuacau

SEQ ID NO: 15126 - RNA, 22 nt, Homo sapiens
uguggaaauggugcuacgaaca

SEQ ID NO: 15127 - RNA, 20 nt, Homo sapiens
uucaagugauucucaugccu

SEQ ID NO: 15128 - RNA, 22 nt, Homo sapiens
uucauacaguggcugcacucca

SEQ ID NO: 15129 - RNA, 20 nt, Homo sapiens
uuccagcacauuagggaagc

SEQ ID NO: 15130 - RNA, 21 nt, Homo sapiens
uuccagugagccuagaugccu

SEQ ID NO: 15131 - RNA, 22 nt, Homo sapiens
uuccagugggacgagaugugga

SEQ ID NO: 15132 - RNA, 22 nt, Homo sapiens
uugagacgaagucucacucuug

SEQ ID NO: 15133 - RNA, 21 nt, Homo sapiens
uugagacggagucucacucug

SEQ ID NO: 15134 - RNA, 22 nt, Homo sapiens
uugagauggagcuucacucuug

SEQ ID NO: 15135 - RNA, 22 nt, Homo sapiens
uugagauggagucucacucuuu

SEQ ID NO: 15136 - RNA, 22 nt, Homo sapiens
uugagauggagucuugcacugu

SEQ ID NO: 15137 - RNA, 22 nt, Homo sapiens
uugagauggagucuuguucucu

SEQ ID NO: 15138 - RNA, 22 nt, Homo sapiens
uugagauggaguuucacucuug

SEQ ID NO: 15139 - RNA, 22 nt, Homo sapiens
uugagauggaguuuugcucuug

SEQ ID NO: 15140 - RNA, 19 nt, Homo sapiens
uugagaugugaacucacac

SEQ ID NO: 15141 - RNA, 22 nt, Homo sapiens
uugcagagccccacacugggcu

SEQ ID NO: 15142 - RNA, 22 nt, Homo sapiens
uugcucaggcuagaguucagcu

SEQ ID NO: 15143 - RNA, 22 nt, Homo sapiens
uuggcacgugguggggcucgga

SEQ ID NO: 15144 - RNA, 22 nt, Homo sapiens
uuggcagugcccgaugcugggg

SEQ ID NO: 15145 - RNA, 22 nt, Homo sapiens
uuggcauuguggauggaaucau

SEQ ID NO: 15146 - RNA, 22 nt, Homo sapiens
uuguccccuuccaaaucucaug

SEQ ID NO: 15147 - RNA, 23 nt, Homo sapiens
uuucacaguagcuggaucagccu

SEQ ID NO: 15148 - RNA, 22 nt, Homo sapiens
uuuccagguggccaacauuuua

SEQ ID NO: 15149 - RNA, 22 nt, Homo sapiens
uuuggcauauuuuaagcugguu

SEQ ID NO: 15150 - RNA, 22 nt, Homo sapiens
uuuggguuaguuuuccaaucuu

SEQ ID NO: 15151 - RNA, 20 nt, Homo sapiens
uaugaccugucuuuucucuc

SEQ ID NO: 15152 - RNA, 22 nt, Homo sapiens
uaugaccuuggacaaguuacuu

SEQ ID NO: 15153 - RNA, 22 nt, Homo sapiens
uauggcacuaguacuggaaagc

SEQ ID NO: 15154 - RNA, 22 nt, Homo sapiens
ucacaugugacauauauauuug

SEQ ID NO: 15155 - RNA, 22 nt, Homo sapiens
ucacugaaaccuccaccucucg

SEQ ID NO: 15156 - RNA, 22 nt, Homo sapiens
ucacugcgaccuccaccuccug

SEQ ID NO: 15157 - RNA, 22 nt, Homo sapiens
ucacuggagauagcaaucuggu

SEQ ID NO: 15158 - RNA, 22 nt, Homo sapiens
ucaggcacuaguaagaaaaagg

SEQ ID NO: 15159 - RNA, 22 nt, Homo sapiens
ucaggucauuccaggagggcca

SEQ ID NO: 15160 - RNA, 22 nt, Homo sapiens
uccagaguggugaugcuggggc

SEQ ID NO: 15161 - RNA, 19 nt, Homo sapiens
uccaugagcccacagugau

SEQ ID NO: 15162 - RNA, 22 nt, Homo sapiens
ucugguguuacugagccuccca

SEQ ID NO: 15163 - RNA, 22 nt, Homo sapiens
ucugucaaaucuuauguuguag

SEQ ID NO: 15164 - RNA, 23 nt, Homo sapiens
ugacauguaauucaguccagcag

SEQ ID NO: 15165 - RNA, 22 nt, Homo sapiens
ugagacggaguuucgcucuugu

SEQ ID NO: 15166 - RNA, 22 nt, Homo sapiens
ugagacugagucucccucuguc

SEQ ID NO: 15167 - RNA, 22 nt, Homo sapiens
ugagacugagucuugcucuauu

SEQ ID NO: 15168 - RNA, 22 nt, Homo sapiens
ugagaucgagucucgcucuguc

SEQ ID NO: 15169 - RNA, 22 nt, Homo sapiens
ugagaugacgacacaccucagu

SEQ ID NO: 15170 - RNA, 22 nt, Homo sapiens
ugagcuacuacacccagcuugg

SEQ ID NO: 15171 - RNA, 22 nt, Homo sapiens
ugagcuguuugaagaagcauuu

SEQ ID NO: 15172 - RNA, 20 nt, Homo sapiens
ugcaguguccucacuuguca

SEQ ID NO: 15173 - RNA, 22 nt, Homo sapiens
ugcugcauuggggauuaaguuu

SEQ ID NO: 15174 - RNA, 22 nt, Homo sapiens
ugcugcuguuguuguuacuagc

SEQ ID NO: 15175 - RNA, 22 nt, Homo sapiens
uggaaaacaugcacauuggauu

SEQ ID NO: 15176 - RNA, 20 nt, Homo sapiens
uggagugaagguucuggacc

SEQ ID NO: 15177 - RNA, 22 nt, Homo sapiens
uggauugagaagcuguggcuca

SEQ ID NO: 15178 - RNA, 22 nt, Homo sapiens
uggcaccauccaggugucucua

SEQ ID NO: 15179 - RNA, 22 nt, Homo sapiens
uggcaggugcacuggcuuugaa

SEQ ID NO: 15180 - RNA, 22 nt, Homo sapiens
ugggcggagacgugcagccgcc

SEQ ID NO: 15181 - RNA, 22 nt, Homo sapiens
uggguccccuacucuuuccaca

SEQ ID NO: 15182 - RNA, 22 nt, Homo sapiens
ugguaaacaacaggagaacuug

SEQ ID NO: 15183 - RNA, 22 nt, Homo sapiens
uggugcccuguccuucuguggc

SEQ ID NO: 15184 - RNA, 22 nt, Homo sapiens
uguggaaauaaaagaaagguua

SEQ ID NO: 15185 - RNA, 22 nt, Homo sapiens
ugugucuuuuaucacacaaugu

SEQ ID NO: 15186 - RNA, 22 nt, Homo sapiens
uguuauguuguuugagaaaguc

SEQ ID NO: 15187 - RNA, 22 nt, Homo sapiens
uuacaagaugucuguccaacac

SEQ ID NO: 15188 - RNA, 22 nt, Homo sapiens
uccccgagcccaggcugugacu

SEQ ID NO: 15189 - RNA, 22 nt, Homo sapiens
uccccgaggcuggagugcagug

SEQ ID NO: 15190 - RNA, 20 nt, Homo sapiens
ucccuaagagccuuuccuuc

SEQ ID NO: 15191 - RNA, 22 nt, Homo sapiens
ucuacagccaguucaggaagaa

SEQ ID NO: 15192 - RNA, 22 nt, Homo sapiens
ucugugcauuguaacaacuaaa

SEQ ID NO: 15193 - RNA, 22 nt, Homo sapiens
ucuucaugcuugaaauaauagc

SEQ ID NO: 15194 - RNA, 22 nt, Homo sapiens
ucuuugaguggagcgaggcaga

SEQ ID NO: 15195 - RNA, 22 nt, Homo sapiens
ugagacggagucucacucuguu

SEQ ID NO: 15196 - RNA, 22 nt, Homo sapiens
ugagaugaagucucacucuguc

SEQ ID NO: 15197 - RNA, 22 nt, Homo sapiens
ugagaugaagucuugcucuguu

SEQ ID NO: 15198 - RNA, 22 nt, Homo sapiens
ugagaugaggucucacucuguu

SEQ ID NO: 15199 - RNA, 22 nt, Homo sapiens
ugagaugcauauucuggcuccu

SEQ ID NO: 15200 - RNA, 22 nt, Homo sapiens
ugaguucuuccaccgggaccag

SEQ ID NO: 15201 - RNA, 22 nt, Homo sapiens
ugcaccacugcacuccacccug

SEQ ID NO: 15202 - RNA, 19 nt, Homo sapiens
ugccauguagcacaugguc

SEQ ID NO: 15203 - RNA, 23 nt, Homo sapiens
ugcugagaccuagauccuaaaga

SEQ ID NO: 15204 - RNA, 22 nt, Homo sapiens
ugcugcuguuaucauuuuacca

SEQ ID NO: 15205 - RNA, 22 nt, Homo sapiens
uggaacacaucuaaggaagcag

SEQ ID NO: 15206 - RNA, 21 nt, Homo sapiens
uggagugaagaguuuauugac

SEQ ID NO: 15207 - RNA, 22 nt, Homo sapiens
uggagugauaugguuauauggg

SEQ ID NO: 15208 - RNA, 19 nt, Homo sapiens
uggcaaugucagcagagau

SEQ ID NO: 15209 - RNA, 22 nt, Homo sapiens
uggcauggaguggauggcccca

SEQ ID NO: 15210 - RNA, 22 nt, Homo sapiens
uggcaugucagguuucuggguu

SEQ ID NO: 15211 - RNA, 22 nt, Homo sapiens
ugguguccugucucugcgcuug

SEQ ID NO: 15212 - RNA, 22 nt, Homo sapiens
ugugacugguugucccacuuuc

SEQ ID NO: 15213 - RNA, 22 nt, Homo sapiens
uuaauucugucugcccucaucc

SEQ ID NO: 15214 - RNA, 22 nt, Homo sapiens
uuagcagcucuggugacaaggu

SEQ ID NO: 15215 - RNA, 22 nt, Homo sapiens
uucaugcaucuguagugguuaa

SEQ ID NO: 15216 - RNA, 22 nt, Homo sapiens
uuccaguggaguaaauggacaa

SEQ ID NO: 15217 - RNA, 22 nt, Homo sapiens
uucucagcccccugacagucag

SEQ ID NO: 15218 - RNA, 22 nt, Homo sapiens
uucucauggaacaucuguacug

SEQ ID NO: 15219 - RNA, 22 nt, Homo sapiens
uugagauggaaucucgcuuugu

SEQ ID NO: 15220 - RNA, 22 nt, Homo sapiens
uugagauggagucucacgcauu

SEQ ID NO: 15221 - RNA, 22 nt, Homo sapiens
uugagauggagucucacuccuu

SEQ ID NO: 15222 - RNA, 22 nt, Homo sapiens
uugagauggagucucacucugu

SEQ ID NO: 15223 - RNA, 22 nt, Homo sapiens
uugagauggagucuugcucucu

SEQ ID NO: 15224 - RNA, 22 nt, Homo sapiens
uugagauggagucuugcucugu

SEQ ID NO: 15225 - RNA, 22 nt, Homo sapiens
uugagauggagucuuguucuuu

SEQ ID NO: 15226 - RNA, 22 nt, Homo sapiens
uugagauggaguguugcucugu

SEQ ID NO: 15227 - RNA, 22 nt, Homo sapiens
uugagauggaguucauuuuugu

SEQ ID NO: 15228 - RNA, 22 nt, Homo sapiens
uuggcuucuggacuauugugca

SEQ ID NO: 15229 - RNA, 22 nt, Homo sapiens
uuguccccacccaaaugucauc

SEQ ID NO: 15230 - RNA, 19 nt, Homo sapiens
uuguccccucuaaaucuca

SEQ ID NO: 15231 - RNA, 23 nt, Homo sapiens
uuugccacuuauuagcugggagg

SEQ ID NO: 15232 - RNA, 22 nt, Homo sapiens
uuuuggcuagaaauauaccucc

SEQ ID NO: 15233 - RNA, 22 nt, Homo sapiens
gugugcauggagggggcaguga

SEQ ID NO: 15234 - RNA, 21 nt, Homo sapiens
gugugcuugaauucagcuguc

SEQ ID NO: 15235 - RNA, 22 nt, Homo sapiens
guuauguuauguuauguuaugu

SEQ ID NO: 15236 - RNA, 22 nt, Homo sapiens
uaagugcuugacuuugauguuu

SEQ ID NO: 15237 - RNA, 20 nt, Homo sapiens
uaagugcuugagacuucuga

SEQ ID NO: 15238 - RNA, 20 nt, Homo sapiens
uaagugcuugaugaaugaac

SEQ ID NO: 15239 - RNA, 22 nt, Homo sapiens
uagcaaaucaauggaauugaag

SEQ ID NO: 15240 - RNA, 20 nt, Homo sapiens
uaggagcaaugagaguagaa

SEQ ID NO: 15241 - RNA, 22 nt, Homo sapiens
uaggagcacagcagcauguggg

SEQ ID NO: 15242 - RNA, 22 nt, Homo sapiens
uaggagcauaggauuguuugag

SEQ ID NO: 15243 - RNA, 22 nt, Homo sapiens
uaguagagauggggcacaugcc

SEQ ID NO: 15244 - RNA, 22 nt, Homo sapiens
uagucaaaucugaaggaaauuu

SEQ ID NO: 15245 - RNA, 21 nt, Homo sapiens
uagugcugaggcaguauggga

SEQ ID NO: 15246 - RNA, 22 nt, Homo sapiens
uaugacucagaaggcacacaca

SEQ ID NO: 15247 - RNA, 18 nt, Homo sapiens
ucaagcuauugucaugcc

SEQ ID NO: 15248 - RNA, 22 nt, Homo sapiens
aaagcacuggagucaucaucua

SEQ ID NO: 15249 - RNA, 21 nt, Homo sapiens
uuaggcagugucagaggugag

SEQ ID NO: 15250 - RNA, 22 nt, Homo sapiens
uucaaaaccucugcuuaagccc

SEQ ID NO: 15251 - RNA, 22 nt, Homo sapiens
uuccaggugggcgugggccugg

SEQ ID NO: 15252 - RNA, 22 nt, Homo sapiens
uuccuggaggggaaguguccaa

SEQ ID NO: 15253 - RNA, 22 nt, Homo sapiens
uuccuuguagcaaaugcgauga

SEQ ID NO: 15254 - RNA, 22 nt, Homo sapiens
uucugccaaucaacccacaucc

SEQ ID NO: 15255 - RNA, 22 nt, Homo sapiens
uugaaagaugaacuggauugga

SEQ ID NO: 15256 - RNA, 22 nt, Homo sapiens
uugagaugaagucuugcucucu

SEQ ID NO: 15257 - RNA, 22 nt, Homo sapiens
uugagaugaaguuuugcucuuu

SEQ ID NO: 15258 - RNA, 22 nt, Homo sapiens
uugagauggagucucacucuuc

SEQ ID NO: 15259 - RNA, 22 nt, Homo sapiens
uugagauggagucucacucuug

SEQ ID NO: 15260 - RNA, 22 nt, Homo sapiens
uugagauggagucucgcucugu

SEQ ID NO: 15261 - RNA, 22 nt, Homo sapiens
uugagauggaguuucaauauug

SEQ ID NO: 15262 - RNA, 22 nt, Homo sapiens
uugagauggaguuucacucucg

SEQ ID NO: 15263 - RNA, 22 nt, Homo sapiens
uugagauggaguuucacucugu

SEQ ID NO: 15264 - RNA, 22 nt, Homo sapiens
uugagauggaguuucgcucuug

SEQ ID NO: 15265 - RNA, 22 nt, Homo sapiens
uugagauggaguuucgcucuuu

SEQ ID NO: 15266 - RNA, 22 nt, Homo sapiens
uugagauguaagauguuaauau

SEQ ID NO: 15267 - RNA, 22 nt, Homo sapiens
uuggcagugguucugacggacc

SEQ ID NO: 15268 - RNA, 22 nt, Homo sapiens
uuguugcacugcuuuccuggcc

SEQ ID NO: 15269 - RNA, 22 nt, Homo sapiens
uuuagcagcaaagagccaugcu

SEQ ID NO: 15270 - RNA, 22 nt, Homo sapiens
uuuggcacuauagguaaauuug

SEQ ID NO: 15271 - RNA, 20 nt, Homo sapiens
uuuggcacugagugguauaa

SEQ ID NO: 15272 - RNA, 18 nt, Homo sapiens
uuuuugaggcacagggga

SEQ ID NO: 15273 - RNA, 22 nt, Homo sapiens
aacuggccuggcgugcagaggg

SEQ ID NO: 15274 - RNA, 20 nt, Homo sapiens
acacuggcuuugagauuuag

SEQ ID NO: 15275 - RNA, 22 nt, Homo sapiens
acugcacuccagccugugagac

SEQ ID NO: 15276 - RNA, 22 nt, Homo sapiens
acugcacuccagccuucaggac

SEQ ID NO: 15277 - RNA, 22 nt, Homo sapiens
aggcacacaacccuggaccuga

SEQ ID NO: 15278 - RNA, 22 nt, Homo sapiens
caccagguuggagugcaguggu

SEQ ID NO: 15279 - RNA, 19 nt, Homo sapiens
caccgccugcccccugcug

SEQ ID NO: 15280 - RNA, 22 nt, Homo sapiens
cuccacugagcaggugggaggc

SEQ ID NO: 15281 - RNA, 22 nt, Homo sapiens
cucucugagccauggcugcccu

SEQ ID NO: 15282 - RNA, 22 nt, Homo sapiens
cugagcccauucuggggagaag

SEQ ID NO: 15283 - RNA, 22 nt, Homo sapiens
gcaccacugcacucucagcuug

SEQ ID NO: 15284 - RNA, 22 nt, Homo sapiens
gcauggccuuuaaaugucacag

SEQ ID NO: 15285 - RNA, 22 nt, Homo sapiens
uacuggccccaaaguagguagu

SEQ ID NO: 15286 - RNA, 22 nt, Homo sapiens
uacuggccuugaacucuggugu

SEQ ID NO: 15287 - RNA, 21 nt, Homo sapiens
ucaggaccucuaguuagccag

SEQ ID NO: 15288 - RNA, 22 nt, Homo sapiens
uggaggacugcagaacugaggc

SEQ ID NO: 15289 - RNA, 22 nt, Homo sapiens
uggcaccauccaggugucucua

SEQ ID NO: 15290 - RNA, 22 nt, Homo sapiens
uuccugagccuuguaucuagua

SEQ ID NO: 15291 - RNA, 22 nt, Homo sapiens
uugggacccuguccuguaacaa

SEQ ID NO: 15292 - RNA, 22 nt, Homo sapiens
aacuggccugagaugaaaagug

SEQ ID NO: 15293 - RNA, 22 nt, Homo sapiens
acccugucacucccaucaauuu

SEQ ID NO: 15294 - RNA, 22 nt, Homo sapiens
acugcacuccagacucugucuc

SEQ ID NO: 15295 - RNA, 22 nt, Homo sapiens
acugcacuccagcuccagggug

SEQ ID NO: 15296 - RNA, 22 nt, Homo sapiens
cacugcacuccagcuugugggc

SEQ ID NO: 15297 - RNA, 22 nt, Homo sapiens
gcacccugucaaaauggaccaa

SEQ ID NO: 15298 - RNA, 22 nt, Homo sapiens
ggcaccacagacgccaggcgug

SEQ ID NO: 15299 - RNA, 22 nt, Homo sapiens
gucaaaugcacagaaccauuaa

SEQ ID NO: 15300 - RNA, 22 nt, Homo sapiens
gugacacagcaagacuccgucu

SEQ ID NO: 15301 - RNA, 20 nt, Homo sapiens
ucacccugacaucugcccag

SEQ ID NO: 15302 - RNA, 22 nt, Homo sapiens
ugagcugguacuaauauuauca

SEQ ID NO: 15303 - RNA, 22 nt, Homo sapiens
acagcacugccaagugacccau

SEQ ID NO: 15304 - RNA, 22 nt, Homo sapiens
aguggcacaauuuugacucccc

SEQ ID NO: 15305 - RNA, 22 nt, Homo sapiens
caccaggugcccagcacggcca

SEQ ID NO: 15306 - RNA, 22 nt, Homo sapiens
cauggcccugggcugggcgaac

SEQ ID NO: 15307 - RNA, 22 nt, Homo sapiens
gacuggccauugauacagaggu

SEQ ID NO: 15308 - RNA, 22 nt, Homo sapiens
gcaccccuuaccgggcuggguu

SEQ ID NO: 15309 - RNA, 17 nt, Homo sapiens
gcacuggcguaucccac

SEQ ID NO: 15310 - RNA, 22 nt, Homo sapiens
ucacuggcaaauauauccguug

SEQ ID NO: 15311 - RNA, 22 nt, Homo sapiens
ucacuggccaaauucuggguga

SEQ ID NO: 15312 - RNA, 22 nt, Homo sapiens
ucugagucaucacaaaugaugc

SEQ ID NO: 15313 - RNA, 22 nt, Homo sapiens
uguggcacuguguccagagaaa

SEQ ID NO: 15314 - RNA, 21 nt, Homo sapiens
uuuccuggagcguauggcuuc

SEQ ID NO: 15315 - RNA, 22 nt, Homo sapiens
aacuggccuccuugggaaauua

SEQ ID NO: 15316 - RNA, 22 nt, Homo sapiens
acccugucaaaacggaccaauc

SEQ ID NO: 15317 - RNA, 22 nt, Homo sapiens
acccugucaaaauggaccaauc

SEQ ID NO: 15318 - RNA, 19 nt, Homo sapiens
agagacucauuguagcauu

SEQ ID NO: 15319 - RNA, 22 nt, Homo sapiens
aguggcacuauucucagaguca

SEQ ID NO: 15320 - RNA, 22 nt, Homo sapiens
gacuggccuauaauggcgaauu

SEQ ID NO: 15321 - RNA, 22 nt, Homo sapiens
gagacucuuagauuggaaaucu

SEQ ID NO: 15322 - RNA, 22 nt, Homo sapiens
gaggucaugucgggccccagga

SEQ ID NO: 15323 - RNA, 22 nt, Homo sapiens
gaggucauucugugguacccag

SEQ ID NO: 15324 - RNA, 22 nt, Homo sapiens
ggcaccauggaaggacgggagc

SEQ ID NO: 15325 - RNA, 22 nt, Homo sapiens
ggucacccugaugcuggugguc

SEQ ID NO: 15326 - RNA, 22 nt, Homo sapiens
gucacugggugcugcgccuguc

SEQ ID NO: 15327 - RNA, 22 nt, Homo sapiens
ucaugggagcccccaucaugag

SEQ ID NO: 15328 - RNA, 20 nt, Homo sapiens
uguggcacuguaucucucag

SEQ ID NO: 15329 - RNA, 19 nt, Homo sapiens
uuccugagaacaagggcuu

SEQ ID NO: 15330 - RNA, 22 nt, Homo sapiens
aaagugcaguacuucguauauu

SEQ ID NO: 15331 - RNA, 22 nt, Homo sapiens
aaagugcaguauuugggcagga

SEQ ID NO: 15332 - RNA, 22 nt, Homo sapiens
aaaugcacgcuacccagcuaga

SEQ ID NO: 15333 - RNA, 22 nt, Homo sapiens
aacagugcuucauucacacauu

SEQ ID NO: 15334 - RNA, 22 nt, Homo sapiens
aaccuuuagucagcucuuagga

SEQ ID NO: 15335 - RNA, 22 nt, Homo sapiens
aagagguuuaacugacucacag

SEQ ID NO: 15336 - RNA, 22 nt, Homo sapiens
aagggaaugcgcugccuguguu

SEQ ID NO: 15337 - RNA, 22 nt, Homo sapiens
aauacugcuuugauguaagcua

SEQ ID NO: 15338 - RNA, 22 nt, Homo sapiens
aauaugucugcuaauuguuucu

SEQ ID NO: 15339 - RNA, 22 nt, Homo sapiens
aaugaaguuagauguugagaag

SEQ ID NO: 15340 - RNA, 22 nt, Homo sapiens
aauggcagaugaaauugucauu

SEQ ID NO: 15341 - RNA, 22 nt, Homo sapiens
aauugcauaaaauucaacucug

SEQ ID NO: 15342 - RNA, 22 nt, Homo sapiens
aauuggcagugcucuugccaca

SEQ ID NO: 15343 - RNA, 22 nt, Homo sapiens
acaagacuucuuguauucuagu

SEQ ID NO: 15344 - RNA, 22 nt, Homo sapiens
acacauuagcaagugcuguuau

SEQ ID NO: 15345 - RNA, 22 nt, Homo sapiens
acacuauugagguuuguuugca

SEQ ID NO: 15346 - RNA, 21 nt, Homo sapiens
acauguacacauguaugcaca

SEQ ID NO: 15347 - RNA, 22 nt, Homo sapiens
accaguuuuuuauacaucuucu

SEQ ID NO: 15348 - RNA, 22 nt, Homo sapiens
accauugcacuccagcccaggc

SEQ ID NO: 15349 - RNA, 22 nt, Homo sapiens
acccaguguugggcagaacugu

SEQ ID NO: 15350 - RNA, 22 nt, Homo sapiens
acccgcccagguguggccggga

SEQ ID NO: 15351 - RNA, 22 nt, Homo sapiens
acugcacuccaaccuuggugac

SEQ ID NO: 15352 - RNA, 22 nt, Homo sapiens
acugcacuccagccuugugaca

SEQ ID NO: 15353 - RNA, 22 nt, Homo sapiens
acugcacuccuccuugggugac

SEQ ID NO: 15354 - RNA, 22 nt, Homo sapiens
acugcacuucagccuugugaca

SEQ ID NO: 15355 - RNA, 22 nt, Homo sapiens
agauguuguucaucugauuguu

SEQ ID NO: 15356 - RNA, 22 nt, Homo sapiens
agcacaguuaaaugaggcuucu

SEQ ID NO: 15357 - RNA, 22 nt, Homo sapiens
agcaccauuucucuaaagcacu

SEQ ID NO: 15358 - RNA, 20 nt, Homo sapiens
agcugcagauauaaauccgc

SEQ ID NO: 15359 - RNA, 22 nt, Homo sapiens
agcuuuuugggcagcuauugac

SEQ ID NO: 15360 - RNA, 20 nt, Homo sapiens
aggcauguugguuugcgugu

SEQ ID NO: 15361 - RNA, 22 nt, Homo sapiens
uuaauucugucugcccucaucc

SEQ ID NO: 15362 - RNA, 22 nt, Homo sapiens
uuacauguggugugaagaagag

SEQ ID NO: 15363 - RNA, 22 nt, Homo sapiens
uuauauguuucuguuuggaggc

SEQ ID NO: 15364 - RNA, 22 nt, Homo sapiens
uuaugcagcaaagugcuugaaa

SEQ ID NO: 15365 - RNA, 22 nt, Homo sapiens
uuauugcuuaugauuagguguu

SEQ ID NO: 15366 - RNA, 22 nt, Homo sapiens
uucaacagugauggccuuugua

SEQ ID NO: 15367 - RNA, 22 nt, Homo sapiens
uucaauuaauauuauacucuca

SEQ ID NO: 15368 - RNA, 22 nt, Homo sapiens
uucacagugugaucuaugggca

SEQ ID NO: 15369 - RNA, 22 nt, Homo sapiens
uucaggcuuuuauuuacugaua

SEQ ID NO: 15370 - RNA, 22 nt, Homo sapiens
uucaguggguggaugaauauga

SEQ ID NO: 15371 - RNA, 22 nt, Homo sapiens
uucagugguuauuugugagauu

SEQ ID NO: 15372 - RNA, 21 nt, Homo sapiens
uucaucagccagaaaucaagc

SEQ ID NO: 15373 - RNA, 22 nt, Homo sapiens
uucauguaauauuucacagcuu

SEQ ID NO: 15374 - RNA, 22 nt, Homo sapiens
uucccugagcaucuguugagcc

SEQ ID NO: 15375 - RNA, 19 nt, Homo sapiens
uuccugagaacaagggcuu

SEQ ID NO: 15376 - RNA, 22 nt, Homo sapiens
uuccugugacccccaagcccac

SEQ ID NO: 15377 - RNA, 22 nt, Homo sapiens
uuccugugacuguguggcaccc

SEQ ID NO: 15378 - RNA, 20 nt, Homo sapiens
uucuaguacuucuguuucca

SEQ ID NO: 15379 - RNA, 22 nt, Homo sapiens
uugaaauguguaagcuccgaaa

SEQ ID NO: 15380 - RNA, 22 nt, Homo sapiens
uugaagacuaauuuagauaaug

SEQ ID NO: 15381 - RNA, 22 nt, Homo sapiens
uugacauaaucauuucacagug

SEQ ID NO: 15382 - RNA, 22 nt, Homo sapiens
uugacauguaaguacucuauag

SEQ ID NO: 15383 - RNA, 22 nt, Homo sapiens
uugacuuagacauucaguugga

SEQ ID NO: 15384 - RNA, 22 nt, Homo sapiens
uugacuuuuauucacucugcua

SEQ ID NO: 15385 - RNA, 23 nt, Homo sapiens
uugaggcauguaccaucaauauc

SEQ ID NO: 15386 - RNA, 22 nt, Homo sapiens
uugaggccugauaacacacuga

SEQ ID NO: 15387 - RNA, 22 nt, Homo sapiens
uugauaguccuguaucuauuuu

SEQ ID NO: 15388 - RNA, 22 nt, Homo sapiens
uugcauauguugaaccagccuu

SEQ ID NO: 15389 - RNA, 22 nt, Homo sapiens
uuggauuauaaacugagauuug

SEQ ID NO: 15390 - RNA, 20 nt, Homo sapiens
uuggcauuuagacaagaguu

SEQ ID NO: 15391 - RNA, 22 nt, Homo sapiens
uugggcaaguggcaugaccaug

SEQ ID NO: 15392 - RNA, 22 nt, Homo sapiens
uugggcaauaggaagcaggugg

SEQ ID NO: 15393 - RNA, 22 nt, Homo sapiens
uugucauggucuugauccauua

SEQ ID NO: 15394 - RNA, 22 nt, Homo sapiens
uugugguuuucagcuuauauau

SEQ ID NO: 15395 - RNA, 22 nt, Homo sapiens
uuuaagccaggugcaguggcuc

SEQ ID NO: 15396 - RNA, 22 nt, Homo sapiens
uuuacugugggguuucuuagag

SEQ ID NO: 15397 - RNA, 22 nt, Homo sapiens
uuuagcaauucauuuugugucu

SEQ ID NO: 15398 - RNA, 22 nt, Homo sapiens
uuucacagagggcuucuuucua

SEQ ID NO: 15399 - RNA, 17 nt, Homo sapiens
uuucagaguggaagugu

SEQ ID NO: 15400 - RNA, 22 nt, Homo sapiens
uuucauggaggcauuuuagauu

SEQ ID NO: 15401 - RNA, 22 nt, Homo sapiens
uuuccaguuguucuagaaagcu

SEQ ID NO: 15402 - RNA, 22 nt, Homo sapiens
uuugccuuugugauauggucua

SEQ ID NO: 15403 - RNA, 22 nt, Homo sapiens
uuugcuucacuguuuggcaaaa

SEQ ID NO: 15404 - RNA, 18 nt, Homo sapiens
uuuggcuguucaugacuc

SEQ ID NO: 15405 - RNA, 22 nt, Homo sapiens
uuuggcuguuucuggacuaaga

SEQ ID NO: 15406 - RNA, 22 nt, Homo sapiens
uuuggucuuuuauuuaaagcag

SEQ ID NO: 15407 - RNA, 18 nt, Homo sapiens
uuuguacuuuuucuaaug

SEQ ID NO: 15408 - RNA, 22 nt, Homo sapiens
uuugucauagcagcaggaaugg

SEQ ID NO: 15409 - RNA, 22 nt, Homo sapiens
uuugucccccguaguucauaua

SEQ ID NO: 15410 - RNA, 22 nt, Homo sapiens
uuugugcuccuguugagaaucu

SEQ ID NO: 15411 - RNA, 22 nt, Homo sapiens
uuugugucccucuaaaauuuau

SEQ ID NO: 15412 - RNA, 22 nt, Homo sapiens
uuuuagcaaagagacugguggc

SEQ ID NO: 15413 - RNA, 20 nt, Homo sapiens
uuuuagcacuuguuauggug

SEQ ID NO: 15414 - RNA, 22 nt, Homo sapiens
uuuuagcagccaugacaaagau

SEQ ID NO: 15415 - RNA, 19 nt, Homo sapiens
uuuuggaaaugugaacagc

SEQ ID NO: 15416 - RNA, 22 nt, Homo sapiens
uuuuuugguaauugaacaauga

SEQ ID NO: 15417 - RNA, 18 nt, Homo sapiens
cuuugcagcuuccagagg

SEQ ID NO: 15418 - RNA, 22 nt, Homo sapiens
gaaagacuuucugcuguggaua

SEQ ID NO: 15419 - RNA, 22 nt, Homo sapiens
gaaaguaauuaacgauuguugc

SEQ ID NO: 15420 - RNA, 22 nt, Homo sapiens
gaaaugcucagggguuuuccag

SEQ ID NO: 15421 - RNA, 22 nt, Homo sapiens
gaagaacuaggugagaucuaga

SEQ ID NO: 15422 - RNA, 22 nt, Homo sapiens
gaaugauacuguuaacgaaaga

SEQ ID NO: 15423 - RNA, 22 nt, Homo sapiens
gaaugcaugaggggaucagaug

SEQ ID NO: 15424 - RNA, 22 nt, Homo sapiens
gacacugucuucugcucuuaaa

SEQ ID NO: 15425 - RNA, 22 nt, Homo sapiens
gacaguuuggugaggaagacga

SEQ ID NO: 15426 - RNA, 20 nt, Homo sapiens
gagaccugagauucacucaa

SEQ ID NO: 15427 - RNA, 22 nt, Homo sapiens
gagacugagucucgcucugccg

SEQ ID NO: 15428 - RNA, 22 nt, Homo sapiens
gagauaaauaggucacaguucu

SEQ ID NO: 15429 - RNA, 22 nt, Homo sapiens
gagaugugguucaaggguguuu

SEQ ID NO: 15430 - RNA, 22 nt, Homo sapiens
gaggcauuauucccaucuuaca

SEQ ID NO: 15431 - RNA, 22 nt, Homo sapiens
gaggugguagguucacagcagc

SEQ ID NO: 15432 - RNA, 22 nt, Homo sapiens
gaguagugcugcaguaaacaua

SEQ ID NO: 15433 - RNA, 22 nt, Homo sapiens
gauauguaaaaauuauaucuga

SEQ ID NO: 15434 - RNA, 22 nt, Homo sapiens
gauaugugauaagaguuaucuu

SEQ ID NO: 15435 - RNA, 22 nt, Homo sapiens
gaucacaugggagaaugagagu

SEQ ID NO: 15436 - RNA, 22 nt, Homo sapiens
gaucacauuguuucauacauau

SEQ ID NO: 15437 - RNA, 22 nt, Homo sapiens
gauggcacuuaagagcaagagc

SEQ ID NO: 15438 - RNA, 22 nt, Homo sapiens
gcaaaauugagaagggaauaua

SEQ ID NO: 15439 - RNA, 22 nt, Homo sapiens
gcaaaugcuaugccauuuuaua

SEQ ID NO: 15440 - RNA, 20 nt, Homo sapiens
gcaaauggaucccacaagcc

SEQ ID NO: 15441 - RNA, 22 nt, Homo sapiens
gcagugcaugacgguauauaua

SEQ ID NO: 15442 - RNA, 20 nt, Homo sapiens
gcauaugucuuuauagcaga

SEQ ID NO: 15443 - RNA, 22 nt, Homo sapiens
gccccaguacaggcuccuuaga

SEQ ID NO: 15444 - RNA, 22 nt, Homo sapiens
gccuagagacuugguaucuugc

SEQ ID NO: 15445 - RNA, 23 nt, Homo sapiens
gcuaggagagaugaaacacaggu

SEQ ID NO: 15446 - RNA, 17 nt, Homo sapiens
gcugcauucauguagaa

SEQ ID NO: 15447 - RNA, 22 nt, Homo sapiens
gcuucauggaggcugggcgcag

SEQ ID NO: 15448 - RNA, 23 nt, Homo sapiens
ggaaacauccagucuuucaccau

SEQ ID NO: 15449 - RNA, 22 nt, Homo sapiens
ggagucugacuuauaggaaccu

SEQ ID NO: 15450 - RNA, 22 nt, Homo sapiens
ggagugucccaaucucagcuca

SEQ ID NO: 15451 - RNA, 22 nt, Homo sapiens
ggcaccacagacgccaggcgug

SEQ ID NO: 15452 - RNA, 22 nt, Homo sapiens
gggagguagguauuagcuuuuc

SEQ ID NO: 15453 - RNA, 22 nt, Homo sapiens
gggaguguguaggacccagugu

SEQ ID NO: 15454 - RNA, 22 nt, Homo sapiens
gguggugguauuucagaaaaug

SEQ ID NO: 15455 - RNA, 22 nt, Homo sapiens
guacacauacauauaugugugu

SEQ ID NO: 15456 - RNA, 22 nt, Homo sapiens
guacuuagagauagggucuuua

SEQ ID NO: 15457 - RNA, 22 nt, Homo sapiens
guauaaguugacucaaucuuug

SEQ ID NO: 15458 - RNA, 22 nt, Homo sapiens
guauacuucugaaaauagcuau

SEQ ID NO: 15459 - RNA, 22 nt, Homo sapiens
guauuuguugcagcagcacuau

SEQ ID NO: 15460 - RNA, 22 nt, Homo sapiens
gucacuggcugucuuguaugau

SEQ ID NO: 15461 - RNA, 22 nt, Homo sapiens
gucacugggugcugcgccuguc

SEQ ID NO: 15462 - RNA, 22 nt, Homo sapiens
gucaguggagaaaaggacaugu

SEQ ID NO: 15463 - RNA, 22 nt, Homo sapiens
gucaguuucacucagcuggaac

SEQ ID NO: 15464 - RNA, 22 nt, Homo sapiens
gucuggcacagggaaaguacaa

SEQ ID NO: 15465 - RNA, 22 nt, Homo sapiens
gugaaguuuuugugaggccuaa

SEQ ID NO: 15466 - RNA, 22 nt, Homo sapiens
gugagguguuaaccaaccugug

SEQ ID NO: 15467 - RNA, 22 nt, Homo sapiens
gugcacauuguuuaugucuguu

SEQ ID NO: 15468 - RNA, 22 nt, Homo sapiens
gugcauguccacuaguccauau

SEQ ID NO: 15469 - RNA, 21 nt, Homo sapiens
guggaaauggaauuuacuaau

SEQ ID NO: 15470 - RNA, 22 nt, Homo sapiens
guggcaugaaagcaucugugau

SEQ ID NO: 15471 - RNA, 22 nt, Homo sapiens
gugguagaaauguagaugcuag

SEQ ID NO: 15472 - RNA, 22 nt, Homo sapiens
guguagagaaaaguaccauuuu

SEQ ID NO: 15473 - RNA, 22 nt, Homo sapiens
gugucaugggcauguccuuaac

SEQ ID NO: 15474 - RNA, 22 nt, Homo sapiens
guguucaaacccaggucugucu

SEQ ID NO: 15475 - RNA, 22 nt, Homo sapiens
guucuauguugggaguucacua

SEQ ID NO: 15476 - RNA, 22 nt, Homo sapiens
guuggcuguuucccccaaguga

SEQ ID NO: 15477 - RNA, 22 nt, Homo sapiens
uaaagaugcugggaaggcuagg

SEQ ID NO: 15478 - RNA, 22 nt, Homo sapiens
uaacccacgcagaauggacaag

SEQ ID NO: 15479 - RNA, 21 nt, Homo sapiens
uaacccugaaggagcucugga

SEQ ID NO: 15480 - RNA, 22 nt, Homo sapiens
gugcaaugucaggagaugcagc

SEQ ID NO: 15481 - RNA, 22 nt, Homo sapiens
gugcagugugauccuuccguau

SEQ ID NO: 15482 - RNA, 22 nt, Homo sapiens
guggaaguuaagugacuuucug

SEQ ID NO: 15483 - RNA, 22 nt, Homo sapiens
gugggauaauuuuuggugcugu

SEQ ID NO: 15484 - RNA, 22 nt, Homo sapiens
gugggaugcaaguaaaauuguc

SEQ ID NO: 15485 - RNA, 22 nt, Homo sapiens
gugggcaaagcuaguguguaga

SEQ ID NO: 15486 - RNA, 22 nt, Homo sapiens
gugggcaagucacuucaguucu

SEQ ID NO: 15487 - RNA, 22 nt, Homo sapiens
gugucaugagggggacaggaag

SEQ ID NO: 15488 - RNA, 21 nt, Homo sapiens
gugucaugguugacuuuggca

SEQ ID NO: 15489 - RNA, 22 nt, Homo sapiens
gugugauuguuaauuuuaggug

SEQ ID NO: 15490 - RNA, 22 nt, Homo sapiens
guguucaaauucugacagagag

SEQ ID NO: 15491 - RNA, 22 nt, Homo sapiens
guucacucuggagaauauugac

SEQ ID NO: 15492 - RNA, 22 nt, Homo sapiens
guucaguuuuaaagggaaauug

SEQ ID NO: 15493 - RNA, 22 nt, Homo sapiens
uaaagccauugucaaguuugua

SEQ ID NO: 15494 - RNA, 22 nt, Homo sapiens
uaaauugcauaaguacaaauga

SEQ ID NO: 15495 - RNA, 22 nt, Homo sapiens
uaacaagagagucagucagucc

SEQ ID NO: 15496 - RNA, 22 nt, Homo sapiens
uaagacacauguguucccaggc

SEQ ID NO: 15497 - RNA, 22 nt, Homo sapiens
uaagggacgcccccuucucucu

SEQ ID NO: 15498 - RNA, 22 nt, Homo sapiens
uaagugcuguguuguuaccuaa

SEQ ID NO: 15499 - RNA, 20 nt, Homo sapiens
uaagugcuuuauauugauua

SEQ ID NO: 15500 - RNA, 22 nt, Homo sapiens
uacaaagcuacucgagggcagg

SEQ ID NO: 15501 - RNA, 22 nt, Homo sapiens
uacaaagcuuugaugugucuuu

SEQ ID NO: 15502 - RNA, 22 nt, Homo sapiens
uggaaucaucaacgaaugaaau

SEQ ID NO: 15503 - RNA, 22 nt, Homo sapiens
uggaaugugaauaacuuccuuc

SEQ ID NO: 15504 - RNA, 20 nt, Homo sapiens
uggaguuugaguucuuggag

SEQ ID NO: 15505 - RNA, 22 nt, Homo sapiens
uggcaacaucuggggacauguu

SEQ ID NO: 15506 - RNA, 19 nt, Homo sapiens
uggcaugaaugugaacuaa

SEQ ID NO: 15507 - RNA, 22 nt, Homo sapiens
uggcauguaaugcagaaguugc

SEQ ID NO: 15508 - RNA, 23 nt, Homo sapiens
uggcauuuuaguuagcuucagug

SEQ ID NO: 15509 - RNA, 22 nt, Homo sapiens
ugggaacaugaagguuaaagag

SEQ ID NO: 15510 - RNA, 22 nt, Homo sapiens
uggguagauaucauaguugccc

SEQ ID NO: 15511 - RNA, 22 nt, Homo sapiens
uggugagaaaugagaugcuuuu

SEQ ID NO: 15512 - RNA, 22 nt, Homo sapiens
uggugccguccugcaauccugg

SEQ ID NO: 15513 - RNA, 22 nt, Homo sapiens
ugguguccugucucugcgcuug

SEQ ID NO: 15514 - RNA, 22 nt, Homo sapiens
uguaagcauuauauaauuguug

SEQ ID NO: 15515 - RNA, 22 nt, Homo sapiens
ugucaugguguuaauuuuccug

SEQ ID NO: 15516 - RNA, 22 nt, Homo sapiens
ugucaugucaacuauggaauuu

SEQ ID NO: 15517 - RNA, 22 nt, Homo sapiens
ugucuaaagaauggcagacuca

SEQ ID NO: 15518 - RNA, 18 nt, Homo sapiens
ugugcaauauuaaccacc

SEQ ID NO: 15519 - RNA, 22 nt, Homo sapiens
uguggaaauuguuguauuuaau

SEQ ID NO: 15520 - RNA, 22 nt, Homo sapiens
ugugucuuguuuauagcuuucu

SEQ ID NO: 15521 - RNA, 22 nt, Homo sapiens
uguuacagcagaauugaaagag

SEQ ID NO: 15522 - RNA, 22 nt, Homo sapiens
uguuuguuugugauacgguaca

SEQ ID NO: 15523 - RNA, 23 nt, Homo sapiens
uuaagcaacggcugcuuuucaga

SEQ ID NO: 15524 - RNA, 21 nt, Homo sapiens
uuaagugcuuuguaugcacua

SEQ ID NO: 15525 - RNA, 22 nt, Homo sapiens
uuaauagcaaagaguuuagacu

SEQ ID NO: 15526 - RNA, 22 nt, Homo sapiens
uuacaugucuugguaagguuag

SEQ ID NO: 15527 - RNA, 22 nt, Homo sapiens
uuaccuugcacugagucugaaa

SEQ ID NO: 15528 - RNA, 21 nt, Homo sapiens
cugguguuagcacuucuuccc

SEQ ID NO: 15529 - RNA, 22 nt, Homo sapiens
cuguauguuucuaugaauguga

SEQ ID NO: 15530 - RNA, 22 nt, Homo sapiens
cuguuugguuaucuuuuccugu

SEQ ID NO: 15531 - RNA, 22 nt, Homo sapiens
cuucaugagacuuuuggaaggc

SEQ ID NO: 15532 - RNA, 22 nt, Homo sapiens
cuuccaaguggggcacgugcca

SEQ ID NO: 15533 - RNA, 21 nt, Homo sapiens
cuucuuggggcagggcagggu

SEQ ID NO: 15534 - RNA, 22 nt, Homo sapiens
gcaugugaauguguaagaaaau

SEQ ID NO: 15535 - RNA, 22 nt, Homo sapiens
gcgcagugggcugugccaucca

SEQ ID NO: 15536 - RNA, 22 nt, Homo sapiens
gcuacugucuaucugugcuucu

SEQ ID NO: 15537 - RNA, 22 nt, Homo sapiens
gcugcuguggcagauuggauuc

SEQ ID NO: 15538 - RNA, 22 nt, Homo sapiens
gcuuuggauaaaugucaguuua

SEQ ID NO: 15539 - RNA, 22 nt, Homo sapiens
ggagucugaacuggacaaugac

SEQ ID NO: 15540 - RNA, 22 nt, Homo sapiens
ggagucugauguucuaaggcag

SEQ ID NO: 15541 - RNA, 22 nt, Homo sapiens
ggcaaaugaagauggagaggcu

SEQ ID NO: 15542 - RNA, 22 nt, Homo sapiens
ggcaaugucagcuaaugaugga

SEQ ID NO: 15543 - RNA, 22 nt, Homo sapiens
ggcaguggaagugccaguuucu

SEQ ID NO: 15544 - RNA, 22 nt, Homo sapiens
ggccggguggccauggcugccc

SEQ ID NO: 15545 - RNA, 22 nt, Homo sapiens
guacaguggguguagggaccag

SEQ ID NO: 15546 - RNA, 22 nt, Homo sapiens
guacaguuuucaguguucacug

SEQ ID NO: 15547 - RNA, 22 nt, Homo sapiens
guauacacccugugauauuauu

SEQ ID NO: 15548 - RNA, 22 nt, Homo sapiens
guaugacacaggaagcuuaacc

SEQ ID NO: 15549 - RNA, 22 nt, Homo sapiens
guauggaagucaguuuguuggc

SEQ ID NO: 15550 - RNA, 20 nt, Homo sapiens
gucacuggcccagggcuugu

SEQ ID NO: 15551 - RNA, 21 nt, Homo sapiens
gucacuggggcuggauaauuc

SEQ ID NO: 15552 - RNA, 22 nt, Homo sapiens
gucauaugcucggaaaauguua

SEQ ID NO: 15553 - RNA, 22 nt, Homo sapiens
gucuuuugcuagccagagagcu

SEQ ID NO: 15554 - RNA, 17 nt, Homo sapiens
gugaaaucaucauuuuu

SEQ ID NO: 15555 - RNA, 22 nt, Homo sapiens
gugaaaugaaucuggaaauauu

SEQ ID NO: 15556 - RNA, 22 nt, Homo sapiens
gugaagugugaccucagcaucu

SEQ ID NO: 15557 - RNA, 22 nt, Homo sapiens
gugaaguuuuuugcugagaguc

SEQ ID NO: 15558 - RNA, 22 nt, Homo sapiens
gugacaguggagacuuacuuca

SEQ ID NO: 15559 - RNA, 22 nt, Homo sapiens
gugagauccucucuuauauggg

SEQ ID NO: 15560 - RNA, 20 nt, Homo sapiens
gugagguagaggguuaccug

SEQ ID NO: 15561 - RNA, 22 nt, Homo sapiens
gugaguggacgugaccaauaaa

SEQ ID NO: 15562 - RNA, 22 nt, Homo sapiens
gugaucaugauccugaagcauu

SEQ ID NO: 15563 - RNA, 22 nt, Homo sapiens
gugcaguguuugcauggaauca

SEQ ID NO: 15564 - RNA, 20 nt, Homo sapiens
gugggcaaauccuuuccucu

SEQ ID NO: 15565 - RNA, 22 nt, Homo sapiens
gugguuguuggaguggcaauuu

SEQ ID NO: 15566 - RNA, 22 nt, Homo sapiens
guguaaaacaauuagaggauuu

SEQ ID NO: 15567 - RNA, 22 nt, Homo sapiens
guuaagaaguguaacuuaaguu

SEQ ID NO: 15568 - RNA, 22 nt, Homo sapiens
guucacaguuucuaaucccagc

SEQ ID NO: 15569 - RNA, 22 nt, Homo sapiens
guucaguuuugaaauguuaauu

SEQ ID NO: 15570 - RNA, 22 nt, Homo sapiens
uaacccuuacaacuacacucgu

SEQ ID NO: 15571 - RNA, 23 nt, Homo sapiens
uaagacacuaacuuuaugcuuug

SEQ ID NO: 15572 - RNA, 22 nt, Homo sapiens
aagcaaacaucagcuugguuaa

SEQ ID NO: 15573 - RNA, 22 nt, Homo sapiens
aagcugcauuuucuagaugcuu

SEQ ID NO: 15574 - RNA, 22 nt, Homo sapiens
aagggagcugcauaaucuugug

SEQ ID NO: 15575 - RNA, 18 nt, Homo sapiens
aaggugcuucuguucuga

SEQ ID NO: 15576 - RNA, 22 nt, Homo sapiens
aaguaucaggaauaguuauugg

SEQ ID NO: 15577 - RNA, 22 nt, Homo sapiens
aagugaauucauuguguuauau

SEQ ID NO: 15578 - RNA, 17 nt, Homo sapiens
aaguggcuuguucacca

SEQ ID NO: 15579 - RNA, 22 nt, Homo sapiens
aauugcauaugcaguagaucua

SEQ ID NO: 15580 - RNA, 22 nt, Homo sapiens
aauugcauugaauuuguagcuu

SEQ ID NO: 15581 - RNA, 20 nt, Homo sapiens
acaaaugcauucugugacau

SEQ ID NO: 15582 - RNA, 22 nt, Homo sapiens
acacuggguaacauaucuguua

SEQ ID NO: 15583 - RNA, 22 nt, Homo sapiens
acacuugcuugcaauagccucc

SEQ ID NO: 15584 - RNA, 22 nt, Homo sapiens
accccauuugcacugagcccuu

SEQ ID NO: 15585 - RNA, 22 nt, Homo sapiens
acugagaucuuuaaauaaauaa

SEQ ID NO: 15586 - RNA, 22 nt, Homo sapiens
acugcacuccagccugugagac

SEQ ID NO: 15587 - RNA, 22 nt, Homo sapiens
acugcacuccagccuucgugac

SEQ ID NO: 15588 - RNA, 22 nt, Homo sapiens
acugcacuccagccuugauggc

SEQ ID NO: 15589 - RNA, 22 nt, Homo sapiens
acugcacucuagcuugggugac

SEQ ID NO: 15590 - RNA, 22 nt, Homo sapiens
acuuuuguuauacagugugaua

SEQ ID NO: 15591 - RNA, 23 nt, Homo sapiens
agaaaugucuauucagggucccu

SEQ ID NO: 15592 - RNA, 22 nt, Homo sapiens
agaauguaaacagaauagagga

SEQ ID NO: 15593 - RNA, 22 nt, Homo sapiens
agacacuguugaaaaggcccca

SEQ ID NO: 15594 - RNA, 21 nt, Homo sapiens
agacacuuggaagguuuuaga

SEQ ID NO: 15595 - RNA, 19 nt, Homo sapiens
agagacucauuguagcauu

SEQ ID NO: 15596 - RNA, 22 nt, Homo sapiens
agagauaaagauuuuaauuuug

SEQ ID NO: 15597 - RNA, 22 nt, Homo sapiens
agagguaagaauaguaguugga

SEQ ID NO: 15598 - RNA, 22 nt, Homo sapiens
agagguuuaacuggcuuauggu

SEQ ID NO: 15599 - RNA, 22 nt, Homo sapiens
agagguuuaauugauucacagu

SEQ ID NO: 15600 - RNA, 22 nt, Homo sapiens
agauauguuauugauguuaaug

SEQ ID NO: 15601 - RNA, 22 nt, Homo sapiens
agcaccaugggcugaguaagug

SEQ ID NO: 15602 - RNA, 22 nt, Homo sapiens
agcaggacaauaugggaucagg

SEQ ID NO: 15603 - RNA, 22 nt, Homo sapiens
agcggcuguuccccuggucuau

SEQ ID NO: 15604 - RNA, 22 nt, Homo sapiens
agcuaaaucucauguugaauug

SEQ ID NO: 15605 - RNA, 22 nt, Homo sapiens
agcuagugugauucuuuggggu

SEQ ID NO: 15606 - RNA, 21 nt, Homo sapiens
aggaagacuaugaucaauugg

SEQ ID NO: 15607 - RNA, 22 nt, Homo sapiens
aggagcacaauggucaugugga

SEQ ID NO: 15608 - RNA, 22 nt, Homo sapiens
aggcuguguggauaauauuggg

SEQ ID NO: 15609 - RNA, 22 nt, Homo sapiens
cagagaucaugcaacugcucgc

SEQ ID NO: 15610 - RNA, 22 nt, Homo sapiens
cagauguaguauuuuagugaaa

SEQ ID NO: 15611 - RNA, 22 nt, Homo sapiens
caguggacuaaauggggaauau

SEQ ID NO: 15612 - RNA, 22 nt, Homo sapiens
cauacaagcuacaaucacaaag

SEQ ID NO: 15613 - RNA, 22 nt, Homo sapiens
caugccauugcucuccugggug

SEQ ID NO: 15614 - RNA, 20 nt, Homo sapiens
cauugcacuccagcuugggc

SEQ ID NO: 15615 - RNA, 22 nt, Homo sapiens
cauugcauuuucuuuguaccuu

SEQ ID NO: 15616 - RNA, 22 nt, Homo sapiens
ccaguuuuucauuuauacuagu

SEQ ID NO: 15617 - RNA, 22 nt, Homo sapiens
ccaguuuuuggcaaugaugaau

SEQ ID NO: 15618 - RNA, 22 nt, Homo sapiens
ccucacaaccuuuauugaagag

SEQ ID NO: 15619 - RNA, 22 nt, Homo sapiens
ccuggaucauugucauucccaa

SEQ ID NO: 15620 - RNA, 22 nt, Homo sapiens
ccugucuugauuaaauuacuua

SEQ ID NO: 15621 - RNA, 22 nt, Homo sapiens
ccuucauucauuaauuuagccc

SEQ ID NO: 15622 - RNA, 22 nt, Homo sapiens
cuauaugucuguuuugguacca

SEQ ID NO: 15623 - RNA, 22 nt, Homo sapiens
cuaucucauugguuuuugaaag

SEQ ID NO: 15624 - RNA, 19 nt, Homo sapiens
cuauugcacauagcugaag

SEQ ID NO: 15625 - RNA, 20 nt, Homo sapiens
cucacagacagcuucuuucu

SEQ ID NO: 15626 - RNA, 22 nt, Homo sapiens
cucacuggguguaaaacaugua

SEQ ID NO: 15627 - RNA, 22 nt, Homo sapiens
cucagugaagggcaagaggcaa

SEQ ID NO: 15628 - RNA, 22 nt, Homo sapiens
cuccauuuaucugaaauuuuau

SEQ ID NO: 15629 - RNA, 22 nt, Homo sapiens
cucgcuccauuucggugaucaa

SEQ ID NO: 15630 - RNA, 22 nt, Homo sapiens
cugaaaugaauuauuuucuuuc

SEQ ID NO: 15631 - RNA, 22 nt, Homo sapiens
cugaagugugaaagucuuuuuu

SEQ ID NO: 15632 - RNA, 22 nt, Homo sapiens
cugagcaaaaugaagacacgau

SEQ ID NO: 15633 - RNA, 22 nt, Homo sapiens
cuugcagaggcccuggggagag

SEQ ID NO: 15634 - RNA, 22 nt, Homo sapiens
cuuuacacauccuaaccagugu

SEQ ID NO: 15635 - RNA, 21 nt, Homo sapiens
cuuuaugcuguguuagaaaag

SEQ ID NO: 15636 - RNA, 22 nt, Homo sapiens
cuuugcacaucucugcuuuccc

SEQ ID NO: 15637 - RNA, 22 nt, Homo sapiens
cuuuggagaaaaguucuugggc

SEQ ID NO: 15638 - RNA, 20 nt, Homo sapiens
cuuuggcaaugagaacaggg

SEQ ID NO: 15639 - RNA, 22 nt, Homo sapiens
cuuuggcaaugucauuuucaau

SEQ ID NO: 15640 - RNA, 19 nt, Homo sapiens
cuuugguugagcguguugg

SEQ ID NO: 15641 - RNA, 20 nt, Homo sapiens
cuuuuagcagcagcaagaga

SEQ ID NO: 15642 - RNA, 21 nt, Homo sapiens
cuuuuuacucguucauaugca

SEQ ID NO: 15643 - RNA, 22 nt, Homo sapiens
gacauguuuucaagauuuauaa

SEQ ID NO: 15644 - RNA, 22 nt, Homo sapiens
gagauuaauacacaucaaaugc

SEQ ID NO: 15645 - RNA, 22 nt, Homo sapiens
gagguggugguggaggcauagc

SEQ ID NO: 15646 - RNA, 22 nt, Homo sapiens
gaguagugcuguaauaaacaua

SEQ ID NO: 15647 - RNA, 22 nt, Homo sapiens
gaucagagugaaccuuguuaug

SEQ ID NO: 15648 - RNA, 22 nt, Homo sapiens
gaugguuuuucuccgauuuaua

SEQ ID NO: 15649 - RNA, 22 nt, Homo sapiens
gcaagaaugagaaggauuaauu

SEQ ID NO: 15650 - RNA, 22 nt, Homo sapiens
gcaccauugacaagaaauaggu

SEQ ID NO: 15651 - RNA, 22 nt, Homo sapiens
gcacugagagaagccccaagua

SEQ ID NO: 15652 - RNA, 22 nt, Homo sapiens
uugccuuuguuggaaacaagug

SEQ ID NO: 15653 - RNA, 22 nt, Homo sapiens
uugcucaggcuggaguacaaug

SEQ ID NO: 15654 - RNA, 22 nt, Homo sapiens
uuggaaacauuuaugguaacag

SEQ ID NO: 15655 - RNA, 22 nt, Homo sapiens
uuggaaaccucugcagguguuu

SEQ ID NO: 15656 - RNA, 22 nt, Homo sapiens
uuggcauuguggauggaaucau

SEQ ID NO: 15657 - RNA, 22 nt, Homo sapiens
uuggcauuuuggacacccagga

SEQ ID NO: 15658 - RNA, 17 nt, Homo sapiens
uugggcaagguagguga

SEQ ID NO: 15659 - RNA, 22 nt, Homo sapiens
uugucacugcacuccagucugg

SEQ ID NO: 15660 - RNA, 22 nt, Homo sapiens
uugucaugguuaauuuuaugua

SEQ ID NO: 15661 - RNA, 22 nt, Homo sapiens
uugugguuuuaucuaccuuugg

SEQ ID NO: 15662 - RNA, 22 nt, Homo sapiens
uugugguuuuuaaaacuaggug

SEQ ID NO: 15663 - RNA, 22 nt, Homo sapiens
uuguucccuucuggcuuuuaug

SEQ ID NO: 15664 - RNA, 22 nt, Homo sapiens
uuuaaagcuaaaauauguuuau

SEQ ID NO: 15665 - RNA, 22 nt, Homo sapiens
uuuagcaaagcaauuuacacca

SEQ ID NO: 15666 - RNA, 22 nt, Homo sapiens
uuuagcaaugcuguggggaagu

SEQ ID NO: 15667 - RNA, 22 nt, Homo sapiens
uuucauagccuucuaaugaguu

SEQ ID NO: 15668 - RNA, 20 nt, Homo sapiens
uuugaauguaaagcauguca

SEQ ID NO: 15669 - RNA, 22 nt, Homo sapiens
uuugagaaugcuaccagagaag

SEQ ID NO: 15670 - RNA, 20 nt, Homo sapiens
uuuuagcuuuuauugaaagc

SEQ ID NO: 15671 - RNA, 22 nt, Homo sapiens
uuuugcucuugguaaugaaaga

SEQ ID NO: 15672 - RNA, 22 nt, Homo sapiens
uuuuuauggccaauccucagaa

SEQ ID NO: 15673 - RNA, 22 nt, Homo sapiens
cuugaauguaaauaauguacag

SEQ ID NO: 15674 - RNA, 22 nt, Homo sapiens
cuugagacauuguuuuccaagu

SEQ ID NO: 15675 - RNA, 22 nt, Homo sapiens
cuugcagagcccauggauguca

SEQ ID NO: 15676 - RNA, 22 nt, Homo sapiens
cuugcagagucauucuaauuuc

SEQ ID NO: 15677 - RNA, 22 nt, Homo sapiens
cuuuuggucuaucagagaagca

SEQ ID NO: 15678 - RNA, 22 nt, Homo sapiens
gaaaauccauccccagggagua

SEQ ID NO: 15679 - RNA, 22 nt, Homo sapiens
gaauggaacugacuauagcuga

SEQ ID NO: 15680 - RNA, 22 nt, Homo sapiens
gacaguuucucaggcuuccuua

SEQ ID NO: 15681 - RNA, 22 nt, Homo sapiens
gacauguuuucauguauuugga

SEQ ID NO: 15682 - RNA, 22 nt, Homo sapiens
gagaugaaguuaaggaucuuua

SEQ ID NO: 15683 - RNA, 22 nt, Homo sapiens
gagcaucauucaacaaaagucu

SEQ ID NO: 15684 - RNA, 22 nt, Homo sapiens
gaggcacucuguacaaaucugc

SEQ ID NO: 15685 - RNA, 22 nt, Homo sapiens
gaguagaacugguuaucuaaua

SEQ ID NO: 15686 - RNA, 22 nt, Homo sapiens
gaguauauuugcacuguuaugu

SEQ ID NO: 15687 - RNA, 22 nt, Homo sapiens
gauauguguaucuauguacaug

SEQ ID NO: 15688 - RNA, 22 nt, Homo sapiens
gauauguguuuuagucaggguu

SEQ ID NO: 15689 - RNA, 22 nt, Homo sapiens
gauuagcacuucaguuacagua

SEQ ID NO: 15690 - RNA, 22 nt, Homo sapiens
gcaccccuuaccgggcuggguu

SEQ ID NO: 15691 - RNA, 22 nt, Homo sapiens
gcagcagugcccuggauggaaa

SEQ ID NO: 15692 - RNA, 22 nt, Homo sapiens
gcauugcacuuggcauagacug

SEQ ID NO: 15693 - RNA, 22 nt, Homo sapiens
gcuuuguugauggugagucugu

SEQ ID NO: 15694 - RNA, 22 nt, Homo sapiens
ggaagccugcacucgggcaggg

SEQ ID NO: 15695 - RNA, 22 nt, Homo sapiens
ggacaaaguauuuucaaaugua

SEQ ID NO: 15696 - RNA, 22 nt, Homo sapiens
ggagugucugugcuggucaaag

SEQ ID NO: 15697 - RNA, 22 nt, Homo sapiens
ggcaaaaucgcaauuacuuuug

SEQ ID NO: 15698 - RNA, 22 nt, Homo sapiens
ggcaagugucagcagcaacacc

SEQ ID NO: 15699 - RNA, 22 nt, Homo sapiens
ggcagcacaauuuucugaugga

SEQ ID NO: 15700 - RNA, 22 nt, Homo sapiens
ggcucaguugcaaaucaguuca

SEQ ID NO: 15701 - RNA, 22 nt, Homo sapiens
ggcuuuggucacacaggggcaa

SEQ ID NO: 15702 - RNA, 22 nt, Homo sapiens
gggagcacaagaaauguuucau

SEQ ID NO: 15703 - RNA, 22 nt, Homo sapiens
gggagguaggaguuauuauuuu

SEQ ID NO: 15704 - RNA, 22 nt, Homo sapiens
gggaggucauuguaaggucuua

SEQ ID NO: 15705 - RNA, 22 nt, Homo sapiens
gggguaggcuacacugaguucc

SEQ ID NO: 15706 - RNA, 19 nt, Homo sapiens
ggugcuugaauauuccucc

SEQ ID NO: 15707 - RNA, 22 nt, Homo sapiens
guaacagucucaacaguggucu

SEQ ID NO: 15708 - RNA, 22 nt, Homo sapiens
guacaguucucuuuguugucag

SEQ ID NO: 15709 - RNA, 22 nt, Homo sapiens
guacaguuuagugcuuugagaa

SEQ ID NO: 15710 - RNA, 22 nt, Homo sapiens
guacauguaugcaugcaugcau

SEQ ID NO: 15711 - RNA, 22 nt, Homo sapiens
guagcagcuacuaaguugcugu

SEQ ID NO: 15712 - RNA, 22 nt, Homo sapiens
gucaauguaucuagcuguauua

SEQ ID NO: 15713 - RNA, 22 nt, Homo sapiens
guccagagaagucauuacuuca

SEQ ID NO: 15714 - RNA, 22 nt, Homo sapiens
gucuuccagccuccaucuuucu

SEQ ID NO: 15715 - RNA, 22 nt, Homo sapiens
gugaaauguguagaggaucugg

SEQ ID NO: 15716 - RNA, 22 nt, Homo sapiens
gugaggcacugcugcuuuccag

SEQ ID NO: 15717 - RNA, 22 nt, Homo sapiens
gugagguaauuagcucccuuag

SEQ ID NO: 15718 - RNA, 22 nt, Homo sapiens
gugcaauguuaauuacuugacu

SEQ ID NO: 15719 - RNA, 22 nt, Homo sapiens
gugcaauucacuguuaugucug

SEQ ID NO: 15720 - RNA, 23 nt, Homo sapiens
gugcaguggcgagauuucggcuc

SEQ ID NO: 15721 - RNA, 22 nt, Homo sapiens
gugcaguuugaaaguagaaaca

SEQ ID NO: 15722 - RNA, 22 nt, Homo sapiens
gugcgguauuagcaagccaaca

SEQ ID NO: 15723 - RNA, 22 nt, Homo sapiens
guggacggagguugcagugagc

SEQ ID NO: 15724 - RNA, 22 nt, Homo sapiens
guggcuuguaggggucaaggga

SEQ ID NO: 15725 - RNA, 22 nt, Homo sapiens
gugguaggaaagugcaaaugua

SEQ ID NO: 15726 - RNA, 22 nt, Homo sapiens
guuaugcagcaauugauaaucu

SEQ ID NO: 15727 - RNA, 22 nt, Homo sapiens
guucaguuugcugaugcguuga

SEQ ID NO: 15728 - RNA, 22 nt, Homo sapiens
uaaagccagugauuaugucucu

SEQ ID NO: 15729 - RNA, 22 nt, Homo sapiens
uaacccuuaguaucuguggguu

SEQ ID NO: 15730 - RNA, 22 nt, Homo sapiens
uaagugcaacauaaguguuaaa

SEQ ID NO: 15731 - RNA, 22 nt, Homo sapiens
uaagugcuugacuuugauguuu

SEQ ID NO: 15732 - RNA, 22 nt, Homo sapiens
uaauauguauacagacagauac

SEQ ID NO: 15733 - RNA, 22 nt, Homo sapiens
uaauccuggcacuuugggaggc

SEQ ID NO: 15734 - RNA, 22 nt, Homo sapiens
uaaugcaucagugguaguucuu

SEQ ID NO: 15735 - RNA, 22 nt, Homo sapiens
uaaugcaucaugguuggcaaac

SEQ ID NO: 15736 - RNA, 22 nt, Homo sapiens
uacagaauugcagguguggcag

SEQ ID NO: 15737 - RNA, 22 nt, Homo sapiens
uacuacuuucugacaucuuuaa

SEQ ID NO: 15738 - RNA, 22 nt, Homo sapiens
uacucugcagccauaaaacaga

SEQ ID NO: 15739 - RNA, 22 nt, Homo sapiens
uacuuuguagagugugagaauu

SEQ ID NO: 15740 - RNA, 22 nt, Homo sapiens
uacuuuguagauuguuuccuuu

SEQ ID NO: 15741 - RNA, 22 nt, Homo sapiens
uagaaugucagcuucuugaggg

SEQ ID NO: 15742 - RNA, 21 nt, Homo sapiens
uagauacuguauuaaaccuag

SEQ ID NO: 15743 - RNA, 22 nt, Homo sapiens
uagcacuauguuaucacauacu

SEQ ID NO: 15744 - RNA, 22 nt, Homo sapiens
uagcagcaaagcaggaucugcu

SEQ ID NO: 15745 - RNA, 22 nt, Homo sapiens
uaucacuuugauaguuuaaaug

SEQ ID NO: 15746 - RNA, 22 nt, Homo sapiens
uaucucacauauucaguagguu

SEQ ID NO: 15747 - RNA, 18 nt, Homo sapiens
uaucucauuucuuagguc

SEQ ID NO: 15748 - RNA, 22 nt, Homo sapiens
uccuucaugcaucaauguaucc

SEQ ID NO: 15749 - RNA, 22 nt, Homo sapiens
uccuugagaggacagagccaua

SEQ ID NO: 15750 - RNA, 21 nt, Homo sapiens
uccuuggugaugcccugcagu

SEQ ID NO: 15751 - RNA, 22 nt, Homo sapiens
uccuuuaguuaauaaagacaag

SEQ ID NO: 15752 - RNA, 22 nt, Homo sapiens
ucucaauuugauuacauucaua

SEQ ID NO: 15753 - RNA, 22 nt, Homo sapiens
ucucauggagucaggagcagaa

SEQ ID NO: 15754 - RNA, 22 nt, Homo sapiens
ucucugauuaaacaagauagug

SEQ ID NO: 15755 - RNA, 22 nt, Homo sapiens
ucugucuuugccuaaguuuguc

SEQ ID NO: 15756 - RNA, 22 nt, Homo sapiens
ucuucaugcuugaaauaauagc

SEQ ID NO: 15757 - RNA, 22 nt, Homo sapiens
ucuuugaguggagcgaggcaga

SEQ ID NO: 15758 - RNA, 22 nt, Homo sapiens
ucuuuggauggaaauuggaguc

SEQ ID NO: 15759 - RNA, 22 nt, Homo sapiens
ucuuuguugcauaggcuuguuc

SEQ ID NO: 15760 - RNA, 22 nt, Homo sapiens
ugaaaugcagaacuuuaggucu

SEQ ID NO: 15761 - RNA, 22 nt, Homo sapiens
ugaaaugccuuuaaugaauuua

SEQ ID NO: 15762 - RNA, 22 nt, Homo sapiens
ugaaauguaaguugucuagucu

SEQ ID NO: 15763 - RNA, 22 nt, Homo sapiens
ugaagcuaacuugauugugaug

SEQ ID NO: 15764 - RNA, 22 nt, Homo sapiens
ugaaucaugcugcuauaaagac

SEQ ID NO: 15765 - RNA, 22 nt, Homo sapiens
ugacaugaugagcaauaauggc

SEQ ID NO: 15766 - RNA, 22 nt, Homo sapiens
ugagaauauuuuccaugucuca

SEQ ID NO: 15767 - RNA, 22 nt, Homo sapiens
ugagaaugacugggcaugcugc

SEQ ID NO: 15768 - RNA, 22 nt, Homo sapiens
ugagcagaaagcugcaaggucg

SEQ ID NO: 15769 - RNA, 22 nt, Homo sapiens
ugaggcacucccuagcggggug

SEQ ID NO: 15770 - RNA, 22 nt, Homo sapiens
ugagggaugccugguuuguuuu

SEQ ID NO: 15771 - RNA, 22 nt, Homo sapiens
ugaguguccaaguaaggugaaa

SEQ ID NO: 15772 - RNA, 18 nt, Homo sapiens
ugauaucaaugauagcca

SEQ ID NO: 15773 - RNA, 22 nt, Homo sapiens
ugauaucugaucauccuugaua

SEQ ID NO: 15774 - RNA, 22 nt, Homo sapiens
ugaugacccugcaguucucaag

SEQ ID NO: 15775 - RNA, 22 nt, Homo sapiens
ugauuuguuucaggaguuuucu

SEQ ID NO: 15776 - RNA, 22 nt, Homo sapiens
ugcaagcacacccagggauugu

SEQ ID NO: 15777 - RNA, 22 nt, Homo sapiens
ugcagagaaacauuuuguauuu

SEQ ID NO: 15778 - RNA, 17 nt, Homo sapiens
ugcagcacacugauggg

SEQ ID NO: 15779 - RNA, 22 nt, Homo sapiens
ugcagcacuguucacaauagcc

SEQ ID NO: 15780 - RNA, 22 nt, Homo sapiens
ugcaguaggcccagcgggaggc

SEQ ID NO: 15781 - RNA, 22 nt, Homo sapiens
ugccugcugucuaauauauucu

SEQ ID NO: 15782 - RNA, 20 nt, Homo sapiens
ugcugcacuuaagcaugggc

SEQ ID NO: 15783 - RNA, 19 nt, Homo sapiens
ugcugcauugugaccuugc

SEQ ID NO: 15784 - RNA, 22 nt, Homo sapiens
uggagucuugcucuguugccca

SEQ ID NO: 15785 - RNA, 22 nt, Homo sapiens
uggauguacagucaguauuugu

SEQ ID NO: 15786 - RNA, 22 nt, Homo sapiens
uggcaauaaggacuccuuaggu

SEQ ID NO: 15787 - RNA, 22 nt, Homo sapiens
uggcaugucguuuuucauagga

SEQ ID NO: 15788 - RNA, 22 nt, Homo sapiens
uggcauuuucucuguucuuaga

SEQ ID NO: 15789 - RNA, 23 nt, Homo sapiens
uggccagaaacuucuuuucaucc

SEQ ID NO: 15790 - RNA, 22 nt, Homo sapiens
ugggcaagagagcaugacccug

SEQ ID NO: 15791 - RNA, 22 nt, Homo sapiens
ugggugugaccgcucaaggggg

SEQ ID NO: 15792 - RNA, 19 nt, Homo sapiens
uggucaguucugggagcug

SEQ ID NO: 15793 - RNA, 22 nt, Homo sapiens
uggugcccuguccuucuguggc

SEQ ID NO: 15794 - RNA, 22 nt, Homo sapiens
uguauacugucuaauauguugu

SEQ ID NO: 15795 - RNA, 22 nt, Homo sapiens
uguauagaucugauucaucucc

SEQ ID NO: 15796 - RNA, 22 nt, Homo sapiens
ugucaaagagacaucugcacuc

SEQ ID NO: 15797 - RNA, 22 nt, Homo sapiens
ugucauguugguguacugcacc

SEQ ID NO: 15798 - RNA, 22 nt, Homo sapiens
ugucauuggacuucuuucaugg

SEQ ID NO: 15799 - RNA, 22 nt, Homo sapiens
ugugaugcagggccugggccuc

SEQ ID NO: 15800 - RNA, 22 nt, Homo sapiens
ugugcuugaauuuaguagcuua

SEQ ID NO: 15801 - RNA, 22 nt, Homo sapiens
uguggaaauaaaagaaagguua

SEQ ID NO: 15802 - RNA, 22 nt, Homo sapiens
uguggaaauggugcuacgaaca

SEQ ID NO: 15803 - RNA, 22 nt, Homo sapiens
uguguaaauauauacacacgug

SEQ ID NO: 15804 - RNA, 22 nt, Homo sapiens
uuaaaaguauaggccuggcaua

SEQ ID NO: 15805 - RNA, 22 nt, Homo sapiens
uuaagcaaagguaacaugagaa

SEQ ID NO: 15806 - RNA, 22 nt, Homo sapiens
uuaagguaugugggcauuuugu

SEQ ID NO: 15807 - RNA, 22 nt, Homo sapiens
uuaauuguccauuauucuguuc

SEQ ID NO: 15808 - RNA, 19 nt, Homo sapiens
uuacagugugcccuuuuag

SEQ ID NO: 15809 - RNA, 21 nt, Homo sapiens
uuacaguugguugugaggugg

SEQ ID NO: 15810 - RNA, 22 nt, Homo sapiens
uuacaguugugagccaccaugc

SEQ ID NO: 15811 - RNA, 22 nt, Homo sapiens
uuagagcacugaucugcucuuu

SEQ ID NO: 15812 - RNA, 22 nt, Homo sapiens
uuagugaaugggugugauuugu

SEQ ID NO: 15813 - RNA, 22 nt, Homo sapiens
uuaguuuaucagugguuucuga

SEQ ID NO: 15814 - RNA, 22 nt, Homo sapiens
uuauauguuagacauggugggu

SEQ ID NO: 15815 - RNA, 22 nt, Homo sapiens
uuaugucuuugagcaaugcugu

SEQ ID NO: 15816 - RNA, 23 nt, Homo sapiens
uucaacagguagacccucccugc

SEQ ID NO: 15817 - RNA, 22 nt, Homo sapiens
uucaauaugucauuggcaggca

SEQ ID NO: 15818 - RNA, 22 nt, Homo sapiens
uucacuggagcccaggaguugg

SEQ ID NO: 15819 - RNA, 22 nt, Homo sapiens
uucacugggugugguggcucac

SEQ ID NO: 15820 - RNA, 22 nt, Homo sapiens
uucaguggagaggcugaguggu

SEQ ID NO: 15821 - RNA, 18 nt, Homo sapiens
uucaguuuguaucugggg

SEQ ID NO: 15822 - RNA, 22 nt, Homo sapiens
uucauacaguggcugcacucca

SEQ ID NO: 15823 - RNA, 22 nt, Homo sapiens
uucauaguaacaguaacuaugg

SEQ ID NO: 15824 - RNA, 22 nt, Homo sapiens
uucauaguuuauacugauauuu

SEQ ID NO: 15825 - RNA, 22 nt, Homo sapiens
uucauguaauauauuucaggcc

SEQ ID NO: 15826 - RNA, 23 nt, Homo sapiens
uuccaccauugacuaguuacaua

SEQ ID NO: 15827 - RNA, 22 nt, Homo sapiens
uuccuuguuuauuuacaggagg

SEQ ID NO: 15828 - RNA, 22 nt, Homo sapiens
uucuauugguaauauuuucugu

SEQ ID NO: 15829 - RNA, 22 nt, Homo sapiens
uugaaagaugaacuggauugga

SEQ ID NO: 15830 - RNA, 22 nt, Homo sapiens
uugacaguggcuuaaauugguu

SEQ ID NO: 15831 - RNA, 20 nt, Homo sapiens
uugacaguggguuguuaaag

SEQ ID NO: 15832 - RNA, 22 nt, Homo sapiens
uugagccaaggauugucuuucc

SEQ ID NO: 15833 - RNA, 22 nt, Homo sapiens
uugauaguuuaauuaaugcuag

SEQ ID NO: 15834 - RNA, 20 nt, Homo sapiens
uugcagagcccaacccugga

SEQ ID NO: 15835 - RNA, 22 nt, Homo sapiens
uugcagagccccugcaaggguc

SEQ ID NO: 15836 - RNA, 22 nt, Homo sapiens
uugcagugugacgacuauauuu

SEQ ID NO: 15837 - RNA, 22 nt, Homo sapiens
uugcauuagugugguacauuug

SEQ ID NO: 15838 - RNA, 22 nt, Homo sapiens
agcugguaugaaaaucucccca

SEQ ID NO: 15839 - RNA, 22 nt, Homo sapiens
aggacacugauguaugcugugg

SEQ ID NO: 15840 - RNA, 22 nt, Homo sapiens
aggcauguggcucuguucugac

SEQ ID NO: 15841 - RNA, 22 nt, Homo sapiens
agggaagugugcuaugcauuua

SEQ ID NO: 15842 - RNA, 22 nt, Homo sapiens
agucacagguucuugggauuag

SEQ ID NO: 15843 - RNA, 22 nt, Homo sapiens
agugggccccuagaggugaggu

SEQ ID NO: 15844 - RNA, 22 nt, Homo sapiens
auaaaagcaggucuaggucagg

SEQ ID NO: 15845 - RNA, 22 nt, Homo sapiens
auaaaugcaaugguauuuuuga

SEQ ID NO: 15846 - RNA, 22 nt, Homo sapiens
auacagguauacaaugcauaau

SEQ ID NO: 15847 - RNA, 22 nt, Homo sapiens
auagaucauugucauuuuagau

SEQ ID NO: 15848 - RNA, 22 nt, Homo sapiens
auauaccuaggcuacaugguuu

SEQ ID NO: 15849 - RNA, 22 nt, Homo sapiens
auauaugcacacgugugcauau

SEQ ID NO: 15850 - RNA, 22 nt, Homo sapiens
uuaccuuuuuaagacagguuag

SEQ ID NO: 15851 - RNA, 22 nt, Homo sapiens
uuagcacaguucauucauguua

SEQ ID NO: 15852 - RNA, 22 nt, Homo sapiens
uuagguauuaggaaauaugcuu

SEQ ID NO: 15853 - RNA, 22 nt, Homo sapiens
uuauauguuacucccucuagca

SEQ ID NO: 15854 - RNA, 22 nt, Homo sapiens
uuauggauuuauauucuguagu

SEQ ID NO: 15855 - RNA, 22 nt, Homo sapiens
uuauugcacuccagccugggua

SEQ ID NO: 15856 - RNA, 16 nt, Homo sapiens
uuauugcauucuucuc

SEQ ID NO: 15857 - RNA, 22 nt, Homo sapiens
uucacaaugccuuguugauggu

SEQ ID NO: 15858 - RNA, 20 nt, Homo sapiens
uucacugggcucucuguugg

SEQ ID NO: 15859 - RNA, 21 nt, Homo sapiens
uucacuggucuauuucccuuu

SEQ ID NO: 15860 - RNA, 22 nt, Homo sapiens
uucaguggacuuaguagugcuu

SEQ ID NO: 15861 - RNA, 22 nt, Homo sapiens
uucaucuggcaauucagagauu

SEQ ID NO: 15862 - RNA, 22 nt, Homo sapiens
uuccaagugggaaacaaaaaug

SEQ ID NO: 15863 - RNA, 22 nt, Homo sapiens
uuccacaggguugaacuaguuu

SEQ ID NO: 15864 - RNA, 22 nt, Homo sapiens
uucccugaaguguuacucuaga

SEQ ID NO: 15865 - RNA, 22 nt, Homo sapiens
uucccugaguaucuuaccaugg

SEQ ID NO: 15866 - RNA, 22 nt, Homo sapiens
uuccuugaaacagucaagagaa

SEQ ID NO: 15867 - RNA, 22 nt, Homo sapiens
uucuaugguuaccaggcuaguc

SEQ ID NO: 15868 - RNA, 22 nt, Homo sapiens
uucuuuggaaacaguacuaauu

SEQ ID NO: 15869 - RNA, 22 nt, Homo sapiens
uugaaauguuuagaaguuugga

SEQ ID NO: 15870 - RNA, 22 nt, Homo sapiens
uugaagugaagaacaauaucac

SEQ ID NO: 15871 - RNA, 22 nt, Homo sapiens
uugaaugaaauuggugugggga

SEQ ID NO: 15872 - RNA, 22 nt, Homo sapiens
uugaggcaaugaggagaagcug

SEQ ID NO: 15873 - RNA, 22 nt, Homo sapiens
uugaguuugaguauucuaaagc

SEQ ID NO: 15874 - RNA, 22 nt, Homo sapiens
uugauaguuuuaaaauuaaucu

SEQ ID NO: 15875 - RNA, 22 nt, Homo sapiens
uugcacuucauguaggccaaag

SEQ ID NO: 15876 - RNA, 22 nt, Homo sapiens
uugcagagccccacacugggcu

SEQ ID NO: 15877 - RNA, 22 nt, Homo sapiens
uugcagcaaagagggaggggca

SEQ ID NO: 15878 - RNA, 22 nt, Homo sapiens
uugcagcaacauggaugaaacu

SEQ ID NO: 15879 - RNA, 23 nt, Homo sapiens
uugcauugcccuccauaguacuc

SEQ ID NO: 15880 - RNA, 22 nt, Homo sapiens
uugcuccucugccaggaccugu

SEQ ID NO: 15881 - RNA, 22 nt, Homo sapiens
uuggaaacaccuggugagguua

SEQ ID NO: 15882 - RNA, 22 nt, Homo sapiens
uuggaaacgucaccuuuuccuu

SEQ ID NO: 15883 - RNA, 22 nt, Homo sapiens
uuggagagugauauucagaugc

SEQ ID NO: 15884 - RNA, 22 nt, Homo sapiens
uuggagcacuggggcacugaca

SEQ ID NO: 15885 - RNA, 22 nt, Homo sapiens
uugggcauugcuauaaauucuu

SEQ ID NO: 15886 - RNA, 22 nt, Homo sapiens
uuguacuccagccugggugaca

SEQ ID NO: 15887 - RNA, 21 nt, Homo sapiens
uuguagcagcauaaucccaga

SEQ ID NO: 15888 - RNA, 22 nt, Homo sapiens
uuguccuugagauaguuugcag

SEQ ID NO: 15889 - RNA, 22 nt, Homo sapiens
uuguccuugagauaguuugcug

SEQ ID NO: 15890 - RNA, 22 nt, Homo sapiens
uugugaauggugccacaauaaa

SEQ ID NO: 15891 - RNA, 22 nt, Homo sapiens
uugugcuugcuguguucuaugc

SEQ ID NO: 15892 - RNA, 22 nt, Homo sapiens
uuuaaugcaucccaaaauguag

SEQ ID NO: 15893 - RNA, 22 nt, Homo sapiens
uuuaaugcgucucugaguuuug

SEQ ID NO: 15894 - RNA, 22 nt, Homo sapiens
uuuagcaauggagggugacuuu

SEQ ID NO: 15895 - RNA, 22 nt, Homo sapiens
uuuauccagccucuagcaaggu

SEQ ID NO: 15896 - RNA, 19 nt, Homo sapiens
uuuccaguaaucuuaugug

SEQ ID NO: 15897 - RNA, 22 nt, Homo sapiens
uuugacaaugugugcuuguauu

SEQ ID NO: 15898 - RNA, 22 nt, Homo sapiens
uuuguaauccuauuccaaagga

SEQ ID NO: 15899 - RNA, 22 nt, Homo sapiens
acugcacuccagcuugggugac

SEQ ID NO: 15900 - RNA, 22 nt, Homo sapiens
acugcauuugguaaagucaaga

SEQ ID NO: 15901 - RNA, 22 nt, Homo sapiens
agaauguauauucuguaguugu

SEQ ID NO: 15902 - RNA, 22 nt, Homo sapiens
agacagcuggaguaucauagcu

SEQ ID NO: 15903 - RNA, 22 nt, Homo sapiens
agagccacauuaaauaugggaa

SEQ ID NO: 15904 - RNA, 22 nt, Homo sapiens
agaguaguaggaugaauggacu

SEQ ID NO: 15905 - RNA, 22 nt, Homo sapiens
agaugauguuuacugagcauca

SEQ ID NO: 15906 - RNA, 22 nt, Homo sapiens
agaugcuguuaucaacuguagc

SEQ ID NO: 15907 - RNA, 22 nt, Homo sapiens
agcgccacugcacuccagccug

SEQ ID NO: 15908 - RNA, 22 nt, Homo sapiens
agcgguguuaggaaggugaggg

SEQ ID NO: 15909 - RNA, 22 nt, Homo sapiens
aggacacugagcaugggagguu

SEQ ID NO: 15910 - RNA, 22 nt, Homo sapiens
aggcaacaugguaaaacccugu

SEQ ID NO: 15911 - RNA, 22 nt, Homo sapiens
agggagcaaaguggucuuucuc

SEQ ID NO: 15912 - RNA, 22 nt, Homo sapiens
agguauguaugucuguacagcg

SEQ ID NO: 15913 - RNA, 22 nt, Homo sapiens
agguauuuucaacuuagaaugg

SEQ ID NO: 15914 - RNA, 22 nt, Homo sapiens
agucagucuguccugugcugag

SEQ ID NO: 15915 - RNA, 22 nt, Homo sapiens
agugauauguuugccuugaggg

SEQ ID NO: 15916 - RNA, 22 nt, Homo sapiens
auaacaggaaauacagggcuuu

SEQ ID NO: 15917 - RNA, 19 nt, Homo sapiens
auacacguguauacauaca

SEQ ID NO: 15918 - RNA, 22 nt, Homo sapiens
auacagugaauaucuggggcag

SEQ ID NO: 15919 - RNA, 22 nt, Homo sapiens
auacuguuucugaacuuugauu

SEQ ID NO: 15920 - RNA, 22 nt, Homo sapiens
auagaauguauuaguaaauuug

SEQ ID NO: 15921 - RNA, 22 nt, Homo sapiens
auauaugcuaagugcuaauaaa

SEQ ID NO: 15922 - RNA, 22 nt, Homo sapiens
auauauguuuucugggaagaaa

SEQ ID NO: 15923 - RNA, 22 nt, Homo sapiens
auauccuggagcauuuuugcaa

SEQ ID NO: 15924 - RNA, 18 nt, Homo sapiens
auauugcauuggauggau

SEQ ID NO: 15925 - RNA, 19 nt, Homo sapiens
aucaaacugcucuuugagg

SEQ ID NO: 15926 - RNA, 22 nt, Homo sapiens
aucacaauuguacguaggagcc

SEQ ID NO: 15927 - RNA, 22 nt, Homo sapiens
aucacuggccuuuuuaaaugcu

SEQ ID NO: 15928 - RNA, 22 nt, Homo sapiens
aucacugggauggaacugcuga

SEQ ID NO: 15929 - RNA, 22 nt, Homo sapiens
aucagcauucccaaaugaugug

SEQ ID NO: 15930 - RNA, 22 nt, Homo sapiens
auccacauucauggaccagucc

SEQ ID NO: 15931 - RNA, 22 nt, Homo sapiens
aucgcgccauuguacuccagcc

SEQ ID NO: 15932 - RNA, 21 nt, Homo sapiens
aucucacuugaauguaaaagc

SEQ ID NO: 15933 - RNA, 22 nt, Homo sapiens
aucuugcauuugcuaaaaugca

SEQ ID NO: 15934 - RNA, 22 nt, Homo sapiens
augaaacuggagcgccuggagg

SEQ ID NO: 15935 - RNA, 22 nt, Homo sapiens
augaaacuggcuaauuuuugua

SEQ ID NO: 15936 - RNA, 22 nt, Homo sapiens
augaagcuagcugauugcugau

SEQ ID NO: 15937 - RNA, 17 nt, Homo sapiens
augaagucaucauuuuu

SEQ ID NO: 15938 - RNA, 21 nt, Homo sapiens
augacccuggguguccuuucc

SEQ ID NO: 15939 - RNA, 22 nt, Homo sapiens
augagaccagcagaaaaccugu

SEQ ID NO: 15940 - RNA, 22 nt, Homo sapiens
augagauaggaacaaacuuaca

SEQ ID NO: 15941 - RNA, 18 nt, Homo sapiens
augagucauuguggaaau

SEQ ID NO: 15942 - RNA, 22 nt, Homo sapiens
augauauggguugucaguugua

SEQ ID NO: 15943 - RNA, 22 nt, Homo sapiens
augaucacuguggaaauucagc

SEQ ID NO: 15944 - RNA, 22 nt, Homo sapiens
augaucauggaaguuuuccugu

SEQ ID NO: 15945 - RNA, 22 nt, Homo sapiens
auggcaguuucagcuauaguuu

SEQ ID NO: 15946 - RNA, 22 nt, Homo sapiens
auggcccugaguucaauauauu

SEQ ID NO: 15947 - RNA, 20 nt, Homo sapiens
auguaauguaugauauguac

SEQ ID NO: 15948 - RNA, 22 nt, Homo sapiens
auguagugugauuuucacuaga

SEQ ID NO: 15949 - RNA, 22 nt, Homo sapiens
auguaugagaguuccagcugau

SEQ ID NO: 15950 - RNA, 22 nt, Homo sapiens
augucaaggugaagaaagauca

SEQ ID NO: 15951 - RNA, 22 nt, Homo sapiens
augucuagagugauacugaagc

SEQ ID NO: 15952 - RNA, 22 nt, Homo sapiens
auuccacagccgauaccaugac

SEQ ID NO: 15953 - RNA, 22 nt, Homo sapiens
auugcaaugggaaacuaugaaa

SEQ ID NO: 15954 - RNA, 22 nt, Homo sapiens
auugcacaucugcacuacagcc

SEQ ID NO: 15955 - RNA, 22 nt, Homo sapiens
auugcacuggggguuagaauuu

SEQ ID NO: 15956 - RNA, 22 nt, Homo sapiens
auugcaugucauguuuagugua

SEQ ID NO: 15957 - RNA, 22 nt, Homo sapiens
auuggugaccugcggcaguaug

SEQ ID NO: 15958 - RNA, 22 nt, Homo sapiens
auuguaauuuuagagaaagugg

SEQ ID NO: 15959 - RNA, 22 nt, Homo sapiens
auuguacuccagccugggugac

SEQ ID NO: 15960 - RNA, 22 nt, Homo sapiens
auuguaguuugcuauggcaaua

SEQ ID NO: 15961 - RNA, 22 nt, Homo sapiens
auuguucuuacaugcugucauc

SEQ ID NO: 15962 - RNA, 22 nt, Homo sapiens
caacacagugaaacccgucucu

SEQ ID NO: 15963 - RNA, 22 nt, Homo sapiens
cacaggccugucucuuucuaac

SEQ ID NO: 15964 - RNA, 22 nt, Homo sapiens
cuaucugcacaggguggaaauu

SEQ ID NO: 15965 - RNA, 22 nt, Homo sapiens
cucaauuuggaauugucaguaa

SEQ ID NO: 15966 - RNA, 17 nt, Homo sapiens
cucacugagaacagcua

SEQ ID NO: 15967 - RNA, 20 nt, Homo sapiens
cucagauuauucugaagcaa

SEQ ID NO: 15968 - RNA, 22 nt, Homo sapiens
cucaguuuugccuuguuuaagg

SEQ ID NO: 15969 - RNA, 22 nt, Homo sapiens
cucauggauggucuggcagcca

SEQ ID NO: 15970 - RNA, 20 nt, Homo sapiens
cucuaguaauaaaguuuccc

SEQ ID NO: 15971 - RNA, 22 nt, Homo sapiens
cuggcaaaaagagggcaauaau

SEQ ID NO: 15972 - RNA, 22 nt, Homo sapiens
cugggcaaugcggcuggauaga

SEQ ID NO: 15973 - RNA, 22 nt, Homo sapiens
cugucuggaguccuucgugugc

SEQ ID NO: 15974 - RNA, 22 nt, Homo sapiens
cugugcaaguuauaggccaggu

SEQ ID NO: 15975 - RNA, 22 nt, Homo sapiens
cugugguguaacucuuggggcg

SEQ ID NO: 15976 - RNA, 22 nt, Homo sapiens
cugugguuacguucuuugugcu

SEQ ID NO: 15977 - RNA, 22 nt, Homo sapiens
cugugguuuaaggaauuuugac

SEQ ID NO: 15978 - RNA, 22 nt, Homo sapiens
cuucaugggagaaccacaggua

SEQ ID NO: 15979 - RNA, 23 nt, Homo sapiens
cuugagacaaaugcgugugugca

SEQ ID NO: 15980 - RNA, 22 nt, Homo sapiens
cuugcacuugaaauuccaguuu

SEQ ID NO: 15981 - RNA, 19 nt, Homo sapiens
cuugugccugaagcuuggg

SEQ ID NO: 15982 - RNA, 22 nt, Homo sapiens
ucaacagugggcacuguaaaug

SEQ ID NO: 15983 - RNA, 22 nt, Homo sapiens
ucacagaugaggcgagaggcag

SEQ ID NO: 15984 - RNA, 23 nt, Homo sapiens
ucacaguuacuuuugcaucaacc

SEQ ID NO: 15985 - RNA, 21 nt, Homo sapiens
ucacauggccagaguaggaac

SEQ ID NO: 15986 - RNA, 22 nt, Homo sapiens
ucacauggggaagggacuagcu

SEQ ID NO: 15987 - RNA, 22 nt, Homo sapiens
ucaccaccugcugauuguagag

SEQ ID NO: 15988 - RNA, 19 nt, Homo sapiens
ucaccaguacacaauacaa

SEQ ID NO: 15989 - RNA, 22 nt, Homo sapiens
ucaccaguacuccaaauugagg

SEQ ID NO: 15990 - RNA, 22 nt, Homo sapiens
ucacugagaaugauguuucuga

SEQ ID NO: 15991 - RNA, 22 nt, Homo sapiens
ucacugagcuagaucacuugac

SEQ ID NO: 15992 - RNA, 22 nt, Homo sapiens
ucacuggucuaaguggaggggg

SEQ ID NO: 15993 - RNA, 22 nt, Homo sapiens
ucacugugguuggaaggcuuaa

SEQ ID NO: 15994 - RNA, 22 nt, Homo sapiens
ucacuuggugaacacauuaugu

SEQ ID NO: 15995 - RNA, 22 nt, Homo sapiens
ucacuuuggguacuauggaaau

SEQ ID NO: 15996 - RNA, 22 nt, Homo sapiens
ucagaacugauacuagaacuuu

SEQ ID NO: 15997 - RNA, 22 nt, Homo sapiens
ucagucuuuuuuuggcaagcau

SEQ ID NO: 15998 - RNA, 22 nt, Homo sapiens
ucagugaauauauaacagcgau

SEQ ID NO: 15999 - RNA, 22 nt, Homo sapiens
ucauguauuaucauuagugggu

SEQ ID NO: 16000 - RNA, 22 nt, Homo sapiens
uccagguacucagggggcugag

SEQ ID NO: 16001 - RNA, 22 nt, Homo sapiens
uccugagacucacaggcucccc

SEQ ID NO: 16002 - RNA, 22 nt, Homo sapiens
uccuugagucuuugcucagaug

SEQ ID NO: 16003 - RNA, 22 nt, Homo sapiens
ucucuuggcggaaguugcagug

SEQ ID NO: 16004 - RNA, 22 nt, Homo sapiens
ucugucaaaucuuauguuguag

SEQ ID NO: 16005 - RNA, 22 nt, Homo sapiens
ucuuggccaugaauggcaaggc

SEQ ID NO: 16006 - RNA, 22 nt, Homo sapiens
ucuuugaguuauugugcagacu

SEQ ID NO: 16007 - RNA, 21 nt, Homo sapiens
ucuuuggucaccaguuuucau

SEQ ID NO: 16008 - RNA, 22 nt, Homo sapiens
ugaauauagacagggguagaga

SEQ ID NO: 16009 - RNA, 22 nt, Homo sapiens
ugaaugcaucuagaaauuuauu

SEQ ID NO: 16010 - RNA, 22 nt, Homo sapiens
ugacagcaucaggauuggagag

SEQ ID NO: 16011 - RNA, 22 nt, Homo sapiens
ugacaugauguuccuacacugu

SEQ ID NO: 16012 - RNA, 22 nt, Homo sapiens
ugagagaugaacucugauaugu

SEQ ID NO: 16013 - RNA, 22 nt, Homo sapiens
ugagaucacgccacugcacucc

SEQ ID NO: 16014 - RNA, 22 nt, Homo sapiens
ugagauuaaucuuuaaguaaga

SEQ ID NO: 16015 - RNA, 23 nt, Homo sapiens
ugagauuacccagaaagaguaua

SEQ ID NO: 16016 - RNA, 22 nt, Homo sapiens
ugagauuaucguaauguaucuc

SEQ ID NO: 16017 - RNA, 20 nt, Homo sapiens
ugagccccuggacucaagcg

SEQ ID NO: 16018 - RNA, 22 nt, Homo sapiens
ugagcugagaucuuaccacugc

SEQ ID NO: 16019 - RNA, 22 nt, Homo sapiens
ugaggugagggguuaggugcua

SEQ ID NO: 16020 - RNA, 22 nt, Homo sapiens
ugaguaugaguucaggaaaggc

SEQ ID NO: 16021 - RNA, 22 nt, Homo sapiens
ugagucaugcuggagucauggc

SEQ ID NO: 16022 - RNA, 22 nt, Homo sapiens
ugauauguaacuacuccuuaua

SEQ ID NO: 16023 - RNA, 22 nt, Homo sapiens
ugcaaaugucaaggguuagugu

SEQ ID NO: 16024 - RNA, 22 nt, Homo sapiens
ugcaaauguuaggugucauuau

SEQ ID NO: 16025 - RNA, 22 nt, Homo sapiens
ugcaagaugagauuuuggaugg

SEQ ID NO: 16026 - RNA, 22 nt, Homo sapiens
ugcagagucuguccugccugcc

SEQ ID NO: 16027 - RNA, 19 nt, Homo sapiens
ugcagcaauguaaaagaca

SEQ ID NO: 16028 - RNA, 22 nt, Homo sapiens
ugcaguagugugaucuuggcuc

SEQ ID NO: 16029 - RNA, 20 nt, Homo sapiens
ugcaguguccucacuuguca

SEQ ID NO: 16030 - RNA, 22 nt, Homo sapiens
ugcauauucgaguuauuuuggg

SEQ ID NO: 16031 - RNA, 22 nt, Homo sapiens
ugccagaugcaguguucaacaa

SEQ ID NO: 16032 - RNA, 22 nt, Homo sapiens
ugccagaugcuggugugagggg

SEQ ID NO: 16033 - RNA, 23 nt, Homo sapiens
ugcugagaccuagauccuaaaga

SEQ ID NO: 16034 - RNA, 22 nt, Homo sapiens
ugcugcaaacaggcaucugugg

SEQ ID NO: 16035 - RNA, 22 nt, Homo sapiens
ugcugcauuggggauuaaguuu

SEQ ID NO: 16036 - RNA, 22 nt, Homo sapiens
uggaaaguacuugaguuuguau

SEQ ID NO: 16037 - RNA, 22 nt, Homo sapiens
uggaagucuauggcauuugagu

SEQ ID NO: 16038 - RNA, 22 nt, Homo sapiens
uggaaugucagcuacaagaggg

SEQ ID NO: 16039 - RNA, 22 nt, Homo sapiens
uggaccccuucuccuauuaaaa

SEQ ID NO: 16040 - RNA, 22 nt, Homo sapiens
uggagggcuagucauuucuuuu

SEQ ID NO: 16041 - RNA, 22 nt, Homo sapiens
uggcauguguuugaaugaguau

SEQ ID NO: 16042 - RNA, 20 nt, Homo sapiens
agguaguuauacaaaugugu

SEQ ID NO: 16043 - RNA, 22 nt, Homo sapiens
aguccaguguuaugaucaguag

SEQ ID NO: 16044 - RNA, 23 nt, Homo sapiens
agucuguguuuacaggcucucug

SEQ ID NO: 16045 - RNA, 22 nt, Homo sapiens
agugcaauggugccaucauagc

SEQ ID NO: 16046 - RNA, 22 nt, Homo sapiens
agugcaguggcacaaucuuggc

SEQ ID NO: 16047 - RNA, 22 nt, Homo sapiens
agugcaguugucacgugccuuc

SEQ ID NO: 16048 - RNA, 22 nt, Homo sapiens
aguggcacuauucucagaguca

SEQ ID NO: 16049 - RNA, 22 nt, Homo sapiens
aguggcuuuuuaguggcagaug

SEQ ID NO: 16050 - RNA, 20 nt, Homo sapiens
auaaauguauagguguacau

SEQ ID NO: 16051 - RNA, 22 nt, Homo sapiens
auacacguguauauguguaucu

SEQ ID NO: 16052 - RNA, 22 nt, Homo sapiens
auacuaugagauaauaaagacu

SEQ ID NO: 16053 - RNA, 22 nt, Homo sapiens
auauagcaaugaaagagaugaa

SEQ ID NO: 16054 - RNA, 22 nt, Homo sapiens
auauuacuggcuauaucgcaag

SEQ ID NO: 16055 - RNA, 22 nt, Homo sapiens
aucacugggagcagccauuaau

SEQ ID NO: 16056 - RNA, 22 nt, Homo sapiens
aucagaaucucuagaggacugu

SEQ ID NO: 16057 - RNA, 22 nt, Homo sapiens
aucagugcauguuuguugagcu

SEQ ID NO: 16058 - RNA, 22 nt, Homo sapiens
aucauguuuauguguaggauau

SEQ ID NO: 16059 - RNA, 23 nt, Homo sapiens
auccacauucuaguccuuuaugc

SEQ ID NO: 16060 - RNA, 22 nt, Homo sapiens
aucuuugauuguagguacaaug

SEQ ID NO: 16061 - RNA, 22 nt, Homo sapiens
augagaauguaaguuaaugaaa

SEQ ID NO: 16062 - RNA, 22 nt, Homo sapiens
augagauuguuugugugaaaua

SEQ ID NO: 16063 - RNA, 22 nt, Homo sapiens
augauucugaucuagagcuugg

SEQ ID NO: 16064 - RNA, 22 nt, Homo sapiens
augcaaaucuuaaguaugugug

SEQ ID NO: 16065 - RNA, 22 nt, Homo sapiens
auggcccaguuugcuaucccua

SEQ ID NO: 16066 - RNA, 22 nt, Homo sapiens
augguauuuugugauaccuugu

SEQ ID NO: 16067 - RNA, 22 nt, Homo sapiens
augucaaggugggugauaguuu

SEQ ID NO: 16068 - RNA, 22 nt, Homo sapiens
auuauauguguaugugcauacc

SEQ ID NO: 16069 - RNA, 22 nt, Homo sapiens
auucacuuuuauagacaggucu

SEQ ID NO: 16070 - RNA, 22 nt, Homo sapiens
auugagcacugacucugugcca

SEQ ID NO: 16071 - RNA, 22 nt, Homo sapiens
auugcacuccagccuggcaaua

SEQ ID NO: 16072 - RNA, 22 nt, Homo sapiens
auugcagcccacccugggugau

SEQ ID NO: 16073 - RNA, 19 nt, Homo sapiens
auugcaguguaaaacuauu

SEQ ID NO: 16074 - RNA, 22 nt, Homo sapiens
auugcauaaacacauuucuuau

SEQ ID NO: 16075 - RNA, 22 nt, Homo sapiens
auuguacuuaagccugggugaa

SEQ ID NO: 16076 - RNA, 20 nt, Homo sapiens
auuguccuugauuacacaga

SEQ ID NO: 16077 - RNA, 22 nt, Homo sapiens
auuuguccugccuuuuccuccu

SEQ ID NO: 16078 - RNA, 22 nt, Homo sapiens
caaaggcuuccacugcauccuu

SEQ ID NO: 16079 - RNA, 22 nt, Homo sapiens
caaaguaauugcuguuuugcca

SEQ ID NO: 16080 - RNA, 22 nt, Homo sapiens
caaggugcugagacaggagccc

SEQ ID NO: 16081 - RNA, 22 nt, Homo sapiens
cagggcauuggcugguaccugg

SEQ ID NO: 16082 - RNA, 22 nt, Homo sapiens
cagguacuucugggcugagcag

SEQ ID NO: 16083 - RNA, 20 nt, Homo sapiens
cagucaugaagaacugugag

SEQ ID NO: 16084 - RNA, 22 nt, Homo sapiens
cagugauaggugguuguuggca

SEQ ID NO: 16085 - RNA, 22 nt, Homo sapiens
caguggaugaacaagaagugau

SEQ ID NO: 16086 - RNA, 19 nt, Homo sapiens
caucccugagcugaagugg

SEQ ID NO: 16087 - RNA, 22 nt, Homo sapiens
cauuccacauguaggacaauuu

SEQ ID NO: 16088 - RNA, 22 nt, Homo sapiens
cauugcacuccagcucugggcg

SEQ ID NO: 16089 - RNA, 22 nt, Homo sapiens
cauugcacugcauucugggcaa

SEQ ID NO: 16090 - RNA, 22 nt, Homo sapiens
cauugcacuuagacaacuuuug

SEQ ID NO: 16091 - RNA, 22 nt, Homo sapiens
cauugcaugccagccugggcaa

SEQ ID NO: 16092 - RNA, 22 nt, Homo sapiens
ccaccuguacuuaagucacuuu

SEQ ID NO: 16093 - RNA, 22 nt, Homo sapiens
ccagauguuuucauucagcaag

SEQ ID NO: 16094 - RNA, 22 nt, Homo sapiens
ccagugucugacagacacggcg

SEQ ID NO: 16095 - RNA, 17 nt, Homo sapiens
ccaguuuucccucagug

SEQ ID NO: 16096 - RNA, 22 nt, Homo sapiens
ccaguuuucucacuguugcagu

SEQ ID NO: 16097 - RNA, 22 nt, Homo sapiens
ccccaguguguaaaggccuugc

SEQ ID NO: 16098 - RNA, 22 nt, Homo sapiens
ccccauguucucucugcagcuc

SEQ ID NO: 16099 - RNA, 23 nt, Homo sapiens
cccucagaagugcagggagagaa

SEQ ID NO: 16100 - RNA, 21 nt, Homo sapiens
cccugguguuuggaguuugag

SEQ ID NO: 16101 - RNA, 22 nt, Homo sapiens
cccuugcacuucagagcugcau

SEQ ID NO: 16102 - RNA, 22 nt, Homo sapiens
cuaaaguauugagugguaaaga

SEQ ID NO: 16103 - RNA, 22 nt, Homo sapiens
cuacaguucuuaauuaaguagu

SEQ ID NO: 16104 - RNA, 22 nt, Homo sapiens
cuacucuggagagugacaauca

SEQ ID NO: 16105 - RNA, 22 nt, Homo sapiens
cuagauuauccaacuuauuagc

SEQ ID NO: 16106 - RNA, 22 nt, Homo sapiens
cuaggaaguauguguuauugcu

SEQ ID NO: 16107 - RNA, 22 nt, Homo sapiens
cucacugggaccacucugaagu

SEQ ID NO: 16108 - RNA, 22 nt, Homo sapiens
cucagugguugauuuauuuauc

SEQ ID NO: 16109 - RNA, 22 nt, Homo sapiens
cucaguguuucagcugcucaga

SEQ ID NO: 16110 - RNA, 22 nt, Homo sapiens
cucccuuugcugaauguuuuuc

SEQ ID NO: 16111 - RNA, 22 nt, Homo sapiens
cugaagugcuugccacauaaaa

SEQ ID NO: 16112 - RNA, 22 nt, Homo sapiens
cugagagaugagaccucucacu

SEQ ID NO: 16113 - RNA, 22 nt, Homo sapiens
cugcaaauacuugugggauuuu

SEQ ID NO: 16114 - RNA, 22 nt, Homo sapiens
cugcaagaaucguaguauuuga

SEQ ID NO: 16115 - RNA, 22 nt, Homo sapiens
cugcaauggagaaagugagacu

SEQ ID NO: 16116 - RNA, 22 nt, Homo sapiens
cugcagaucuuggggcuugcca

SEQ ID NO: 16117 - RNA, 22 nt, Homo sapiens
cugcauuugaugacguauggug

SEQ ID NO: 16118 - RNA, 22 nt, Homo sapiens
cuggaguuugaggcugcaguga

SEQ ID NO: 16119 - RNA, 22 nt, Homo sapiens
cuggcaaauaguagagccagga

SEQ ID NO: 16120 - RNA, 22 nt, Homo sapiens
aaagagaucuaugggcacuaug

SEQ ID NO: 16121 - RNA, 22 nt, Homo sapiens
aaagggcuugaauacucuuuuu

SEQ ID NO: 16122 - RNA, 22 nt, Homo sapiens
aaaguacucaguucaguuccgu

SEQ ID NO: 16123 - RNA, 22 nt, Homo sapiens
aaaugcacaaagauuuugcacu

SEQ ID NO: 16124 - RNA, 22 nt, Homo sapiens
aacaguaucuaacgagugauga

SEQ ID NO: 16125 - RNA, 22 nt, Homo sapiens
aacagugcauuccuguccauau

SEQ ID NO: 16126 - RNA, 22 nt, Homo sapiens
aagcagauguguugaaaguacu

SEQ ID NO: 16127 - RNA, 22 nt, Homo sapiens
uuaagcaguaguuaaggagagg

SEQ ID NO: 16128 - RNA, 20 nt, Homo sapiens
uuaagugcuuucugcuuaga

SEQ ID NO: 16129 - RNA, 22 nt, Homo sapiens
uuacaguguuuguucuguuacu

SEQ ID NO: 16130 - RNA, 22 nt, Homo sapiens
uuacaguucugguggagaggua

SEQ ID NO: 16131 - RNA, 22 nt, Homo sapiens
uuaccucuguggcucucggacu

SEQ ID NO: 16132 - RNA, 22 nt, Homo sapiens
uuagcacaucuuucuauguaag

SEQ ID NO: 16133 - RNA, 22 nt, Homo sapiens
uuagcaugucuacuaauuugcu

SEQ ID NO: 16134 - RNA, 22 nt, Homo sapiens
uuauauguuucuuagggacaga

SEQ ID NO: 16135 - RNA, 22 nt, Homo sapiens
uuauauguuuguacuuaggccu

SEQ ID NO: 16136 - RNA, 22 nt, Homo sapiens
uuaucauagugcaguuuucuga

SEQ ID NO: 16137 - RNA, 22 nt, Homo sapiens
uuaugucauuuuuggauguuaa

SEQ ID NO: 16138 - RNA, 22 nt, Homo sapiens
uucaaaaccucugcuuaagccc

SEQ ID NO: 16139 - RNA, 22 nt, Homo sapiens
uucaaaucuucguuuugccaua

SEQ ID NO: 16140 - RNA, 22 nt, Homo sapiens
uucacaauuaaaugugguuauu

SEQ ID NO: 16141 - RNA, 22 nt, Homo sapiens
uucagggcauuggaguuucuga

SEQ ID NO: 16142 - RNA, 22 nt, Homo sapiens
uaauacucuucucauuuuacag

SEQ ID NO: 16143 - RNA, 22 nt, Homo sapiens
uaauacuugucauaaaggcauu

SEQ ID NO: 16144 - RNA, 22 nt, Homo sapiens
uacaguggcaugucaggugcuu

SEQ ID NO: 16145 - RNA, 22 nt, Homo sapiens
uacugagagaggaauauugaaa

SEQ ID NO: 16146 - RNA, 22 nt, Homo sapiens
uacuuaguagcuuauccugugg

SEQ ID NO: 16147 - RNA, 22 nt, Homo sapiens
uagaauguaacaguuaaaagca

SEQ ID NO: 16148 - RNA, 22 nt, Homo sapiens
uagaauguaacuuccaugucau

SEQ ID NO: 16149 - RNA, 22 nt, Homo sapiens
uagaauguauaauauuuuacuu

SEQ ID NO: 16150 - RNA, 23 nt, Homo sapiens
uagaauguuuuuccauguuucuu

SEQ ID NO: 16151 - RNA, 22 nt, Homo sapiens
uagacacugcauauuuuuuuaa

SEQ ID NO: 16152 - RNA, 22 nt, Homo sapiens
uagagcuagggacucgcaaugu

SEQ ID NO: 16153 - RNA, 22 nt, Homo sapiens
uagagcuugacacuuuccaugg

SEQ ID NO: 16154 - RNA, 22 nt, Homo sapiens
uagcaagaugaauuugugcaaa

SEQ ID NO: 16155 - RNA, 22 nt, Homo sapiens
uagcacaucccuaaaaugcugu

SEQ ID NO: 16156 - RNA, 22 nt, Homo sapiens
uaggcacuguguuuguaggagu

SEQ ID NO: 16157 - RNA, 22 nt, Homo sapiens
uaugaauuuuauccaggauaua

SEQ ID NO: 16158 - RNA, 22 nt, Homo sapiens
uaugucauggguaaagugcccu

SEQ ID NO: 16159 - RNA, 22 nt, Homo sapiens
uauuacauccauaggcucugcu

SEQ ID NO: 16160 - RNA, 22 nt, Homo sapiens
uauuccacuuacaugagguauc

SEQ ID NO: 16161 - RNA, 22 nt, Homo sapiens
uauuccuuuugcauuuccacau

SEQ ID NO: 16162 - RNA, 22 nt, Homo sapiens
uauugcacuuuuccauaggagu

SEQ ID NO: 16163 - RNA, 22 nt, Homo sapiens
uauugcagugagauccaucugg

SEQ ID NO: 16164 - RNA, 22 nt, Homo sapiens
uauugcauuugagguugguuga

SEQ ID NO: 16165 - RNA, 22 nt, Homo sapiens
ucaaaugcuguauuguaguaau

SEQ ID NO: 16166 - RNA, 22 nt, Homo sapiens
ucaaggacucagagagggauua

SEQ ID NO: 16167 - RNA, 22 nt, Homo sapiens
ucaaugaaugaugguugguaug

SEQ ID NO: 16168 - RNA, 18 nt, Homo sapiens
ucacauggccgagagaga

SEQ ID NO: 16169 - RNA, 22 nt, Homo sapiens
ucacuggacucuagccugggug

SEQ ID NO: 16170 - RNA, 22 nt, Homo sapiens
ucacugggagcauuugagccuu

SEQ ID NO: 16171 - RNA, 18 nt, Homo sapiens
ucacugugugucuugggu

SEQ ID NO: 16172 - RNA, 22 nt, Homo sapiens
ucacuugguggcaaaguuuaug

SEQ ID NO: 16173 - RNA, 22 nt, Homo sapiens
ucagaacugaacaaaccagucu

SEQ ID NO: 16174 - RNA, 22 nt, Homo sapiens
ucagaucauuaagguagguuua

SEQ ID NO: 16175 - RNA, 22 nt, Homo sapiens
ucagauguuuuguuuaucugcu

SEQ ID NO: 16176 - RNA, 22 nt, Homo sapiens
ucagucauucacucacucggac

SEQ ID NO: 16177 - RNA, 22 nt, Homo sapiens
ucaguuuagguguaacggccac

SEQ ID NO: 16178 - RNA, 22 nt, Homo sapiens
ucaugagacacacuggaaagga

SEQ ID NO: 16179 - RNA, 22 nt, Homo sapiens
ucauugcauguuaauuaaacag

SEQ ID NO: 16180 - RNA, 22 nt, Homo sapiens
uccacagugguugaacuaguaa

SEQ ID NO: 16181 - RNA, 22 nt, Homo sapiens
uccaugugaaaaggucgugaua

SEQ ID NO: 16182 - RNA, 22 nt, Homo sapiens
uccaugugaaaucuaugaggac

SEQ ID NO: 16183 - RNA, 19 nt, Homo sapiens
uccccaguuuuccguucag

SEQ ID NO: 16184 - RNA, 22 nt, Homo sapiens
uccccugagaacuugcuagaaa

SEQ ID NO: 16185 - RNA, 22 nt, Homo sapiens
ucccugaaagcugagauuggaa

SEQ ID NO: 16186 - RNA, 22 nt, Homo sapiens
ucccugaacacauguugagaag

SEQ ID NO: 16187 - RNA, 22 nt, Homo sapiens
ucccugaaucucagguucugua

SEQ ID NO: 16188 - RNA, 22 nt, Homo sapiens
cacugcauuacucaugagcaug

SEQ ID NO: 16189 - RNA, 23 nt, Homo sapiens
cacugggcagcagguguucccag

SEQ ID NO: 16190 - RNA, 20 nt, Homo sapiens
cagagcaaagcaguccuggc

SEQ ID NO: 16191 - RNA, 23 nt, Homo sapiens
cagcuucauugaacauaacuccu

SEQ ID NO: 16192 - RNA, 20 nt, Homo sapiens
cagugcauugcuucugauuu

SEQ ID NO: 16193 - RNA, 22 nt, Homo sapiens
caucucauugaauugcugagca

SEQ ID NO: 16194 - RNA, 22 nt, Homo sapiens
cauugcacuccagccugcugac

SEQ ID NO: 16195 - RNA, 22 nt, Homo sapiens
ccacccuuccauucuuccucuu

SEQ ID NO: 16196 - RNA, 22 nt, Homo sapiens
ccacugggcuagguguuuugga

SEQ ID NO: 16197 - RNA, 22 nt, Homo sapiens
ccagucuuggugucuguagcac

SEQ ID NO: 16198 - RNA, 22 nt, Homo sapiens
ccaguuuucccagcaccauuaa

SEQ ID NO: 16199 - RNA, 22 nt, Homo sapiens
cuacaguuauguuuuaaaugug

SEQ ID NO: 16200 - RNA, 22 nt, Homo sapiens
cucaguggauuagauaaugcac

SEQ ID NO: 16201 - RNA, 22 nt, Homo sapiens
cucauuaguuguuuuaagauga

SEQ ID NO: 16202 - RNA, 22 nt, Homo sapiens
cucccauugcaaacaacagaag

SEQ ID NO: 16203 - RNA, 19 nt, Homo sapiens
cugaaacacagagagggcu

SEQ ID NO: 16204 - RNA, 22 nt, Homo sapiens
cugagcuaugccuggaaaggca

SEQ ID NO: 16205 - RNA, 21 nt, Homo sapiens
cugcaaaugcugcugccugau

SEQ ID NO: 16206 - RNA, 20 nt, Homo sapiens
cugcaaaugcugcugcugau

SEQ ID NO: 16207 - RNA, 22 nt, Homo sapiens
uacagugggcacuggcgcccug

SEQ ID NO: 16208 - RNA, 22 nt, Homo sapiens
uacauagucuucuuuugguuau

SEQ ID NO: 16209 - RNA, 22 nt, Homo sapiens
uaccuaguaggagggaggugga

SEQ ID NO: 16210 - RNA, 22 nt, Homo sapiens
uagaauguaaauuccaagggca

SEQ ID NO: 16211 - RNA, 22 nt, Homo sapiens
uagagguucuaagauucucaga

SEQ ID NO: 16212 - RNA, 22 nt, Homo sapiens
uauaagacuagcagcugaauug

SEQ ID NO: 16213 - RNA, 22 nt, Homo sapiens
uauagcagugaguauugacuaa

SEQ ID NO: 16214 - RNA, 22 nt, Homo sapiens
uauagcuuaaaguuuagauccu

SEQ ID NO: 16215 - RNA, 23 nt, Homo sapiens
uauaugugucuaggagcuauggu

SEQ ID NO: 16216 - RNA, 22 nt, Homo sapiens
uaucacagauauuaugggccaa

SEQ ID NO: 16217 - RNA, 22 nt, Homo sapiens
uaucugcacauacacuuauagc

SEQ ID NO: 16218 - RNA, 22 nt, Homo sapiens
uaucugcaucccauuuuuauca

SEQ ID NO: 16219 - RNA, 22 nt, Homo sapiens
uaugaucauuauguuauugcag

SEQ ID NO: 16220 - RNA, 22 nt, Homo sapiens
uauggauuucauuagacuugag

SEQ ID NO: 16221 - RNA, 22 nt, Homo sapiens
uaugucuuuugcuugcaaauag

SEQ ID NO: 16222 - RNA, 22 nt, Homo sapiens
uauuccacucuguuggagguaa

SEQ ID NO: 16223 - RNA, 22 nt, Homo sapiens
uauugcacaugaggagacauug

SEQ ID NO: 16224 - RNA, 22 nt, Homo sapiens
uauugcacuccucaugcauuug

SEQ ID NO: 16225 - RNA, 22 nt, Homo sapiens
uauugcauauuauucuaguggc

SEQ ID NO: 16226 - RNA, 22 nt, Homo sapiens
uauugggcuucucagaauagag

SEQ ID NO: 16227 - RNA, 22 nt, Homo sapiens
ucaaacacuccauaucgcgauu

SEQ ID NO: 16228 - RNA, 22 nt, Homo sapiens
ucacaauucucaauuugugaaa

SEQ ID NO: 16229 - RNA, 22 nt, Homo sapiens
ucaccuggagccuucacauucu

SEQ ID NO: 16230 - RNA, 18 nt, Homo sapiens
ucaccuugugagagagag

SEQ ID NO: 16231 - RNA, 20 nt, Homo sapiens
ucacugagugguccacagua

SEQ ID NO: 16232 - RNA, 19 nt, Homo sapiens
ucacuggacagcacacuca

SEQ ID NO: 16233 - RNA, 22 nt, Homo sapiens
ucagauguuugagaaguauacu

SEQ ID NO: 16234 - RNA, 22 nt, Homo sapiens
ucagugaacgaggaggagggug

SEQ ID NO: 16235 - RNA, 22 nt, Homo sapiens
ucauugcacucccagacacccu

SEQ ID NO: 16236 - RNA, 19 nt, Homo sapiens
ucuaaaucucuugauagac

SEQ ID NO: 16237 - RNA, 22 nt, Homo sapiens
ucuaaugcucugagaacagugc

SEQ ID NO: 16238 - RNA, 22 nt, Homo sapiens
ucucagugaauguggaaaaagc

SEQ ID NO: 16239 - RNA, 22 nt, Homo sapiens
ucugagacuguuucuaacaagc

SEQ ID NO: 16240 - RNA, 22 nt, Homo sapiens
ucugagucaucacaaaugaugc

SEQ ID NO: 16241 - RNA, 17 nt, Homo sapiens
ucuucuguuacuguggc

SEQ ID NO: 16242 - RNA, 22 nt, Homo sapiens
ucuugcacaaauuauuuuaacu

SEQ ID NO: 16243 - RNA, 22 nt, Homo sapiens
ucuuuugggccucuugucagac

SEQ ID NO: 16244 - RNA, 22 nt, Homo sapiens
ugaaaaguuguugaaggcuuca

SEQ ID NO: 16245 - RNA, 22 nt, Homo sapiens
ugaaauacuuuggcucuuuguu

SEQ ID NO: 16246 - RNA, 22 nt, Homo sapiens
ugaacucagcauccagggccaa

SEQ ID NO: 16247 - RNA, 22 nt, Homo sapiens
ugaauucuguccaaaauaacug

SEQ ID NO: 16248 - RNA, 22 nt, Homo sapiens
ugacacuugcccuuagaaacau

SEQ ID NO: 16249 - RNA, 22 nt, Homo sapiens
ugacagugaauaagucucuuaa

SEQ ID NO: 16250 - RNA, 22 nt, Homo sapiens
ugacauguugcauuauauuucc

SEQ ID NO: 16251 - RNA, 22 nt, Homo sapiens
ugacuagagacagaaacuaaaa

SEQ ID NO: 16252 - RNA, 17 nt, Homo sapiens
ugagaacaugugguauu

SEQ ID NO: 16253 - RNA, 22 nt, Homo sapiens
ugagacgaagucuugcucuguu

SEQ ID NO: 16254 - RNA, 22 nt, Homo sapiens
ugagaucaugccacugcacuuc

SEQ ID NO: 16255 - RNA, 17 nt, Homo sapiens
ugaggcacuaguaucac

SEQ ID NO: 16256 - RNA, 22 nt, Homo sapiens
ugauaauuuugucagguuuugg

SEQ ID NO: 16257 - RNA, 22 nt, Homo sapiens
ugauaugaaagggaaauaagug

SEQ ID NO: 16258 - RNA, 20 nt, Homo sapiens
ugaugcaaaucuuuaaaagu

SEQ ID NO: 16259 - RNA, 22 nt, Homo sapiens
ugcaaaugcugcuauuucucuu

SEQ ID NO: 16260 - RNA, 22 nt, Homo sapiens
ugcaaauguuaguaacaccacu

SEQ ID NO: 16261 - RNA, 22 nt, Homo sapiens
ugcaaauguuauuuugguuucu

SEQ ID NO: 16262 - RNA, 22 nt, Homo sapiens
ugcaagauaggcaguuugcacu

SEQ ID NO: 16263 - RNA, 20 nt, Homo sapiens
ugcaaguugccuuuggaggc

SEQ ID NO: 16264 - RNA, 23 nt, Homo sapiens
ugcaccacuacacacucuugggu

SEQ ID NO: 16265 - RNA, 22 nt, Homo sapiens
ugcuucauuggccaccaggaag

SEQ ID NO: 16266 - RNA, 22 nt, Homo sapiens
uggccagagggcaauuagcugu

SEQ ID NO: 16267 - RNA, 22 nt, Homo sapiens
uggcucauuucuaaacccagcu

SEQ ID NO: 16268 - RNA, 22 nt, Homo sapiens
uggcuguguccucucccaaauc

SEQ ID NO: 16269 - RNA, 20 nt, Homo sapiens
ugggaacaugugguauaugg

SEQ ID NO: 16270 - RNA, 22 nt, Homo sapiens
ugggaucuuuccuauuagcgag

SEQ ID NO: 16271 - RNA, 22 nt, Homo sapiens
ugguauuuaauauaugagaguu

SEQ ID NO: 16272 - RNA, 22 nt, Homo sapiens
uggugagaaaagaugucuuugu

SEQ ID NO: 16273 - RNA, 18 nt, Homo sapiens
uguaaacuaccucaaccu

SEQ ID NO: 16274 - RNA, 20 nt, Homo sapiens
uguaaucuaaguuuuaagcc

SEQ ID NO: 16275 - RNA, 22 nt, Homo sapiens
ugucaauauguaauaacugaau

SEQ ID NO: 16276 - RNA, 22 nt, Homo sapiens
ugucaguguaugagccccggau

SEQ ID NO: 16277 - RNA, 22 nt, Homo sapiens
ugucaugaacucacauucuggg

SEQ ID NO: 16278 - RNA, 22 nt, Homo sapiens
ugucucaguucccuucucugga

SEQ ID NO: 16279 - RNA, 22 nt, Homo sapiens
ugugaaacacgaaagucuaaaa

SEQ ID NO: 16280 - RNA, 22 nt, Homo sapiens
ugugacagcacgguucaacugc

SEQ ID NO: 16281 - RNA, 22 nt, Homo sapiens
ugugcaaucagcuucauuacau

SEQ ID NO: 16282 - RNA, 22 nt, Homo sapiens
ugugcaaucuuccauuuuuagg

SEQ ID NO: 16283 - RNA, 22 nt, Homo sapiens
uguucaauucccaccuaugagu

SEQ ID NO: 16284 - RNA, 22 nt, Homo sapiens
uguucacaguguuucuuugaga

SEQ ID NO: 16285 - RNA, 22 nt, Homo sapiens
uguucuggagccgguucaaaug

SEQ ID NO: 16286 - RNA, 22 nt, Homo sapiens
uguuuaguuaagacauagaauu

SEQ ID NO: 16287 - RNA, 22 nt, Homo sapiens
uguuuuggaguggacuuugcau

SEQ ID NO: 16288 - RNA, 22 nt, Homo sapiens
uguuuuguuagcacucugggaa

SEQ ID NO: 16289 - RNA, 22 nt, Homo sapiens
uuaacagcacaugcugucccuu

SEQ ID NO: 16290 - RNA, 22 nt, Homo sapiens
ucaccaccugcugaucauagag

SEQ ID NO: 16291 - RNA, 22 nt, Homo sapiens
ucaccaguaauaaagagccugc

SEQ ID NO: 16292 - RNA, 22 nt, Homo sapiens
ucacccacacaggagacaggga

SEQ ID NO: 16293 - RNA, 22 nt, Homo sapiens
ucacugugguuuugaugugcau

SEQ ID NO: 16294 - RNA, 22 nt, Homo sapiens
ucacuuggccgcagccuucucu

SEQ ID NO: 16295 - RNA, 22 nt, Homo sapiens
ucagaucacuggcgcuggcgga

SEQ ID NO: 16296 - RNA, 22 nt, Homo sapiens
ucagaucauauucuucgcugcu

SEQ ID NO: 16297 - RNA, 22 nt, Homo sapiens
ucagauguuucuuuaacgcaug

SEQ ID NO: 16298 - RNA, 22 nt, Homo sapiens
ucagcagugugaaaauggacua

SEQ ID NO: 16299 - RNA, 22 nt, Homo sapiens
ucauauugguuaaaauaguggg

SEQ ID NO: 16300 - RNA, 21 nt, Homo sapiens
ucaucagucaaagacaauggu

SEQ ID NO: 16301 - RNA, 22 nt, Homo sapiens
ucaucaguuuuuuauaugugau

SEQ ID NO: 16302 - RNA, 22 nt, Homo sapiens
ucaucuggcgaaugugaagagu

SEQ ID NO: 16303 - RNA, 22 nt, Homo sapiens
uccaauguaaucaucauugaau

SEQ ID NO: 16304 - RNA, 22 nt, Homo sapiens
uccacagugguugaacuaguuu

SEQ ID NO: 16305 - RNA, 22 nt, Homo sapiens
ucccugaaaaauuggcuuaaca

SEQ ID NO: 16306 - RNA, 22 nt, Homo sapiens
ucccugaaaauuagcauuuuaa

SEQ ID NO: 16307 - RNA, 22 nt, Homo sapiens
ucccugaagcugcagcaacaca

SEQ ID NO: 16308 - RNA, 22 nt, Homo sapiens
uccucugaacuccagacccaua

SEQ ID NO: 16309 - RNA, 22 nt, Homo sapiens
uccuugagccucccagacucag

SEQ ID NO: 16310 - RNA, 21 nt, Homo sapiens
ucuaccuacugcucacaggcu

SEQ ID NO: 16311 - RNA, 22 nt, Homo sapiens
ucucuugguugaacaguuugga

SEQ ID NO: 16312 - RNA, 22 nt, Homo sapiens
ucugacaaugaacaaucuauag

SEQ ID NO: 16313 - RNA, 22 nt, Homo sapiens
ucugacacagugauuaguaaau

SEQ ID NO: 16314 - RNA, 22 nt, Homo sapiens
ucuuaggugggccaucacccca

SEQ ID NO: 16315 - RNA, 22 nt, Homo sapiens
ucuugcaguucccaaauucaca

SEQ ID NO: 16316 - RNA, 22 nt, Homo sapiens
ucuuuagguguuauaguucaag

SEQ ID NO: 16317 - RNA, 22 nt, Homo sapiens
ucuuuagugacaguugugcaag

SEQ ID NO: 16318 - RNA, 22 nt, Homo sapiens
ucuuugauuuuguuacuaagac

SEQ ID NO: 16319 - RNA, 22 nt, Homo sapiens
ucuuuggguguauuucacagcc

SEQ ID NO: 16320 - RNA, 22 nt, Homo sapiens
ugaaaagucuaagauuaagguu

SEQ ID NO: 16321 - RNA, 22 nt, Homo sapiens
ugaaauggaaagaguguagacu

SEQ ID NO: 16322 - RNA, 22 nt, Homo sapiens
ugaaaugguuaugugaggagau

SEQ ID NO: 16323 - RNA, 21 nt, Homo sapiens
ugaaguguaaccgugcagggc

SEQ ID NO: 16324 - RNA, 21 nt, Homo sapiens
ugagauaauauguuucugaug

SEQ ID NO: 16325 - RNA, 22 nt, Homo sapiens
ugagaucaaggugggcccuggg

SEQ ID NO: 16326 - RNA, 23 nt, Homo sapiens
ugagauuauaaucuuuuacuucu

SEQ ID NO: 16327 - RNA, 22 nt, Homo sapiens
ugagauuaucuugaucuugaaa

SEQ ID NO: 16328 - RNA, 19 nt, Homo sapiens
ugagauuguaugaggagau

SEQ ID NO: 16329 - RNA, 22 nt, Homo sapiens
ugaggcacucuagacuuauuca

SEQ ID NO: 16330 - RNA, 22 nt, Homo sapiens
ugaguguccaccccuuucacag

SEQ ID NO: 16331 - RNA, 22 nt, Homo sapiens
ugaguuuaucuaaagaccuggg

SEQ ID NO: 16332 - RNA, 22 nt, Homo sapiens
ugauaagugagauagcaaguga

SEQ ID NO: 16333 - RNA, 22 nt, Homo sapiens
ugauauguguaaacaauguaua

SEQ ID NO: 16334 - RNA, 21 nt, Homo sapiens
ugcaagaaucaggaagcugcc

SEQ ID NO: 16335 - RNA, 22 nt, Homo sapiens
ugcaguacauucagcauccucu

SEQ ID NO: 16336 - RNA, 23 nt, Homo sapiens
ugcaguagugagaucuaggcuca

SEQ ID NO: 16337 - RNA, 22 nt, Homo sapiens
ugcaugaugcugagauuuggga

SEQ ID NO: 16338 - RNA, 22 nt, Homo sapiens
ugccagagacguagggaauauu

SEQ ID NO: 16339 - RNA, 22 nt, Homo sapiens
ugccaucauuaauauuaggcau

SEQ ID NO: 16340 - RNA, 22 nt, Homo sapiens
ugcugcacuuauggcucugagg

SEQ ID NO: 16341 - RNA, 20 nt, Homo sapiens
uggaaaguaagucaugauau

SEQ ID NO: 16342 - RNA, 22 nt, Homo sapiens
uggaaaguaguucuaaucuaag

SEQ ID NO: 16343 - RNA, 22 nt, Homo sapiens
uggaccccugcucgggagcccu

SEQ ID NO: 16344 - RNA, 22 nt, Homo sapiens
uggagucuugaugauuuucaaa

SEQ ID NO: 16345 - RNA, 21 nt, Homo sapiens
uggcaacauggauggauucug

SEQ ID NO: 16346 - RNA, 22 nt, Homo sapiens
uggcaugaagaccccauccuuu

SEQ ID NO: 16347 - RNA, 22 nt, Homo sapiens
uggcauuuugugugaauuagaa

SEQ ID NO: 16348 - RNA, 23 nt, Homo sapiens
uggcauuuuuggcaaugccuucu

SEQ ID NO: 16349 - RNA, 22 nt, Homo sapiens
uggcuacugacugaugauuaua

SEQ ID NO: 16350 - RNA, 22 nt, Homo sapiens
ugggaagauucuguguuuuucc

SEQ ID NO: 16351 - RNA, 22 nt, Homo sapiens
ugggaucgucaagugaggcucg

SEQ ID NO: 16352 - RNA, 22 nt, Homo sapiens
ugggaugaauacaaugggauca

SEQ ID NO: 16353 - RNA, 22 nt, Homo sapiens
uggguagagaaucaggaucuua

SEQ ID NO: 16354 - RNA, 22 nt, Homo sapiens
uggguagugucagcugauccau

SEQ ID NO: 16355 - RNA, 22 nt, Homo sapiens
ugguccuuuccauuggagacac

SEQ ID NO: 16356 - RNA, 19 nt, Homo sapiens
ugucaucaucuuuucuugc

SEQ ID NO: 16357 - RNA, 22 nt, Homo sapiens
ugucaugucuuuguguaucaau

SEQ ID NO: 16358 - RNA, 22 nt, Homo sapiens
ugucuagaucugaauguaauug

SEQ ID NO: 16359 - RNA, 22 nt, Homo sapiens
ugugaauguaaccuuauuugga

SEQ ID NO: 16360 - RNA, 22 nt, Homo sapiens
uguguagagaaauauuacuuau

SEQ ID NO: 16361 - RNA, 22 nt, Homo sapiens
ugugucuuuuaucacacaaugu

SEQ ID NO: 16362 - RNA, 22 nt, Homo sapiens
uuaaaugucuguagaugugcug

SEQ ID NO: 16363 - RNA, 18 nt, Homo sapiens
aaaaagugcucaggccua

SEQ ID NO: 16364 - RNA, 22 nt, Homo sapiens
aaaagugguguuguuucuaaau

SEQ ID NO: 16365 - RNA, 22 nt, Homo sapiens
aaacagucuucuccugagggac

SEQ ID NO: 16366 - RNA, 22 nt, Homo sapiens
aaagugcaguauuugggcagaa

SEQ ID NO: 16367 - RNA, 22 nt, Homo sapiens
aaaugcuuucuuggaccauuug

SEQ ID NO: 16368 - RNA, 22 nt, Homo sapiens
aaauugcauugagcugcuuauu

SEQ ID NO: 16369 - RNA, 22 nt, Homo sapiens
aacugguauugaauuuaggaag

SEQ ID NO: 16370 - RNA, 22 nt, Homo sapiens
aaugauacuguguacaagggca

SEQ ID NO: 16371 - RNA, 22 nt, Homo sapiens
aauggcaguagauggaugggua

SEQ ID NO: 16372 - RNA, 22 nt, Homo sapiens
aauuacauggcaauugggaaau

SEQ ID NO: 16373 - RNA, 22 nt, Homo sapiens
aauugcaucuguucuuugccag

SEQ ID NO: 16374 - RNA, 22 nt, Homo sapiens
acaguguguguguucaccuaga

SEQ ID NO: 16375 - RNA, 22 nt, Homo sapiens
acauaguagacacugaaaauau

SEQ ID NO: 16376 - RNA, 21 nt, Homo sapiens
acccucuaguuuucaacaggc

SEQ ID NO: 16377 - RNA, 22 nt, Homo sapiens
acccugcuaaacagcccccugc

SEQ ID NO: 16378 - RNA, 18 nt, Homo sapiens
accuucauuccuuugccu

SEQ ID NO: 16379 - RNA, 22 nt, Homo sapiens
acugagacugagaauguuucuu

SEQ ID NO: 16380 - RNA, 22 nt, Homo sapiens
acugugcuguuuuaauuauuga

SEQ ID NO: 16381 - RNA, 22 nt, Homo sapiens
agagauaauuagguuaaaugag

SEQ ID NO: 16382 - RNA, 23 nt, Homo sapiens
agagguuuaaucaggcaguugcu

SEQ ID NO: 16383 - RNA, 22 nt, Homo sapiens
agaguaguuuauuaugcuaagg

SEQ ID NO: 16384 - RNA, 23 nt, Homo sapiens
agcaaaugcucuagcacuccaac

SEQ ID NO: 16385 - RNA, 22 nt, Homo sapiens
agcagauguuuagugagcgccu

SEQ ID NO: 16386 - RNA, 21 nt, Homo sapiens
agcuaaauuggaaauuucugu

SEQ ID NO: 16387 - RNA, 22 nt, Homo sapiens
agcucuuguuaguauuagcagu

SEQ ID NO: 16388 - RNA, 22 nt, Homo sapiens
uauggcauuguuggugaugaua

SEQ ID NO: 16389 - RNA, 22 nt, Homo sapiens
uauggguguuauugcaugggag

SEQ ID NO: 16390 - RNA, 22 nt, Homo sapiens
uauucacaggugugggacaaag

SEQ ID NO: 16391 - RNA, 22 nt, Homo sapiens
uauugcaaauggugaucccagg

SEQ ID NO: 16392 - RNA, 22 nt, Homo sapiens
uauugcauguugagcaguaccu

SEQ ID NO: 16393 - RNA, 22 nt, Homo sapiens
uauugcuuaugaugcugaauua

SEQ ID NO: 16394 - RNA, 22 nt, Homo sapiens
ucacagaggagaagaccuuuaa

SEQ ID NO: 16395 - RNA, 22 nt, Homo sapiens
ucacagucaaaguaaucauaga

SEQ ID NO: 16396 - RNA, 22 nt, Homo sapiens
auaugcaaauccauagagacag

SEQ ID NO: 16397 - RNA, 22 nt, Homo sapiens
auauuacuggccauaucgcagg

SEQ ID NO: 16398 - RNA, 22 nt, Homo sapiens
auauuggacugugcuaguuaga

SEQ ID NO: 16399 - RNA, 22 nt, Homo sapiens
auauuguacugcuacugguucu

SEQ ID NO: 16400 - RNA, 20 nt, Homo sapiens
aucaaagacuuagaggggga

SEQ ID NO: 16401 - RNA, 22 nt, Homo sapiens
aucacugggcaagauaucauga

SEQ ID NO: 16402 - RNA, 22 nt, Homo sapiens
aucacuggucaugagagaagua

SEQ ID NO: 16403 - RNA, 22 nt, Homo sapiens
aucagaaucucuagugggacca

SEQ ID NO: 16404 - RNA, 22 nt, Homo sapiens
aucagucacugcguuuuuggga

SEQ ID NO: 16405 - RNA, 22 nt, Homo sapiens
aucauccagccccagaagggag

SEQ ID NO: 16406 - RNA, 22 nt, Homo sapiens
aucucuugccagucagaauggu

SEQ ID NO: 16407 - RNA, 22 nt, Homo sapiens
augaaaugcauguuaaguccgu

SEQ ID NO: 16408 - RNA, 18 nt, Homo sapiens
augaagucaucacuuuua

SEQ ID NO: 16409 - RNA, 22 nt, Homo sapiens
augagauauuuuauaagaucau

SEQ ID NO: 16410 - RNA, 22 nt, Homo sapiens
augauaaguuauuagaagaaga

SEQ ID NO: 16411 - RNA, 22 nt, Homo sapiens
augauaucuuguuuuucaugca

SEQ ID NO: 16412 - RNA, 22 nt, Homo sapiens
augauauguuuguagcuaucuc

SEQ ID NO: 16413 - RNA, 22 nt, Homo sapiens
augaugcaguacuuugggaaca

SEQ ID NO: 16414 - RNA, 20 nt, Homo sapiens
augcaaacccugcuuugugg

SEQ ID NO: 16415 - RNA, 19 nt, Homo sapiens
augcaaugucacaggcugc

SEQ ID NO: 16416 - RNA, 22 nt, Homo sapiens
augcaauucuagauugauagua

SEQ ID NO: 16417 - RNA, 22 nt, Homo sapiens
augcagagucccagccccuagc

SEQ ID NO: 16418 - RNA, 22 nt, Homo sapiens
augcagugugcaacagauuaag

SEQ ID NO: 16419 - RNA, 22 nt, Homo sapiens
auggaacauaacuauuugggga

SEQ ID NO: 16420 - RNA, 22 nt, Homo sapiens
augggcaaauguuggaaauucc

SEQ ID NO: 16421 - RNA, 22 nt, Homo sapiens
augguauuuaacagucuuucua

SEQ ID NO: 16422 - RNA, 22 nt, Homo sapiens
augugcauaugaagcacagaca

SEQ ID NO: 16423 - RNA, 18 nt, Homo sapiens
auguggcuuuugaaggcu

SEQ ID NO: 16424 - RNA, 22 nt, Homo sapiens
auguguaaagcuuuucuuuguu

SEQ ID NO: 16425 - RNA, 22 nt, Homo sapiens
auuaacaucuagaguuuuggug

SEQ ID NO: 16426 - RNA, 22 nt, Homo sapiens
auuauaguguauacuugaaauu

SEQ ID NO: 16427 - RNA, 22 nt, Homo sapiens
auucacagggggagaaggguau

SEQ ID NO: 16428 - RNA, 22 nt, Homo sapiens
auugcacuccagccuggaugac

SEQ ID NO: 16429 - RNA, 22 nt, Homo sapiens
auugcacucugaucugcacucc

SEQ ID NO: 16430 - RNA, 22 nt, Homo sapiens
auugcagaaaugacagagcgcc

SEQ ID NO: 16431 - RNA, 23 nt, Homo sapiens
auugcagaaucacagagguagug

SEQ ID NO: 16432 - RNA, 22 nt, Homo sapiens
auugcagauucgcuuuguguug

SEQ ID NO: 16433 - RNA, 22 nt, Homo sapiens
auuggcagaaaucuuuauagua

SEQ ID NO: 16434 - RNA, 22 nt, Homo sapiens
auugucauuuauaacuguguag

SEQ ID NO: 16435 - RNA, 22 nt, Homo sapiens
auuguucuuguguccuuuuccu

SEQ ID NO: 16436 - RNA, 22 nt, Homo sapiens
auuuggcaacguagggaggcau

SEQ ID NO: 16437 - RNA, 22 nt, Homo sapiens
auuuggcaauuuugaagaugcc

SEQ ID NO: 16438 - RNA, 22 nt, Homo sapiens
auuuggcagugaagggaucaca

SEQ ID NO: 16439 - RNA, 22 nt, Homo sapiens
caaaagugauugcgguuuuugc

SEQ ID NO: 16440 - RNA, 22 nt, Homo sapiens
caaaagugguucuuauccuuuu

SEQ ID NO: 16441 - RNA, 19 nt, Homo sapiens
caauacuucuuggcauaca

SEQ ID NO: 16442 - RNA, 21 nt, Homo sapiens
caauggcacaaucucugcuca

SEQ ID NO: 16443 - RNA, 22 nt, Homo sapiens
cagcuguuguuaugucugcagg

SEQ ID NO: 16444 - RNA, 18 nt, Homo sapiens
cagugcaauacaggagag

SEQ ID NO: 16445 - RNA, 22 nt, Homo sapiens
cauuccacuggauaaacaaggu

SEQ ID NO: 16446 - RNA, 22 nt, Homo sapiens
cauugcacuccagucugggcaa

SEQ ID NO: 16447 - RNA, 22 nt, Homo sapiens
cauugcacucuagucuggguga

SEQ ID NO: 16448 - RNA, 22 nt, Homo sapiens
cauugcaugcauauggcuuggu

SEQ ID NO: 16449 - RNA, 22 nt, Homo sapiens
cauugcauuccagucugggcaa

SEQ ID NO: 16450 - RNA, 22 nt, Homo sapiens
cauuuuacuuuccagacgugga

SEQ ID NO: 16451 - RNA, 22 nt, Homo sapiens
ccagccgggugcaguggcucac

SEQ ID NO: 16452 - RNA, 20 nt, Homo sapiens
ccaguguuauuuauguucua

SEQ ID NO: 16453 - RNA, 22 nt, Homo sapiens
ccaguuuucaagauaaugguuu

SEQ ID NO: 16454 - RNA, 22 nt, Homo sapiens
cccugagcagccugaguuuccc

SEQ ID NO: 16455 - RNA, 23 nt, Homo sapiens
ccgugagagaguucauagaaagc

SEQ ID NO: 16456 - RNA, 22 nt, Homo sapiens
ccucuguaguccugcaagagga

SEQ ID NO: 16457 - RNA, 22 nt, Homo sapiens
cggcaguggguaagccaagcuu

SEQ ID NO: 16458 - RNA, 22 nt, Homo sapiens
cuaaugcagucaggagaaggaa

SEQ ID NO: 16459 - RNA, 22 nt, Homo sapiens
cuacaguguauuuauggagggu

SEQ ID NO: 16460 - RNA, 22 nt, Homo sapiens
cuacaguucucaggaguuggcc

SEQ ID NO: 16461 - RNA, 22 nt, Homo sapiens
cuagaauguauaaaaccaagcu

SEQ ID NO: 16462 - RNA, 22 nt, Homo sapiens
cuagaggcacagccuaggcacu

SEQ ID NO: 16463 - RNA, 22 nt, Homo sapiens
cuauauacugccugcugauuag

SEQ ID NO: 16464 - RNA, 21 nt, Homo sapiens
cuaucucaguguuuacauuug

SEQ ID NO: 16465 - RNA, 22 nt, Homo sapiens
aaggcacugaacuuaaauucug

SEQ ID NO: 16466 - RNA, 17 nt, Homo sapiens
aaggugcuucgaccucc

SEQ ID NO: 16467 - RNA, 22 nt, Homo sapiens
aagguggugucagagagcuuau

SEQ ID NO: 16468 - RNA, 22 nt, Homo sapiens
aaguagcuggaugcaguggcac

SEQ ID NO: 16469 - RNA, 20 nt, Homo sapiens
aagugcaucguugugucugc

SEQ ID NO: 16470 - RNA, 22 nt, Homo sapiens
aagugguuuuuacaaagacaga

SEQ ID NO: 16471 - RNA, 22 nt, Homo sapiens
aauauguccuugaaauggugcu

SEQ ID NO: 16472 - RNA, 17 nt, Homo sapiens
aaugagacauuucugcu

SEQ ID NO: 16473 - RNA, 22 nt, Homo sapiens
acaaagugccuccuuuuagagu

SEQ ID NO: 16474 - RNA, 20 nt, Homo sapiens
acaguagaagggauuucaaa

SEQ ID NO: 16475 - RNA, 22 nt, Homo sapiens
acaguguacaauagccuuuuaa

SEQ ID NO: 16476 - RNA, 22 nt, Homo sapiens
acagugucugacacguaggaag

SEQ ID NO: 16477 - RNA, 23 nt, Homo sapiens
accuucauucauucagcugaagu

SEQ ID NO: 16478 - RNA, 22 nt, Homo sapiens
accuuguagcaaaccuaacaua

SEQ ID NO: 16479 - RNA, 18 nt, Homo sapiens
acugcacuccaccuuggg

SEQ ID NO: 16480 - RNA, 22 nt, Homo sapiens
acugcacuccagccuuagugac

SEQ ID NO: 16481 - RNA, 22 nt, Homo sapiens
cugcacugagacccucuuugcu

SEQ ID NO: 16482 - RNA, 19 nt, Homo sapiens
cugcaugagacaguugguu

SEQ ID NO: 16483 - RNA, 22 nt, Homo sapiens
cuggaaacaucuuaggaaugca

SEQ ID NO: 16484 - RNA, 22 nt, Homo sapiens
cugucuggaggccugcaaauaa

SEQ ID NO: 16485 - RNA, 22 nt, Homo sapiens
cuguucaaauuguuugugaagu

SEQ ID NO: 16486 - RNA, 22 nt, Homo sapiens
cuucaguucuguaaggacagca

SEQ ID NO: 16487 - RNA, 20 nt, Homo sapiens
cuugcuccccuuguucuaga

SEQ ID NO: 16488 - RNA, 22 nt, Homo sapiens
cuuggcauugccccuggaauuu

SEQ ID NO: 16489 - RNA, 20 nt, Homo sapiens
cuuggcuuucuugguguuaa

SEQ ID NO: 16490 - RNA, 22 nt, Homo sapiens
cuuucacacuguuggugggaau

SEQ ID NO: 16491 - RNA, 21 nt, Homo sapiens
cuuugcacugcuccucagcuc

SEQ ID NO: 16492 - RNA, 22 nt, Homo sapiens
cuuuuggugugaagaagcucuu

SEQ ID NO: 16493 - RNA, 21 nt, Homo sapiens
gaaauacugccuuaggagcug

SEQ ID NO: 16494 - RNA, 22 nt, Homo sapiens
gaagcauugauccacaggcgug

SEQ ID NO: 16495 - RNA, 22 nt, Homo sapiens
gaaucauuguuucuaaguuugu

SEQ ID NO: 16496 - RNA, 22 nt, Homo sapiens
gaauguuuacuuuguuuaauac

SEQ ID NO: 16497 - RNA, 22 nt, Homo sapiens
gaauugcacaaaaacugcuugu

SEQ ID NO: 16498 - RNA, 22 nt, Homo sapiens
gagaaccauuuggagaaaaagu

SEQ ID NO: 16499 - RNA, 22 nt, Homo sapiens
gagggcacugcuuuccuuucaa

SEQ ID NO: 16500 - RNA, 22 nt, Homo sapiens
gaguagugcugcaauaaacaua

SEQ ID NO: 16501 - RNA, 22 nt, Homo sapiens
gaguagugcugcaguaaacaca

SEQ ID NO: 16502 - RNA, 22 nt, Homo sapiens
gagugcaauggcaugaucuggg

SEQ ID NO: 16503 - RNA, 22 nt, Homo sapiens
gagugcaauggcgcgaucuggg

SEQ ID NO: 16504 - RNA, 22 nt, Homo sapiens
gaucaauuggcugaagacacgu

SEQ ID NO: 16505 - RNA, 22 nt, Homo sapiens
gaugagaucauaaguguggagc

SEQ ID NO: 16506 - RNA, 22 nt, Homo sapiens
gaugcaguaagaaugcauagcg

SEQ ID NO: 16507 - RNA, 22 nt, Homo sapiens
gcuuuguuguugaugggaaauc

SEQ ID NO: 16508 - RNA, 22 nt, Homo sapiens
ggaaaguaacccauucucuuac

SEQ ID NO: 16509 - RNA, 22 nt, Homo sapiens
ggacaagagacugggacacuga

SEQ ID NO: 16510 - RNA, 22 nt, Homo sapiens
ggagcucaucuagcauagaggu

SEQ ID NO: 16511 - RNA, 22 nt, Homo sapiens
ggaggcuaguaaaaagguagaa

SEQ ID NO: 16512 - RNA, 22 nt, Homo sapiens
ggagggugagaucaauuuggga

SEQ ID NO: 16513 - RNA, 22 nt, Homo sapiens
ggagugucagaaacaguguccu

SEQ ID NO: 16514 - RNA, 22 nt, Homo sapiens
ggcagguaaggagugggagccu

SEQ ID NO: 16515 - RNA, 22 nt, Homo sapiens
ggcauguuuaguagaauguggu

SEQ ID NO: 16516 - RNA, 22 nt, Homo sapiens
ggcauugugauccaccagccuu

SEQ ID NO: 16517 - RNA, 22 nt, Homo sapiens
ggcuagagagcucagggauaug

SEQ ID NO: 16518 - RNA, 22 nt, Homo sapiens
gggaugaagcccuaggguuggu

SEQ ID NO: 16519 - RNA, 23 nt, Homo sapiens
gggauuguaaaauaugagggcag

SEQ ID NO: 16520 - RNA, 22 nt, Homo sapiens
gggcaacauugaguacccugaa

SEQ ID NO: 16521 - RNA, 22 nt, Homo sapiens
gggccagaugcauuuguuauuu

SEQ ID NO: 16522 - RNA, 22 nt, Homo sapiens
ggguaggcaagcggaugucaga

SEQ ID NO: 16523 - RNA, 22 nt, Homo sapiens
ggugacugguuuaucuggcagu

SEQ ID NO: 16524 - RNA, 18 nt, Homo sapiens
guaaauguaucuauugcc

SEQ ID NO: 16525 - RNA, 22 nt, Homo sapiens
guaacccuguaggccuaaagua

SEQ ID NO: 16526 - RNA, 22 nt, Homo sapiens
guaaugcacucccaaagaucca

SEQ ID NO: 16527 - RNA, 22 nt, Homo sapiens
guacaugcauaguuuauuucug

SEQ ID NO: 16528 - RNA, 22 nt, Homo sapiens
guacaugcaugcaugggugugc

SEQ ID NO: 16529 - RNA, 22 nt, Homo sapiens
guaucucaguucucgugauuag

SEQ ID NO: 16530 - RNA, 22 nt, Homo sapiens
gucaguggauacugucucuguc

SEQ ID NO: 16531 - RNA, 22 nt, Homo sapiens
gucaguuugguuaaucauucca

SEQ ID NO: 16532 - RNA, 22 nt, Homo sapiens
gucauguuuaacuucuugagga

SEQ ID NO: 16533 - RNA, 22 nt, Homo sapiens
guccaagacuaggaguuggcag

SEQ ID NO: 16534 - RNA, 20 nt, Homo sapiens
gucugucuccgaguagaauu

SEQ ID NO: 16535 - RNA, 20 nt, Homo sapiens
gucuugcuccguugcccagg

SEQ ID NO: 16536 - RNA, 22 nt, Homo sapiens
gucuuuaguugaaacauguggu

SEQ ID NO: 16537 - RNA, 22 nt, Homo sapiens
gugaacuguuugaggaagagaa

SEQ ID NO: 16538 - RNA, 22 nt, Homo sapiens
gugacagucaaagacaugacuu

SEQ ID NO: 16539 - RNA, 22 nt, Homo sapiens
gugagaaucaaacuacauaaau

SEQ ID NO: 16540 - RNA, 22 nt, Homo sapiens
gugagcaguguccuugggggca

SEQ ID NO: 16541 - RNA, 22 nt, Homo sapiens
gugaucauuguauugggguuau

SEQ ID NO: 16542 - RNA, 22 nt, Homo sapiens
gugcaaguguaauacagcuagg

SEQ ID NO: 16543 - RNA, 22 nt, Homo sapiens
uaagacacuuaaaauguuacau

SEQ ID NO: 16544 - RNA, 22 nt, Homo sapiens
uaagaugaaggcucaccuagaa

SEQ ID NO: 16545 - RNA, 22 nt, Homo sapiens
uaauacauucaaggugguaguu

SEQ ID NO: 16546 - RNA, 21 nt, Homo sapiens
uaauggcaugaucucggcuca

SEQ ID NO: 16547 - RNA, 22 nt, Homo sapiens
uaauucacauaaagcacuuaga

SEQ ID NO: 16548 - RNA, 22 nt, Homo sapiens
uacaaagcuuucugcaaaucau

SEQ ID NO: 16549 - RNA, 22 nt, Homo sapiens
uacagguauagauguguguucu

SEQ ID NO: 16550 - RNA, 22 nt, Homo sapiens
uacuuuguuauagcagcaggaa

SEQ ID NO: 16551 - RNA, 22 nt, Homo sapiens
uagacccauuacguaguuucca

SEQ ID NO: 16552 - RNA, 22 nt, Homo sapiens
uagacccauuguucagagagug

SEQ ID NO: 16553 - RNA, 22 nt, Homo sapiens
uagcagaauaacuugccagccu

SEQ ID NO: 16554 - RNA, 22 nt, Homo sapiens
uagcagcaccccacucuacugg

SEQ ID NO: 16555 - RNA, 22 nt, Homo sapiens
uagcagcauaaauggacuaaga

SEQ ID NO: 16556 - RNA, 22 nt, Homo sapiens
uaggcacugagaauaugaggau

SEQ ID NO: 16557 - RNA, 22 nt, Homo sapiens
uaggggcacacuucgguuagca

SEQ ID NO: 16558 - RNA, 22 nt, Homo sapiens
uagucagcaauguucauguucu

SEQ ID NO: 16559 - RNA, 22 nt, Homo sapiens
uaugagagcugguagguagaga

SEQ ID NO: 16560 - RNA, 22 nt, Homo sapiens
uauggauguuaagguucacagc

SEQ ID NO: 16561 - RNA, 22 nt, Homo sapiens
uauggcauuauuuugauagaca

SEQ ID NO: 16562 - RNA, 22 nt, Homo sapiens
uaugucuucuuuagagaaaugu

SEQ ID NO: 16563 - RNA, 22 nt, Homo sapiens
uauugcuugaggaaaugguaau

SEQ ID NO: 16564 - RNA, 22 nt, Homo sapiens
aaaaguucuuugagccuugaca

SEQ ID NO: 16565 - RNA, 22 nt, Homo sapiens
aaacauugaccucauccuggca

SEQ ID NO: 16566 - RNA, 22 nt, Homo sapiens
aaaugcugcuuuggccucuucu

SEQ ID NO: 16567 - RNA, 22 nt, Homo sapiens
aaaugcuguuccaggaccuauc

SEQ ID NO: 16568 - RNA, 19 nt, Homo sapiens
aaaugugcacuguuuucca

SEQ ID NO: 16569 - RNA, 22 nt, Homo sapiens
aaauugcaaugcgaggcagagg

SEQ ID NO: 16570 - RNA, 22 nt, Homo sapiens
aaauugcaguuaggaugauggu

SEQ ID NO: 16571 - RNA, 21 nt, Homo sapiens
aacagugcuuaguagauguuc

SEQ ID NO: 16572 - RNA, 22 nt, Homo sapiens
aaccuacauucuuaacuguugc

SEQ ID NO: 16573 - RNA, 22 nt, Homo sapiens
aagagaugaagguccugacugu

SEQ ID NO: 16574 - RNA, 22 nt, Homo sapiens
aagaggccuaggaaucuguauu

SEQ ID NO: 16575 - RNA, 22 nt, Homo sapiens
uucauaguguaccugaaggcac

SEQ ID NO: 16576 - RNA, 22 nt, Homo sapiens
uucauaguucuuuuagucauua

SEQ ID NO: 16577 - RNA, 22 nt, Homo sapiens
uucccagugguuagcucugguc

SEQ ID NO: 16578 - RNA, 22 nt, Homo sapiens
uucccugaaauauucacuuuca

SEQ ID NO: 16579 - RNA, 22 nt, Homo sapiens
uucccuuugaaacuaaacuugc

SEQ ID NO: 16580 - RNA, 22 nt, Homo sapiens
uuccugagaucagaauucaaau

SEQ ID NO: 16581 - RNA, 22 nt, Homo sapiens
uuccuuaguuauuugguccccu

SEQ ID NO: 16582 - RNA, 22 nt, Homo sapiens
uuccuugguucagggaaggucc

SEQ ID NO: 16583 - RNA, 22 nt, Homo sapiens
uucuucaguuacaacaaggggg

SEQ ID NO: 16584 - RNA, 22 nt, Homo sapiens
uugagcccuggagguggaggcu

SEQ ID NO: 16585 - RNA, 22 nt, Homo sapiens
uugagcucaucaagauagagaa

SEQ ID NO: 16586 - RNA, 22 nt, Homo sapiens
uugaucaucagcuuugucaucu

SEQ ID NO: 16587 - RNA, 22 nt, Homo sapiens
uugcacagugcuuucuuugccc

SEQ ID NO: 16588 - RNA, 22 nt, Homo sapiens
uugcacaguguguacagcacca

SEQ ID NO: 16589 - RNA, 22 nt, Homo sapiens
uugcacuguaauuuauuuaugu

SEQ ID NO: 16590 - RNA, 22 nt, Homo sapiens
uugcagugguuucacuggcaaa

SEQ ID NO: 16591 - RNA, 22 nt, Homo sapiens
uugcaucagcaggcauaauugg

SEQ ID NO: 16592 - RNA, 22 nt, Homo sapiens
uugcauuuucuaggagggcaaa

SEQ ID NO: 16593 - RNA, 22 nt, Homo sapiens
uuggagagucacuaguuagugc

SEQ ID NO: 16594 - RNA, 22 nt, Homo sapiens
uuggcaacauagugagaccccc

SEQ ID NO: 16595 - RNA, 23 nt, Homo sapiens
uugggcaaaucacuaacgucucc

SEQ ID NO: 16596 - RNA, 23 nt, Homo sapiens
uugggcaaaucacugagggcaga

SEQ ID NO: 16597 - RNA, 22 nt, Homo sapiens
uuguacuggguuuucuggaauu

SEQ ID NO: 16598 - RNA, 22 nt, Homo sapiens
uuguagcaaauguguaaacaaa

SEQ ID NO: 16599 - RNA, 22 nt, Homo sapiens
uugucccauggggucuuccuuu

SEQ ID NO: 16600 - RNA, 22 nt, Homo sapiens
uugugaauggugccucaguaaa

SEQ ID NO: 16601 - RNA, 22 nt, Homo sapiens
uugugguuauagagucucccug

SEQ ID NO: 16602 - RNA, 22 nt, Homo sapiens
uuuaaggcaugccuguacaugc

SEQ ID NO: 16603 - RNA, 22 nt, Homo sapiens
uuuagguauuugguauagcagu

SEQ ID NO: 16604 - RNA, 22 nt, Homo sapiens
uuucacuagccagcccuuuauu

SEQ ID NO: 16605 - RNA, 18 nt, Homo sapiens
uuucaggguggacaugag

SEQ ID NO: 16606 - RNA, 23 nt, Homo sapiens
uuucauggggauuuacucauucc

SEQ ID NO: 16607 - RNA, 22 nt, Homo sapiens
uuugcagagucuuucgcugggc

SEQ ID NO: 16608 - RNA, 22 nt, Homo sapiens
uuuggcaaagaucaacauguua

SEQ ID NO: 16609 - RNA, 22 nt, Homo sapiens
uuuggcaguuauuuacucagug

SEQ ID NO: 16610 - RNA, 22 nt, Homo sapiens
uuuuaugggcuauuugcauuag

SEQ ID NO: 16611 - RNA, 22 nt, Homo sapiens
uuuuggcacuuugucugauucu

SEQ ID NO: 16612 - RNA, 22 nt, Homo sapiens
uuuugucccaugggcuguuccc

SEQ ID NO: 16613 - RNA, 21 nt, Homo sapiens
uuuuugggcuuucauaguguu

SEQ ID NO: 16614 - RNA, 23 nt, Homo sapiens
agggcacuauagauguuauucua

SEQ ID NO: 16615 - RNA, 22 nt, Homo sapiens
agggcacuguagguccugccuc

SEQ ID NO: 16616 - RNA, 22 nt, Homo sapiens
aggguuuuuauuuauguggcau

SEQ ID NO: 16617 - RNA, 22 nt, Homo sapiens
aggugcucuuccuguaggucac

SEQ ID NO: 16618 - RNA, 22 nt, Homo sapiens
aguaacaggauccaaagaaugu

SEQ ID NO: 16619 - RNA, 22 nt, Homo sapiens
aguaaucaucugagggcagaaa

SEQ ID NO: 16620 - RNA, 22 nt, Homo sapiens
aguacaauguugaguagaagug

SEQ ID NO: 16621 - RNA, 22 nt, Homo sapiens
agugaucauuugaauugaugau

SEQ ID NO: 16622 - RNA, 22 nt, Homo sapiens
agugcaaggacauuuagguugu

SEQ ID NO: 16623 - RNA, 22 nt, Homo sapiens
agugcaauaaggauguagaacu

SEQ ID NO: 16624 - RNA, 22 nt, Homo sapiens
agugcauugcaucucugcuuca

SEQ ID NO: 16625 - RNA, 22 nt, Homo sapiens
aguggaaucuguuauacuaacu

SEQ ID NO: 16626 - RNA, 22 nt, Homo sapiens
aguucaaugcucuuucuacuau

SEQ ID NO: 16627 - RNA, 22 nt, Homo sapiens
auaaagacacuuggcaugauuu

SEQ ID NO: 16628 - RNA, 22 nt, Homo sapiens
auaaagccaggagacguaauug

SEQ ID NO: 16629 - RNA, 23 nt, Homo sapiens
auaaugcaaguggugguaaucug

SEQ ID NO: 16630 - RNA, 22 nt, Homo sapiens
auacaguugccauuucuugugc

SEQ ID NO: 16631 - RNA, 22 nt, Homo sapiens
auacuguuuuacaucauugccu

SEQ ID NO: 16632 - RNA, 22 nt, Homo sapiens
auagcagaagaagggacaauuc

SEQ ID NO: 16633 - RNA, 22 nt, Homo sapiens
auaugcacaguggaguacuauu

SEQ ID NO: 16634 - RNA, 22 nt, Homo sapiens
aucaaauugucauuuuaaggau

SEQ ID NO: 16635 - RNA, 20 nt, Homo sapiens
aucacuggagaaggaaaccu

SEQ ID NO: 16636 - RNA, 22 nt, Homo sapiens
auccacaugcaguuggaaacag

SEQ ID NO: 16637 - RNA, 22 nt, Homo sapiens
aucucugagauguucugauuuu

SEQ ID NO: 16638 - RNA, 22 nt, Homo sapiens
augaaagugauaaaugucucua

SEQ ID NO: 16639 - RNA, 22 nt, Homo sapiens
augaaaucuuuccugugaggau

SEQ ID NO: 16640 - RNA, 23 nt, Homo sapiens
augacacuguccuugaccauuuc

SEQ ID NO: 16641 - RNA, 22 nt, Homo sapiens
augacccugaccuaagccaauc

SEQ ID NO: 16642 - RNA, 22 nt, Homo sapiens
augacugagacuaacuuacuuu

SEQ ID NO: 16643 - RNA, 22 nt, Homo sapiens
augagcaucaccagaaucaaua

SEQ ID NO: 16644 - RNA, 22 nt, Homo sapiens
augaucaucugaaagcuuuuac

SEQ ID NO: 16645 - RNA, 22 nt, Homo sapiens
auggaaacauaagaguauagau

SEQ ID NO: 16646 - RNA, 22 nt, Homo sapiens
augggcacugauguauucugug

SEQ ID NO: 16647 - RNA, 22 nt, Homo sapiens
augucuuucauagagacccaga

SEQ ID NO: 16648 - RNA, 22 nt, Homo sapiens
augugcaauggugucaccacau

SEQ ID NO: 16649 - RNA, 22 nt, Homo sapiens
augugcaauguguacguagccc

SEQ ID NO: 16650 - RNA, 22 nt, Homo sapiens
auuccacaguuaacacagaccg

SEQ ID NO: 16651 - RNA, 22 nt, Homo sapiens
auugacaguuggccaguaagug

SEQ ID NO: 16652 - RNA, 22 nt, Homo sapiens
auugcacuccagccuugugaca

SEQ ID NO: 16653 - RNA, 22 nt, Homo sapiens
auuguacucuagccucugggca

SEQ ID NO: 16654 - RNA, 22 nt, Homo sapiens
caaaguaauuacgguuuuggcc

SEQ ID NO: 16655 - RNA, 22 nt, Homo sapiens
caaaguaauugugguuuugcca

SEQ ID NO: 16656 - RNA, 22 nt, Homo sapiens
cacagugaacaauauccucugu

SEQ ID NO: 16657 - RNA, 22 nt, Homo sapiens
caccgagguuggagugcagugg

SEQ ID NO: 16658 - RNA, 18 nt, Homo sapiens
aaaaagugcucaggccua

SEQ ID NO: 16659 - RNA, 22 nt, Homo sapiens
aaaagucuguagugaaagguga

SEQ ID NO: 16660 - RNA, 22 nt, Homo sapiens
aaagaguucagguagauuucaa

SEQ ID NO: 16661 - RNA, 22 nt, Homo sapiens
aaagcacugaauaaauuugcuu

SEQ ID NO: 16662 - RNA, 22 nt, Homo sapiens
aaagcagcaggugguuuucaau

SEQ ID NO: 16663 - RNA, 22 nt, Homo sapiens
aaagcuagagaagcugcuguca

SEQ ID NO: 16664 - RNA, 22 nt, Homo sapiens
aaaggcacugaucuuauccagu

SEQ ID NO: 16665 - RNA, 20 nt, Homo sapiens
aaaggcugugagaacgagau

SEQ ID NO: 16666 - RNA, 22 nt, Homo sapiens
aaaggcuucggaucagaaggua

SEQ ID NO: 16667 - RNA, 22 nt, Homo sapiens
aaagucacuggagaaggaauau

SEQ ID NO: 16668 - RNA, 22 nt, Homo sapiens
aaagucuagaggaucaugugug

SEQ ID NO: 16669 - RNA, 18 nt, Homo sapiens
aaagugaugucauucuuu

SEQ ID NO: 16670 - RNA, 22 nt, Homo sapiens
aaagugauugcgguuuuugcca

SEQ ID NO: 16671 - RNA, 22 nt, Homo sapiens
aaagugauuguaguuuuugcca

SEQ ID NO: 16672 - RNA, 22 nt, Homo sapiens
aaagugcacuuggaagagggcc

SEQ ID NO: 16673 - RNA, 22 nt, Homo sapiens
aaagugcugagaguucuaacuu

SEQ ID NO: 16674 - RNA, 22 nt, Homo sapiens
aaagugcugggauuuuaggcau

SEQ ID NO: 16675 - RNA, 22 nt, Homo sapiens
aaaguggugggauuccaggcau

SEQ ID NO: 16676 - RNA, 22 nt, Homo sapiens
aaauccauuuguucagcuaugc

SEQ ID NO: 16677 - RNA, 22 nt, Homo sapiens
aaaucccuugcucucucagacc

SEQ ID NO: 16678 - RNA, 22 nt, Homo sapiens
aaaugacuuuuuaugcagagua

SEQ ID NO: 16679 - RNA, 22 nt, Homo sapiens
aaaugcaguugguggggauaug

SEQ ID NO: 16680 - RNA, 22 nt, Homo sapiens
aaaugcucucuacacguuucug

SEQ ID NO: 16681 - RNA, 22 nt, Homo sapiens
aaaugcucuguggguaguaaug

SEQ ID NO: 16682 - RNA, 20 nt, Homo sapiens
aaaugcuguaauguuuggga

SEQ ID NO: 16683 - RNA, 22 nt, Homo sapiens
aaaugcugucaaauuguguucu

SEQ ID NO: 16684 - RNA, 22 nt, Homo sapiens
aaaugguguuaguagaucuuua

SEQ ID NO: 16685 - RNA, 22 nt, Homo sapiens
aaaugucauggaguguuucccc

SEQ ID NO: 16686 - RNA, 19 nt, Homo sapiens
aaaugugcacuguuuucca

SEQ ID NO: 16687 - RNA, 22 nt, Homo sapiens
aaauugcaguuaggaugauggu

SEQ ID NO: 16688 - RNA, 22 nt, Homo sapiens
aaauugcauugagcugcuuauu

SEQ ID NO: 16689 - RNA, 22 nt, Homo sapiens
aacaccauucucuguaacaaga

SEQ ID NO: 16690 - RNA, 22 nt, Homo sapiens
aacacuguuuccagucaugauc

SEQ ID NO: 16691 - RNA, 22 nt, Homo sapiens
aacagaauccucuuuuccuggg

SEQ ID NO: 16692 - RNA, 20 nt, Homo sapiens
aacagcacugucugaagcuu

SEQ ID NO: 16693 - RNA, 22 nt, Homo sapiens
aacaggguguuugcaguuucuu

SEQ ID NO: 16694 - RNA, 21 nt, Homo sapiens
ugagaguaguguauuauucuc

SEQ ID NO: 16695 - RNA, 22 nt, Homo sapiens
ugagagucacugaccugguaua

SEQ ID NO: 16696 - RNA, 22 nt, Homo sapiens
ugagauaguacuuuuuuaaagg

SEQ ID NO: 16697 - RNA, 22 nt, Homo sapiens
ugagauaguuguagauguacau

SEQ ID NO: 16698 - RNA, 22 nt, Homo sapiens
ugagaucacgccacugcacucc

SEQ ID NO: 16699 - RNA, 18 nt, Homo sapiens
ugagaucagcaucaaggg

SEQ ID NO: 16700 - RNA, 22 nt, Homo sapiens
ugagaucaugccacugcacuuc

SEQ ID NO: 16701 - RNA, 22 nt, Homo sapiens
ugagauccaugcuauuugggcu

SEQ ID NO: 16702 - RNA, 22 nt, Homo sapiens
ugagaucugucuuuauaguauu

SEQ ID NO: 16703 - RNA, 22 nt, Homo sapiens
ugagaugguaaauuuuuguugu

SEQ ID NO: 16704 - RNA, 22 nt, Homo sapiens
ugagaugugaagaucacaugaa

SEQ ID NO: 16705 - RNA, 22 nt, Homo sapiens
ugagaugugaucaccugaaggg

SEQ ID NO: 16706 - RNA, 22 nt, Homo sapiens
ugagauguggcuagagagguug

SEQ ID NO: 16707 - RNA, 22 nt, Homo sapiens
ugagauuaucguaauguaucuc

SEQ ID NO: 16708 - RNA, 19 nt, Homo sapiens
ugagauuguaugaggagau

SEQ ID NO: 16709 - RNA, 22 nt, Homo sapiens
ugagcagaaagcugcaaggucg

SEQ ID NO: 16710 - RNA, 22 nt, Homo sapiens
ugagcaucucuaaaaggagcaa

SEQ ID NO: 16711 - RNA, 17 nt, Homo sapiens
ugagcuaugauccuguc

SEQ ID NO: 16712 - RNA, 22 nt, Homo sapiens
ugagcugagaucaugcuauugu

SEQ ID NO: 16713 - RNA, 22 nt, Homo sapiens
ugagguagaggugaacuugacc

SEQ ID NO: 16714 - RNA, 22 nt, Homo sapiens
ugagguaggugaagaaugcacg

SEQ ID NO: 16715 - RNA, 23 nt, Homo sapiens
ugagguguuaagcagacuugucu

SEQ ID NO: 16716 - RNA, 22 nt, Homo sapiens
ugaguagugccacaauaagcau

SEQ ID NO: 16717 - RNA, 22 nt, Homo sapiens
ugaguauguaggaugugucuua

SEQ ID NO: 16718 - RNA, 22 nt, Homo sapiens
ugagucaauucuaacaauggca

SEQ ID NO: 16719 - RNA, 22 nt, Homo sapiens
ugagucaugcuggagucauggc

SEQ ID NO: 16720 - RNA, 22 nt, Homo sapiens
ugagucgagauugcgccacugu

SEQ ID NO: 16721 - RNA, 22 nt, Homo sapiens
ugagugugacuuagcagaagga

SEQ ID NO: 16722 - RNA, 22 nt, Homo sapiens
ugaguucaugcuuguaguucua

SEQ ID NO: 16723 - RNA, 22 nt, Homo sapiens
ugauaacauuucuucugguaca

SEQ ID NO: 16724 - RNA, 22 nt, Homo sapiens
ugauaagaaauuguucauguag

SEQ ID NO: 16725 - RNA, 22 nt, Homo sapiens
ugauaagugagauagcaaguga

SEQ ID NO: 16726 - RNA, 22 nt, Homo sapiens
ugauacuggcuucauagaauga

SEQ ID NO: 16727 - RNA, 22 nt, Homo sapiens
ugauaucugaauagauacacaa

SEQ ID NO: 16728 - RNA, 22 nt, Homo sapiens
ugauaugaaagggaaauaagug

SEQ ID NO: 16729 - RNA, 22 nt, Homo sapiens
ugauaugucacuugaucauggu

SEQ ID NO: 16730 - RNA, 22 nt, Homo sapiens
ugaucacagcuugacuaaagga

SEQ ID NO: 16731 - RNA, 22 nt, Homo sapiens
ugaugaaguauaggaagggcuu

SEQ ID NO: 16732 - RNA, 22 nt, Homo sapiens
ugaugcugaguggcuauuugaa

SEQ ID NO: 16733 - RNA, 22 nt, Homo sapiens
ugauggcauuucauguuuguaa

SEQ ID NO: 16734 - RNA, 20 nt, Homo sapiens
ugauguccaggcagagguuu

SEQ ID NO: 16735 - RNA, 22 nt, Homo sapiens
ugauguccaguucauagaaacu

SEQ ID NO: 16736 - RNA, 22 nt, Homo sapiens
ugaugugucaucugagagagug

SEQ ID NO: 16737 - RNA, 22 nt, Homo sapiens
ugcaaaucuuguguaguuguga

SEQ ID NO: 16738 - RNA, 22 nt, Homo sapiens
ugcaaaugucaaggguuagugu

SEQ ID NO: 16739 - RNA, 22 nt, Homo sapiens
ugcaaauguuaggugucauuau

SEQ ID NO: 16740 - RNA, 22 nt, Homo sapiens
ugcaaauguuauuuugguuucu

SEQ ID NO: 16741 - RNA, 22 nt, Homo sapiens
ugcaagaaucagccuaucauua

SEQ ID NO: 16742 - RNA, 22 nt, Homo sapiens
ugcaagcacacccagggauugu

SEQ ID NO: 16743 - RNA, 22 nt, Homo sapiens
ugcaaguaauuccagcuacuga

SEQ ID NO: 16744 - RNA, 22 nt, Homo sapiens
ugcaccacacuccauccugggc

SEQ ID NO: 16745 - RNA, 23 nt, Homo sapiens
ugcaccacuacacacucuugggu

SEQ ID NO: 16746 - RNA, 22 nt, Homo sapiens
ugcaccacugcacuccacccug

SEQ ID NO: 16747 - RNA, 22 nt, Homo sapiens
ugcagagaaacauuuuguauuu

SEQ ID NO: 16748 - RNA, 22 nt, Homo sapiens
ugcagagucuguccugccugcc

SEQ ID NO: 16749 - RNA, 20 nt, Homo sapiens
ugcagcacugggaaugcagu

SEQ ID NO: 16750 - RNA, 22 nt, Homo sapiens
ugcagcauguaggcacguuauu

SEQ ID NO: 16751 - RNA, 22 nt, Homo sapiens
ugcagugugaaagagccugaca

SEQ ID NO: 16752 - RNA, 22 nt, Homo sapiens
ugcaguuuaggaacugguaaca

SEQ ID NO: 16753 - RNA, 22 nt, Homo sapiens
ugcauacacaagcauacaugua

SEQ ID NO: 16754 - RNA, 22 nt, Homo sapiens
ugcauauguugagaugcauauu

SEQ ID NO: 16755 - RNA, 22 nt, Homo sapiens
ugcauauucgaguuauuuuggg

SEQ ID NO: 16756 - RNA, 21 nt, Homo sapiens
ugcauauuggaacuuucucuc

SEQ ID NO: 16757 - RNA, 21 nt, Homo sapiens
ugcauggagaacacugagggu

SEQ ID NO: 16758 - RNA, 20 nt, Homo sapiens
ugcauguccucacuuacuug

SEQ ID NO: 16759 - RNA, 22 nt, Homo sapiens
ugcauuaucagauguuugcuuu

SEQ ID NO: 16760 - RNA, 22 nt, Homo sapiens
ugccaagauuucaggaauuaag

SEQ ID NO: 16761 - RNA, 22 nt, Homo sapiens
ugccagaugcuggugugagggg

SEQ ID NO: 16762 - RNA, 22 nt, Homo sapiens
ugcuaugucagccaggcugguc

SEQ ID NO: 16763 - RNA, 21 nt, Homo sapiens
ugcuauguuguccaggcuggc

SEQ ID NO: 16764 - RNA, 21 nt, Homo sapiens
ugcucaugaguaaugcaguga

SEQ ID NO: 16765 - RNA, 22 nt, Homo sapiens
ucagaacugauacuagaacuuu

SEQ ID NO: 16766 - RNA, 21 nt, Homo sapiens
ucagaagcucccagggaggac

SEQ ID NO: 16767 - RNA, 22 nt, Homo sapiens
ucagacacuguggccuuuggac

SEQ ID NO: 16768 - RNA, 22 nt, Homo sapiens
ucagaguaguuccuggcagaaa

SEQ ID NO: 16769 - RNA, 18 nt, Homo sapiens
ucagagugcagacuauac

SEQ ID NO: 16770 - RNA, 22 nt, Homo sapiens
ucagaguguuuuccaacuuggu

SEQ ID NO: 16771 - RNA, 22 nt, Homo sapiens
ucagauacuggugacaugaaug

SEQ ID NO: 16772 - RNA, 22 nt, Homo sapiens
ucagauguuucuuuaacgcaug

SEQ ID NO: 16773 - RNA, 22 nt, Homo sapiens
ucagcagugugaaaacaaacua

SEQ ID NO: 16774 - RNA, 22 nt, Homo sapiens
ucaggucauuccaggagggcca

SEQ ID NO: 16775 - RNA, 22 nt, Homo sapiens
ucaggugcaguggcucugaccu

SEQ ID NO: 16776 - RNA, 22 nt, Homo sapiens
ucaguagcauugcuuauacagu

SEQ ID NO: 16777 - RNA, 22 nt, Homo sapiens
ucagugaacgaggaggagggug

SEQ ID NO: 16778 - RNA, 22 nt, Homo sapiens
ucagugauugguuauuuuaggc

SEQ ID NO: 16779 - RNA, 22 nt, Homo sapiens
ucagugcuuggcacagagagcu

SEQ ID NO: 16780 - RNA, 22 nt, Homo sapiens
ucaguggagcuacaauucuggg

SEQ ID NO: 16781 - RNA, 22 nt, Homo sapiens
ucaguguuuggaaucucaauuu

SEQ ID NO: 16782 - RNA, 18 nt, Homo sapiens
ucauagaucaugacagug

SEQ ID NO: 16783 - RNA, 22 nt, Homo sapiens
ucauaguagucacuuaauaaau

SEQ ID NO: 16784 - RNA, 20 nt, Homo sapiens
ucaucaguuggugcucgcug

SEQ ID NO: 16785 - RNA, 21 nt, Homo sapiens
ucaugccacugcacuuuagcc

SEQ ID NO: 16786 - RNA, 22 nt, Homo sapiens
ucauggggugcuuugcuagauu

SEQ ID NO: 16787 - RNA, 22 nt, Homo sapiens
ucaugugagcacagagcaagau

SEQ ID NO: 16788 - RNA, 18 nt, Homo sapiens
ucauuggugagcaccucc

SEQ ID NO: 16789 - RNA, 22 nt, Homo sapiens
uccacaauggagaagaguauga

SEQ ID NO: 16790 - RNA, 22 nt, Homo sapiens
uccacaguggugaggugcagca

SEQ ID NO: 16791 - RNA, 19 nt, Homo sapiens
uccaccgcgugcaccucua

SEQ ID NO: 16792 - RNA, 22 nt, Homo sapiens
uccagaguggugaugcuggggc

SEQ ID NO: 16793 - RNA, 22 nt, Homo sapiens
uccagugcauucagacacuugg

SEQ ID NO: 16794 - RNA, 18 nt, Homo sapiens
uccaguuuucccagcauc

SEQ ID NO: 16795 - RNA, 20 nt, Homo sapiens
uccaguuuuggagacauucu

SEQ ID NO: 16796 - RNA, 22 nt, Homo sapiens
uccaguuuuguuaacauauggu

SEQ ID NO: 16797 - RNA, 22 nt, Homo sapiens
uccaugagaauaguuaggcucu

SEQ ID NO: 16798 - RNA, 18 nt, Homo sapiens
uccauuuguaugggaugg

SEQ ID NO: 16799 - RNA, 22 nt, Homo sapiens
ucccacugucuucucgugcucg

SEQ ID NO: 16800 - RNA, 22 nt, Homo sapiens
ucccagucuagagccggauugg

SEQ ID NO: 16801 - RNA, 22 nt, Homo sapiens
ucccagugaaaccccaccuuca

SEQ ID NO: 16802 - RNA, 22 nt, Homo sapiens
aguuccuacuggcuguaaagaa

SEQ ID NO: 16803 - RNA, 22 nt, Homo sapiens
auaaaguucugcuggcauauau

SEQ ID NO: 16804 - RNA, 22 nt, Homo sapiens
auaaaugcuuccagucauuaaa

SEQ ID NO: 16805 - RNA, 22 nt, Homo sapiens
auaacucuguuuuuuucaugca

SEQ ID NO: 16806 - RNA, 22 nt, Homo sapiens
auaagagcaggcuucuggccag

SEQ ID NO: 16807 - RNA, 22 nt, Homo sapiens
auaagcuaagaguuucugggcu

SEQ ID NO: 16808 - RNA, 22 nt, Homo sapiens
auaaguauuuggacuuuacugu

SEQ ID NO: 16809 - RNA, 22 nt, Homo sapiens
auaauacugggaagaugagcau

SEQ ID NO: 16810 - RNA, 22 nt, Homo sapiens
auaauagguaguaauggauuga

SEQ ID NO: 16811 - RNA, 19 nt, Homo sapiens
auaauuagcagugaggaca

SEQ ID NO: 16812 - RNA, 19 nt, Homo sapiens
auacacguguauacauaca

SEQ ID NO: 16813 - RNA, 22 nt, Homo sapiens
auacaguaucuucuggcaagca

SEQ ID NO: 16814 - RNA, 22 nt, Homo sapiens
auacaugcauuugcacgagagu

SEQ ID NO: 16815 - RNA, 16 nt, Homo sapiens
auaccacagugacaca

SEQ ID NO: 16816 - RNA, 22 nt, Homo sapiens
auacuguuuuacaucauugccu

SEQ ID NO: 16817 - RNA, 22 nt, Homo sapiens
auagaucuauuuauguaucccu

SEQ ID NO: 16818 - RNA, 22 nt, Homo sapiens
auagcaauuugggaaucagacu

SEQ ID NO: 16819 - RNA, 22 nt, Homo sapiens
auagcacaugugcaaauggcug

SEQ ID NO: 16820 - RNA, 22 nt, Homo sapiens
auagcaucauuucuugaaaaga

SEQ ID NO: 16821 - RNA, 22 nt, Homo sapiens
auagugaacuuugugagaacaa

SEQ ID NO: 16822 - RNA, 22 nt, Homo sapiens
auagugcugcaacaaauauacg

SEQ ID NO: 16823 - RNA, 22 nt, Homo sapiens
auagugcugcaagaaacauacg

SEQ ID NO: 16824 - RNA, 22 nt, Homo sapiens
auagugcugcaauaaacauaug

SEQ ID NO: 16825 - RNA, 22 nt, Homo sapiens
auagugcugcacuaaacauaca

SEQ ID NO: 16826 - RNA, 22 nt, Homo sapiens
auagugcuuuuuagaaccugga

SEQ ID NO: 16827 - RNA, 22 nt, Homo sapiens
auauagcucuggcuggaugacu

SEQ ID NO: 16828 - RNA, 22 nt, Homo sapiens
auauaguguuuuuugguacgcu

SEQ ID NO: 16829 - RNA, 22 nt, Homo sapiens
auaucacaaacaagucuguacu

SEQ ID NO: 16830 - RNA, 22 nt, Homo sapiens
auaucacagguguuuaccugau

SEQ ID NO: 16831 - RNA, 22 nt, Homo sapiens
auauccaugccauagguuuuga

SEQ ID NO: 16832 - RNA, 22 nt, Homo sapiens
auaucccaguguguaaacacug

SEQ ID NO: 16833 - RNA, 20 nt, Homo sapiens
auaugcagacacauacauac

SEQ ID NO: 16834 - RNA, 22 nt, Homo sapiens
auauggucccuguucucaagga

SEQ ID NO: 16835 - RNA, 22 nt, Homo sapiens
auauuacagagaggaccuggga

SEQ ID NO: 16836 - RNA, 22 nt, Homo sapiens
auauuacuggccauaucgcagg

SEQ ID NO: 16837 - RNA, 22 nt, Homo sapiens
aucaaaugcuggcagagugccu

SEQ ID NO: 16838 - RNA, 22 nt, Homo sapiens
aucacaauuguacguaggagcc

SEQ ID NO: 16839 - RNA, 22 nt, Homo sapiens
aucacagcccuccucuuggaug

SEQ ID NO: 16840 - RNA, 22 nt, Homo sapiens
aucacagcuacuccucugucuu

SEQ ID NO: 16841 - RNA, 22 nt, Homo sapiens
aucacagguacuauggcugaca

SEQ ID NO: 16842 - RNA, 22 nt, Homo sapiens
aucacauggccuagccuaaccu

SEQ ID NO: 16843 - RNA, 22 nt, Homo sapiens
aucacauuuauaguggcacgca

SEQ ID NO: 16844 - RNA, 22 nt, Homo sapiens
aucaccagaugcuucaagcaga

SEQ ID NO: 16845 - RNA, 22 nt, Homo sapiens
aucacuguaaguuuacacuuug

SEQ ID NO: 16846 - RNA, 21 nt, Homo sapiens
aucagagacccaggcuuccuc

SEQ ID NO: 16847 - RNA, 22 nt, Homo sapiens
aucagagccugugugcccugaa

SEQ ID NO: 16848 - RNA, 22 nt, Homo sapiens
aucagcaguguaaaaacggacu

SEQ ID NO: 16849 - RNA, 22 nt, Homo sapiens
aucaggcacacauuggaguuug

SEQ ID NO: 16850 - RNA, 22 nt, Homo sapiens
aucagugaaagugaaaucuccg

SEQ ID NO: 16851 - RNA, 22 nt, Homo sapiens
aucagugcauaguauuuaauga

SEQ ID NO: 16852 - RNA, 22 nt, Homo sapiens
aucagugcauguuuguugagcu

SEQ ID NO: 16853 - RNA, 22 nt, Homo sapiens
aucauacuguuuugauuacugu

SEQ ID NO: 16854 - RNA, 22 nt, Homo sapiens
aucaucacaguuguguguaaug

SEQ ID NO: 16855 - RNA, 22 nt, Homo sapiens
aucaucaugcacuacagccugg

SEQ ID NO: 16856 - RNA, 22 nt, Homo sapiens
aucauguaguaagacacauuua

SEQ ID NO: 16857 - RNA, 22 nt, Homo sapiens
auccaguuuuaggagauuucua

SEQ ID NO: 16858 - RNA, 22 nt, Homo sapiens
auccauugucuaaugcuaagau

SEQ ID NO: 16859 - RNA, 22 nt, Homo sapiens
aucccuuccuagcacuuggugu

SEQ ID NO: 16860 - RNA, 22 nt, Homo sapiens
auccugaagcuuuacugaauuc

SEQ ID NO: 16861 - RNA, 22 nt, Homo sapiens
auccugagacuuuucugaaguu

SEQ ID NO: 16862 - RNA, 22 nt, Homo sapiens
auccugaugacacagugcugca

SEQ ID NO: 16863 - RNA, 21 nt, Homo sapiens
aucgcacaauauaccccugua

SEQ ID NO: 16864 - RNA, 22 nt, Homo sapiens
aucuaaaucucauaugggcaca

SEQ ID NO: 16865 - RNA, 22 nt, Homo sapiens
aucucauuccuucugggcugau

SEQ ID NO: 16866 - RNA, 22 nt, Homo sapiens
aucuccaggugccagcugcgcc

SEQ ID NO: 16867 - RNA, 22 nt, Homo sapiens
aucugcauuagggugaagaccu

SEQ ID NO: 16868 - RNA, 22 nt, Homo sapiens
aucuuguguugaauggugcaga

SEQ ID NO: 16869 - RNA, 22 nt, Homo sapiens
aucuuuggauacuugauauagu

SEQ ID NO: 16870 - RNA, 23 nt, Homo sapiens
augaaagcccuugcaaaugcugg

SEQ ID NO: 16871 - RNA, 22 nt, Homo sapiens
augaaagucaauccccaagugu

SEQ ID NO: 16872 - RNA, 22 nt, Homo sapiens
augaagagaaaguggaucuugg

SEQ ID NO: 16873 - RNA, 18 nt, Homo sapiens
augaagucaucacuuuua

SEQ ID NO: 16874 - RNA, 22 nt, Homo sapiens
augaauagaguuaauugaguac

SEQ ID NO: 16875 - RNA, 22 nt, Homo sapiens
augacaagagccuucuuuccuu

SEQ ID NO: 16876 - RNA, 22 nt, Homo sapiens
augacaguaugacuccaaaagu

SEQ ID NO: 16877 - RNA, 22 nt, Homo sapiens
augacagugagugagcucucac

SEQ ID NO: 16878 - RNA, 22 nt, Homo sapiens
augacauugaugcucuggcugg

SEQ ID NO: 16879 - RNA, 19 nt, Homo sapiens
augaccauuuccauaguau

SEQ ID NO: 16880 - RNA, 22 nt, Homo sapiens
augacccugaccuaagccaauc

SEQ ID NO: 16881 - RNA, 21 nt, Homo sapiens
augacccuggguguccuuucc

SEQ ID NO: 16882 - RNA, 22 nt, Homo sapiens
augacuaaaggguuuauguuga

SEQ ID NO: 16883 - RNA, 22 nt, Homo sapiens
augacuauugcacuuuccuggu

SEQ ID NO: 16884 - RNA, 22 nt, Homo sapiens
augacuggaacagcaauuuaca

SEQ ID NO: 16885 - RNA, 22 nt, Homo sapiens
augacuuuucugaaaaccacca

SEQ ID NO: 16886 - RNA, 22 nt, Homo sapiens
augagaccagcagaaaaccugu

SEQ ID NO: 16887 - RNA, 22 nt, Homo sapiens
augagcuccucaaggucagaga

SEQ ID NO: 16888 - RNA, 22 nt, Homo sapiens
augagcugauuuccuuaccaua

SEQ ID NO: 16889 - RNA, 22 nt, Homo sapiens
augagcuguuuggaagacacuu

SEQ ID NO: 16890 - RNA, 22 nt, Homo sapiens
augaggugggcggcuuggaaga

SEQ ID NO: 16891 - RNA, 21 nt, Homo sapiens
augagguguacuguggugaaa

SEQ ID NO: 16892 - RNA, 22 nt, Homo sapiens
augaguaguugcuaaauauuga

SEQ ID NO: 16893 - RNA, 19 nt, Homo sapiens
augaguuaggggaaauuuc

SEQ ID NO: 16894 - RNA, 22 nt, Homo sapiens
augauauuauucuagcccagag

SEQ ID NO: 16895 - RNA, 22 nt, Homo sapiens
augaucaucugaaagcuuuuac

SEQ ID NO: 16896 - RNA, 22 nt, Homo sapiens
augaugcugcaguuguugccaa

SEQ ID NO: 16897 - RNA, 22 nt, Homo sapiens
augauggaggccgugauggacg

SEQ ID NO: 16898 - RNA, 22 nt, Homo sapiens
augauuagaacucauuuccagg

SEQ ID NO: 16899 - RNA, 22 nt, Homo sapiens
augcaaaucuuaaguaugugug

SEQ ID NO: 16900 - RNA, 22 nt, Homo sapiens
augcauggucugaagucaaccu

SEQ ID NO: 16901 - RNA, 22 nt, Homo sapiens
auggaacauaacuauuugggga

SEQ ID NO: 16902 - RNA, 22 nt, Homo sapiens
auggaacauuauagauguaaaa

SEQ ID NO: 16903 - RNA, 22 nt, Homo sapiens
aaagugauguccaggcuuucag

SEQ ID NO: 16904 - RNA, 22 nt, Homo sapiens
aaagugcaguauuugggcagga

SEQ ID NO: 16905 - RNA, 22 nt, Homo sapiens
aaagugcugggaucacacugaa

SEQ ID NO: 16906 - RNA, 15 nt, Homo sapiens
aaauaugucaguucu

SEQ ID NO: 16907 - RNA, 22 nt, Homo sapiens
aaaugcacaaagauuuugcacu

SEQ ID NO: 16908 - RNA, 22 nt, Homo sapiens
aaaugcacgcuacccagcuaga

SEQ ID NO: 16909 - RNA, 22 nt, Homo sapiens
aaaugcagauucugcuuagguu

SEQ ID NO: 16910 - RNA, 22 nt, Homo sapiens
aaaugcagcacucaagugggaa

SEQ ID NO: 16911 - RNA, 22 nt, Homo sapiens
aaaugcaugaggugggaagaaa

SEQ ID NO: 16912 - RNA, 22 nt, Homo sapiens
aaaugcauugagggaaaaggca

SEQ ID NO: 16913 - RNA, 18 nt, Homo sapiens
aaaugcucuucuggaaua

SEQ ID NO: 16914 - RNA, 22 nt, Homo sapiens
aaaugcugucugugagccucau

SEQ ID NO: 16915 - RNA, 22 nt, Homo sapiens
aaaugcuucuauguggcauguu

SEQ ID NO: 16916 - RNA, 22 nt, Homo sapiens
aaauugcacaaguggugauuug

SEQ ID NO: 16917 - RNA, 22 nt, Homo sapiens
aacaggcuccuaggggugcacc

SEQ ID NO: 16918 - RNA, 22 nt, Homo sapiens
aacaguaucuaacgagugauga

SEQ ID NO: 16919 - RNA, 21 nt, Homo sapiens
aacagugcuuaguagauguuc

SEQ ID NO: 16920 - RNA, 22 nt, Homo sapiens
aaccugaagaaaauauuugcug

SEQ ID NO: 16921 - RNA, 22 nt, Homo sapiens
aaccuucauuccuuucccugcc

SEQ ID NO: 16922 - RNA, 22 nt, Homo sapiens
aacuacaucucuuugaggcagg

SEQ ID NO: 16923 - RNA, 22 nt, Homo sapiens
aacugcuguuuggguacuggug

SEQ ID NO: 16924 - RNA, 22 nt, Homo sapiens
aacuggcauagccagacuucuc

SEQ ID NO: 16925 - RNA, 22 nt, Homo sapiens
aacuggcauaugaacuuguucu

SEQ ID NO: 16926 - RNA, 22 nt, Homo sapiens
aacuggcauauucugguugcgg

SEQ ID NO: 16927 - RNA, 22 nt, Homo sapiens
aacuugcacuugauugagagcu

SEQ ID NO: 16928 - RNA, 22 nt, Homo sapiens
aagagcauuauuuaguaauuuc

SEQ ID NO: 16929 - RNA, 22 nt, Homo sapiens
aagagcucauccauaguuguca

SEQ ID NO: 16930 - RNA, 22 nt, Homo sapiens
aagaggcuguaggauaaugccu

SEQ ID NO: 16931 - RNA, 22 nt, Homo sapiens
aagagguagaagcuugccuucu

SEQ ID NO: 16932 - RNA, 22 nt, Homo sapiens
aagaugauguuguguuuucacu

SEQ ID NO: 16933 - RNA, 22 nt, Homo sapiens
aagaugcagucauacuggagga

SEQ ID NO: 16934 - RNA, 22 nt, Homo sapiens
aagcacaauuucaccuucuugu

SEQ ID NO: 16935 - RNA, 22 nt, Homo sapiens
aagcaccaauaggagauuuguc

SEQ ID NO: 16936 - RNA, 22 nt, Homo sapiens
aagcagauguguugaaaguacu

SEQ ID NO: 16937 - RNA, 20 nt, Homo sapiens
aagcauggguuuuaggguca

SEQ ID NO: 16938 - RNA, 22 nt, Homo sapiens
aagccacuguaccugucucuua

SEQ ID NO: 16939 - RNA, 22 nt, Homo sapiens
aagcuggcauucauucguucuu

SEQ ID NO: 16940 - RNA, 22 nt, Homo sapiens
aagcuggcuuucauugagugcu

SEQ ID NO: 16941 - RNA, 22 nt, Homo sapiens
aagcugguguugcugcucuguu

SEQ ID NO: 16942 - RNA, 22 nt, Homo sapiens
aagcugugucuugucagcuacc

SEQ ID NO: 16943 - RNA, 23 nt, Homo sapiens
aaggacacugaacacuucccagc

SEQ ID NO: 16944 - RNA, 22 nt, Homo sapiens
aaggagcagagagcccuguuuc

SEQ ID NO: 16945 - RNA, 22 nt, Homo sapiens
aaggagcaguggacggguccua

SEQ ID NO: 16946 - RNA, 22 nt, Homo sapiens
aaggaguagaggaauagcaaug

SEQ ID NO: 16947 - RNA, 22 nt, Homo sapiens
aaggcaugcaaagaacauuuua

SEQ ID NO: 16948 - RNA, 22 nt, Homo sapiens
aaggcauucucaaacuaguucu

SEQ ID NO: 16949 - RNA, 22 nt, Homo sapiens
aaggcuagagaagaagggcauc

SEQ ID NO: 16950 - RNA, 22 nt, Homo sapiens
aagggaauguuguagcugguuu

SEQ ID NO: 16951 - RNA, 22 nt, Homo sapiens
aagguggugucagagagcuuau

SEQ ID NO: 16952 - RNA, 22 nt, Homo sapiens
aaguaaacauugagagacaaga

SEQ ID NO: 16953 - RNA, 19 nt, Homo sapiens
aaguacuugucuuuugaag

SEQ ID NO: 16954 - RNA, 22 nt, Homo sapiens
aagucaguuugggagaagcuau

SEQ ID NO: 16955 - RNA, 22 nt, Homo sapiens
aagugaaugaugugaaguguaa

SEQ ID NO: 16956 - RNA, 21 nt, Homo sapiens
aagugcucugggacucuaaau

SEQ ID NO: 16957 - RNA, 22 nt, Homo sapiens
aaguggcauugaggaaaaaaau

SEQ ID NO: 16958 - RNA, 23 nt, Homo sapiens
aaguucaugcucaucuguuacac

SEQ ID NO: 16959 - RNA, 22 nt, Homo sapiens
aauaaagcagcuuuuugggacu

SEQ ID NO: 16960 - RNA, 22 nt, Homo sapiens
aauaaaguaggaggugaggaaa

SEQ ID NO: 16961 - RNA, 22 nt, Homo sapiens
aauaagcauaguaccugauagg

SEQ ID NO: 16962 - RNA, 22 nt, Homo sapiens
aauaaugucacaggggguuagc

SEQ ID NO: 16963 - RNA, 22 nt, Homo sapiens
aaucacaggucuuggcugcaug

SEQ ID NO: 16964 - RNA, 22 nt, Homo sapiens
aaucacuaugccaugaaguaca

SEQ ID NO: 16965 - RNA, 22 nt, Homo sapiens
aauccuguagauucuaauuccu

SEQ ID NO: 16966 - RNA, 20 nt, Homo sapiens
aaucuacuugcccauuuagc

SEQ ID NO: 16967 - RNA, 22 nt, Homo sapiens
aaucugucuuuuguuauugagg

SEQ ID NO: 16968 - RNA, 22 nt, Homo sapiens
aaugcaagauguuaauuauagg

SEQ ID NO: 16969 - RNA, 22 nt, Homo sapiens
aaugcauaauuuguaugaggua

SEQ ID NO: 16970 - RNA, 22 nt, Homo sapiens
aauggcacacaccuggucuaac

SEQ ID NO: 16971 - RNA, 22 nt, Homo sapiens
aauucuguauuguuuagggacu

SEQ ID NO: 16972 - RNA, 22 nt, Homo sapiens
aauucugugagauggugcagau

SEQ ID NO: 16973 - RNA, 22 nt, Homo sapiens
aauugcauaugcaguagaucua

SEQ ID NO: 16974 - RNA, 22 nt, Homo sapiens
aauugcuuuuauuuagggccag

SEQ ID NO: 16975 - RNA, 22 nt, Homo sapiens
acaaaguguuuucugaaggccu

SEQ ID NO: 16976 - RNA, 22 nt, Homo sapiens
acaagcacaaauuuaauccugu

SEQ ID NO: 16977 - RNA, 22 nt, Homo sapiens
acacaguaaauauguauugaau

SEQ ID NO: 16978 - RNA, 22 nt, Homo sapiens
acacaguaagcacaguguagau

SEQ ID NO: 16979 - RNA, 22 nt, Homo sapiens
acacugcugaguaaauaauuuu

SEQ ID NO: 16980 - RNA, 22 nt, Homo sapiens
acacuggaggagagcuguugcu

SEQ ID NO: 16981 - RNA, 22 nt, Homo sapiens
acacuguacuuauguuuugcag

SEQ ID NO: 16982 - RNA, 23 nt, Homo sapiens
acacuugcugaguaaaucaaaua

SEQ ID NO: 16983 - RNA, 22 nt, Homo sapiens
acacuuucuagacaagggaaua

SEQ ID NO: 16984 - RNA, 22 nt, Homo sapiens
acagaucagagauauuuagguu

SEQ ID NO: 16985 - RNA, 20 nt, Homo sapiens
acagcacugguuucaagcaa

SEQ ID NO: 16986 - RNA, 22 nt, Homo sapiens
ggagucugacuuauaggaaccu

SEQ ID NO: 16987 - RNA, 22 nt, Homo sapiens
ggagugucagaaacaguguccu

SEQ ID NO: 16988 - RNA, 22 nt, Homo sapiens
ggauugugauaauuguugcaaa

SEQ ID NO: 16989 - RNA, 22 nt, Homo sapiens
ggauuuguuggcauuagugaug

SEQ ID NO: 16990 - RNA, 23 nt, Homo sapiens
ggcaagaucucagcucacugcaa

SEQ ID NO: 16991 - RNA, 22 nt, Homo sapiens
ggcaaggaggggcacuuucacu

SEQ ID NO: 16992 - RNA, 22 nt, Homo sapiens
ggcaagugucagcagcaacacc

SEQ ID NO: 16993 - RNA, 22 nt, Homo sapiens
ggcaaguugcuauucuuuaaug

SEQ ID NO: 16994 - RNA, 19 nt, Homo sapiens
ggcaccuuuuccaaaaaug

SEQ ID NO: 16995 - RNA, 22 nt, Homo sapiens
ggcacugugaugugagggggua

SEQ ID NO: 16996 - RNA, 22 nt, Homo sapiens
ggcaguuucucaggcaggggua

SEQ ID NO: 16997 - RNA, 22 nt, Homo sapiens
ggcaguuuguucuugcuccuuu

SEQ ID NO: 16998 - RNA, 21 nt, Homo sapiens
ggcaugaauggaaaagugaga

SEQ ID NO: 16999 - RNA, 22 nt, Homo sapiens
ggcccugauacaaguaaggucu

SEQ ID NO: 17000 - RNA, 22 nt, Homo sapiens
ggcgguguugauggcccccaca

SEQ ID NO: 17001 - RNA, 22 nt, Homo sapiens
ggcuagagagcucagggauaug

SEQ ID NO: 17002 - RNA, 18 nt, Homo sapiens
ggcugguguuuuaguaua

SEQ ID NO: 17003 - RNA, 22 nt, Homo sapiens
ggcuuggaggaaugugagggcu

SEQ ID NO: 17004 - RNA, 22 nt, Homo sapiens
gggaaauguaaagucauaagau

SEQ ID NO: 17005 - RNA, 22 nt, Homo sapiens
gggaagugugcagaguucucuu

SEQ ID NO: 17006 - RNA, 22 nt, Homo sapiens
gggaagugugguuucuuuacag

SEQ ID NO: 17007 - RNA, 22 nt, Homo sapiens
gggaugaagaagaauaguucgu

SEQ ID NO: 17008 - RNA, 22 nt, Homo sapiens
gggcauugugggcagagggcag

SEQ ID NO: 17009 - RNA, 22 nt, Homo sapiens
ggggaguguggacaucacccug

SEQ ID NO: 17010 - RNA, 22 nt, Homo sapiens
ggggcaaaaugccacgagucuc

SEQ ID NO: 17011 - RNA, 22 nt, Homo sapiens
gguagacucuguaagugaucau

SEQ ID NO: 17012 - RNA, 22 nt, Homo sapiens
ggucacauuggacuaucaaguu

SEQ ID NO: 17013 - RNA, 22 nt, Homo sapiens
ggugacagugguuaaaauuugu

SEQ ID NO: 17014 - RNA, 22 nt, Homo sapiens
ggugagaaaaacauagucucag

SEQ ID NO: 17015 - RNA, 21 nt, Homo sapiens
ggugagaaaggagacauagac

SEQ ID NO: 17016 - RNA, 22 nt, Homo sapiens
ggugaggaaaguugaguuucua

SEQ ID NO: 17017 - RNA, 22 nt, Homo sapiens
ggugaucauugucucuaguaug

SEQ ID NO: 17018 - RNA, 22 nt, Homo sapiens
ggugucaguuggccccuacugg

SEQ ID NO: 17019 - RNA, 22 nt, Homo sapiens
guaaaugcagaugcaugaccuu

SEQ ID NO: 17020 - RNA, 22 nt, Homo sapiens
guaaucucagcuacucaggagg

SEQ ID NO: 17021 - RNA, 22 nt, Homo sapiens
guaaucucagcuacucgggaga

SEQ ID NO: 17022 - RNA, 22 nt, Homo sapiens
guacaugugcacagugugcagg

SEQ ID NO: 17023 - RNA, 22 nt, Homo sapiens
guacuuuguuauaacccacagg

SEQ ID NO: 17024 - RNA, 22 nt, Homo sapiens
guagcagcuacuaaguugcugu

SEQ ID NO: 17025 - RNA, 22 nt, Homo sapiens
guauggaagucaguuuguuggc

SEQ ID NO: 17026 - RNA, 22 nt, Homo sapiens
guaugugcauuguaaauuuuga

SEQ ID NO: 17027 - RNA, 19 nt, Homo sapiens
guauuugacuuucuuguuu

SEQ ID NO: 17028 - RNA, 22 nt, Homo sapiens
gucaaagugauuguaauuaggu

SEQ ID NO: 17029 - RNA, 22 nt, Homo sapiens
gucaacauauuaauuauguucu

SEQ ID NO: 17030 - RNA, 22 nt, Homo sapiens
gucaaggaauuuauccauuucu

SEQ ID NO: 17031 - RNA, 22 nt, Homo sapiens
gucacagcacuuuuaguaagug

SEQ ID NO: 17032 - RNA, 22 nt, Homo sapiens
gucacagcuggcauugucugca

SEQ ID NO: 17033 - RNA, 22 nt, Homo sapiens
gucacaguguuuguucauccca

SEQ ID NO: 17034 - RNA, 22 nt, Homo sapiens
gucaccagcuguguuagccccu

SEQ ID NO: 17035 - RNA, 22 nt, Homo sapiens
gucacugucuacuguaauagcc

SEQ ID NO: 17036 - RNA, 22 nt, Homo sapiens
gucagguaccugaaagcagcca

SEQ ID NO: 17037 - RNA, 22 nt, Homo sapiens
gucauaugcucggaaaauguua

SEQ ID NO: 17038 - RNA, 22 nt, Homo sapiens
gucauccaggcuggagugaagc

SEQ ID NO: 17039 - RNA, 22 nt, Homo sapiens
gucauggagggacauaacuaac

SEQ ID NO: 17040 - RNA, 22 nt, Homo sapiens
gucauucauucagcaagcacug

SEQ ID NO: 17041 - RNA, 22 nt, Homo sapiens
gucgguguuuccugagaacgaa

SEQ ID NO: 17042 - RNA, 22 nt, Homo sapiens
gucuaugagucccugaauuuaa

SEQ ID NO: 17043 - RNA, 22 nt, Homo sapiens
gucucacaggcaugaugccagc

SEQ ID NO: 17044 - RNA, 22 nt, Homo sapiens
gucugguugacagcauguggcc

SEQ ID NO: 17045 - RNA, 22 nt, Homo sapiens
gucugugguuccuaugucaccu

SEQ ID NO: 17046 - RNA, 20 nt, Homo sapiens
gucuugcuccguugcccagg

SEQ ID NO: 17047 - RNA, 22 nt, Homo sapiens
gucuuggcaugugcagcuggga

SEQ ID NO: 17048 - RNA, 22 nt, Homo sapiens
gucuuugcuuuuaaccagaggu

SEQ ID NO: 17049 - RNA, 22 nt, Homo sapiens
gucuuuggaaagacaaaguuca

SEQ ID NO: 17050 - RNA, 22 nt, Homo sapiens
gucuuuugcuagccagagagcu

SEQ ID NO: 17051 - RNA, 22 nt, Homo sapiens
gugaaauacauaaucccaagug

SEQ ID NO: 17052 - RNA, 17 nt, Homo sapiens
gugaaaucaucauuuuu

SEQ ID NO: 17053 - RNA, 22 nt, Homo sapiens
gugaacuguuugaggaagagaa

SEQ ID NO: 17054 - RNA, 22 nt, Homo sapiens
gugaagaugugcaucagaucca

SEQ ID NO: 17055 - RNA, 22 nt, Homo sapiens
gugaccauuugacauauccuug

SEQ ID NO: 17056 - RNA, 22 nt, Homo sapiens
gugagaagaaaaauauggcugu

SEQ ID NO: 17057 - RNA, 22 nt, Homo sapiens
cuggaaaguagacaaucuaaaa

SEQ ID NO: 17058 - RNA, 22 nt, Homo sapiens
cuggaagaaaaucacgccaucu

SEQ ID NO: 17059 - RNA, 18 nt, Homo sapiens
cuggaaggcuacuacagu

SEQ ID NO: 17060 - RNA, 22 nt, Homo sapiens
cuggagaucuugacauugaagu

SEQ ID NO: 17061 - RNA, 22 nt, Homo sapiens
cuggaguaugaaccauguauca

SEQ ID NO: 17062 - RNA, 22 nt, Homo sapiens
cuggaguuugaggcugcaguga

SEQ ID NO: 17063 - RNA, 22 nt, Homo sapiens
cuggauagucaggagauauaua

SEQ ID NO: 17064 - RNA, 20 nt, Homo sapiens
cuggaugucgaggcagaggu

SEQ ID NO: 17065 - RNA, 18 nt, Homo sapiens
cuggaugucgaguguguu

SEQ ID NO: 17066 - RNA, 22 nt, Homo sapiens
cuggcaaaaagagggcaauaau

SEQ ID NO: 17067 - RNA, 22 nt, Homo sapiens
cuggccagagacauucauuaaa

SEQ ID NO: 17068 - RNA, 22 nt, Homo sapiens
cugggaugauguaaauaggcua

SEQ ID NO: 17069 - RNA, 22 nt, Homo sapiens
cugggaugugacuguugccccc

SEQ ID NO: 17070 - RNA, 22 nt, Homo sapiens
cuggugauugguuucauucagu

SEQ ID NO: 17071 - RNA, 22 nt, Homo sapiens
cugguuguuacaugcuugccag

SEQ ID NO: 17072 - RNA, 22 nt, Homo sapiens
cugguuuguaaaguuccugaga

SEQ ID NO: 17073 - RNA, 22 nt, Homo sapiens
cuguaaaguaagagguaaguua

SEQ ID NO: 17074 - RNA, 22 nt, Homo sapiens
cuguaacagaauaaauuuguuu

SEQ ID NO: 17075 - RNA, 22 nt, Homo sapiens
cuguagacauuaggccugcacu

SEQ ID NO: 17076 - RNA, 22 nt, Homo sapiens
cugucaucauuucuaugugcca

SEQ ID NO: 17077 - RNA, 22 nt, Homo sapiens
cugugcuugagagaugacacag

SEQ ID NO: 17078 - RNA, 22 nt, Homo sapiens
cugugcuugauuauaugagugu

SEQ ID NO: 17079 - RNA, 22 nt, Homo sapiens
cuguggauguauugcacagucu

SEQ ID NO: 17080 - RNA, 22 nt, Homo sapiens
cuuaacagugguauugaugacc

SEQ ID NO: 17081 - RNA, 22 nt, Homo sapiens
cuucaugucuucaauggggggg

SEQ ID NO: 17082 - RNA, 22 nt, Homo sapiens
cuuccaaguggggcacgugcca

SEQ ID NO: 17083 - RNA, 22 nt, Homo sapiens
cuuccaguggcagccgggcaug

SEQ ID NO: 17084 - RNA, 22 nt, Homo sapiens
cuuccauaguauuuuuacaaaa

SEQ ID NO: 17085 - RNA, 22 nt, Homo sapiens
cuuccauaguuacacccaggga

SEQ ID NO: 17086 - RNA, 22 nt, Homo sapiens
cuucuugagacuuaggcuuugg

SEQ ID NO: 17087 - RNA, 23 nt, Homo sapiens
cuugagacaaaugcgugugugca

SEQ ID NO: 17088 - RNA, 18 nt, Homo sapiens
cuuugcagcuuccagagg

SEQ ID NO: 17089 - RNA, 21 nt, Homo sapiens
cuuugguagaguuuuuagggu

SEQ ID NO: 17090 - RNA, 22 nt, Homo sapiens
cuuuggucaauugcugcgggga

SEQ ID NO: 17091 - RNA, 20 nt, Homo sapiens
cuuuggugagucaacuccuu

SEQ ID NO: 17092 - RNA, 23 nt, Homo sapiens
cuuuugcaaugugaucuugccac

SEQ ID NO: 17093 - RNA, 22 nt, Homo sapiens
cuuuuugcugcagcaauacugg

SEQ ID NO: 17094 - RNA, 22 nt, Homo sapiens
gacauuaucagguuuguuuucu

SEQ ID NO: 17095 - RNA, 21 nt, Homo sapiens
gaccacagcagggaaugucag

SEQ ID NO: 17096 - RNA, 22 nt, Homo sapiens
gaccacauuccacacaggcuuu

SEQ ID NO: 17097 - RNA, 22 nt, Homo sapiens
gaccugagagguacauguauuu

SEQ ID NO: 17098 - RNA, 22 nt, Homo sapiens
gacuaguuaggucucucacaga

SEQ ID NO: 17099 - RNA, 22 nt, Homo sapiens
gacucagaacuaaggguguuuc

SEQ ID NO: 17100 - RNA, 22 nt, Homo sapiens
gagaaguaaauuuauuugcaaa

SEQ ID NO: 17101 - RNA, 20 nt, Homo sapiens
gagaccugagauucacucaa

SEQ ID NO: 17102 - RNA, 22 nt, Homo sapiens
gagacggagucucgcucugucg

SEQ ID NO: 17103 - RNA, 22 nt, Homo sapiens
gagacggagucuugcucuguug

SEQ ID NO: 17104 - RNA, 22 nt, Homo sapiens
gagacugagucucacucuguca

SEQ ID NO: 17105 - RNA, 22 nt, Homo sapiens
gagacugagucucgcucugccg

SEQ ID NO: 17106 - RNA, 22 nt, Homo sapiens
gagacugagucuugcucugucg

SEQ ID NO: 17107 - RNA, 22 nt, Homo sapiens
gagacugaguuuugcucuuguu

SEQ ID NO: 17108 - RNA, 22 nt, Homo sapiens
gagauacacccagugcagaggc

SEQ ID NO: 17109 - RNA, 22 nt, Homo sapiens
gagaucuucguguggggagaca

SEQ ID NO: 17110 - RNA, 22 nt, Homo sapiens
gagaugaaaucuugcucuguca

SEQ ID NO: 17111 - RNA, 20 nt, Homo sapiens
gagauguugaucagggcuau

SEQ ID NO: 17112 - RNA, 22 nt, Homo sapiens
gagcaucaguggccucaucuca

SEQ ID NO: 17113 - RNA, 22 nt, Homo sapiens
gagcaucauucaacaaaagucu

SEQ ID NO: 17114 - RNA, 22 nt, Homo sapiens
gagcugaucuuuauguaaauuc

SEQ ID NO: 17115 - RNA, 22 nt, Homo sapiens
gaggaaguagcuacugucuuuc

SEQ ID NO: 17116 - RNA, 22 nt, Homo sapiens
gaggcagucugacccuuagcag

SEQ ID NO: 17117 - RNA, 22 nt, Homo sapiens
gaggguguuguguugcuuaaua

SEQ ID NO: 17118 - RNA, 22 nt, Homo sapiens
gagguaaguaagaauggcaagc

SEQ ID NO: 17119 - RNA, 22 nt, Homo sapiens
gagguaaguggauuaugagguc

SEQ ID NO: 17120 - RNA, 22 nt, Homo sapiens
gagguagggucccacuauguug

SEQ ID NO: 17121 - RNA, 22 nt, Homo sapiens
gagguauggauaucuggagagg

SEQ ID NO: 17122 - RNA, 22 nt, Homo sapiens
gaggucaggacauuuuugcuuu

SEQ ID NO: 17123 - RNA, 22 nt, Homo sapiens
gaggucaugucgggccccagga

SEQ ID NO: 17124 - RNA, 22 nt, Homo sapiens
gaggugaaggucucaauaaaua

SEQ ID NO: 17125 - RNA, 22 nt, Homo sapiens
gaggugguagguucacagcagc

SEQ ID NO: 17126 - RNA, 22 nt, Homo sapiens
gaguaaaugucaaguacuuagg

SEQ ID NO: 17127 - RNA, 22 nt, Homo sapiens
gaguaaauguccuagcuucuug

SEQ ID NO: 17128 - RNA, 22 nt, Homo sapiens
gaguaacagcauaaauuuguga

SEQ ID NO: 17129 - RNA, 22 nt, Homo sapiens
gaguauguauaugagugugucu

SEQ ID NO: 17130 - RNA, 22 nt, Homo sapiens
gagucagugucuugcucuguca

SEQ ID NO: 17131 - RNA, 22 nt, Homo sapiens
gaguucauaucuaugagugugc

SEQ ID NO: 17132 - RNA, 22 nt, Homo sapiens
gauaaaguauuggguacuaugc

SEQ ID NO: 17133 - RNA, 22 nt, Homo sapiens
gauaaaucuuggcuagucuaag

SEQ ID NO: 17134 - RNA, 18 nt, Homo sapiens
gauaacaguggacuaugc

SEQ ID NO: 17135 - RNA, 22 nt, Homo sapiens
gauaagagaugauuuugccaug

SEQ ID NO: 17136 - RNA, 22 nt, Homo sapiens
gauaauucuagcagauacaggc

SEQ ID NO: 17137 - RNA, 22 nt, Homo sapiens
gauacaccauuuucuagcuauu

SEQ ID NO: 17138 - RNA, 22 nt, Homo sapiens
gauacaguaugcaugugguauu

SEQ ID NO: 17139 - RNA, 22 nt, Homo sapiens
gauagcagccauucuuuuuauu

SEQ ID NO: 17140 - RNA, 22 nt, Homo sapiens
gauagcauucaauuaucuguug

SEQ ID NO: 17141 - RNA, 21 nt, Homo sapiens
gauaucuuuauucccaagagc

SEQ ID NO: 17142 - RNA, 22 nt, Homo sapiens
gauauguaguaguugaaaaaga

SEQ ID NO: 17143 - RNA, 22 nt, Homo sapiens
gaucaauuggcugaagacacgu

SEQ ID NO: 17144 - RNA, 22 nt, Homo sapiens
gaugaaacaucuuuggaaacug

SEQ ID NO: 17145 - RNA, 22 nt, Homo sapiens
gauggaauuaaaaucagaauca

SEQ ID NO: 17146 - RNA, 22 nt, Homo sapiens
gauggcauuucuggaucugccc

SEQ ID NO: 17147 - RNA, 22 nt, Homo sapiens
gauggcucugcaggugagggua

SEQ ID NO: 17148 - RNA, 22 nt, Homo sapiens
gauguguugggaagauuucaag

SEQ ID NO: 17149 - RNA, 22 nt, Homo sapiens
gauguguuuuaggaucucagca

SEQ ID NO: 17150 - RNA, 22 nt, Homo sapiens
gauguuguuuagccuuugaugu

SEQ ID NO: 17151 - RNA, 22 nt, Homo sapiens
gauuagcacuucaguuacagua

SEQ ID NO: 17152 - RNA, 22 nt, Homo sapiens
gauuggcauugcugcaccugag

SEQ ID NO: 17153 - RNA, 22 nt, Homo sapiens
gcaaaguguuuuuaggaagucu

SEQ ID NO: 17154 - RNA, 23 nt, Homo sapiens
gcaaauaucguagagugucccug

SEQ ID NO: 17155 - RNA, 22 nt, Homo sapiens
gcaaaucuuauguccucacauu

SEQ ID NO: 17156 - RNA, 22 nt, Homo sapiens
gcaagaguauuucaaggaagau

SEQ ID NO: 17157 - RNA, 22 nt, Homo sapiens
gcacugggccacauuuauuuuc

SEQ ID NO: 17158 - RNA, 22 nt, Homo sapiens
gcagaucuucgcgguaaguguu

SEQ ID NO: 17159 - RNA, 23 nt, Homo sapiens
gcagcaaugucacagggguccgg

SEQ ID NO: 17160 - RNA, 22 nt, Homo sapiens
gcagcagugcccuggauggaaa

SEQ ID NO: 17161 - RNA, 22 nt, Homo sapiens
gcagcauuaccaagacauggca

SEQ ID NO: 17162 - RNA, 22 nt, Homo sapiens
gcaggaaucuugagaaggauuc

SEQ ID NO: 17163 - RNA, 22 nt, Homo sapiens
gcaguagugugaucuuggcuca

SEQ ID NO: 17164 - RNA, 22 nt, Homo sapiens
gcagugcaguggcgcgaucucg

SEQ ID NO: 17165 - RNA, 22 nt, Homo sapiens
uagagaucuuauauuuuaugac

SEQ ID NO: 17166 - RNA, 22 nt, Homo sapiens
uagagguagagugacuucccca

SEQ ID NO: 17167 - RNA, 22 nt, Homo sapiens
uagagguaggucuucgagucuc

SEQ ID NO: 17168 - RNA, 21 nt, Homo sapiens
uagauacuguauuaaaccuag

SEQ ID NO: 17169 - RNA, 19 nt, Homo sapiens
uagaugucuuugcauagau

SEQ ID NO: 17170 - RNA, 22 nt, Homo sapiens
uagauuaucucaccacucgagu

SEQ ID NO: 17171 - RNA, 22 nt, Homo sapiens
uagcacagggaauugguucucu

SEQ ID NO: 17172 - RNA, 20 nt, Homo sapiens
uagcacaucuggcuguagag

SEQ ID NO: 17173 - RNA, 22 nt, Homo sapiens
uagcaccacaaucaagauacag

SEQ ID NO: 17174 - RNA, 22 nt, Homo sapiens
uagcagcaccccacucuacugg

SEQ ID NO: 17175 - RNA, 18 nt, Homo sapiens
uagcaugaugcugagugc

SEQ ID NO: 17176 - RNA, 22 nt, Homo sapiens
uagcauggaggcggccauagug

SEQ ID NO: 17177 - RNA, 22 nt, Homo sapiens
uagcugagacuacaguaggugc

SEQ ID NO: 17178 - RNA, 22 nt, Homo sapiens
uagcuucuccauagcuccaugu

SEQ ID NO: 17179 - RNA, 22 nt, Homo sapiens
uaggcaaaugcaagaguagaac

SEQ ID NO: 17180 - RNA, 19 nt, Homo sapiens
uagggcacgaggcagaguc

SEQ ID NO: 17181 - RNA, 22 nt, Homo sapiens
uaggucuuuuaugaaauauauu

SEQ ID NO: 17182 - RNA, 22 nt, Homo sapiens
uaggugguuugaaauacucaag

SEQ ID NO: 17183 - RNA, 22 nt, Homo sapiens
uaguaaacauuuuucuaucauu

SEQ ID NO: 17184 - RNA, 21 nt, Homo sapiens
uagugcagugggguaugacuu

SEQ ID NO: 17185 - RNA, 22 nt, Homo sapiens
uaguuaguagacucugauuauu

SEQ ID NO: 17186 - RNA, 22 nt, Homo sapiens
uaguugcauucaggauaugacg

SEQ ID NO: 17187 - RNA, 22 nt, Homo sapiens
uauagcauuuugauccuguaga

SEQ ID NO: 17188 - RNA, 22 nt, Homo sapiens
uauagcuaugggauguauuugc

SEQ ID NO: 17189 - RNA, 22 nt, Homo sapiens
uaucacacaucaugguaaaucu

SEQ ID NO: 17190 - RNA, 21 nt, Homo sapiens
uaucacaguagaauaggaucu

SEQ ID NO: 17191 - RNA, 22 nt, Homo sapiens
uaucacaguaucuagcacagug

SEQ ID NO: 17192 - RNA, 20 nt, Homo sapiens
uaucacaguucaggaacucu

SEQ ID NO: 17193 - RNA, 22 nt, Homo sapiens
uaucaccauguccguuuuaaaa

SEQ ID NO: 17194 - RNA, 22 nt, Homo sapiens
uaucagauugcugccaucugcu

SEQ ID NO: 17195 - RNA, 22 nt, Homo sapiens
uaucaucauguuuuugcugugu

SEQ ID NO: 17196 - RNA, 22 nt, Homo sapiens
uaucccaauguaauaucacaaa

SEQ ID NO: 17197 - RNA, 22 nt, Homo sapiens
uaucccuguggacuucccaaca

SEQ ID NO: 17198 - RNA, 20 nt, Homo sapiens
uaucuacuugcaaaugccau

SEQ ID NO: 17199 - RNA, 22 nt, Homo sapiens
uaucucacauauucaguagguu

SEQ ID NO: 17200 - RNA, 22 nt, Homo sapiens
uaugaagccaggauuuauuauu

SEQ ID NO: 17201 - RNA, 22 nt, Homo sapiens
uaugaauuuuauccaggauaua

SEQ ID NO: 17202 - RNA, 18 nt, Homo sapiens
uuuugcuuaacugcgcca

SEQ ID NO: 17203 - RNA, 22 nt, Homo sapiens
uuuugcuuuuccucggucccac

SEQ ID NO: 17204 - RNA, 17 nt, Homo sapiens
uuuuggauuagaaaucc

SEQ ID NO: 17205 - RNA, 22 nt, Homo sapiens
uuuuggcuuuuccucagcaagc

SEQ ID NO: 17206 - RNA, 22 nt, Homo sapiens
uuuugguauaugcaggggucuu

SEQ ID NO: 17207 - RNA, 22 nt, Homo sapiens
uuuuguacgccuguguccauca

SEQ ID NO: 17208 - RNA, 22 nt, Homo sapiens
uuuugugacuauuguaaauggg

SEQ ID NO: 17209 - RNA, 18 nt, Homo sapiens
uuuuugaggcacagggga

SEQ ID NO: 17210 - RNA, 22 nt, Homo sapiens
uuuuugagguauaguguggcua

SEQ ID NO: 17211 - RNA, 22 nt, Homo sapiens
uuuuugaguaaauauaaauugu

SEQ ID NO: 17212 - RNA, 16 nt, Homo sapiens
uuuuugcagaaaugac

SEQ ID NO: 17213 - RNA, 22 nt, Homo sapiens
uuuuuggauaaugguacaugua

SEQ ID NO: 17214 - RNA, 21 nt, Homo sapiens
uuuuugguggucauggauaga

SEQ ID NO: 17215 - RNA, 22 nt, Homo sapiens
ugucaaggaaugucauugguuu

SEQ ID NO: 17216 - RNA, 22 nt, Homo sapiens
ugucaauauguaauaacugaau

SEQ ID NO: 17217 - RNA, 22 nt, Homo sapiens
ugucacaguuuguacuuuauag

SEQ ID NO: 17218 - RNA, 22 nt, Homo sapiens
ugucacccuuuauccauuuccu

SEQ ID NO: 17219 - RNA, 22 nt, Homo sapiens
ugucaguggacugugaaaggca

SEQ ID NO: 17220 - RNA, 22 nt, Homo sapiens
ugucaguuucuugagauggaac

SEQ ID NO: 17221 - RNA, 21 nt, Homo sapiens
ugucaugcagagacccuggag

SEQ ID NO: 17222 - RNA, 22 nt, Homo sapiens
uguccaguguuccucagaagaa

SEQ ID NO: 17223 - RNA, 22 nt, Homo sapiens
uguccugcagagguguuugccu

SEQ ID NO: 17224 - RNA, 22 nt, Homo sapiens
ugucucaguucccuucucugga

SEQ ID NO: 17225 - RNA, 22 nt, Homo sapiens
ugucucaguuucuguggguuag

SEQ ID NO: 17226 - RNA, 22 nt, Homo sapiens
ugucuuggagaauccuggguuu

SEQ ID NO: 17227 - RNA, 22 nt, Homo sapiens
ugugaaacauggauagaacugg

SEQ ID NO: 17228 - RNA, 19 nt, Homo sapiens
ugugaacaucacagagugu

SEQ ID NO: 17229 - RNA, 22 nt, Homo sapiens
ugugaacaugacagugggcuag

SEQ ID NO: 17230 - RNA, 22 nt, Homo sapiens
ugugaaccucuggccaagauga

SEQ ID NO: 17231 - RNA, 22 nt, Homo sapiens
ugugaagaaagucauugguagc

SEQ ID NO: 17232 - RNA, 19 nt, Homo sapiens
ugugaagaaaugcugcaag

SEQ ID NO: 17233 - RNA, 22 nt, Homo sapiens
ugugaagaugagaugacgcccu

SEQ ID NO: 17234 - RNA, 22 nt, Homo sapiens
ugugaagauggacuaauauagu

SEQ ID NO: 17235 - RNA, 22 nt, Homo sapiens
ugugacagcacagcaucucuuu

SEQ ID NO: 17236 - RNA, 22 nt, Homo sapiens
ugugagcuauggaguuguagag

SEQ ID NO: 17237 - RNA, 22 nt, Homo sapiens
ugugaugaagaguccaagaaca

SEQ ID NO: 17238 - RNA, 22 nt, Homo sapiens
ugugauguggagggcagaucca

SEQ ID NO: 17239 - RNA, 22 nt, Homo sapiens
ugugcaaucuuccauuuuuagg

SEQ ID NO: 17240 - RNA, 22 nt, Homo sapiens
ugugcacaacgugcagguuugu

SEQ ID NO: 17241 - RNA, 22 nt, Homo sapiens
ugugcacaauguacagguuagu

SEQ ID NO: 17242 - RNA, 22 nt, Homo sapiens
ugugcauauaaguguguauaua

SEQ ID NO: 17243 - RNA, 22 nt, Homo sapiens
ugugccuucuaagaaggagucu

SEQ ID NO: 17244 - RNA, 22 nt, Homo sapiens
ugugcuugaauuuaguagcuua

SEQ ID NO: 17245 - RNA, 22 nt, Homo sapiens
uguggaaauaaaagaaagguua

SEQ ID NO: 17246 - RNA, 22 nt, Homo sapiens
uguggcagugcuuuaugaaacc

SEQ ID NO: 17247 - RNA, 22 nt, Homo sapiens
uguggcucuucuguucuccacu

SEQ ID NO: 17248 - RNA, 22 nt, Homo sapiens
ugugguccucugaaggcuuuuc

SEQ ID NO: 17249 - RNA, 22 nt, Homo sapiens
ugugguuuuaguaaaacuaugu

SEQ ID NO: 17250 - RNA, 22 nt, Homo sapiens
ugugguuuuucacauuuagaga

SEQ ID NO: 17251 - RNA, 22 nt, Homo sapiens
uguuaagaugucaauuuuccac

SEQ ID NO: 17252 - RNA, 22 nt, Homo sapiens
uugagcuauguacagaugcugu

SEQ ID NO: 17253 - RNA, 22 nt, Homo sapiens
uugaggaaugugauuucaaaua

SEQ ID NO: 17254 - RNA, 16 nt, Homo sapiens
uugaggcaugucucag

SEQ ID NO: 17255 - RNA, 22 nt, Homo sapiens
uugaggcuuuugaccucaugug

SEQ ID NO: 17256 - RNA, 22 nt, Homo sapiens
uugagggaaacauucacaucau

SEQ ID NO: 17257 - RNA, 22 nt, Homo sapiens
uugagggagcauuuguuuugag

SEQ ID NO: 17258 - RNA, 22 nt, Homo sapiens
uugaggucagagguucgagacc

SEQ ID NO: 17259 - RNA, 20 nt, Homo sapiens
uugaggucaggaguuuggga

SEQ ID NO: 17260 - RNA, 22 nt, Homo sapiens
uugaggucuuugagcaaacgca

SEQ ID NO: 17261 - RNA, 22 nt, Homo sapiens
uugaggugaauuugcaggaugc

SEQ ID NO: 17262 - RNA, 22 nt, Homo sapiens
uugaguaguaagaagaugauag

SEQ ID NO: 17263 - RNA, 22 nt, Homo sapiens
uugaguauuggacugguaucuu

SEQ ID NO: 17264 - RNA, 22 nt, Homo sapiens
uugaguccccacacuggguccc

SEQ ID NO: 17265 - RNA, 22 nt, Homo sapiens
uugaguuuaucuaaagaccugg

SEQ ID NO: 17266 - RNA, 22 nt, Homo sapiens
uugauaguccuguaucuauuuu

SEQ ID NO: 17267 - RNA, 22 nt, Homo sapiens
uugauauguguauagcaugugg

SEQ ID NO: 17268 - RNA, 21 nt, Homo sapiens
uugcaaaugcugcugccugau

SEQ ID NO: 17269 - RNA, 22 nt, Homo sapiens
uugcacauggcuggggaggccu

SEQ ID NO: 17270 - RNA, 22 nt, Homo sapiens
uugcacauguugaaccagcaaa

SEQ ID NO: 17271 - RNA, 22 nt, Homo sapiens
uugcacauuuuuucuggcagaa

SEQ ID NO: 17272 - RNA, 22 nt, Homo sapiens
uugcacuauaggaaaauguguc

SEQ ID NO: 17273 - RNA, 22 nt, Homo sapiens
uugcacuauuaguauagauguc

SEQ ID NO: 17274 - RNA, 18 nt, Homo sapiens
uugcacuccugccugggu

SEQ ID NO: 17275 - RNA, 22 nt, Homo sapiens
uugcacuuccgccugggugaca

SEQ ID NO: 17276 - RNA, 22 nt, Homo sapiens
uugcacuugcugaggagugauu

SEQ ID NO: 17277 - RNA, 22 nt, Homo sapiens
uugcagagaaauuucugguuua

SEQ ID NO: 17278 - RNA, 20 nt, Homo sapiens
uugcagagcccaacccugga

SEQ ID NO: 17279 - RNA, 22 nt, Homo sapiens
uugcauauucucugaggcagga

SEQ ID NO: 17280 - RNA, 22 nt, Homo sapiens
uugcaugcuccuuaugagaauc

SEQ ID NO: 17281 - RNA, 22 nt, Homo sapiens
uugcuauguugcccagucugga

SEQ ID NO: 17282 - RNA, 22 nt, Homo sapiens
uugcugagucuuucuagguugc

SEQ ID NO: 17283 - RNA, 22 nt, Homo sapiens
uugcuucauucaacauugaggg

SEQ ID NO: 17284 - RNA, 22 nt, Homo sapiens
uuggaacacauguuuuucuacc

SEQ ID NO: 17285 - RNA, 22 nt, Homo sapiens
uuggaagauuacuuaguuuucu

SEQ ID NO: 17286 - RNA, 22 nt, Homo sapiens
uuggaauauaaccuguuucuaa

SEQ ID NO: 17287 - RNA, 22 nt, Homo sapiens
uuggaaugcaacagaaggauaa

SEQ ID NO: 17288 - RNA, 22 nt, Homo sapiens
uuggaccacuugauuucugguc

SEQ ID NO: 17289 - RNA, 22 nt, Homo sapiens
uuggacugagaguuccaccauu

SEQ ID NO: 17290 - RNA, 22 nt, Homo sapiens
uuggagugugcucauaacugcu

SEQ ID NO: 17291 - RNA, 23 nt, Homo sapiens
uuggcaucugggacacaagcuga

SEQ ID NO: 17292 - RNA, 22 nt, Homo sapiens
uuggccagugucuuuuuuuccu

SEQ ID NO: 17293 - RNA, 22 nt, Homo sapiens
uuggccccuccaaaucucaugu

SEQ ID NO: 17294 - RNA, 22 nt, Homo sapiens
uuggcuguguuccucaaggagu

SEQ ID NO: 17295 - RNA, 22 nt, Homo sapiens
uugggagugucucuggacugca

SEQ ID NO: 17296 - RNA, 22 nt, Homo sapiens
uugggauaaucacaaaguaaaa

SEQ ID NO: 17297 - RNA, 23 nt, Homo sapiens
uugggcaaaucacugagggcaga

SEQ ID NO: 17298 - RNA, 22 nt, Homo sapiens
uugggccacuuuaguuuccuua

SEQ ID NO: 17299 - RNA, 22 nt, Homo sapiens
uugggcuugagggugcccaguc

SEQ ID NO: 17300 - RNA, 22 nt, Homo sapiens
uugggguaggaauauggaauga

SEQ ID NO: 17301 - RNA, 22 nt, Homo sapiens
uugguaaucccuagugucuaga

SEQ ID NO: 17302 - RNA, 22 nt, Homo sapiens
uuguaacaugcuuucacuucag

SEQ ID NO: 17303 - RNA, 22 nt, Homo sapiens
uuguaaucaacacaucauuggg

SEQ ID NO: 17304 - RNA, 22 nt, Homo sapiens
uugucaaugggugagugcagag

SEQ ID NO: 17305 - RNA, 22 nt, Homo sapiens
uugucacauggggcggcugccc

SEQ ID NO: 17306 - RNA, 22 nt, Homo sapiens
uugucaguguucacucaaagcu

SEQ ID NO: 17307 - RNA, 22 nt, Homo sapiens
uuguccuugagauaguuugcag

SEQ ID NO: 17308 - RNA, 22 nt, Homo sapiens
uugugaauggugccacaauaaa

SEQ ID NO: 17309 - RNA, 22 nt, Homo sapiens
uugugcacauguacccuagaac

SEQ ID NO: 17310 - RNA, 21 nt, Homo sapiens
uugugccaaacccuggaggga

SEQ ID NO: 17311 - RNA, 22 nt, Homo sapiens
uugugcuccugugagaaucuag

SEQ ID NO: 17312 - RNA, 22 nt, Homo sapiens
uugugcuugauuugccuagcug

SEQ ID NO: 17313 - RNA, 18 nt, Homo sapiens
uuguggccccuacaaauu

SEQ ID NO: 17314 - RNA, 22 nt, Homo sapiens
uugugguuuucagcuuauauau

SEQ ID NO: 17315 - RNA, 19 nt, Homo sapiens
uuguguccccacaaaauuc

SEQ ID NO: 17316 - RNA, 22 nt, Homo sapiens
uuguguccccacccaaauuuca

SEQ ID NO: 17317 - RNA, 22 nt, Homo sapiens
uugugucccuacccaaaucuca

SEQ ID NO: 17318 - RNA, 23 nt, Homo sapiens
uugugucccuacccaaaucucau

SEQ ID NO: 17319 - RNA, 22 nt, Homo sapiens
uuguguuuuuaguagggaaggg

SEQ ID NO: 17320 - RNA, 22 nt, Homo sapiens
uuguuuuggagaugagcuaaaa

SEQ ID NO: 17321 - RNA, 22 nt, Homo sapiens
uuuaaagcacggaguuuguggc

SEQ ID NO: 17322 - RNA, 22 nt, Homo sapiens
aaggcauggugacuauuuaggc

SEQ ID NO: 17323 - RNA, 22 nt, Homo sapiens
aagggaaugugguagcugguuu

SEQ ID NO: 17324 - RNA, 23 nt, Homo sapiens
aagguaagcuagaaagauguaga

SEQ ID NO: 17325 - RNA, 21 nt, Homo sapiens
aaggugguggugauugagaug

SEQ ID NO: 17326 - RNA, 22 nt, Homo sapiens
aagucaugaagaggaaaggaca

SEQ ID NO: 17327 - RNA, 22 nt, Homo sapiens
aaguccccugacagaggggagg

SEQ ID NO: 17328 - RNA, 19 nt, Homo sapiens
aagugaaugcuuuguucac

SEQ ID NO: 17329 - RNA, 22 nt, Homo sapiens
aagugaauucauuguguuauau

SEQ ID NO: 17330 - RNA, 23 nt, Homo sapiens
aagugagcuccaauugggugaga

SEQ ID NO: 17331 - RNA, 20 nt, Homo sapiens
aagugaguguuaaacugaac

SEQ ID NO: 17332 - RNA, 22 nt, Homo sapiens
aagugauguuauugggugacuc

SEQ ID NO: 17333 - RNA, 22 nt, Homo sapiens
aagugcuggccuacucaaucga

SEQ ID NO: 17334 - RNA, 22 nt, Homo sapiens
aagugcugggauuggccgggca

SEQ ID NO: 17335 - RNA, 22 nt, Homo sapiens
aagugcuuacagggaacaugau

SEQ ID NO: 17336 - RNA, 22 nt, Homo sapiens
aagugcuuuguacagggguuga

SEQ ID NO: 17337 - RNA, 22 nt, Homo sapiens
aagugguagggucaggauugga

SEQ ID NO: 17338 - RNA, 22 nt, Homo sapiens
aagugguguuuguauuuaugca

SEQ ID NO: 17339 - RNA, 22 nt, Homo sapiens
aaguugcuuuagguaagucaau

SEQ ID NO: 17340 - RNA, 22 nt, Homo sapiens
aaguugguguaugagacagaag

SEQ ID NO: 17341 - RNA, 21 nt, Homo sapiens
aauaaagcaaccuuaugccau

SEQ ID NO: 17342 - RNA, 22 nt, Homo sapiens
aauaaagcaggguccuugcacu

SEQ ID NO: 17343 - RNA, 22 nt, Homo sapiens
aauaaagcauggcuacuccaua

SEQ ID NO: 17344 - RNA, 22 nt, Homo sapiens
aauaaagccugucucuuuagag

SEQ ID NO: 17345 - RNA, 22 nt, Homo sapiens
aauaaagcugaauccuuccuga

SEQ ID NO: 17346 - RNA, 21 nt, Homo sapiens
aauacucuagguuaagagagc

SEQ ID NO: 17347 - RNA, 22 nt, Homo sapiens
aauacugagaugugagguacua

SEQ ID NO: 17348 - RNA, 22 nt, Homo sapiens
aauacuuccaaaucuagucauu

SEQ ID NO: 17349 - RNA, 22 nt, Homo sapiens
aauagcuguuuuuaauuccugc

SEQ ID NO: 17350 - RNA, 22 nt, Homo sapiens
aauaucacaguggguguacacc

SEQ ID NO: 17351 - RNA, 22 nt, Homo sapiens
aaucacacuugauguugagcaa

SEQ ID NO: 17352 - RNA, 22 nt, Homo sapiens
aaucacauugaaucugcuaccu

SEQ ID NO: 17353 - RNA, 22 nt, Homo sapiens
aauccaugugcuuuaccauuuu

SEQ ID NO: 17354 - RNA, 22 nt, Homo sapiens
aaucccuuuguccagucucuuu

SEQ ID NO: 17355 - RNA, 22 nt, Homo sapiens
aaugacacugagcaucuuucau

SEQ ID NO: 17356 - RNA, 22 nt, Homo sapiens
aaugcacauauauuuccuuauu

SEQ ID NO: 17357 - RNA, 22 nt, Homo sapiens
aaugcuguguuauuucaugacc

SEQ ID NO: 17358 - RNA, 22 nt, Homo sapiens
aauggcagaugaaauugucauu

SEQ ID NO: 17359 - RNA, 22 nt, Homo sapiens
aauggcaguagauggaugggua

SEQ ID NO: 17360 - RNA, 22 nt, Homo sapiens
aaugggacugacgccucccaga

SEQ ID NO: 17361 - RNA, 22 nt, Homo sapiens
aaugugcuuucuuucacacagu

SEQ ID NO: 17362 - RNA, 22 nt, Homo sapiens
aauugaccuaaucugauuacug

SEQ ID NO: 17363 - RNA, 22 nt, Homo sapiens
aauugcuucuguauuuuggaca

SEQ ID NO: 17364 - RNA, 16 nt, Homo sapiens
acaaagcuggcuaucu

SEQ ID NO: 17365 - RNA, 20 nt, Homo sapiens
acaaaugcauucugugacau

SEQ ID NO: 17366 - RNA, 22 nt, Homo sapiens
acaacaguuuuaucaccccaga

SEQ ID NO: 17367 - RNA, 22 nt, Homo sapiens
acacagucaaauccacuuggcu

SEQ ID NO: 17368 - RNA, 22 nt, Homo sapiens
acacaugcuccacuguggccuc

SEQ ID NO: 17369 - RNA, 22 nt, Homo sapiens
acacaugugaaaaaaauguuac

SEQ ID NO: 17370 - RNA, 22 nt, Homo sapiens
acacauuggcaauucuggagca

SEQ ID NO: 17371 - RNA, 22 nt, Homo sapiens
acacuguuggugggaguguaaa

SEQ ID NO: 17372 - RNA, 22 nt, Homo sapiens
acagauagacauauauagcuca

SEQ ID NO: 17373 - RNA, 20 nt, Homo sapiens
acagcauagccuuuuaaagc

SEQ ID NO: 17374 - RNA, 23 nt, Homo sapiens
acagucuaguuugaagucaggua

SEQ ID NO: 17375 - RNA, 22 nt, Homo sapiens
acagugcuucugauaugaugcc

SEQ ID NO: 17376 - RNA, 22 nt, Homo sapiens
acaguguuacuugauaguguau

SEQ ID NO: 17377 - RNA, 22 nt, Homo sapiens
acaucacuguuugauugauuga

SEQ ID NO: 17378 - RNA, 22 nt, Homo sapiens
acaucccaugccuggguacucc

SEQ ID NO: 17379 - RNA, 22 nt, Homo sapiens
acaucccuugcucggggccccu

SEQ ID NO: 17380 - RNA, 22 nt, Homo sapiens
acaucccuuucccacccuucac

SEQ ID NO: 17381 - RNA, 22 nt, Homo sapiens
acaugagacuggguuuguaggg

SEQ ID NO: 17382 - RNA, 22 nt, Homo sapiens
acauggcuuaugaauuuggaga

SEQ ID NO: 17383 - RNA, 22 nt, Homo sapiens
acauucagcuguuguuucaaug

SEQ ID NO: 17384 - RNA, 18 nt, Homo sapiens
acauucagcuugaagaua

SEQ ID NO: 17385 - RNA, 22 nt, Homo sapiens
accacaggguaaaguuagauau

SEQ ID NO: 17386 - RNA, 22 nt, Homo sapiens
accaguuuuuuauacaucuucu

SEQ ID NO: 17387 - RNA, 22 nt, Homo sapiens
acccaguguugggcagaacugu

SEQ ID NO: 17388 - RNA, 22 nt, Homo sapiens
acccugacacgauucuucacuu

SEQ ID NO: 17389 - RNA, 22 nt, Homo sapiens
acccugcuaaacagcccccugc

SEQ ID NO: 17390 - RNA, 22 nt, Homo sapiens
acccugucauccacauggugcu

SEQ ID NO: 17391 - RNA, 22 nt, Homo sapiens
acccugugaauauuuaaacuuc

SEQ ID NO: 17392 - RNA, 22 nt, Homo sapiens
acccuugaguguguuucaggca

SEQ ID NO: 17393 - RNA, 22 nt, Homo sapiens
accucagcccggggaaguugag

SEQ ID NO: 17394 - RNA, 22 nt, Homo sapiens
auagugcugcaauaaccauggg

SEQ ID NO: 17395 - RNA, 22 nt, Homo sapiens
auagugcuguauuaaacauacg

SEQ ID NO: 17396 - RNA, 23 nt, Homo sapiens
auauaguagaugugcaguaacau

SEQ ID NO: 17397 - RNA, 22 nt, Homo sapiens
auaucaacaucgugucauuagu

SEQ ID NO: 17398 - RNA, 22 nt, Homo sapiens
auaucaaggccauuuucuaaau

SEQ ID NO: 17399 - RNA, 17 nt, Homo sapiens
auaugaauuuuggagau

SEQ ID NO: 17400 - RNA, 20 nt, Homo sapiens
auaugcauguguuuucacuu

SEQ ID NO: 17401 - RNA, 22 nt, Homo sapiens
auaugguacuuaugcucaaacu

SEQ ID NO: 17402 - RNA, 22 nt, Homo sapiens
auauguauuuuaacguguaagg

SEQ ID NO: 17403 - RNA, 22 nt, Homo sapiens
auauuacuggcuauaucgcaag

SEQ ID NO: 17404 - RNA, 22 nt, Homo sapiens
aucaaaguaggcauauguuuuu

SEQ ID NO: 17405 - RNA, 22 nt, Homo sapiens
aucaaagugaauuaaugagaau

SEQ ID NO: 17406 - RNA, 22 nt, Homo sapiens
aucaaauugucauuuuaaggau

SEQ ID NO: 17407 - RNA, 22 nt, Homo sapiens
aucacaguggcucacaagagcc

SEQ ID NO: 17408 - RNA, 22 nt, Homo sapiens
aucaccauguguacauuagacc

SEQ ID NO: 17409 - RNA, 22 nt, Homo sapiens
aucaccuuucccuuucugaauc

SEQ ID NO: 17410 - RNA, 22 nt, Homo sapiens
aucacuaugcaggugucucggg

SEQ ID NO: 17411 - RNA, 20 nt, Homo sapiens
aucacuggagaaggaaaccu

SEQ ID NO: 17412 - RNA, 22 nt, Homo sapiens
aucacugggauggaacugcuga

SEQ ID NO: 17413 - RNA, 22 nt, Homo sapiens
aucacuguuuugaugcucggac

SEQ ID NO: 17414 - RNA, 22 nt, Homo sapiens
aucagaaucucuagaggacugu

SEQ ID NO: 17415 - RNA, 22 nt, Homo sapiens
aucagaaucucuagugggacca

SEQ ID NO: 17416 - RNA, 22 nt, Homo sapiens
aucagauggcuaaaacagaaga

SEQ ID NO: 17417 - RNA, 22 nt, Homo sapiens
aucagauguuuguauaggagua

SEQ ID NO: 17418 - RNA, 22 nt, Homo sapiens
aucagauuccagaggcagcacc

SEQ ID NO: 17419 - RNA, 22 nt, Homo sapiens
aucagcagcaugaaaagcaacu

SEQ ID NO: 17420 - RNA, 22 nt, Homo sapiens
aucagcauucccaaaugaugug

SEQ ID NO: 17421 - RNA, 22 nt, Homo sapiens
aucauggaguauuugcaagucu

SEQ ID NO: 17422 - RNA, 22 nt, Homo sapiens
auccaagagacugaugacuucc

SEQ ID NO: 17423 - RNA, 22 nt, Homo sapiens
auccauugcucaagagaaguca

SEQ ID NO: 17424 - RNA, 22 nt, Homo sapiens
aucccuagaaaaaucagcacau

SEQ ID NO: 17425 - RNA, 22 nt, Homo sapiens
aucccugagccugacucucaga

SEQ ID NO: 17426 - RNA, 22 nt, Homo sapiens
auccuguagagaugagggugga

SEQ ID NO: 17427 - RNA, 22 nt, Homo sapiens
aucgcgccauuguacuccagcc

SEQ ID NO: 17428 - RNA, 22 nt, Homo sapiens
aucucagcaacuaaagauccuu

SEQ ID NO: 17429 - RNA, 22 nt, Homo sapiens
aucucaguucaggcuggccaca

SEQ ID NO: 17430 - RNA, 22 nt, Homo sapiens
aagcugguuuuauaucugugag

SEQ ID NO: 17431 - RNA, 22 nt, Homo sapiens
aagcuguguguaagcucucaca

SEQ ID NO: 17432 - RNA, 22 nt, Homo sapiens
aagcuguugguggauguaccau

SEQ ID NO: 17433 - RNA, 22 nt, Homo sapiens
aaggaagcuagcaggaauuggu

SEQ ID NO: 17434 - RNA, 22 nt, Homo sapiens
aaggagcuuaagugacuuguac

SEQ ID NO: 17435 - RNA, 22 nt, Homo sapiens
aaggcaacgugaguuguugauu

SEQ ID NO: 17436 - RNA, 22 nt, Homo sapiens
aaggcagucacuaaauagugag

SEQ ID NO: 17437 - RNA, 22 nt, Homo sapiens
aaggcagugugcacauaacacu

SEQ ID NO: 17438 - RNA, 22 nt, Homo sapiens
aaggcaugcaguacguuucuau

SEQ ID NO: 17439 - RNA, 22 nt, Homo sapiens
aaggcaugcugaguccuaaaag

SEQ ID NO: 17440 - RNA, 22 nt, Homo sapiens
aaggcuguuguguaauaggauu

SEQ ID NO: 17441 - RNA, 22 nt, Homo sapiens
aagggaaugcuuccaguuugug

SEQ ID NO: 17442 - RNA, 22 nt, Homo sapiens
aaggugcucucuuauguagaaa

SEQ ID NO: 17443 - RNA, 22 nt, Homo sapiens
aaguaaacauuuuguacaauaa

SEQ ID NO: 17444 - RNA, 22 nt, Homo sapiens
aaguaauggaguuauuuuauga

SEQ ID NO: 17445 - RNA, 22 nt, Homo sapiens
aaguagcuggaugcaguggcac

SEQ ID NO: 17446 - RNA, 22 nt, Homo sapiens
aaguauuaugaguccuuguuuu

SEQ ID NO: 17447 - RNA, 22 nt, Homo sapiens
aagucacugagacuuguggcug

SEQ ID NO: 17448 - RNA, 22 nt, Homo sapiens
aagugaccuaacaaugaaggcc

SEQ ID NO: 17449 - RNA, 22 nt, Homo sapiens
aagugacuagacuaugaaaccu

SEQ ID NO: 17450 - RNA, 22 nt, Homo sapiens
aagugcuuuacacaugcaugau

SEQ ID NO: 17451 - RNA, 22 nt, Homo sapiens
aagugguguuugggagcuggac

SEQ ID NO: 17452 - RNA, 22 nt, Homo sapiens
aaguuguuggaguuccauuguu

SEQ ID NO: 17453 - RNA, 22 nt, Homo sapiens
aauaaagcuuugagcuuugcug

SEQ ID NO: 17454 - RNA, 22 nt, Homo sapiens
aauaaagucugaagugugcuua

SEQ ID NO: 17455 - RNA, 22 nt, Homo sapiens
aauaauggcaccaaagcacaag

SEQ ID NO: 17456 - RNA, 22 nt, Homo sapiens
aauacucaguccuggugaggcu

SEQ ID NO: 17457 - RNA, 22 nt, Homo sapiens
aauacuggcacugaagaccaug

SEQ ID NO: 17458 - RNA, 22 nt, Homo sapiens
aauacugugauaucgagcgauu

SEQ ID NO: 17459 - RNA, 22 nt, Homo sapiens
aauagcauugaaucuaccaauu

SEQ ID NO: 17460 - RNA, 23 nt, Homo sapiens
aauaucacaguggguguacaccc

SEQ ID NO: 17461 - RNA, 19 nt, Homo sapiens
aauauugacaguggugucu

SEQ ID NO: 17462 - RNA, 22 nt, Homo sapiens
aauauugucaaaauggauucca

SEQ ID NO: 17463 - RNA, 22 nt, Homo sapiens
aaucacaguguucuugugaggg

SEQ ID NO: 17464 - RNA, 22 nt, Homo sapiens
aaucagcacacugugcuuucca

SEQ ID NO: 17465 - RNA, 22 nt, Homo sapiens
aaucauauugucugccaagagg

SEQ ID NO: 17466 - RNA, 22 nt, Homo sapiens
aauccugucuugccauccaaua

SEQ ID NO: 17467 - RNA, 22 nt, Homo sapiens
aaugacuaagaugguacauuuu

SEQ ID NO: 17468 - RNA, 22 nt, Homo sapiens
aauggcacaagacaugaagaag

SEQ ID NO: 17469 - RNA, 22 nt, Homo sapiens
aauggcacuuuauaaauguuaa

SEQ ID NO: 17470 - RNA, 22 nt, Homo sapiens
aaugucacugugguccuccagu

SEQ ID NO: 17471 - RNA, 22 nt, Homo sapiens
aaugugcacuuggagccuugcu

SEQ ID NO: 17472 - RNA, 22 nt, Homo sapiens
aauugcaccaucuagaucaaga

SEQ ID NO: 17473 - RNA, 22 nt, Homo sapiens
aauugcauugaauuuguagcuu

SEQ ID NO: 17474 - RNA, 22 nt, Homo sapiens
aauuggcagugcucuugccaca

SEQ ID NO: 17475 - RNA, 22 nt, Homo sapiens
acaagugcuuuuccuggagaca

SEQ ID NO: 17476 - RNA, 22 nt, Homo sapiens
acacacgugcauguaugcguau

SEQ ID NO: 17477 - RNA, 22 nt, Homo sapiens
acaccaugucuguuucugguuu

SEQ ID NO: 17478 - RNA, 22 nt, Homo sapiens
acacgugcguauauguacguau

SEQ ID NO: 17479 - RNA, 22 nt, Homo sapiens
acacucuaguguucuuaaucag

SEQ ID NO: 17480 - RNA, 20 nt, Homo sapiens
acacuggaguaucaaggccc

SEQ ID NO: 17481 - RNA, 22 nt, Homo sapiens
acacuguauccuucuguccuuu

SEQ ID NO: 17482 - RNA, 22 nt, Homo sapiens
acacuguuuuaguuauuauagc

SEQ ID NO: 17483 - RNA, 22 nt, Homo sapiens
acacuugcuugcaauagccucc

SEQ ID NO: 17484 - RNA, 22 nt, Homo sapiens
acacuuucuggagcugcacaua

SEQ ID NO: 17485 - RNA, 19 nt, Homo sapiens
acagcugguuuugguuucu

SEQ ID NO: 17486 - RNA, 22 nt, Homo sapiens
acaguaaugggccccuuuuccu

SEQ ID NO: 17487 - RNA, 18 nt, Homo sapiens
acagugcuggcaugagau

SEQ ID NO: 17488 - RNA, 22 nt, Homo sapiens
acagugcuguuguguuuucacg

SEQ ID NO: 17489 - RNA, 22 nt, Homo sapiens
acagugcuuggcacacaguaau

SEQ ID NO: 17490 - RNA, 22 nt, Homo sapiens
acagugcuuucaauguucagua

SEQ ID NO: 17491 - RNA, 22 nt, Homo sapiens
acagugucugacacguaggaag

SEQ ID NO: 17492 - RNA, 22 nt, Homo sapiens
acaugccucccugguccgcugu

SEQ ID NO: 17493 - RNA, 22 nt, Homo sapiens
acauggcacugcgggcuucuug

SEQ ID NO: 17494 - RNA, 22 nt, Homo sapiens
acauugcagauguguuuaaugu

SEQ ID NO: 17495 - RNA, 17 nt, Homo sapiens
accagugcaugugcuuu

SEQ ID NO: 17496 - RNA, 22 nt, Homo sapiens
acccuacauaguagauccuaca

SEQ ID NO: 17497 - RNA, 22 nt, Homo sapiens
acccucagaccaguuucccugg

SEQ ID NO: 17498 - RNA, 20 nt, Homo sapiens
acccucuaggaugauuucuu

SEQ ID NO: 17499 - RNA, 22 nt, Homo sapiens
acccuuugucaaucaguacuaa

SEQ ID NO: 17500 - RNA, 22 nt, Homo sapiens
accgggcugagcgcaggccccg

SEQ ID NO: 17501 - RNA, 23 nt, Homo sapiens
accugauguuucuguggggagcc

SEQ ID NO: 17502 - RNA, 22 nt, Homo sapiens
augguuuauuuguaagcagagu

SEQ ID NO: 17503 - RNA, 22 nt, Homo sapiens
auguaauugagguuuuugccau

SEQ ID NO: 17504 - RNA, 22 nt, Homo sapiens
auguagauaucaagaggcauau

SEQ ID NO: 17505 - RNA, 22 nt, Homo sapiens
auguaguagauauuuauggaaa

SEQ ID NO: 17506 - RNA, 22 nt, Homo sapiens
auguaguaugaagaagaugcuu

SEQ ID NO: 17507 - RNA, 22 nt, Homo sapiens
auguauacaugcaggucacagg

SEQ ID NO: 17508 - RNA, 22 nt, Homo sapiens
auguccaugagcacauguauca

SEQ ID NO: 17509 - RNA, 22 nt, Homo sapiens
augugacagcaacccccagccc

SEQ ID NO: 17510 - RNA, 22 nt, Homo sapiens
augugacuugugaaaaguucag

SEQ ID NO: 17511 - RNA, 22 nt, Homo sapiens
augugcacauucugguaaauau

SEQ ID NO: 17512 - RNA, 20 nt, Homo sapiens
augugcuaauauuaauaugu

SEQ ID NO: 17513 - RNA, 22 nt, Homo sapiens
augugcuagguacuguuuagca

SEQ ID NO: 17514 - RNA, 22 nt, Homo sapiens
augugcuuuuggugagagauuu

SEQ ID NO: 17515 - RNA, 22 nt, Homo sapiens
auguggcauuucucauucauuu

SEQ ID NO: 17516 - RNA, 22 nt, Homo sapiens
auguuauguucuucucuguaua

SEQ ID NO: 17517 - RNA, 22 nt, Homo sapiens
auuaaauguuggacguauacau

SEQ ID NO: 17518 - RNA, 22 nt, Homo sapiens
auuacaugucuauccaugaaca

SEQ ID NO: 17519 - RNA, 22 nt, Homo sapiens
auuacuuugcaccaaccuaaua

SEQ ID NO: 17520 - RNA, 22 nt, Homo sapiens
auuagguuagugcaaaaguaau

SEQ ID NO: 17521 - RNA, 22 nt, Homo sapiens
auuagguuggugcaaaaguaau

SEQ ID NO: 17522 - RNA, 22 nt, Homo sapiens
auuagguuguugcaaaaguaau

SEQ ID NO: 17523 - RNA, 22 nt, Homo sapiens
auuagugaaugugaugucuuga

SEQ ID NO: 17524 - RNA, 22 nt, Homo sapiens
auucaaagugcauguucccacu

SEQ ID NO: 17525 - RNA, 22 nt, Homo sapiens
auucaagggauuucaggaggcu

SEQ ID NO: 17526 - RNA, 22 nt, Homo sapiens
auucaagugaugcagcuguuuu

SEQ ID NO: 17527 - RNA, 22 nt, Homo sapiens
auuccacuuacaugaaguaccu

SEQ ID NO: 17528 - RNA, 22 nt, Homo sapiens
auuccacuuccacuaguuucuc

SEQ ID NO: 17529 - RNA, 22 nt, Homo sapiens
auuccauuuguguggaauggcu

SEQ ID NO: 17530 - RNA, 22 nt, Homo sapiens
auucccuguagaauaaggaugg

SEQ ID NO: 17531 - RNA, 22 nt, Homo sapiens
auuccuuaggcccuuugguuag

SEQ ID NO: 17532 - RNA, 22 nt, Homo sapiens
auugcaaugggaaacuaugaaa

SEQ ID NO: 17533 - RNA, 18 nt, Homo sapiens
auugcacaccagccuggg

SEQ ID NO: 17534 - RNA, 22 nt, Homo sapiens
auugcacaccagucugggcaaa

SEQ ID NO: 17535 - RNA, 22 nt, Homo sapiens
auugcacuccagccccggggac

SEQ ID NO: 17536 - RNA, 22 nt, Homo sapiens
auugcacuccagccuagguaac

SEQ ID NO: 17537 - RNA, 22 nt, Homo sapiens
auugcacuccagccuuggggau

SEQ ID NO: 17538 - RNA, 21 nt, Homo sapiens
ccugauguucacuuggccuuc

SEQ ID NO: 17539 - RNA, 22 nt, Homo sapiens
ccugugguuaaccagcuagaug

SEQ ID NO: 17540 - RNA, 22 nt, Homo sapiens
ccuucauccuccagcaggcuag

SEQ ID NO: 17541 - RNA, 22 nt, Homo sapiens
ccuucuuuuguaaggcugaaua

SEQ ID NO: 17542 - RNA, 22 nt, Homo sapiens
ccuugcacuucccaggugaggc

SEQ ID NO: 17543 - RNA, 22 nt, Homo sapiens
ccuuggcaauggcuggggcuga

SEQ ID NO: 17544 - RNA, 22 nt, Homo sapiens
ccuuuuugaguugccagaguuc

SEQ ID NO: 17545 - RNA, 22 nt, Homo sapiens
cgccgggggaugggcaccagcg

SEQ ID NO: 17546 - RNA, 22 nt, Homo sapiens
cgcuggugaucuagacccccaa

SEQ ID NO: 17547 - RNA, 22 nt, Homo sapiens
cggugcaaauguaauugcaguu

SEQ ID NO: 17548 - RNA, 20 nt, Homo sapiens
cguugcacuccagccugggc

SEQ ID NO: 17549 - RNA, 22 nt, Homo sapiens
cuaaaguagccaggacugcagg

SEQ ID NO: 17550 - RNA, 22 nt, Homo sapiens
cuaagauugucuuaguguguug

SEQ ID NO: 17551 - RNA, 22 nt, Homo sapiens
cuaaucugugcauagaagaggc

SEQ ID NO: 17552 - RNA, 22 nt, Homo sapiens
cuacagcagcccaguccccgaa

SEQ ID NO: 17553 - RNA, 22 nt, Homo sapiens
cuacagguaugaaagggaguau

SEQ ID NO: 17554 - RNA, 22 nt, Homo sapiens
cuacugcacaucaucugaguua

SEQ ID NO: 17555 - RNA, 22 nt, Homo sapiens
cuagcagcaugagaauggacca

SEQ ID NO: 17556 - RNA, 22 nt, Homo sapiens
cuagguuauacucugaaauggu

SEQ ID NO: 17557 - RNA, 22 nt, Homo sapiens
cuagguucucaaaccagcguca

SEQ ID NO: 17558 - RNA, 22 nt, Homo sapiens
cuaugcuuucugggcccugggu

SEQ ID NO: 17559 - RNA, 22 nt, Homo sapiens
cuauuagguuggggcgaaagua

SEQ ID NO: 17560 - RNA, 22 nt, Homo sapiens
cuauuagguuggugcaaaagua

SEQ ID NO: 17561 - RNA, 19 nt, Homo sapiens
cuauugcacauagcugaag

SEQ ID NO: 17562 - RNA, 22 nt, Homo sapiens
cucaaaguguggucuguggguu

SEQ ID NO: 17563 - RNA, 20 nt, Homo sapiens
cucacagacagcuucuuucu

SEQ ID NO: 17564 - RNA, 18 nt, Homo sapiens
cucacaguaacuuuuaag

SEQ ID NO: 17565 - RNA, 22 nt, Homo sapiens
cucacuaggaaguaaaguuugu

SEQ ID NO: 17566 - RNA, 22 nt, Homo sapiens
cucaguagaaaauacauggacu

SEQ ID NO: 17567 - RNA, 22 nt, Homo sapiens
cucagugaagggcaagaggcaa

SEQ ID NO: 17568 - RNA, 22 nt, Homo sapiens
cucaguguuucagcugcucaga

SEQ ID NO: 17569 - RNA, 22 nt, Homo sapiens
cucauugcaaucuccaccuccc

SEQ ID NO: 17570 - RNA, 22 nt, Homo sapiens
cucccagagccaguuauaggcu

SEQ ID NO: 17571 - RNA, 22 nt, Homo sapiens
cucccagugacccaggaacagg

SEQ ID NO: 17572 - RNA, 22 nt, Homo sapiens
cucccugagccagggcuuugac

SEQ ID NO: 17573 - RNA, 22 nt, Homo sapiens
cugaaauggaaugugugcacag

SEQ ID NO: 17574 - RNA, 22 nt, Homo sapiens
cugaagugugaaagucuuuuuu

SEQ ID NO: 17575 - RNA, 22 nt, Homo sapiens
cugaauguucuggauggaagag

SEQ ID NO: 17576 - RNA, 22 nt, Homo sapiens
cugaccauagacuacucugggc

SEQ ID NO: 17577 - RNA, 22 nt, Homo sapiens
cugacguguuuuccagaccuuu

SEQ ID NO: 17578 - RNA, 22 nt, Homo sapiens
cugacucagacacauguauaug

SEQ ID NO: 17579 - RNA, 22 nt, Homo sapiens
cugagagaggagcuaaaacugc

SEQ ID NO: 17580 - RNA, 22 nt, Homo sapiens
cugagagaugagaccucucacu

SEQ ID NO: 17581 - RNA, 22 nt, Homo sapiens
cugagagugguauguuuaagug

SEQ ID NO: 17582 - RNA, 22 nt, Homo sapiens
cugagauaauuucuagguguca

SEQ ID NO: 17583 - RNA, 22 nt, Homo sapiens
cugagauacacuaauagucucu

SEQ ID NO: 17584 - RNA, 22 nt, Homo sapiens
cugagauaggacucugcuggcu

SEQ ID NO: 17585 - RNA, 22 nt, Homo sapiens
cugagaucugaaccaggagugu

SEQ ID NO: 17586 - RNA, 22 nt, Homo sapiens
cugagcaaaaugaagacacgau

SEQ ID NO: 17587 - RNA, 20 nt, Homo sapiens
cugcacauccacucuacuuc

SEQ ID NO: 17588 - RNA, 22 nt, Homo sapiens
cugcagucaucugaagauuuug

SEQ ID NO: 17589 - RNA, 19 nt, Homo sapiens
cugcaugagacaguugguu

SEQ ID NO: 17590 - RNA, 18 nt, Homo sapiens
cugccagugugcucuccg

SEQ ID NO: 17591 - RNA, 22 nt, Homo sapiens
cugcuguuguuaacuuuuggag

SEQ ID NO: 17592 - RNA, 22 nt, Homo sapiens
cuggaaagaaacccuuaauucu

SEQ ID NO: 17593 - RNA, 22 nt, Homo sapiens
cuggaaggaaaaacaaccacag

SEQ ID NO: 17594 - RNA, 22 nt, Homo sapiens
cuggaaucuagaaaagguaagg

SEQ ID NO: 17595 - RNA, 22 nt, Homo sapiens
cuggagauauuggaagaaagaa

SEQ ID NO: 17596 - RNA, 22 nt, Homo sapiens
cuggagcaaaggugacucuugu

SEQ ID NO: 17597 - RNA, 22 nt, Homo sapiens
cuggcaaauaguagagccagga

SEQ ID NO: 17598 - RNA, 22 nt, Homo sapiens
cuggcaccauuuugaucaaagg

SEQ ID NO: 17599 - RNA, 22 nt, Homo sapiens
cugggaucaguucuagucagaa

SEQ ID NO: 17600 - RNA, 22 nt, Homo sapiens
cugucuggaggccugcaaauaa

SEQ ID NO: 17601 - RNA, 22 nt, Homo sapiens
cugugacugcagggcauauuug

SEQ ID NO: 17602 - RNA, 22 nt, Homo sapiens
cugugauuauauaguuaaggua

SEQ ID NO: 17603 - RNA, 22 nt, Homo sapiens
cugugcaaagcgcucucggggu

SEQ ID NO: 17604 - RNA, 22 nt, Homo sapiens
cugugcacaucuggcggcccga

SEQ ID NO: 17605 - RNA, 22 nt, Homo sapiens
cugugcauggauuuuaagauug

SEQ ID NO: 17606 - RNA, 19 nt, Homo sapiens
cugugcauuucuguggaag

SEQ ID NO: 17607 - RNA, 22 nt, Homo sapiens
cuguggguuuuacuguuuuacu

SEQ ID NO: 17608 - RNA, 23 nt, Homo sapiens
cuguggugaggcccuagaaucug

SEQ ID NO: 17609 - RNA, 22 nt, Homo sapiens
cugugguguaacucuuggggcg

SEQ ID NO: 17610 - RNA, 22 nt, Homo sapiens
auaaaugccuguuguuuuaagc

SEQ ID NO: 17611 - RNA, 22 nt, Homo sapiens
auaaauucauuuaagcuccuua

SEQ ID NO: 17612 - RNA, 22 nt, Homo sapiens
auaacauccuuucuuaucguug

SEQ ID NO: 17613 - RNA, 22 nt, Homo sapiens
auaagaagugaaccagacgucu

SEQ ID NO: 17614 - RNA, 22 nt, Homo sapiens
auaagauaguggaagugggauu

SEQ ID NO: 17615 - RNA, 22 nt, Homo sapiens
auaagucaauggaacagauuaa

SEQ ID NO: 17616 - RNA, 22 nt, Homo sapiens
auacagugaauacuuacagugu

SEQ ID NO: 17617 - RNA, 22 nt, Homo sapiens
auacaugugugagcgaagaugu

SEQ ID NO: 17618 - RNA, 22 nt, Homo sapiens
auacauguucaagggcauauau

SEQ ID NO: 17619 - RNA, 21 nt, Homo sapiens
auacuugcauccuuggagaga

SEQ ID NO: 17620 - RNA, 22 nt, Homo sapiens
auagaagcuauguauaggggcc

SEQ ID NO: 17621 - RNA, 22 nt, Homo sapiens
auagaaucaucugugcacuagu

SEQ ID NO: 17622 - RNA, 22 nt, Homo sapiens
auagaauguauuaguaaauuug

SEQ ID NO: 17623 - RNA, 21 nt, Homo sapiens
auagcacaucagauuuuauua

SEQ ID NO: 17624 - RNA, 22 nt, Homo sapiens
auagcagaacagugucucacug

SEQ ID NO: 17625 - RNA, 22 nt, Homo sapiens
auagcauaucccacaugucaga

SEQ ID NO: 17626 - RNA, 20 nt, Homo sapiens
auagcauugauggacucaaa

SEQ ID NO: 17627 - RNA, 22 nt, Homo sapiens
auaggagugugcacagaguagg

SEQ ID NO: 17628 - RNA, 22 nt, Homo sapiens
auagguagcauagcaggaauau

SEQ ID NO: 17629 - RNA, 22 nt, Homo sapiens
auagucaguagucucauaauga

SEQ ID NO: 17630 - RNA, 22 nt, Homo sapiens
auagugcuauggcagaccuuga

SEQ ID NO: 17631 - RNA, 22 nt, Homo sapiens
auagugcugcaauaaacacacg

SEQ ID NO: 17632 - RNA, 22 nt, Homo sapiens
auagugcugcaauaaacauaca

SEQ ID NO: 17633 - RNA, 22 nt, Homo sapiens
auagugcugcauuaaacauacg

SEQ ID NO: 17634 - RNA, 22 nt, Homo sapiens
auagugcugccauaaacauacg

SEQ ID NO: 17635 - RNA, 22 nt, Homo sapiens
auagugcuggaauaaauauacg

SEQ ID NO: 17636 - RNA, 22 nt, Homo sapiens
auagugcugugaugaacauaca

SEQ ID NO: 17637 - RNA, 22 nt, Homo sapiens
auauagcaaugaaagagaugaa

SEQ ID NO: 17638 - RNA, 22 nt, Homo sapiens
auauaugcacacgugugcauau

SEQ ID NO: 17639 - RNA, 22 nt, Homo sapiens
auauaugcuaagugcuaauaaa

SEQ ID NO: 17640 - RNA, 22 nt, Homo sapiens
auauccuggagcauuuuugcaa

SEQ ID NO: 17641 - RNA, 22 nt, Homo sapiens
auaugcaaauccauagagacag

SEQ ID NO: 17642 - RNA, 22 nt, Homo sapiens
auaugcacgugcauacacacuu

SEQ ID NO: 17643 - RNA, 22 nt, Homo sapiens
auauguaguuucagaaguggaa

SEQ ID NO: 17644 - RNA, 22 nt, Homo sapiens
auaugugacuucaugcaaggcu

SEQ ID NO: 17645 - RNA, 22 nt, Homo sapiens
auauguucucauucauaugugg

SEQ ID NO: 17646 - RNA, 22 nt, Homo sapiens
ccucauggagaaccucugcuag

SEQ ID NO: 17647 - RNA, 22 nt, Homo sapiens
ccucauggagaacuucugcuag

SEQ ID NO: 17648 - RNA, 22 nt, Homo sapiens
ccucauugcuaucccaggcuga

SEQ ID NO: 17649 - RNA, 22 nt, Homo sapiens
ccugagaucauacuguuaguaa

SEQ ID NO: 17650 - RNA, 22 nt, Homo sapiens
ccuggaagaaaggugcuaaaua

SEQ ID NO: 17651 - RNA, 22 nt, Homo sapiens
ccuggcacugagcaguguucua

SEQ ID NO: 17652 - RNA, 22 nt, Homo sapiens
ccugucuugaagagauccuccu

SEQ ID NO: 17653 - RNA, 18 nt, Homo sapiens
ccuuaguuauagagaguc

SEQ ID NO: 17654 - RNA, 22 nt, Homo sapiens
ccuugguaauguguuuuauucu

SEQ ID NO: 17655 - RNA, 22 nt, Homo sapiens
ccuugguggccacaagacauug

SEQ ID NO: 17656 - RNA, 19 nt, Homo sapiens
ccuuugguuuccaugacau

SEQ ID NO: 17657 - RNA, 22 nt, Homo sapiens
cgugaauguuuuggucuuucac

SEQ ID NO: 17658 - RNA, 22 nt, Homo sapiens
cgugaggaguauuuuuaggugc

SEQ ID NO: 17659 - RNA, 22 nt, Homo sapiens
cguugcacuccagccugggcaa

SEQ ID NO: 17660 - RNA, 20 nt, Homo sapiens
cuaaucaucccagaagaaau

SEQ ID NO: 17661 - RNA, 22 nt, Homo sapiens
cuacagaguaucuaaagaggua

SEQ ID NO: 17662 - RNA, 21 nt, Homo sapiens
cuacccuguauuagagaaaga

SEQ ID NO: 17663 - RNA, 23 nt, Homo sapiens
cuacuagucaagucuuuuccagu

SEQ ID NO: 17664 - RNA, 22 nt, Homo sapiens
cuagcagaacaauacaauucgg

SEQ ID NO: 17665 - RNA, 22 nt, Homo sapiens
cuagcagacacuuccagagagu

SEQ ID NO: 17666 - RNA, 22 nt, Homo sapiens
cuagcagacaugggcugaacca

SEQ ID NO: 17667 - RNA, 22 nt, Homo sapiens
cuagccuggagugcaguggugc

SEQ ID NO: 17668 - RNA, 22 nt, Homo sapiens
cuaggcuguagagaaguucagu

SEQ ID NO: 17669 - RNA, 22 nt, Homo sapiens
cuauaugucuguuuugguacca

SEQ ID NO: 17670 - RNA, 22 nt, Homo sapiens
cuauucacaauggugaagauau

SEQ ID NO: 17671 - RNA, 22 nt, Homo sapiens
cuauucacaggcaauauguaca

SEQ ID NO: 17672 - RNA, 21 nt, Homo sapiens
cucaaaguacugauauuacag

SEQ ID NO: 17673 - RNA, 22 nt, Homo sapiens
cucaaguaauccucccgccuug

SEQ ID NO: 17674 - RNA, 18 nt, Homo sapiens
cucacacccuaaucagga

SEQ ID NO: 17675 - RNA, 22 nt, Homo sapiens
cucacagucagaagggacuugc

SEQ ID NO: 17676 - RNA, 22 nt, Homo sapiens
cucaccuugugauccacccacc

SEQ ID NO: 17677 - RNA, 22 nt, Homo sapiens
cucacuggguguaaaacaugua

SEQ ID NO: 17678 - RNA, 22 nt, Homo sapiens
cucacugucaacauguauuugg

SEQ ID NO: 17679 - RNA, 22 nt, Homo sapiens
cucacugugguguccuuaggua

SEQ ID NO: 17680 - RNA, 22 nt, Homo sapiens
cucagucuaugauacuuugcua

SEQ ID NO: 17681 - RNA, 20 nt, Homo sapiens
cucagugcacccccauaaaa

SEQ ID NO: 17682 - RNA, 22 nt, Homo sapiens
cucaguggauuagauaaugcac

SEQ ID NO: 17683 - RNA, 21 nt, Homo sapiens
cucauauugcuuuuccauggu

SEQ ID NO: 17684 - RNA, 22 nt, Homo sapiens
cucauggagaacaucugcuagg

SEQ ID NO: 17685 - RNA, 19 nt, Homo sapiens
cucauggagaaggagaaua

SEQ ID NO: 17686 - RNA, 22 nt, Homo sapiens
cucauuggcuacugaggcuugu

SEQ ID NO: 17687 - RNA, 22 nt, Homo sapiens
cuccagugcaaagucaugauca

SEQ ID NO: 17688 - RNA, 22 nt, Homo sapiens
cuccaguuucagaaucccaugu

SEQ ID NO: 17689 - RNA, 22 nt, Homo sapiens
cucccacccucauuuuuaggca

SEQ ID NO: 17690 - RNA, 22 nt, Homo sapiens
cucuuugaggugagcugcccau

SEQ ID NO: 17691 - RNA, 22 nt, Homo sapiens
cucuuuuguuuagcugagaggg

SEQ ID NO: 17692 - RNA, 22 nt, Homo sapiens
cugaaauguccaucgacugaug

SEQ ID NO: 17693 - RNA, 22 nt, Homo sapiens
cugaauagagcacacugauggg

SEQ ID NO: 17694 - RNA, 22 nt, Homo sapiens
cugacagucucauugauuugcu

SEQ ID NO: 17695 - RNA, 22 nt, Homo sapiens
cugacaugcagccacugcaccu

SEQ ID NO: 17696 - RNA, 22 nt, Homo sapiens
cugagaagaaacagguaaggac

SEQ ID NO: 17697 - RNA, 22 nt, Homo sapiens
cugagacacucuuaucugcaua

SEQ ID NO: 17698 - RNA, 22 nt, Homo sapiens
cugagaucaagucuugcucugu

SEQ ID NO: 17699 - RNA, 22 nt, Homo sapiens
cugagaucaugggucagguggu

SEQ ID NO: 17700 - RNA, 22 nt, Homo sapiens
cugagauuaagauauugggagu

SEQ ID NO: 17701 - RNA, 18 nt, Homo sapiens
cugagcacugcuuuauga

SEQ ID NO: 17702 - RNA, 22 nt, Homo sapiens
cugagcccauucuggggagaag

SEQ ID NO: 17703 - RNA, 22 nt, Homo sapiens
cugaggauauucagccucugug

SEQ ID NO: 17704 - RNA, 22 nt, Homo sapiens
cugaggugggagaaucacauaa

SEQ ID NO: 17705 - RNA, 20 nt, Homo sapiens
cugauacagccugagcucuc

SEQ ID NO: 17706 - RNA, 21 nt, Homo sapiens
cugaucacaggugagcugccu

SEQ ID NO: 17707 - RNA, 22 nt, Homo sapiens
cugaucuguagcagccaccaca

SEQ ID NO: 17708 - RNA, 22 nt, Homo sapiens
cugaucuguuauacuuuucuau

SEQ ID NO: 17709 - RNA, 22 nt, Homo sapiens
cugaugaaguauuuguucugga

SEQ ID NO: 17710 - RNA, 22 nt, Homo sapiens
cugaugguuuuacacaagggca

SEQ ID NO: 17711 - RNA, 22 nt, Homo sapiens
cugauguagguggucugugauc

SEQ ID NO: 17712 - RNA, 19 nt, Homo sapiens
cugcacugagaaaaggagg

SEQ ID NO: 17713 - RNA, 22 nt, Homo sapiens
cugcacugagacccucuuugcu

SEQ ID NO: 17714 - RNA, 22 nt, Homo sapiens
cugcagaucuuggggcuugcca

SEQ ID NO: 17715 - RNA, 22 nt, Homo sapiens
cugcuaagagaaugagacuuag

SEQ ID NO: 17716 - RNA, 20 nt, Homo sapiens
cugcuccccuacaaaucuca

SEQ ID NO: 17717 - RNA, 20 nt, Homo sapiens
augucagaguguggguacgg

SEQ ID NO: 17718 - RNA, 22 nt, Homo sapiens
augucuggcagaagacuucuca

SEQ ID NO: 17719 - RNA, 22 nt, Homo sapiens
augucuuucauagagacccaga

SEQ ID NO: 17720 - RNA, 17 nt, Homo sapiens
augugaauguucaaaua

SEQ ID NO: 17721 - RNA, 22 nt, Homo sapiens
augugaugguuaauuuuaugug

SEQ ID NO: 17722 - RNA, 22 nt, Homo sapiens
augugcaauguguacguagccc

SEQ ID NO: 17723 - RNA, 18 nt, Homo sapiens
augugcaauuuuguauuu

SEQ ID NO: 17724 - RNA, 22 nt, Homo sapiens
augugcacaugcuuacauguga

SEQ ID NO: 17725 - RNA, 21 nt, Homo sapiens
augugcacuaugucauuuaau

SEQ ID NO: 17726 - RNA, 22 nt, Homo sapiens
augugcaugcuguucugccaga

SEQ ID NO: 17727 - RNA, 22 nt, Homo sapiens
augugcuuaaaaaugcagagaa

SEQ ID NO: 17728 - RNA, 22 nt, Homo sapiens
auguggugguagccaggacagg

SEQ ID NO: 17729 - RNA, 19 nt, Homo sapiens
augugguuagcaugacugc

SEQ ID NO: 17730 - RNA, 22 nt, Homo sapiens
auguugcaguuuaauuauccua

SEQ ID NO: 17731 - RNA, 22 nt, Homo sapiens
auguugcuugaaggcauuuugu

SEQ ID NO: 17732 - RNA, 22 nt, Homo sapiens
auguuugguaagaauauuguua

SEQ ID NO: 17733 - RNA, 23 nt, Homo sapiens
auuaagguuacuacaguaugagg

SEQ ID NO: 17734 - RNA, 22 nt, Homo sapiens
auuaaguuaggauuuugagaua

SEQ ID NO: 17735 - RNA, 22 nt, Homo sapiens
auuaaguugugccugaaaacuu

SEQ ID NO: 17736 - RNA, 22 nt, Homo sapiens
auuauaugucaucacagacacc

SEQ ID NO: 17737 - RNA, 20 nt, Homo sapiens
auucaaguaugccuugagaa

SEQ ID NO: 17738 - RNA, 22 nt, Homo sapiens
auucaagucaucucuccgcauu

SEQ ID NO: 17739 - RNA, 22 nt, Homo sapiens
auucacagcuuuaaaaggcgug

SEQ ID NO: 17740 - RNA, 22 nt, Homo sapiens
auucacagggggagaaggguau

SEQ ID NO: 17741 - RNA, 22 nt, Homo sapiens
auucacuuuuauagacaggucu

SEQ ID NO: 17742 - RNA, 22 nt, Homo sapiens
auuccacuuagugacucauuug

SEQ ID NO: 17743 - RNA, 22 nt, Homo sapiens
auucccuuagcugccucagccu

SEQ ID NO: 17744 - RNA, 22 nt, Homo sapiens
auucuugcuugaacuuggugca

SEQ ID NO: 17745 - RNA, 22 nt, Homo sapiens
auugaguaaaugaaaauugccu

SEQ ID NO: 17746 - RNA, 22 nt, Homo sapiens
auugcaaagcguagacucuaaa

SEQ ID NO: 17747 - RNA, 22 nt, Homo sapiens
auugcaacuuccgccuccuggg

SEQ ID NO: 17748 - RNA, 22 nt, Homo sapiens
auugcacaaagagggaaacuga

SEQ ID NO: 17749 - RNA, 22 nt, Homo sapiens
auugcacacagaaucaggguaa

SEQ ID NO: 17750 - RNA, 22 nt, Homo sapiens
auugcacuccagccuggcaaua

SEQ ID NO: 17751 - RNA, 22 nt, Homo sapiens
auugcacuccagccugggggac

SEQ ID NO: 17752 - RNA, 22 nt, Homo sapiens
auugcacugcagccugggcaac

SEQ ID NO: 17753 - RNA, 22 nt, Homo sapiens
auugcagaaaugacagagcgcc

SEQ ID NO: 17754 - RNA, 21 nt, Homo sapiens
ggaguauaaggcaaaggagug

SEQ ID NO: 17755 - RNA, 23 nt, Homo sapiens
ggaguguaaugacucgaucucgg

SEQ ID NO: 17756 - RNA, 23 nt, Homo sapiens
ggaguguauuggcacgaucucag

SEQ ID NO: 17757 - RNA, 22 nt, Homo sapiens
ggaguguguaggagaaagguaa

SEQ ID NO: 17758 - RNA, 22 nt, Homo sapiens
ggauaucauuauuucuagggcu

SEQ ID NO: 17759 - RNA, 22 nt, Homo sapiens
ggaugcauucaacuuccaguuc

SEQ ID NO: 17760 - RNA, 22 nt, Homo sapiens
ggcaaagaugaccauuacuuuu

SEQ ID NO: 17761 - RNA, 19 nt, Homo sapiens
ggcaagaguuguucugugu

SEQ ID NO: 17762 - RNA, 22 nt, Homo sapiens
ggcaaguucuaaugauuagaau

SEQ ID NO: 17763 - RNA, 19 nt, Homo sapiens
ggcaauacuuucuuguugg

SEQ ID NO: 17764 - RNA, 22 nt, Homo sapiens
ggcacaaugucagcucacugca

SEQ ID NO: 17765 - RNA, 22 nt, Homo sapiens
ggcagcacaauuuucugaugga

SEQ ID NO: 17766 - RNA, 22 nt, Homo sapiens
ggcagcauugccuuugcaguga

SEQ ID NO: 17767 - RNA, 17 nt, Homo sapiens
ggcaggaauuaauguca

SEQ ID NO: 17768 - RNA, 22 nt, Homo sapiens
ggcaguguaauaauuuauuaau

SEQ ID NO: 17769 - RNA, 22 nt, Homo sapiens
ggcuagagaauagugccacuaa

SEQ ID NO: 17770 - RNA, 19 nt, Homo sapiens
ggcucagucaacugacugu

SEQ ID NO: 17771 - RNA, 22 nt, Homo sapiens
ggcucguguuuucuguccaguu

SEQ ID NO: 17772 - RNA, 22 nt, Homo sapiens
ggcucuguugcuaccaauuaag

SEQ ID NO: 17773 - RNA, 22 nt, Homo sapiens
gggaugaagcccuaggguuggu

SEQ ID NO: 17774 - RNA, 20 nt, Homo sapiens
gggaugugagguacacucuu

SEQ ID NO: 17775 - RNA, 22 nt, Homo sapiens
gggcaaauuauguaucucucag

SEQ ID NO: 17776 - RNA, 22 nt, Homo sapiens
gggguaggcuacacugaguucc

SEQ ID NO: 17777 - RNA, 22 nt, Homo sapiens
ggguaggcaagcggaugucaga

SEQ ID NO: 17778 - RNA, 22 nt, Homo sapiens
gggugguuuuaucucuucccuu

SEQ ID NO: 17779 - RNA, 22 nt, Homo sapiens
ggguucaaaucuuggcucuuac

SEQ ID NO: 17780 - RNA, 22 nt, Homo sapiens
ggguucccuucuggcucagggu

SEQ ID NO: 17781 - RNA, 22 nt, Homo sapiens
gguauuuaaaguaccugucugc

SEQ ID NO: 17782 - RNA, 19 nt, Homo sapiens
ggucacagggguuacaagg

SEQ ID NO: 17783 - RNA, 22 nt, Homo sapiens
ggucacauugcuagcauggguu

SEQ ID NO: 17784 - RNA, 22 nt, Homo sapiens
ggucaggagaaugguaacugag

SEQ ID NO: 17785 - RNA, 19 nt, Homo sapiens
ggucauggagguuguguga

SEQ ID NO: 17786 - RNA, 22 nt, Homo sapiens
ggucauggauaagauccagaag

SEQ ID NO: 17787 - RNA, 22 nt, Homo sapiens
ggucugguguugaaauucuuca

SEQ ID NO: 17788 - RNA, 22 nt, Homo sapiens
ggugacugguuuaucuggcagu

SEQ ID NO: 17789 - RNA, 22 nt, Homo sapiens
ggugagcacagaaugcccugag

SEQ ID NO: 17790 - RNA, 22 nt, Homo sapiens
gguggcaaaucugaguggcgcu

SEQ ID NO: 17791 - RNA, 22 nt, Homo sapiens
gguggugguauuucagaaaaug

SEQ ID NO: 17792 - RNA, 22 nt, Homo sapiens
guaaaguaaagcacaucaaggu

SEQ ID NO: 17793 - RNA, 22 nt, Homo sapiens
guaacucugucacuuacuaguu

SEQ ID NO: 17794 - RNA, 22 nt, Homo sapiens
guaaucucagcuacucgggagg

SEQ ID NO: 17795 - RNA, 22 nt, Homo sapiens
guagcagucacauagcagauug

SEQ ID NO: 17796 - RNA, 22 nt, Homo sapiens
guagcaucauuugcaauuucau

SEQ ID NO: 17797 - RNA, 22 nt, Homo sapiens
guaguagcacgagcucugucuc

SEQ ID NO: 17798 - RNA, 22 nt, Homo sapiens
guagugcaguuugagaaucagu

SEQ ID NO: 17799 - RNA, 22 nt, Homo sapiens
guauggguuuuguuucuucugg

SEQ ID NO: 17800 - RNA, 22 nt, Homo sapiens
guaugucuugucuauggcugcu

SEQ ID NO: 17801 - RNA, 22 nt, Homo sapiens
guaugugacuggaacaguagga

SEQ ID NO: 17802 - RNA, 22 nt, Homo sapiens
guauuguacuacaagcucuuua

SEQ ID NO: 17803 - RNA, 22 nt, Homo sapiens
gucaagugaagcagugggagua

SEQ ID NO: 17804 - RNA, 22 nt, Homo sapiens
gucagcaaagaggaauaguuug

SEQ ID NO: 17805 - RNA, 22 nt, Homo sapiens
gucaggugcuuacgcggagauc

SEQ ID NO: 17806 - RNA, 22 nt, Homo sapiens
gucagugccugucccaggcuuu

SEQ ID NO: 17807 - RNA, 22 nt, Homo sapiens
gucaugaaguuuugaaugaaau

SEQ ID NO: 17808 - RNA, 22 nt, Homo sapiens
gucauugguucuguuuauguga

SEQ ID NO: 17809 - RNA, 22 nt, Homo sapiens
guccaagacuaggaguuggcag

SEQ ID NO: 17810 - RNA, 22 nt, Homo sapiens
guccagagaagucauuacuuca

SEQ ID NO: 17811 - RNA, 22 nt, Homo sapiens
guccaguguuggagguuuuacc

SEQ ID NO: 17812 - RNA, 22 nt, Homo sapiens
guccaguuguuuucugagguug

SEQ ID NO: 17813 - RNA, 20 nt, Homo sapiens
guccauuugcugccauugcu

SEQ ID NO: 17814 - RNA, 22 nt, Homo sapiens
gucccagagauauugugucuuu

SEQ ID NO: 17815 - RNA, 22 nt, Homo sapiens
gucccaguggaaccuccaagcu

SEQ ID NO: 17816 - RNA, 22 nt, Homo sapiens
gucuagaacuucugaccuuagg

SEQ ID NO: 17817 - RNA, 22 nt, Homo sapiens
gucuccgagccguguggagccg

SEQ ID NO: 17818 - RNA, 22 nt, Homo sapiens
gucuggagacuugggucaucaa

SEQ ID NO: 17819 - RNA, 22 nt, Homo sapiens
gucuggcacagggaaaguacaa

SEQ ID NO: 17820 - RNA, 22 nt, Homo sapiens
gucuggcuuaucucacuuacca

SEQ ID NO: 17821 - RNA, 23 nt, Homo sapiens
gucuggucccugguuggaaacca

SEQ ID NO: 17822 - RNA, 20 nt, Homo sapiens
gucugucuccgaguagaauu

SEQ ID NO: 17823 - RNA, 22 nt, Homo sapiens
gucugugcauuaauacgugcug

SEQ ID NO: 17824 - RNA, 22 nt, Homo sapiens
gucuuugcauguauguucauga

SEQ ID NO: 17825 - RNA, 22 nt, Homo sapiens
ucagugcuguuugcccucguuu

SEQ ID NO: 17826 - RNA, 22 nt, Homo sapiens
ucaguggagccucacucugugg

SEQ ID NO: 17827 - RNA, 22 nt, Homo sapiens
ucaguggauuauuaaagucacc

SEQ ID NO: 17828 - RNA, 22 nt, Homo sapiens
ucauacaguaguccucacuugu

SEQ ID NO: 17829 - RNA, 22 nt, Homo sapiens
ucauacgucuccuugugccacc

SEQ ID NO: 17830 - RNA, 22 nt, Homo sapiens
ucauaggucugagaagaaaaua

SEQ ID NO: 17831 - RNA, 22 nt, Homo sapiens
ucauccauacaguuagcaaagg

SEQ ID NO: 17832 - RNA, 22 nt, Homo sapiens
ucaucuggcgaaugugaagagu

SEQ ID NO: 17833 - RNA, 22 nt, Homo sapiens
ucaugagacacacuggaaagga

SEQ ID NO: 17834 - RNA, 22 nt, Homo sapiens
ucauggcuuuuauuauguugag

SEQ ID NO: 17835 - RNA, 22 nt, Homo sapiens
ucauggggugagcuacaggcac

SEQ ID NO: 17836 - RNA, 22 nt, Homo sapiens
ucauguauuaucauuagugggu

SEQ ID NO: 17837 - RNA, 22 nt, Homo sapiens
ucaugugaggauaacaauagug

SEQ ID NO: 17838 - RNA, 19 nt, Homo sapiens
ucaugugcauacauuuggg

SEQ ID NO: 17839 - RNA, 22 nt, Homo sapiens
ucauuggaugucugaaaugauu

SEQ ID NO: 17840 - RNA, 22 nt, Homo sapiens
uccacagugguggaauuguuca

SEQ ID NO: 17841 - RNA, 22 nt, Homo sapiens
uccacagugguugaacuaguaa

SEQ ID NO: 17842 - RNA, 22 nt, Homo sapiens
uccagguuuggcuuuauaacuu

SEQ ID NO: 17843 - RNA, 22 nt, Homo sapiens
uccaguacaggucucucauuuc

SEQ ID NO: 17844 - RNA, 22 nt, Homo sapiens
uccaguguuauaauaugcgucu

SEQ ID NO: 17845 - RNA, 22 nt, Homo sapiens
uccaguuuggaggcuugaugug

SEQ ID NO: 17846 - RNA, 22 nt, Homo sapiens
uccaugaguccauuagaaaaaa

SEQ ID NO: 17847 - RNA, 22 nt, Homo sapiens
ucccuacugggguacugccuag

SEQ ID NO: 17848 - RNA, 22 nt, Homo sapiens
ucccugaguaucuaauguguuu

SEQ ID NO: 17849 - RNA, 22 nt, Homo sapiens
ucccugguguuaguuuguucuu

SEQ ID NO: 17850 - RNA, 22 nt, Homo sapiens
ucccuugagccuggcuucucac

SEQ ID NO: 17851 - RNA, 22 nt, Homo sapiens
uccucauggagaaccucugcua

SEQ ID NO: 17852 - RNA, 22 nt, Homo sapiens
uccugagacugaggagcuuugg

SEQ ID NO: 17853 - RNA, 21 nt, Homo sapiens
uccugagagaggaguaacucu

SEQ ID NO: 17854 - RNA, 22 nt, Homo sapiens
uccuugagucugaacuuuggau

SEQ ID NO: 17855 - RNA, 22 nt, Homo sapiens
uccuuggugacauuucuugucu

SEQ ID NO: 17856 - RNA, 22 nt, Homo sapiens
ucgcagcucacuggagccucga

SEQ ID NO: 17857 - RNA, 22 nt, Homo sapiens
ucuauggauaaaaugcccucau

SEQ ID NO: 17858 - RNA, 22 nt, Homo sapiens
ucucaaguggucgcaguuagau

SEQ ID NO: 17859 - RNA, 22 nt, Homo sapiens
ucucagcacaaacaaaauugcu

SEQ ID NO: 17860 - RNA, 22 nt, Homo sapiens
ucucagugaauguggaaaaagc

SEQ ID NO: 17861 - RNA, 20 nt, Homo sapiens
ucucauggagggaaagagca

SEQ ID NO: 17862 - RNA, 22 nt, Homo sapiens
ugagugccuggagggcagggac

SEQ ID NO: 17863 - RNA, 22 nt, Homo sapiens
ugaguuagguaauaauaaauau

SEQ ID NO: 17864 - RNA, 22 nt, Homo sapiens
ugaguuagguguuuuaaauaua

SEQ ID NO: 17865 - RNA, 22 nt, Homo sapiens
ugaguucaauuguauuuuauua

SEQ ID NO: 17866 - RNA, 18 nt, Homo sapiens
ugaguucauuagacuucc

SEQ ID NO: 17867 - RNA, 20 nt, Homo sapiens
ugaguuccuuguucagaagc

SEQ ID NO: 17868 - RNA, 22 nt, Homo sapiens
ugauaauuuugucagguuuugg

SEQ ID NO: 17869 - RNA, 18 nt, Homo sapiens
ugauaucaucacaauuga

SEQ ID NO: 17870 - RNA, 22 nt, Homo sapiens
ugauaugaaguucaaaccaggu

SEQ ID NO: 17871 - RNA, 22 nt, Homo sapiens
ugaugacacugauuucuucaau

SEQ ID NO: 17872 - RNA, 22 nt, Homo sapiens
ugaugguuuuaaaaagaggagu

SEQ ID NO: 17873 - RNA, 22 nt, Homo sapiens
ugaugucuugagauggagcuua

SEQ ID NO: 17874 - RNA, 22 nt, Homo sapiens
ugaugucuugcaggcacgagau

SEQ ID NO: 17875 - RNA, 22 nt, Homo sapiens
ugauuagagcccaagcuuugaa

SEQ ID NO: 17876 - RNA, 22 nt, Homo sapiens
ugauugacauucuuuggaguau

SEQ ID NO: 17877 - RNA, 22 nt, Homo sapiens
ugauugcacaccugcacucaag

SEQ ID NO: 17878 - RNA, 22 nt, Homo sapiens
ugauugucucuccugccccauc

SEQ ID NO: 17879 - RNA, 22 nt, Homo sapiens
ugauuuguuuagugccaaguuu

SEQ ID NO: 17880 - RNA, 22 nt, Homo sapiens
ugcaaaguccucauucuuaccc

SEQ ID NO: 17881 - RNA, 22 nt, Homo sapiens
ugcaaauguuaguaacaccacu

SEQ ID NO: 17882 - RNA, 21 nt, Homo sapiens
ugcaagaaucaggaagcugcc

SEQ ID NO: 17883 - RNA, 22 nt, Homo sapiens
ugcaagaaucuuucaggcuagc

SEQ ID NO: 17884 - RNA, 22 nt, Homo sapiens
ugcaagaugagauuuuggaugg

SEQ ID NO: 17885 - RNA, 22 nt, Homo sapiens
ugcaaucaucgcuguuggccac

SEQ ID NO: 17886 - RNA, 22 nt, Homo sapiens
ugcaaugucuucugaggggagc

SEQ ID NO: 17887 - RNA, 22 nt, Homo sapiens
ugcacacucuguaugagaaucu

SEQ ID NO: 17888 - RNA, 22 nt, Homo sapiens
ugcaccaucuugcuucuguggu

SEQ ID NO: 17889 - RNA, 21 nt, Homo sapiens
ugcagccauucagcccuaugc

SEQ ID NO: 17890 - RNA, 22 nt, Homo sapiens
ugcaguacauucagcauccucu

SEQ ID NO: 17891 - RNA, 22 nt, Homo sapiens
ugcaguacugucagacuucuua

SEQ ID NO: 17892 - RNA, 22 nt, Homo sapiens
ugcaguaggcccagcgggaggc

SEQ ID NO: 17893 - RNA, 22 nt, Homo sapiens
ugcagugucaauaauaauuagu

SEQ ID NO: 17894 - RNA, 22 nt, Homo sapiens
ugcauagaauguucuguaaaua

SEQ ID NO: 17895 - RNA, 21 nt, Homo sapiens
ugcauaucucuaaugaccagu

SEQ ID NO: 17896 - RNA, 22 nt, Homo sapiens
ugcauaucuucuuuugagaaau

SEQ ID NO: 17897 - RNA, 22 nt, Homo sapiens
ugcauggucauacauggcaccc

SEQ ID NO: 17898 - RNA, 22 nt, Homo sapiens
ugcauguucuuacucauacaug

SEQ ID NO: 17899 - RNA, 20 nt, Homo sapiens
ugccaagaaaugaggguauu

SEQ ID NO: 17900 - RNA, 22 nt, Homo sapiens
ugccaagaacauuuucuguuuu

SEQ ID NO: 17901 - RNA, 22 nt, Homo sapiens
ugccagaugcaguguucaacaa

SEQ ID NO: 17902 - RNA, 22 nt, Homo sapiens
ugccaguauuuuauugaggauu

SEQ ID NO: 17903 - RNA, 22 nt, Homo sapiens
ugcccguaauuccagcacuuug

SEQ ID NO: 17904 - RNA, 18 nt, Homo sapiens
ugccuacugggcucaagc

SEQ ID NO: 17905 - RNA, 22 nt, Homo sapiens
ugccuaggcuggaaugcaaugg

SEQ ID NO: 17906 - RNA, 22 nt, Homo sapiens
ugccugagccagguuuuaggag

SEQ ID NO: 17907 - RNA, 22 nt, Homo sapiens
ugccugagcccagcccuguagu

SEQ ID NO: 17908 - RNA, 22 nt, Homo sapiens
ugccugcugucuaauauauucu

SEQ ID NO: 17909 - RNA, 21 nt, Homo sapiens
ugccuuuguaguaggugucuu

SEQ ID NO: 17910 - RNA, 20 nt, Homo sapiens
ugcugcacuuaagcaugggc

SEQ ID NO: 17911 - RNA, 22 nt, Homo sapiens
ugcugcuguuguuguuacuagc

SEQ ID NO: 17912 - RNA, 22 nt, Homo sapiens
ugcuggugauuaaauccugaag

SEQ ID NO: 17913 - RNA, 22 nt, Homo sapiens
ugcuggugucaucaaggcuuug

SEQ ID NO: 17914 - RNA, 22 nt, Homo sapiens
ugcugguguggucuagccgcuu

SEQ ID NO: 17915 - RNA, 21 nt, Homo sapiens
ugcuuuggucauacuucuucc

SEQ ID NO: 17916 - RNA, 22 nt, Homo sapiens
uggaaaguacugagguccaccu

SEQ ID NO: 17917 - RNA, 22 nt, Homo sapiens
uggaagacauugggugaagggu

SEQ ID NO: 17918 - RNA, 22 nt, Homo sapiens
uggaagacauuuuggaccuugg

SEQ ID NO: 17919 - RNA, 23 nt, Homo sapiens
uggaagacuccucucuuggcugc

SEQ ID NO: 17920 - RNA, 22 nt, Homo sapiens
uggaagacucuagucucuugag

SEQ ID NO: 17921 - RNA, 22 nt, Homo sapiens
uggaagaugggaccucaguuuu

SEQ ID NO: 17922 - RNA, 22 nt, Homo sapiens
uggaauacuauucugugcugga

SEQ ID NO: 17923 - RNA, 22 nt, Homo sapiens
uggaaucuagagaaaugcaaac

SEQ ID NO: 17924 - RNA, 21 nt, Homo sapiens
uggaaucuauuauuccaguuu

SEQ ID NO: 17925 - RNA, 22 nt, Homo sapiens
uggacaugaagggcacaggagg

SEQ ID NO: 17926 - RNA, 22 nt, Homo sapiens
uggaccccugcucgggagcccu

SEQ ID NO: 17927 - RNA, 22 nt, Homo sapiens
uggaccccuucuccuauuaaaa

SEQ ID NO: 17928 - RNA, 22 nt, Homo sapiens
uggagacugaucccucuuuccu

SEQ ID NO: 17929 - RNA, 22 nt, Homo sapiens
uggagagcaaaaucaauccaaa

SEQ ID NO: 17930 - RNA, 22 nt, Homo sapiens
uggagagugauaaguaaaugga

SEQ ID NO: 17931 - RNA, 23 nt, Homo sapiens
uggaggacaagcauggauaguga

SEQ ID NO: 17932 - RNA, 20 nt, Homo sapiens
uggaggucaucugucacuac

SEQ ID NO: 17933 - RNA, 22 nt, Homo sapiens
ucauucuuucuguggaggggcu

SEQ ID NO: 17934 - RNA, 22 nt, Homo sapiens
ucauugcaaucucugccucccg

SEQ ID NO: 17935 - RNA, 22 nt, Homo sapiens
ucauugguucuggguguuguug

SEQ ID NO: 17936 - RNA, 19 nt, Homo sapiens
uccacagugguugaacuag

SEQ ID NO: 17937 - RNA, 18 nt, Homo sapiens
uccacgugcuuuccagau

SEQ ID NO: 17938 - RNA, 21 nt, Homo sapiens
uccagcuuugagaguuguggu

SEQ ID NO: 17939 - RNA, 22 nt, Homo sapiens
uccagcuuuuucuaauucugug

SEQ ID NO: 17940 - RNA, 22 nt, Homo sapiens
uccagguuucaugcucuuuauu

SEQ ID NO: 17941 - RNA, 22 nt, Homo sapiens
uccauggagacacauuuuauau

SEQ ID NO: 17942 - RNA, 22 nt, Homo sapiens
uccauugucuagauguaacaca

SEQ ID NO: 17943 - RNA, 16 nt, Homo sapiens
ucccaccauugcuugu

SEQ ID NO: 17944 - RNA, 22 nt, Homo sapiens
ucccagaaacgcauauguucau

SEQ ID NO: 17945 - RNA, 22 nt, Homo sapiens
ucccauguagcuaggauuacag

SEQ ID NO: 17946 - RNA, 22 nt, Homo sapiens
uccccaguaggcaauuaacacc

SEQ ID NO: 17947 - RNA, 19 nt, Homo sapiens
uccccaguuuuccguucag

SEQ ID NO: 17948 - RNA, 22 nt, Homo sapiens
uccccugauaccaaccaccaug

SEQ ID NO: 17949 - RNA, 22 nt, Homo sapiens
ucccuacuggggcacugccuag

SEQ ID NO: 17950 - RNA, 18 nt, Homo sapiens
ucccucagaauuauagaa

SEQ ID NO: 17951 - RNA, 22 nt, Homo sapiens
ucccugaaucucagguucugua

SEQ ID NO: 17952 - RNA, 22 nt, Homo sapiens
ucccugacagggucugagcuuu

SEQ ID NO: 17953 - RNA, 22 nt, Homo sapiens
ucccugagugauugaaaauaaa

SEQ ID NO: 17954 - RNA, 22 nt, Homo sapiens
ucccuuucuggaguuucccaag

SEQ ID NO: 17955 - RNA, 19 nt, Homo sapiens
ucccuuuguagguaaccug

SEQ ID NO: 17956 - RNA, 22 nt, Homo sapiens
ucccuuuguccaacggauccac

SEQ ID NO: 17957 - RNA, 22 nt, Homo sapiens
uccugagaauagaguugcaugu

SEQ ID NO: 17958 - RNA, 22 nt, Homo sapiens
uccugagacucacaggcucccc

SEQ ID NO: 17959 - RNA, 20 nt, Homo sapiens
uccugagauucccaguucuc

SEQ ID NO: 17960 - RNA, 22 nt, Homo sapiens
uccugcauucugacuugcuuuc

SEQ ID NO: 17961 - RNA, 22 nt, Homo sapiens
uccuugagccugggaguuauag

SEQ ID NO: 17962 - RNA, 22 nt, Homo sapiens
uccuugagccuuaaauuauaaa

SEQ ID NO: 17963 - RNA, 22 nt, Homo sapiens
uccuuuaguuaauaaagacaag

SEQ ID NO: 17964 - RNA, 22 nt, Homo sapiens
ucgcauuucccucuguagcuuc

SEQ ID NO: 17965 - RNA, 22 nt, Homo sapiens
ucgugcaaacguaauugugguu

SEQ ID NO: 17966 - RNA, 22 nt, Homo sapiens
ucuaaaacuagauugugaugau

SEQ ID NO: 17967 - RNA, 22 nt, Homo sapiens
ucuaauguaaccugcaaauauu

SEQ ID NO: 17968 - RNA, 22 nt, Homo sapiens
ucuagccuaugaagcuugucca

SEQ ID NO: 17969 - RNA, 22 nt, Homo sapiens
ucuauggaguuugaaugagaaa

SEQ ID NO: 17970 - RNA, 20 nt, Homo sapiens
aucucugggcaaaggaaaau

SEQ ID NO: 17971 - RNA, 22 nt, Homo sapiens
aucugcaaagcugggcugagac

SEQ ID NO: 17972 - RNA, 22 nt, Homo sapiens
aucugugaaugaaguuauuuug

SEQ ID NO: 17973 - RNA, 22 nt, Homo sapiens
aucuucucuugaagggugggga

SEQ ID NO: 17974 - RNA, 22 nt, Homo sapiens
aucuugcauuugcuaaaaugca

SEQ ID NO: 17975 - RNA, 22 nt, Homo sapiens
aucuuuggucaucacagcuaga

SEQ ID NO: 17976 - RNA, 22 nt, Homo sapiens
augaaacuggcuaauuuuugua

SEQ ID NO: 17977 - RNA, 22 nt, Homo sapiens
augaaagugauaaaugucucua

SEQ ID NO: 17978 - RNA, 22 nt, Homo sapiens
augaaaguguguggaaacuuga

SEQ ID NO: 17979 - RNA, 22 nt, Homo sapiens
augaaaucuuuggcagaucuua

SEQ ID NO: 17980 - RNA, 18 nt, Homo sapiens
augaacucaucauuuuuu

SEQ ID NO: 17981 - RNA, 22 nt, Homo sapiens
augaacucaucauuuuuuaugg

SEQ ID NO: 17982 - RNA, 20 nt, Homo sapiens
augaaggcaggugugaguuu

SEQ ID NO: 17983 - RNA, 22 nt, Homo sapiens
augaaguauuaggacacauuua

SEQ ID NO: 17984 - RNA, 23 nt, Homo sapiens
augaauguaaggaguguaagaaa

SEQ ID NO: 17985 - RNA, 17 nt, Homo sapiens
augacuucuucagugug

SEQ ID NO: 17986 - RNA, 22 nt, Homo sapiens
augagacuagaagagaauaaua

SEQ ID NO: 17987 - RNA, 22 nt, Homo sapiens
augagagcuaacuguggguaca

SEQ ID NO: 17988 - RNA, 22 nt, Homo sapiens
augagagugagagcagccccuu

SEQ ID NO: 17989 - RNA, 22 nt, Homo sapiens
augagauacuacaaaugaguuu

SEQ ID NO: 17990 - RNA, 22 nt, Homo sapiens
augagaucugugaacaccuguc

SEQ ID NO: 17991 - RNA, 22 nt, Homo sapiens
augagauuauguaaagagacca

SEQ ID NO: 17992 - RNA, 22 nt, Homo sapiens
augagauuguuugugugaaaua

SEQ ID NO: 17993 - RNA, 19 nt, Homo sapiens
augagcaauaguuuuaauc

SEQ ID NO: 17994 - RNA, 22 nt, Homo sapiens
augagcacuuguuuugggcaca

SEQ ID NO: 17995 - RNA, 22 nt, Homo sapiens
augagcaucaccagaaucaaua

SEQ ID NO: 17996 - RNA, 22 nt, Homo sapiens
augagcucauaaagagugauuu

SEQ ID NO: 17997 - RNA, 22 nt, Homo sapiens
augagcucauugggugacuggg

SEQ ID NO: 17998 - RNA, 22 nt, Homo sapiens
augaggaagucaggcccagggg

SEQ ID NO: 17999 - RNA, 22 nt, Homo sapiens
augagggcggacgcccuggaga

SEQ ID NO: 18000 - RNA, 22 nt, Homo sapiens
augagguccuagccaacuuuuu

SEQ ID NO: 18001 - RNA, 22 nt, Homo sapiens
augaucauggaaguuuuccugu

SEQ ID NO: 18002 - RNA, 22 nt, Homo sapiens
augaugaaguaagugcuuagga

SEQ ID NO: 18003 - RNA, 22 nt, Homo sapiens
augauguguguuuaagaugucu

SEQ ID NO: 18004 - RNA, 19 nt, Homo sapiens
augauugucuauggaggaa

SEQ ID NO: 18005 - RNA, 22 nt, Homo sapiens
augauuuuuguaucgccugaug

SEQ ID NO: 18006 - RNA, 22 nt, Homo sapiens
augcagaucacauuuuucuguc

SEQ ID NO: 18007 - RNA, 22 nt, Homo sapiens
augcagcugaggguaguggagc

SEQ ID NO: 18008 - RNA, 22 nt, Homo sapiens
augcagugugcaacagauuaag

SEQ ID NO: 18009 - RNA, 22 nt, Homo sapiens
augcauauuccugggccucacu

SEQ ID NO: 18010 - RNA, 18 nt, Homo sapiens
augcauauuuuaaguugu

SEQ ID NO: 18011 - RNA, 22 nt, Homo sapiens
augcauauuuuaccuagaagag

SEQ ID NO: 18012 - RNA, 22 nt, Homo sapiens
augccacugcacucuagccugg

SEQ ID NO: 18013 - RNA, 22 nt, Homo sapiens
augccacugcgcucuagccugg

SEQ ID NO: 18014 - RNA, 22 nt, Homo sapiens
augccacuguacucuagccuag

SEQ ID NO: 18015 - RNA, 22 nt, Homo sapiens
augccacuucucuaagucaugu

SEQ ID NO: 18016 - RNA, 22 nt, Homo sapiens
augccagggagaauuguucaag

SEQ ID NO: 18017 - RNA, 19 nt, Homo sapiens
augccuggagaugguuaua

SEQ ID NO: 18018 - RNA, 22 nt, Homo sapiens
augcuacuggauuuguauaaau

SEQ ID NO: 18019 - RNA, 22 nt, Homo sapiens
augcuuguguuggggcagugga

SEQ ID NO: 18020 - RNA, 22 nt, Homo sapiens
auggaagaaacgauuuucugga

SEQ ID NO: 18021 - RNA, 22 nt, Homo sapiens
auggaagacuccucuuugggua

SEQ ID NO: 18022 - RNA, 22 nt, Homo sapiens
auggaaggagaauggucuuuga

SEQ ID NO: 18023 - RNA, 22 nt, Homo sapiens
auggaagucucuguuaaguuuc

SEQ ID NO: 18024 - RNA, 22 nt, Homo sapiens
auggaauguaaguuauguuugc

SEQ ID NO: 18025 - RNA, 21 nt, Homo sapiens
auggacugugugacccugcac

SEQ ID NO: 18026 - RNA, 19 nt, Homo sapiens
auggauacauuuucugcua

SEQ ID NO: 18027 - RNA, 22 nt, Homo sapiens
auggcacagaguagaugcucaa

SEQ ID NO: 18028 - RNA, 22 nt, Homo sapiens
auggcacuaaguucaacacuua

SEQ ID NO: 18029 - RNA, 22 nt, Homo sapiens
auggcacuacugggaaugucuu

SEQ ID NO: 18030 - RNA, 22 nt, Homo sapiens
auggcacuuuggacugcuagau

SEQ ID NO: 18031 - RNA, 22 nt, Homo sapiens
auggcagcaccccacucuacug

SEQ ID NO: 18032 - RNA, 23 nt, Homo sapiens
auggcccuggugggagugucuuu

SEQ ID NO: 18033 - RNA, 22 nt, Homo sapiens
auggcguguggcuuggaggcug

SEQ ID NO: 18034 - RNA, 22 nt, Homo sapiens
auggcugugaaaugguaggugg

SEQ ID NO: 18035 - RNA, 22 nt, Homo sapiens
auggcuguuucugcaaugucua

SEQ ID NO: 18036 - RNA, 22 nt, Homo sapiens
auggcuuuaagagugucugaau

SEQ ID NO: 18037 - RNA, 22 nt, Homo sapiens
auggcuuugggcugcucugccc

SEQ ID NO: 18038 - RNA, 22 nt, Homo sapiens
auggcuuuuccugucuugcaug

SEQ ID NO: 18039 - RNA, 22 nt, Homo sapiens
augguagacucucgggucaugg

SEQ ID NO: 18040 - RNA, 22 nt, Homo sapiens
auggucuuuauuguguugagug

SEQ ID NO: 18041 - RNA, 22 nt, Homo sapiens
auggucuuuguuucuaauucug

SEQ ID NO: 18042 - RNA, 22 nt, Homo sapiens
aaaagagcugagagguauucuu

SEQ ID NO: 18043 - RNA, 22 nt, Homo sapiens
aaaagcauucagagugcugggc

SEQ ID NO: 18044 - RNA, 22 nt, Homo sapiens
aaaagugguguuguuucuaaau

SEQ ID NO: 18045 - RNA, 22 nt, Homo sapiens
aaaaguucuuugagccuugaca

SEQ ID NO: 18046 - RNA, 22 nt, Homo sapiens
aaacugccuuccuuguaggugc

SEQ ID NO: 18047 - RNA, 22 nt, Homo sapiens
aaacugcuuuccaugguggcug

SEQ ID NO: 18048 - RNA, 22 nt, Homo sapiens
aaagaagucagccuguccuuug

SEQ ID NO: 18049 - RNA, 22 nt, Homo sapiens
aaagcacuggagucaucaucua

SEQ ID NO: 18050 - RNA, 22 nt, Homo sapiens
aaagcuacaggaccugcucauu

SEQ ID NO: 18051 - RNA, 22 nt, Homo sapiens
aaagcugucaaggcaggaggcu

SEQ ID NO: 18052 - RNA, 22 nt, Homo sapiens
aaaggcacuagaaguuaccuuu

SEQ ID NO: 18053 - RNA, 22 nt, Homo sapiens
aaagggcacugugcuuuggcaa

SEQ ID NO: 18054 - RNA, 19 nt, Homo sapiens
aaagguaguaaccucugau

SEQ ID NO: 18055 - RNA, 20 nt, Homo sapiens
aaaguaggcuaauaccaaaa

SEQ ID NO: 18056 - RNA, 22 nt, Homo sapiens
aaagugcaguacuucguauauu

SEQ ID NO: 18057 - RNA, 22 nt, Homo sapiens
aaagugcaguauuugggcagaa

SEQ ID NO: 18058 - RNA, 22 nt, Homo sapiens
aaaguggacuaagugaauauga

SEQ ID NO: 18059 - RNA, 22 nt, Homo sapiens
aaaguguguuuccaaccugugg

SEQ ID NO: 18060 - RNA, 22 nt, Homo sapiens
aaaugcugcuuuggccucuucu

SEQ ID NO: 18061 - RNA, 22 nt, Homo sapiens
aaaugcuguuccaggaccuauc

SEQ ID NO: 18062 - RNA, 22 nt, Homo sapiens
aaaugggacugggguccuuuga

SEQ ID NO: 18063 - RNA, 22 nt, Homo sapiens
aaauucaugucaccucuaggua

SEQ ID NO: 18064 - RNA, 18 nt, Homo sapiens
aaauucugucccuucuuc

SEQ ID NO: 18065 - RNA, 22 nt, Homo sapiens
aaauugcuuuugaagacuuagu

SEQ ID NO: 18066 - RNA, 23 nt, Homo sapiens
aaauuugccuauuauuccuaugg

SEQ ID NO: 18067 - RNA, 22 nt, Homo sapiens
aacccugagucaugagucuaga

SEQ ID NO: 18068 - RNA, 22 nt, Homo sapiens
aacuggucuuuggaggaggagg

SEQ ID NO: 18069 - RNA, 21 nt, Homo sapiens
aacuggugugagaugguaugu

SEQ ID NO: 18070 - RNA, 22 nt, Homo sapiens
aagaucaucauagagggcauga

SEQ ID NO: 18071 - RNA, 22 nt, Homo sapiens
aagaugauguucuuuuucuuag

SEQ ID NO: 18072 - RNA, 22 nt, Homo sapiens
aagaugcagaagcccagauguu

SEQ ID NO: 18073 - RNA, 22 nt, Homo sapiens
aagaugcagucauacuggagua

SEQ ID NO: 18074 - RNA, 22 nt, Homo sapiens
aagcaggugaugagugggugug

SEQ ID NO: 18075 - RNA, 22 nt, Homo sapiens
aagcugcauuuucuagaugcuu

SEQ ID NO: 18076 - RNA, 22 nt, Homo sapiens
aagcuggauuuaguguggagca

SEQ ID NO: 18077 - RNA, 22 nt, Homo sapiens
aagcuggcauucaugagauuac

SEQ ID NO: 18078 - RNA, 22 nt, Homo sapiens
agagucacaugaggcccuucau

SEQ ID NO: 18079 - RNA, 22 nt, Homo sapiens
agagugaagcuuuuuauauucu

SEQ ID NO: 18080 - RNA, 22 nt, Homo sapiens
agagugcuauagauuagauuuc

SEQ ID NO: 18081 - RNA, 22 nt, Homo sapiens
agauaugucugcuauuugcugu

SEQ ID NO: 18082 - RNA, 22 nt, Homo sapiens
agauauguuauugauguuaaug

SEQ ID NO: 18083 - RNA, 22 nt, Homo sapiens
agaucacaguaccguaaggcug

SEQ ID NO: 18084 - RNA, 22 nt, Homo sapiens
agaucacucagguuucucccug

SEQ ID NO: 18085 - RNA, 20 nt, Homo sapiens
agaugcaugcacauaaacac

SEQ ID NO: 18086 - RNA, 22 nt, Homo sapiens
agaugccuaugaagagaaauua

SEQ ID NO: 18087 - RNA, 22 nt, Homo sapiens
agauggauuuuguagccccagc

SEQ ID NO: 18088 - RNA, 22 nt, Homo sapiens
agauggugauaaaugugguacc

SEQ ID NO: 18089 - RNA, 22 nt, Homo sapiens
agcaacauuguucauaauagcu

SEQ ID NO: 18090 - RNA, 22 nt, Homo sapiens
agcaagacauggcuuccaaaug

SEQ ID NO: 18091 - RNA, 22 nt, Homo sapiens
agcacagugguuaaguuucuua

SEQ ID NO: 18092 - RNA, 22 nt, Homo sapiens
agcacaguuaaaugaggcuucu

SEQ ID NO: 18093 - RNA, 20 nt, Homo sapiens
agcagccacagauuccucag

SEQ ID NO: 18094 - RNA, 22 nt, Homo sapiens
agcagugucauuuucuggugag

SEQ ID NO: 18095 - RNA, 19 nt, Homo sapiens
agcaucauuauuguuuugg

SEQ ID NO: 18096 - RNA, 22 nt, Homo sapiens
agccccauuuguugaaaagacg

SEQ ID NO: 18097 - RNA, 22 nt, Homo sapiens
agccuguguugaauuauagaaa

SEQ ID NO: 18098 - RNA, 22 nt, Homo sapiens
agccuucauucugacaguagga

SEQ ID NO: 18099 - RNA, 22 nt, Homo sapiens
agcuaguguucaccagagguca

SEQ ID NO: 18100 - RNA, 20 nt, Homo sapiens
agcugcagauauaaauccgc

SEQ ID NO: 18101 - RNA, 22 nt, Homo sapiens
agcugguauuuugucaaggaua

SEQ ID NO: 18102 - RNA, 22 nt, Homo sapiens
agcugguauuuugucgaggacu

SEQ ID NO: 18103 - RNA, 22 nt, Homo sapiens
agcuggucuacguguguaugag

SEQ ID NO: 18104 - RNA, 21 nt, Homo sapiens
agcugguuuccacagugugcu

SEQ ID NO: 18105 - RNA, 22 nt, Homo sapiens
agcuucacaaugcagagggcag

SEQ ID NO: 18106 - RNA, 22 nt, Homo sapiens
agcuugugcuguaugaagggcc

SEQ ID NO: 18107 - RNA, 22 nt, Homo sapiens
aggaaaucuuagcugaggggau

SEQ ID NO: 18108 - RNA, 22 nt, Homo sapiens
aggaaauguuggucccauuucu

SEQ ID NO: 18109 - RNA, 21 nt, Homo sapiens
aggaagacuaugaucaauugg

SEQ ID NO: 18110 - RNA, 16 nt, Homo sapiens
aggaagacuuagagau

SEQ ID NO: 18111 - RNA, 22 nt, Homo sapiens
aggaagguaaacuaacuugccu

SEQ ID NO: 18112 - RNA, 22 nt, Homo sapiens
aggaaguaauaaguuugguucu

SEQ ID NO: 18113 - RNA, 22 nt, Homo sapiens
aggaauggaaacuuuugauggu

SEQ ID NO: 18114 - RNA, 18 nt, Homo sapiens
aggaaugguaauacuuca

SEQ ID NO: 18115 - RNA, 22 nt, Homo sapiens
aggagaucagccucccugcaac

SEQ ID NO: 18116 - RNA, 22 nt, Homo sapiens
aggagcacaauggucaugugga

SEQ ID NO: 18117 - RNA, 20 nt, Homo sapiens
aggagcauuuacauuggcuc

SEQ ID NO: 18118 - RNA, 21 nt, Homo sapiens
aggcaagguguuauuauugaa

SEQ ID NO: 18119 - RNA, 22 nt, Homo sapiens
aggcacggugucucaugccugu

SEQ ID NO: 18120 - RNA, 22 nt, Homo sapiens
aggcagaugagguccucagcug

SEQ ID NO: 18121 - RNA, 22 nt, Homo sapiens
aggcaugaguucagaggguaug

SEQ ID NO: 18122 - RNA, 22 nt, Homo sapiens
aggcaugugugcagacugucug

SEQ ID NO: 18123 - RNA, 23 nt, Homo sapiens
aggcauuguacaguaauggaaaa

SEQ ID NO: 18124 - RNA, 22 nt, Homo sapiens
aggcugguauuuacaaaagcuc

SEQ ID NO: 18125 - RNA, 22 nt, Homo sapiens
agguagguugagaugggcauca

SEQ ID NO: 18126 - RNA, 22 nt, Homo sapiens
aggugcuugaaucuaugagcuc

SEQ ID NO: 18127 - RNA, 23 nt, Homo sapiens
agguuaugauuauagagcgagga

SEQ ID NO: 18128 - RNA, 22 nt, Homo sapiens
aguaaucaucugagggcagaaa

SEQ ID NO: 18129 - RNA, 22 nt, Homo sapiens
aguaucaagccacacaugguca

SEQ ID NO: 18130 - RNA, 22 nt, Homo sapiens
agucaaaugcuuauguauaaag

SEQ ID NO: 18131 - RNA, 22 nt, Homo sapiens
agucacaugcauuuucuucaau

SEQ ID NO: 18132 - RNA, 22 nt, Homo sapiens
agugaacaaagaagugcagaua

SEQ ID NO: 18133 - RNA, 22 nt, Homo sapiens
agugagcuggagaaaagaaacu

SEQ ID NO: 18134 - RNA, 22 nt, Homo sapiens
agugauguggaguuuggaugga

SEQ ID NO: 18135 - RNA, 22 nt, Homo sapiens
agugcaauggcgugaucuuggc

SEQ ID NO: 18136 - RNA, 22 nt, Homo sapiens
agugcagugguuaggagccagg

SEQ ID NO: 18137 - RNA, 22 nt, Homo sapiens
agugccaaaucgagggcucuga

SEQ ID NO: 18138 - RNA, 22 nt, Homo sapiens
agugccauggcugcuagauggc

SEQ ID NO: 18139 - RNA, 22 nt, Homo sapiens
aguggauguuguggccugggag

SEQ ID NO: 18140 - RNA, 22 nt, Homo sapiens
aguguaaugauauuuggagagg

SEQ ID NO: 18141 - RNA, 22 nt, Homo sapiens
agugucaggagacagguagcug

SEQ ID NO: 18142 - RNA, 22 nt, Homo sapiens
aguuuuugcugauagcaugcuu

SEQ ID NO: 18143 - RNA, 22 nt, Homo sapiens
auaaagguaauaauaguugcau

SEQ ID NO: 18144 - RNA, 22 nt, Homo sapiens
auaaaugcaaugguauuuuuga

SEQ ID NO: 18145 - RNA, 22 nt, Homo sapiens
auaacauggaguuugucauuua

SEQ ID NO: 18146 - RNA, 22 nt, Homo sapiens
auaauacuuuuauuuugaggaa

SEQ ID NO: 18147 - RNA, 22 nt, Homo sapiens
auaauaucagguugugaugaug

SEQ ID NO: 18148 - RNA, 22 nt, Homo sapiens
auacaagcaguccaacuccaua

SEQ ID NO: 18149 - RNA, 22 nt, Homo sapiens
auacaguguauguauaguacau

SEQ ID NO: 18150 - RNA, 22 nt, Homo sapiens
caugccacuguggacaaagaca

SEQ ID NO: 18151 - RNA, 22 nt, Homo sapiens
cauggagcuaggcuugaucccu

SEQ ID NO: 18152 - RNA, 22 nt, Homo sapiens
cauggauuuuuuugaauggcag

SEQ ID NO: 18153 - RNA, 22 nt, Homo sapiens
cauggccuuuggaaugugucua

SEQ ID NO: 18154 - RNA, 22 nt, Homo sapiens
caugggacugucuuggcuauac

SEQ ID NO: 18155 - RNA, 19 nt, Homo sapiens
caugugcacuacuggcuuc

SEQ ID NO: 18156 - RNA, 22 nt, Homo sapiens
caugugcaugagcacauacgug

SEQ ID NO: 18157 - RNA, 22 nt, Homo sapiens
cauugcacuccagcccuggcaa

SEQ ID NO: 18158 - RNA, 22 nt, Homo sapiens
cauugcacuccagccugcugac

SEQ ID NO: 18159 - RNA, 22 nt, Homo sapiens
cauugcacuccagccuuggcaa

SEQ ID NO: 18160 - RNA, 22 nt, Homo sapiens
cauugcacuccagcucugggcg

SEQ ID NO: 18161 - RNA, 22 nt, Homo sapiens
cauugcacuccagucugggcaa

SEQ ID NO: 18162 - RNA, 22 nt, Homo sapiens
cauugcaguggaguggggaaga

SEQ ID NO: 18163 - RNA, 22 nt, Homo sapiens
cauugcccuccagccugggcaa

SEQ ID NO: 18164 - RNA, 22 nt, Homo sapiens
ccaaggaauacccucccuuuuu

SEQ ID NO: 18165 - RNA, 22 nt, Homo sapiens
ccaaggcacugauucuguacuc

SEQ ID NO: 18166 - RNA, 23 nt, Homo sapiens
ccacacuguuuagaauggcauca

SEQ ID NO: 18167 - RNA, 22 nt, Homo sapiens
ccaccgggucccagcucugcuc

SEQ ID NO: 18168 - RNA, 22 nt, Homo sapiens
ccaggguugcuuuagauucuga

SEQ ID NO: 18169 - RNA, 22 nt, Homo sapiens
ccauugcacuccagccucggca

SEQ ID NO: 18170 - RNA, 22 nt, Homo sapiens
ccauugcacucuggccuaggug

SEQ ID NO: 18171 - RNA, 22 nt, Homo sapiens
cccagaguucuuaaauacugag

SEQ ID NO: 18172 - RNA, 22 nt, Homo sapiens
cccagcguucggcauggcugag

SEQ ID NO: 18173 - RNA, 21 nt, Homo sapiens
cccagguucucugaggguaga

SEQ ID NO: 18174 - RNA, 22 nt, Homo sapiens
cccaguaaucuugccaguuuuc

SEQ ID NO: 18175 - RNA, 22 nt, Homo sapiens
cccagugaagagaaccuuacga

SEQ ID NO: 18176 - RNA, 18 nt, Homo sapiens
cccagugacuuauggccu

SEQ ID NO: 18177 - RNA, 19 nt, Homo sapiens
cccagugucagagaagggu

SEQ ID NO: 18178 - RNA, 17 nt, Homo sapiens
cccuaguagcugggacu

SEQ ID NO: 18179 - RNA, 22 nt, Homo sapiens
cccugagcagccugaguuuccc

SEQ ID NO: 18180 - RNA, 22 nt, Homo sapiens
cccuggacauucaucauuaugu

SEQ ID NO: 18181 - RNA, 22 nt, Homo sapiens
cccuguagcagcauucuuaaau

SEQ ID NO: 18182 - RNA, 22 nt, Homo sapiens
ccucauggagaacaucugcuag

SEQ ID NO: 18183 - RNA, 21 nt, Homo sapiens
ccucuuugagggaagaaaggg

SEQ ID NO: 18184 - RNA, 22 nt, Homo sapiens
ccugagacugauugacucacaa

SEQ ID NO: 18185 - RNA, 21 nt, Homo sapiens
ccugaguacaacccacuccac

SEQ ID NO: 18186 - RNA, 22 nt, Homo sapiens
gacauagcuagauaaccucaug

SEQ ID NO: 18187 - RNA, 19 nt, Homo sapiens
gacaugagauuuggugggg

SEQ ID NO: 18188 - RNA, 22 nt, Homo sapiens
gacauguaaggcucucucuguu

SEQ ID NO: 18189 - RNA, 22 nt, Homo sapiens
gacauguuuucauguauuugga

SEQ ID NO: 18190 - RNA, 22 nt, Homo sapiens
gacuaaugaaagagugugauau

SEQ ID NO: 18191 - RNA, 22 nt, Homo sapiens
gacugcagugcagcuguuaggc

SEQ ID NO: 18192 - RNA, 22 nt, Homo sapiens
gacugcauuugccccaucgaau

SEQ ID NO: 18193 - RNA, 22 nt, Homo sapiens
gacuggcuguuuucuuuauuau

SEQ ID NO: 18194 - RNA, 22 nt, Homo sapiens
gacuuagagauguuguauuugg

SEQ ID NO: 18195 - RNA, 22 nt, Homo sapiens
gagaacaguguuguauuuuuuc

SEQ ID NO: 18196 - RNA, 21 nt, Homo sapiens
gagaaucaucauggcugcaua

SEQ ID NO: 18197 - RNA, 22 nt, Homo sapiens
gagaaugagauuaugguuacau

SEQ ID NO: 18198 - RNA, 22 nt, Homo sapiens
gagaaugaugauuuccaauuuc

SEQ ID NO: 18199 - RNA, 22 nt, Homo sapiens
gagacagugucagccauugaaa

SEQ ID NO: 18200 - RNA, 22 nt, Homo sapiens
gagacggagucucgcucuguca

SEQ ID NO: 18201 - RNA, 22 nt, Homo sapiens
gagacugagucuugcuuuguca

SEQ ID NO: 18202 - RNA, 22 nt, Homo sapiens
gagagugcuuuggguguaggcc

SEQ ID NO: 18203 - RNA, 22 nt, Homo sapiens
gagaucaguuaaugaagugagc

SEQ ID NO: 18204 - RNA, 22 nt, Homo sapiens
gagaucaugcugguucucucau

SEQ ID NO: 18205 - RNA, 22 nt, Homo sapiens
gagaucuuuaagaacuacugcu

SEQ ID NO: 18206 - RNA, 22 nt, Homo sapiens
gagaugaagugucaauaaggau

SEQ ID NO: 18207 - RNA, 22 nt, Homo sapiens
gagaugaucaugugguuuuguc

SEQ ID NO: 18208 - RNA, 22 nt, Homo sapiens
gagauggaguuucacuucgcuc

SEQ ID NO: 18209 - RNA, 22 nt, Homo sapiens
gagauguuuuguuaucaaagga

SEQ ID NO: 18210 - RNA, 18 nt, Homo sapiens
gagcaccuuuuuugcaga

SEQ ID NO: 18211 - RNA, 22 nt, Homo sapiens
gagcacugaauacugugguggu

SEQ ID NO: 18212 - RNA, 22 nt, Homo sapiens
gagcuagggucaugcuacugca

SEQ ID NO: 18213 - RNA, 22 nt, Homo sapiens
gagcuagugcuuaugcaccacu

SEQ ID NO: 18214 - RNA, 22 nt, Homo sapiens
gagcucaccuuaccucuggagc

SEQ ID NO: 18215 - RNA, 22 nt, Homo sapiens
gagcucauuguugcuaaagaga

SEQ ID NO: 18216 - RNA, 22 nt, Homo sapiens
gagcugaaguuuccauuuguac

SEQ ID NO: 18217 - RNA, 22 nt, Homo sapiens
gagcugaauugcugccauuugc

SEQ ID NO: 18218 - RNA, 20 nt, Homo sapiens
gagcugguguacugccgggc

SEQ ID NO: 18219 - RNA, 22 nt, Homo sapiens
gaggcagucuguccauucucag

SEQ ID NO: 18220 - RNA, 22 nt, Homo sapiens
gagguagagacuauguauuaga

SEQ ID NO: 18221 - RNA, 21 nt, Homo sapiens
gagguagggauuaaagaccuc

SEQ ID NO: 18222 - RNA, 22 nt, Homo sapiens
gagguagguacaauugccacca

SEQ ID NO: 18223 - RNA, 22 nt, Homo sapiens
gagguaucauuauguugcccag

SEQ ID NO: 18224 - RNA, 22 nt, Homo sapiens
gaggucauguggcaggcagcca

SEQ ID NO: 18225 - RNA, 22 nt, Homo sapiens
gagguggugguggaggcauagc

SEQ ID NO: 18226 - RNA, 22 nt, Homo sapiens
gaguaaaugucacuguugcugu

SEQ ID NO: 18227 - RNA, 22 nt, Homo sapiens
gaguagaacugguuaucuaaua

SEQ ID NO: 18228 - RNA, 22 nt, Homo sapiens
gaguauauuugcacuguuaugu

SEQ ID NO: 18229 - RNA, 22 nt, Homo sapiens
gagugcuguuagcccuggguuu

SEQ ID NO: 18230 - RNA, 23 nt, Homo sapiens
gaguggagacucauugauuuccu

SEQ ID NO: 18231 - RNA, 22 nt, Homo sapiens
gaguggugguucugaaacuuuu

SEQ ID NO: 18232 - RNA, 22 nt, Homo sapiens
gauacuguauccuaaaagcuuu

SEQ ID NO: 18233 - RNA, 22 nt, Homo sapiens
gauaguugugagaacucuuacu

SEQ ID NO: 18234 - RNA, 22 nt, Homo sapiens
gauaucuuuuguauggugagcu

SEQ ID NO: 18235 - RNA, 22 nt, Homo sapiens
gauauguuagggggagaaguua

SEQ ID NO: 18236 - RNA, 22 nt, Homo sapiens
gaucacauggccauuucuagcu

SEQ ID NO: 18237 - RNA, 22 nt, Homo sapiens
gaucacaugggagaaugagagu

SEQ ID NO: 18238 - RNA, 20 nt, Homo sapiens
gaucaguuuggaguaagugc

SEQ ID NO: 18239 - RNA, 22 nt, Homo sapiens
gaugagaucauaaguguggagc

SEQ ID NO: 18240 - RNA, 22 nt, Homo sapiens
gaugagguaggccugcuuugaa

SEQ ID NO: 18241 - RNA, 22 nt, Homo sapiens
gaugauguuugauaaauaauaa

SEQ ID NO: 18242 - RNA, 22 nt, Homo sapiens
gauggauuuuaagugaaugaaa

SEQ ID NO: 18243 - RNA, 22 nt, Homo sapiens
gauggauuuuuuaggcagagcu

SEQ ID NO: 18244 - RNA, 22 nt, Homo sapiens
gauggcacuaagccauguagga

SEQ ID NO: 18245 - RNA, 22 nt, Homo sapiens
gauggcagugcagccccuggcu

SEQ ID NO: 18246 - RNA, 22 nt, Homo sapiens
gauggugucccaggcucaggcu

SEQ ID NO: 18247 - RNA, 22 nt, Homo sapiens
gauguguuuccaggauuuguuu

SEQ ID NO: 18248 - RNA, 22 nt, Homo sapiens
gauguguuuguuucuggaggag

SEQ ID NO: 18249 - RNA, 22 nt, Homo sapiens
gauuuguauuaaaagugugacg

SEQ ID NO: 18250 - RNA, 22 nt, Homo sapiens
gcaagacaugucuaagguuuaa

SEQ ID NO: 18251 - RNA, 22 nt, Homo sapiens
gcacaguggcucccgucuauaa

SEQ ID NO: 18252 - RNA, 22 nt, Homo sapiens
gcacaguuaaagggucauguga

SEQ ID NO: 18253 - RNA, 22 nt, Homo sapiens
gcaccaugguagaauaauggua

SEQ ID NO: 18254 - RNA, 17 nt, Homo sapiens
gcacuggcguaucccac

SEQ ID NO: 18255 - RNA, 22 nt, Homo sapiens
gcagaauugacucuguuuuuuc

SEQ ID NO: 18256 - RNA, 22 nt, Homo sapiens
gcagagaaacaggucuaaggag

SEQ ID NO: 18257 - RNA, 22 nt, Homo sapiens
caucacacuuggauguaagaca

SEQ ID NO: 18258 - RNA, 22 nt, Homo sapiens
caugcacugaguccaccucugg

SEQ ID NO: 18259 - RNA, 22 nt, Homo sapiens
cauggcacauauauaucuaggu

SEQ ID NO: 18260 - RNA, 22 nt, Homo sapiens
cauggcuuuauuuucagcuucu

SEQ ID NO: 18261 - RNA, 19 nt, Homo sapiens
cauugcacuccacccuggg

SEQ ID NO: 18262 - RNA, 22 nt, Homo sapiens
cauugcacuccaccuuggguaa

SEQ ID NO: 18263 - RNA, 22 nt, Homo sapiens
cauugcacuccagccuugguga

SEQ ID NO: 18264 - RNA, 20 nt, Homo sapiens
cauugcacuccagcuugggc

SEQ ID NO: 18265 - RNA, 22 nt, Homo sapiens
cauugcacuccagcuugggcga

SEQ ID NO: 18266 - RNA, 22 nt, Homo sapiens
cauugcacuccauccuuggcaa

SEQ ID NO: 18267 - RNA, 22 nt, Homo sapiens
cauugcacucuagucuggguga

SEQ ID NO: 18268 - RNA, 22 nt, Homo sapiens
cauugcacugcauucugggcaa

SEQ ID NO: 18269 - RNA, 20 nt, Homo sapiens
cauugcccuccagccugggc

SEQ ID NO: 18270 - RNA, 22 nt, Homo sapiens
cauugguuggacaguucucucu

SEQ ID NO: 18271 - RNA, 22 nt, Homo sapiens
ccacacugucuuggugggaaac

SEQ ID NO: 18272 - RNA, 22 nt, Homo sapiens
ccacaguagucuugggaugggc

SEQ ID NO: 18273 - RNA, 22 nt, Homo sapiens
ccacagucuaugcaacaagguc

SEQ ID NO: 18274 - RNA, 22 nt, Homo sapiens
ccacaguugaaauuuugacugu

SEQ ID NO: 18275 - RNA, 22 nt, Homo sapiens
ccacauuaccuugcuugcucca

SEQ ID NO: 18276 - RNA, 22 nt, Homo sapiens
ccaccuguacuuaagucacuuu

SEQ ID NO: 18277 - RNA, 22 nt, Homo sapiens
ccagaguugccucagguuucug

SEQ ID NO: 18278 - RNA, 22 nt, Homo sapiens
ccagauguuuucauucagcaag

SEQ ID NO: 18279 - RNA, 22 nt, Homo sapiens
ccagcaccauuuguugaauagg

SEQ ID NO: 18280 - RNA, 20 nt, Homo sapiens
ccagcaucauuagauucugg

SEQ ID NO: 18281 - RNA, 22 nt, Homo sapiens
ccaggguugagacccacugacu

SEQ ID NO: 18282 - RNA, 18 nt, Homo sapiens
ccagugcaaggaaagccc

SEQ ID NO: 18283 - RNA, 19 nt, Homo sapiens
ccaguguugccagagcuga

SEQ ID NO: 18284 - RNA, 22 nt, Homo sapiens
ccaguuuucucacuguugcagu

SEQ ID NO: 18285 - RNA, 18 nt, Homo sapiens
ccauucaacagauuuguc

SEQ ID NO: 18286 - RNA, 22 nt, Homo sapiens
ccauugcacuucagccuaggug

SEQ ID NO: 18287 - RNA, 22 nt, Homo sapiens
cccagagacagaaugauaaacu

SEQ ID NO: 18288 - RNA, 22 nt, Homo sapiens
cccagugguuacauaaggagua

SEQ ID NO: 18289 - RNA, 22 nt, Homo sapiens
cccugagagcagggucuuucuc

SEQ ID NO: 18290 - RNA, 22 nt, Homo sapiens
cccugagaugugaauuucagag

SEQ ID NO: 18291 - RNA, 22 nt, Homo sapiens
cccuguguuuagcugaagguuu

SEQ ID NO: 18292 - RNA, 22 nt, Homo sapiens
ccuaggcacugggguccagccc

SEQ ID NO: 18293 - RNA, 22 nt, Homo sapiens
ccucacaaccuuuauugaagag

SEQ ID NO: 18294 - RNA, 22 nt, Homo sapiens
uaugaugcugagguuuggagug

SEQ ID NO: 18295 - RNA, 22 nt, Homo sapiens
uaugcacacguguccaugugca

SEQ ID NO: 18296 - RNA, 22 nt, Homo sapiens
uaugucacuugguuuggugcua

SEQ ID NO: 18297 - RNA, 22 nt, Homo sapiens
uaugucuucuuuagagaaaugu

SEQ ID NO: 18298 - RNA, 22 nt, Homo sapiens
uauuacauccauaggcucugcu

SEQ ID NO: 18299 - RNA, 22 nt, Homo sapiens
uauuagugucuuuugguuagaa

SEQ ID NO: 18300 - RNA, 22 nt, Homo sapiens
uauugacuuuuuuguuaggagg

SEQ ID NO: 18301 - RNA, 22 nt, Homo sapiens
uauugcuaaauucuuuuccuag

SEQ ID NO: 18302 - RNA, 22 nt, Homo sapiens
uauuuggauagucuggaaaaaa

SEQ ID NO: 18303 - RNA, 22 nt, Homo sapiens
ucaaaugguccacgugaacauu

SEQ ID NO: 18304 - RNA, 21 nt, Homo sapiens
ucaacccuugcgucaccaagc

SEQ ID NO: 18305 - RNA, 22 nt, Homo sapiens
ucaagcaauucuccucucagcc

SEQ ID NO: 18306 - RNA, 22 nt, Homo sapiens
ucaagcaauucugcugccucag

SEQ ID NO: 18307 - RNA, 22 nt, Homo sapiens
ucaaggacuacauggggugaaa

SEQ ID NO: 18308 - RNA, 22 nt, Homo sapiens
ucaaugcaaccuccaccucugg

SEQ ID NO: 18309 - RNA, 18 nt, Homo sapiens
ucaauguggauguucuuu

SEQ ID NO: 18310 - RNA, 22 nt, Homo sapiens
ucacaagugagaggaauuagau

SEQ ID NO: 18311 - RNA, 22 nt, Homo sapiens
ucacaauucacuacaggcuuga

SEQ ID NO: 18312 - RNA, 22 nt, Homo sapiens
ucacacugaaacuaggguguga

SEQ ID NO: 18313 - RNA, 22 nt, Homo sapiens
ucacacugaauuugaagcaaug

SEQ ID NO: 18314 - RNA, 22 nt, Homo sapiens
ucacagacugagccaaauagag

SEQ ID NO: 18315 - RNA, 18 nt, Homo sapiens
ucacagguaaaguugaca

SEQ ID NO: 18316 - RNA, 22 nt, Homo sapiens
ucacaguagggaacugacaaag

SEQ ID NO: 18317 - RNA, 22 nt, Homo sapiens
ucacagucggugacuucuugcu

SEQ ID NO: 18318 - RNA, 22 nt, Homo sapiens
ucacaguuggccuggccuuuua

SEQ ID NO: 18319 - RNA, 22 nt, Homo sapiens
ucacaugaagauuuuaguauac

SEQ ID NO: 18320 - RNA, 22 nt, Homo sapiens
ucacauggcagagaagaagcuc

SEQ ID NO: 18321 - RNA, 22 nt, Homo sapiens
ucacauggggaagggacuagcu

SEQ ID NO: 18322 - RNA, 22 nt, Homo sapiens
ucacccacacaggagacaggga

SEQ ID NO: 18323 - RNA, 22 nt, Homo sapiens
ucaccuggagacaugaagacug

SEQ ID NO: 18324 - RNA, 23 nt, Homo sapiens
ucacuagaguccuggaguuugag

SEQ ID NO: 18325 - RNA, 22 nt, Homo sapiens
ucacuagggaucacuuuacccg

SEQ ID NO: 18326 - RNA, 22 nt, Homo sapiens
ucacugaaaccacugccuccug

SEQ ID NO: 18327 - RNA, 22 nt, Homo sapiens
ucacugaaaccgccuccaccuc

SEQ ID NO: 18328 - RNA, 22 nt, Homo sapiens
ucacugaaaccuccaccucucg

SEQ ID NO: 18329 - RNA, 22 nt, Homo sapiens
ucacugaaacuguccuggguua

SEQ ID NO: 18330 - RNA, 22 nt, Homo sapiens
ucacugcacuagguaaugccac

SEQ ID NO: 18331 - RNA, 22 nt, Homo sapiens
ucacugcacuccagccuuuaug

SEQ ID NO: 18332 - RNA, 22 nt, Homo sapiens
ucacuggagauagcaaucuggu

SEQ ID NO: 18333 - RNA, 20 nt, Homo sapiens
ucacuggagcucauuugauu

SEQ ID NO: 18334 - RNA, 22 nt, Homo sapiens
ucacugugcacauaugauaggu

SEQ ID NO: 18335 - RNA, 22 nt, Homo sapiens
ucacuguggaacucaaaaagcu

SEQ ID NO: 18336 - RNA, 22 nt, Homo sapiens
ucacuguguauguauaugcagg

SEQ ID NO: 18337 - RNA, 22 nt, Homo sapiens
ucacuuggccgcagccuucucu

SEQ ID NO: 18338 - RNA, 22 nt, Homo sapiens
ucacuuugacggccaacuucua

SEQ ID NO: 18339 - RNA, 22 nt, Homo sapiens
ucagaucaguuccacaagaacu

SEQ ID NO: 18340 - RNA, 22 nt, Homo sapiens
ucagaucauauucuucgcugcu

SEQ ID NO: 18341 - RNA, 22 nt, Homo sapiens
ucagaucaugcuuaugauggga

SEQ ID NO: 18342 - RNA, 22 nt, Homo sapiens
ucagcaaugaccuaagcaaaua

SEQ ID NO: 18343 - RNA, 20 nt, Homo sapiens
ucagcagucuggagcagagg

SEQ ID NO: 18344 - RNA, 22 nt, Homo sapiens
ucagguaucuuuauagcgaugc

SEQ ID NO: 18345 - RNA, 22 nt, Homo sapiens
ucaggugcaguggcucaugcuu

SEQ ID NO: 18346 - RNA, 22 nt, Homo sapiens
ucaggugccuuggcuaauuguu

SEQ ID NO: 18347 - RNA, 23 nt, Homo sapiens
ucaguagucauugggaaagugug

SEQ ID NO: 18348 - RNA, 20 nt, Homo sapiens
ucaguauauuguuuccacag

SEQ ID NO: 18349 - RNA, 22 nt, Homo sapiens
ucagucauucacucacucggac

SEQ ID NO: 18350 - RNA, 22 nt, Homo sapiens
ucagugaauauauaacagcgau

SEQ ID NO: 18351 - RNA, 20 nt, Homo sapiens
ucagugauugguuuaguuau

SEQ ID NO: 18352 - RNA, 22 nt, Homo sapiens
ucagugccauugccauaugagu

SEQ ID NO: 18353 - RNA, 22 nt, Homo sapiens
ucaguggacuuagucuuucccc

SEQ ID NO: 18354 - RNA, 22 nt, Homo sapiens
ucaguucauggaggugucugcu

SEQ ID NO: 18355 - RNA, 21 nt, Homo sapiens
ucauaagcucaacaucuguag

SEQ ID NO: 18356 - RNA, 22 nt, Homo sapiens
ucauacuguccaauucuagugg

SEQ ID NO: 18357 - RNA, 22 nt, Homo sapiens
ucauacuguugugaaacaaaac

SEQ ID NO: 18358 - RNA, 22 nt, Homo sapiens
ucauaguacuuuguuuugaaaa

SEQ ID NO: 18359 - RNA, 16 nt, Homo sapiens
ucauaguaucucuucu

SEQ ID NO: 18360 - RNA, 21 nt, Homo sapiens
ucaucagucaaagacaauggu

SEQ ID NO: 18361 - RNA, 22 nt, Homo sapiens
ucaugaaguaguuaacugguug

SEQ ID NO: 18362 - RNA, 22 nt, Homo sapiens
ucaugaccaugguauagaccac

SEQ ID NO: 18363 - RNA, 22 nt, Homo sapiens
ucauggcacugaugagaguuuc

SEQ ID NO: 18364 - RNA, 22 nt, Homo sapiens
ucauggguuuugguccaagcaa

SEQ ID NO: 18365 - RNA, 22 nt, Homo sapiens
gugaaagauuaaaccagugugu

SEQ ID NO: 18366 - RNA, 22 nt, Homo sapiens
gugaaauguguagaggaucugg

SEQ ID NO: 18367 - RNA, 22 nt, Homo sapiens
gugaacagaaccugggaucgaa

SEQ ID NO: 18368 - RNA, 22 nt, Homo sapiens
gugacagucaaagacaugacuu

SEQ ID NO: 18369 - RNA, 22 nt, Homo sapiens
gugacaguggagacuuacuuca

SEQ ID NO: 18370 - RNA, 22 nt, Homo sapiens
gugacuacaggccacaguuugg

SEQ ID NO: 18371 - RNA, 22 nt, Homo sapiens
gugacugggaguggugaagaua

SEQ ID NO: 18372 - RNA, 22 nt, Homo sapiens
gugagaaucaaacuacauaaau

SEQ ID NO: 18373 - RNA, 18 nt, Homo sapiens
gugagaaugacuguucug

SEQ ID NO: 18374 - RNA, 22 nt, Homo sapiens
gugagaugaggucucacucugu

SEQ ID NO: 18375 - RNA, 22 nt, Homo sapiens
gugagcauaacaacagaguuua

SEQ ID NO: 18376 - RNA, 22 nt, Homo sapiens
gugagcuccucuucugcugcag

SEQ ID NO: 18377 - RNA, 22 nt, Homo sapiens
gugagggagcuggaauauuuau

SEQ ID NO: 18378 - RNA, 22 nt, Homo sapiens
gugaggucagggcuguggacag

SEQ ID NO: 18379 - RNA, 22 nt, Homo sapiens
gugaggucguagucauaggcaa

SEQ ID NO: 18380 - RNA, 17 nt, Homo sapiens
gugagguggguaguauc

SEQ ID NO: 18381 - RNA, 22 nt, Homo sapiens
gugagucaaucugagggguuca

SEQ ID NO: 18382 - RNA, 22 nt, Homo sapiens
gugaucaugauccugaagcauu

SEQ ID NO: 18383 - RNA, 22 nt, Homo sapiens
gugaucauuguauugggguuau

SEQ ID NO: 18384 - RNA, 20 nt, Homo sapiens
gugauuggucacugguuguu

SEQ ID NO: 18385 - RNA, 22 nt, Homo sapiens
gugauuuaguagaugcuaguua

SEQ ID NO: 18386 - RNA, 21 nt, Homo sapiens
gugcacaguaguguuuaauag

SEQ ID NO: 18387 - RNA, 22 nt, Homo sapiens
gugcacauauggugcauaagug

SEQ ID NO: 18388 - RNA, 22 nt, Homo sapiens
gugcacauuguuuaugucuguu

SEQ ID NO: 18389 - RNA, 22 nt, Homo sapiens
gugcauacgucuuuauaguagc

SEQ ID NO: 18390 - RNA, 22 nt, Homo sapiens
gugccuucuagcuaugguuggc

SEQ ID NO: 18391 - RNA, 22 nt, Homo sapiens
gugcuaggugcuaggaagauag

SEQ ID NO: 18392 - RNA, 21 nt, Homo sapiens
guggaaauggaauuuacuaau

SEQ ID NO: 18393 - RNA, 22 nt, Homo sapiens
guggaaggucaugaauguucuu

SEQ ID NO: 18394 - RNA, 22 nt, Homo sapiens
guggaaucuagagaggcaguag

SEQ ID NO: 18395 - RNA, 22 nt, Homo sapiens
guggacagagacuaaauguugu

SEQ ID NO: 18396 - RNA, 22 nt, Homo sapiens
guggagcuguguggccuugggc

SEQ ID NO: 18397 - RNA, 22 nt, Homo sapiens
guggaggacuggauaaagaaaa

SEQ ID NO: 18398 - RNA, 18 nt, Homo sapiens
guggagugucuuccugga

SEQ ID NO: 18399 - RNA, 22 nt, Homo sapiens
guggcaaguguuccaagaggcg

SEQ ID NO: 18400 - RNA, 22 nt, Homo sapiens
guggcagagucagagggaaaug

SEQ ID NO: 18401 - RNA, 22 nt, Homo sapiens
guggcaugaaagcaucugugau

SEQ ID NO: 18402 - RNA, 22 nt, Homo sapiens
ucucaaccuccacacuacaaua

SEQ ID NO: 18403 - RNA, 22 nt, Homo sapiens
ucucaaccucccaaguagcugg

SEQ ID NO: 18404 - RNA, 22 nt, Homo sapiens
ucucaaguaacugggacaauaa

SEQ ID NO: 18405 - RNA, 22 nt, Homo sapiens
ucucaauuugauuacauucaua

SEQ ID NO: 18406 - RNA, 22 nt, Homo sapiens
ucucacaccccucucauauacc

SEQ ID NO: 18407 - RNA, 22 nt, Homo sapiens
ucucacagaguugaacuuucuu

SEQ ID NO: 18408 - RNA, 22 nt, Homo sapiens
ucucacaggguuauugaggggg

SEQ ID NO: 18409 - RNA, 22 nt, Homo sapiens
ucucaguggcuuccucacuuuu

SEQ ID NO: 18410 - RNA, 22 nt, Homo sapiens
ucucaguguuaucuaucugccu

SEQ ID NO: 18411 - RNA, 22 nt, Homo sapiens
ucucaugaagguggagaguagg

SEQ ID NO: 18412 - RNA, 22 nt, Homo sapiens
ucucauggagucaggagcagaa

SEQ ID NO: 18413 - RNA, 22 nt, Homo sapiens
ucuccauugaaauggacauaau

SEQ ID NO: 18414 - RNA, 22 nt, Homo sapiens
ucuccauuuguaaggguuucuc

SEQ ID NO: 18415 - RNA, 22 nt, Homo sapiens
ucucccauccaugaacuucugu

SEQ ID NO: 18416 - RNA, 22 nt, Homo sapiens
ucucugagaaaaguuucuccca

SEQ ID NO: 18417 - RNA, 22 nt, Homo sapiens
ucucugauuauugcauuucauu

SEQ ID NO: 18418 - RNA, 19 nt, Homo sapiens
ucucugguguuggagggga

SEQ ID NO: 18419 - RNA, 22 nt, Homo sapiens
ucugagguaggugcauggauac

SEQ ID NO: 18420 - RNA, 22 nt, Homo sapiens
ucugauggaguugccagggaga

SEQ ID NO: 18421 - RNA, 22 nt, Homo sapiens
ucugccuacugguuggaggaac

SEQ ID NO: 18422 - RNA, 22 nt, Homo sapiens
ucuggcaagauauccauugcuu

SEQ ID NO: 18423 - RNA, 22 nt, Homo sapiens
ucuggcacugaugugggaugcu

SEQ ID NO: 18424 - RNA, 22 nt, Homo sapiens
ucuggcuuauuucacuuagcau

SEQ ID NO: 18425 - RNA, 22 nt, Homo sapiens
ucugggguuagucaaagguaug

SEQ ID NO: 18426 - RNA, 22 nt, Homo sapiens
ucugguggugaugagagacagu

SEQ ID NO: 18427 - RNA, 22 nt, Homo sapiens
ucugucuugugguuugagugcc

SEQ ID NO: 18428 - RNA, 22 nt, Homo sapiens
ucugucuuugucaggaccagag

SEQ ID NO: 18429 - RNA, 22 nt, Homo sapiens
ucugugaaaucauuuccuguaa

SEQ ID NO: 18430 - RNA, 22 nt, Homo sapiens
ucugugaaugugaccuuauuug

SEQ ID NO: 18431 - RNA, 19 nt, Homo sapiens
ucugugcuugucccccugu

SEQ ID NO: 18432 - RNA, 22 nt, Homo sapiens
ucugugguaagaaacgcauguc

SEQ ID NO: 18433 - RNA, 21 nt, Homo sapiens
ucuguguugaucucacuggga

SEQ ID NO: 18434 - RNA, 22 nt, Homo sapiens
ucuguugguucuuugaggagga

SEQ ID NO: 18435 - RNA, 22 nt, Homo sapiens
ucuuaggugggccaucacccca

SEQ ID NO: 18436 - RNA, 19 nt, Homo sapiens
ucuugcacaugugaacuca

SEQ ID NO: 18437 - RNA, 22 nt, Homo sapiens
ucuugccacuucauccccuuuc

SEQ ID NO: 18438 - RNA, 21 nt, Homo sapiens
ucuuggguugaauucucccag

SEQ ID NO: 18439 - RNA, 17 nt, Homo sapiens
ucuugugguucuugaau

SEQ ID NO: 18440 - RNA, 22 nt, Homo sapiens
ucuuugagugcccugagucccu

SEQ ID NO: 18441 - RNA, 22 nt, Homo sapiens
ucuuugaguggagcgaggcaga

SEQ ID NO: 18442 - RNA, 22 nt, Homo sapiens
ucuuugaguguauacuuagauu

SEQ ID NO: 18443 - RNA, 22 nt, Homo sapiens
ucuuugaguuauugugcagacu

SEQ ID NO: 18444 - RNA, 22 nt, Homo sapiens
ucuuuggaggcgaucuguuuga

SEQ ID NO: 18445 - RNA, 22 nt, Homo sapiens
ucuuuggauggaaauuggaguc

SEQ ID NO: 18446 - RNA, 22 nt, Homo sapiens
ucuuuggucuacuuucauaugu

SEQ ID NO: 18447 - RNA, 22 nt, Homo sapiens
ucuuuguucaggagccaacucc

SEQ ID NO: 18448 - RNA, 22 nt, Homo sapiens
ucuuuuggguauggagccauca

SEQ ID NO: 18449 - RNA, 22 nt, Homo sapiens
ugaaacacacagagaagggaga

SEQ ID NO: 18450 - RNA, 22 nt, Homo sapiens
ugaaacacacauugcccuuuau

SEQ ID NO: 18451 - RNA, 20 nt, Homo sapiens
ugaaacacauggacuggggu

SEQ ID NO: 18452 - RNA, 18 nt, Homo sapiens
ugaaacacauuuuuuccu

SEQ ID NO: 18453 - RNA, 22 nt, Homo sapiens
ugaaagcuacaggaaaguauuu

SEQ ID NO: 18454 - RNA, 22 nt, Homo sapiens
ugaaagguuuaauucugugaga

SEQ ID NO: 18455 - RNA, 22 nt, Homo sapiens
ugaaaucauguaguuauugcaa

SEQ ID NO: 18456 - RNA, 21 nt, Homo sapiens
ugaaaugcaugugcacauuaa

SEQ ID NO: 18457 - RNA, 22 nt, Homo sapiens
ugaaaugccuugagauuuugac

SEQ ID NO: 18458 - RNA, 22 nt, Homo sapiens
ugaaaugccuuuaaugaauuua

SEQ ID NO: 18459 - RNA, 22 nt, Homo sapiens
ugaaauuauucuuaccaaggug

SEQ ID NO: 18460 - RNA, 22 nt, Homo sapiens
ugaaauuuuuuauucguuggcu

SEQ ID NO: 18461 - RNA, 22 nt, Homo sapiens
ugaacuguaagguauaggugau

SEQ ID NO: 18462 - RNA, 22 nt, Homo sapiens
ugaagacucaguuugagggaca

SEQ ID NO: 18463 - RNA, 22 nt, Homo sapiens
ugaagugaagcaguaguguggg

SEQ ID NO: 18464 - RNA, 22 nt, Homo sapiens
ugaauacagcacacccaugggu

SEQ ID NO: 18465 - RNA, 22 nt, Homo sapiens
ugaauagacacuaaagacugua

SEQ ID NO: 18466 - RNA, 22 nt, Homo sapiens
ugaauagugucacaauaaacau

SEQ ID NO: 18467 - RNA, 19 nt, Homo sapiens
ugaaugacaucuaaagucc

SEQ ID NO: 18468 - RNA, 22 nt, Homo sapiens
ugaaugcuaaaggaaaacagua

SEQ ID NO: 18469 - RNA, 23 nt, Homo sapiens
ugaauguaucgaaugugggaaag

SEQ ID NO: 18470 - RNA, 22 nt, Homo sapiens
ugaaugugauggguuucaugug

SEQ ID NO: 18471 - RNA, 22 nt, Homo sapiens
ugacacagcaagauggaaccau

SEQ ID NO: 18472 - RNA, 19 nt, Homo sapiens
ugacacuguuggugggagg

SEQ ID NO: 18473 - RNA, 22 nt, Homo sapiens
uacugcacuccagccugggaga

SEQ ID NO: 18474 - RNA, 20 nt, Homo sapiens
uacugcacuccauccugggu

SEQ ID NO: 18475 - RNA, 23 nt, Homo sapiens
uacugcauccuccgccucuaggg

SEQ ID NO: 18476 - RNA, 22 nt, Homo sapiens
uacuuagagacaugcagcacug

SEQ ID NO: 18477 - RNA, 22 nt, Homo sapiens
uagaaagcaugaccuucagaua

SEQ ID NO: 18478 - RNA, 22 nt, Homo sapiens
uagaaaguagggaagguaggau

SEQ ID NO: 18479 - RNA, 22 nt, Homo sapiens
uagaagcacuaucccuccuagu

SEQ ID NO: 18480 - RNA, 18 nt, Homo sapiens
uagaauauaggucauucu

SEQ ID NO: 18481 - RNA, 22 nt, Homo sapiens
uagaaugaaacaagcugugccu

SEQ ID NO: 18482 - RNA, 22 nt, Homo sapiens
uagaauggaaggcauguuugcc

SEQ ID NO: 18483 - RNA, 22 nt, Homo sapiens
uagaauguaacaguuaaaagca

SEQ ID NO: 18484 - RNA, 22 nt, Homo sapiens
uagaauguauaauauuuuacuu

SEQ ID NO: 18485 - RNA, 22 nt, Homo sapiens
uagagccauugcagauguuuga

SEQ ID NO: 18486 - RNA, 22 nt, Homo sapiens
uagagguauaccaaaaaggcau

SEQ ID NO: 18487 - RNA, 22 nt, Homo sapiens
uagagguauguauaguauucuu

SEQ ID NO: 18488 - RNA, 22 nt, Homo sapiens
uagaucacucaggcaauaaaag

SEQ ID NO: 18489 - RNA, 22 nt, Homo sapiens
uagaucauauacuugccaugac

SEQ ID NO: 18490 - RNA, 22 nt, Homo sapiens
uagaucauauucagugcuuacu

SEQ ID NO: 18491 - RNA, 22 nt, Homo sapiens
uagcacaucccuaaaaugcugu

SEQ ID NO: 18492 - RNA, 22 nt, Homo sapiens
uagcagaauaacuugccagccu

SEQ ID NO: 18493 - RNA, 22 nt, Homo sapiens
uagcagcaaagcaggaucugcu

SEQ ID NO: 18494 - RNA, 22 nt, Homo sapiens
uagcagcaucucuggcuucuac

SEQ ID NO: 18495 - RNA, 22 nt, Homo sapiens
uagcagugugaaaacagacuaa

SEQ ID NO: 18496 - RNA, 21 nt, Homo sapiens
uagcauacauuuugcaucuua

SEQ ID NO: 18497 - RNA, 22 nt, Homo sapiens
uagcuccacagcuauauauaau

SEQ ID NO: 18498 - RNA, 17 nt, Homo sapiens
uagcucuauuucuagcc

SEQ ID NO: 18499 - RNA, 20 nt, Homo sapiens
uaggagcaaugagaguagaa

SEQ ID NO: 18500 - RNA, 22 nt, Homo sapiens
uaggagugugaacccuaugaac

SEQ ID NO: 18501 - RNA, 22 nt, Homo sapiens
uaggcaguggagaaauaaacag

SEQ ID NO: 18502 - RNA, 22 nt, Homo sapiens
uagguucuccacagguucucca

SEQ ID NO: 18503 - RNA, 22 nt, Homo sapiens
uagguugucaucagucuccacu

SEQ ID NO: 18504 - RNA, 22 nt, Homo sapiens
uagucaaaucugaaggaaauuu

SEQ ID NO: 18505 - RNA, 22 nt, Homo sapiens
uagugcugagauugagaagccc

SEQ ID NO: 18506 - RNA, 21 nt, Homo sapiens
uagugcugaggcaguauggga

SEQ ID NO: 18507 - RNA, 18 nt, Homo sapiens
uagugcuguucucaugau

SEQ ID NO: 18508 - RNA, 22 nt, Homo sapiens
uaguugcaucuuaggucuguga

SEQ ID NO: 18509 - RNA, 22 nt, Homo sapiens
uaguugcauuggcugcuaugcu

SEQ ID NO: 18510 - RNA, 22 nt, Homo sapiens
gaaaugcucauuuuggauccuu

SEQ ID NO: 18511 - RNA, 22 nt, Homo sapiens
gaaaugucugagauguggcuca

SEQ ID NO: 18512 - RNA, 22 nt, Homo sapiens
gaaauguuuuucaugugggcaa

SEQ ID NO: 18513 - RNA, 22 nt, Homo sapiens
gaagacauuuacaugggagacc

SEQ ID NO: 18514 - RNA, 22 nt, Homo sapiens
gaaguaguaaaauuuauugcag

SEQ ID NO: 18515 - RNA, 17 nt, Homo sapiens
gaaguguuucagcagcu

SEQ ID NO: 18516 - RNA, 22 nt, Homo sapiens
gaaucauuggguugauucaaga

SEQ ID NO: 18517 - RNA, 22 nt, Homo sapiens
gaaugauacuguuaacgaaaga

SEQ ID NO: 18518 - RNA, 22 nt, Homo sapiens
gaaugcagcagugacagggcug

SEQ ID NO: 18519 - RNA, 20 nt, Homo sapiens
gacauagagacucucaaaaa

SEQ ID NO: 18520 - RNA, 17 nt, Homo sapiens
gacauaggaaaaggaga

SEQ ID NO: 18521 - RNA, 22 nt, Homo sapiens
gacauguuuacaguguugagag

SEQ ID NO: 18522 - RNA, 22 nt, Homo sapiens
gacauguuucucucuguuuacu

SEQ ID NO: 18523 - RNA, 17 nt, Homo sapiens
gacgaucaucaggaggc

SEQ ID NO: 18524 - RNA, 19 nt, Homo sapiens
gacuccagaguugugugcu

SEQ ID NO: 18525 - RNA, 22 nt, Homo sapiens
gacucuguagacaaucacaucu

SEQ ID NO: 18526 - RNA, 22 nt, Homo sapiens
gacuugaagaaucuaagggagg

SEQ ID NO: 18527 - RNA, 18 nt, Homo sapiens
gacuuggaguuuacagug

SEQ ID NO: 18528 - RNA, 22 nt, Homo sapiens
gacuuugguagaggaaaaaucu

SEQ ID NO: 18529 - RNA, 22 nt, Homo sapiens
gagaacugagauaagugauauu

SEQ ID NO: 18530 - RNA, 22 nt, Homo sapiens
gagacugagucuugcucuguca

SEQ ID NO: 18531 - RNA, 22 nt, Homo sapiens
gagagugaaguuugcuaccugu

SEQ ID NO: 18532 - RNA, 22 nt, Homo sapiens
gagagugcuuggcaucugcuga

SEQ ID NO: 18533 - RNA, 22 nt, Homo sapiens
gagagugugucagaggcugcga

SEQ ID NO: 18534 - RNA, 21 nt, Homo sapiens
gagauagguaccgaagcuuag

SEQ ID NO: 18535 - RNA, 22 nt, Homo sapiens
gagaucauguacuagaacaccu

SEQ ID NO: 18536 - RNA, 22 nt, Homo sapiens
gagaucauucugauccagaguc

SEQ ID NO: 18537 - RNA, 22 nt, Homo sapiens
gagaugaaguuaaggaucuuua

SEQ ID NO: 18538 - RNA, 22 nt, Homo sapiens
gagauggugugcuguuggaagu

SEQ ID NO: 18539 - RNA, 22 nt, Homo sapiens
gagaugugugugauuauauaau

SEQ ID NO: 18540 - RNA, 22 nt, Homo sapiens
gagauuaauacacaucaaaugc

SEQ ID NO: 18541 - RNA, 22 nt, Homo sapiens
gagauuauuagauguucugcuu

SEQ ID NO: 18542 - RNA, 22 nt, Homo sapiens
gagauucaucuagguccagaga

SEQ ID NO: 18543 - RNA, 22 nt, Homo sapiens
gagauucuucaauauuuauucu

SEQ ID NO: 18544 - RNA, 22 nt, Homo sapiens
gagcugaucuuuucugauucca

SEQ ID NO: 18545 - RNA, 22 nt, Homo sapiens
gagcuuggguuaaaguugccuu

SEQ ID NO: 18546 - RNA, 22 nt, Homo sapiens
gaggcaaugugcccggcccaca

SEQ ID NO: 18547 - RNA, 22 nt, Homo sapiens
gaggcagucugucccuuagcag

SEQ ID NO: 18548 - RNA, 22 nt, Homo sapiens
gagggcacugcuuuccuuucaa

SEQ ID NO: 18549 - RNA, 21 nt, Homo sapiens
gagguaccucauguaagugga

SEQ ID NO: 18550 - RNA, 22 nt, Homo sapiens
gagguaggaggauugcuuaagg

SEQ ID NO: 18551 - RNA, 22 nt, Homo sapiens
gagguaggggccuuaaagaugc

SEQ ID NO: 18552 - RNA, 22 nt, Homo sapiens
gagguguagucaugccaagauc

SEQ ID NO: 18553 - RNA, 22 nt, Homo sapiens
gagguugggaugagggauacag

SEQ ID NO: 18554 - RNA, 22 nt, Homo sapiens
gaguaacauugacaacuucaug

SEQ ID NO: 18555 - RNA, 22 nt, Homo sapiens
gagugcaagguuuuucugagug

SEQ ID NO: 18556 - RNA, 22 nt, Homo sapiens
gaguuagguugucaaugucuua

SEQ ID NO: 18557 - RNA, 22 nt, Homo sapiens
gaucacauguguacucaaugug

SEQ ID NO: 18558 - RNA, 22 nt, Homo sapiens
gaucauggaguuggguucaagg

SEQ ID NO: 18559 - RNA, 22 nt, Homo sapiens
gaucuguuuuccuauuguuugu

SEQ ID NO: 18560 - RNA, 22 nt, Homo sapiens
gaugacagcugacucccuugcu

SEQ ID NO: 18561 - RNA, 22 nt, Homo sapiens
gaugaggcuagagacaugugua

SEQ ID NO: 18562 - RNA, 22 nt, Homo sapiens
gaugagguagaagacucagcaa

SEQ ID NO: 18563 - RNA, 22 nt, Homo sapiens
gaugcaguaagaaugcauagcg

SEQ ID NO: 18564 - RNA, 22 nt, Homo sapiens
gauggaguugucgccugggcug

SEQ ID NO: 18565 - RNA, 22 nt, Homo sapiens
gauggcaucugagaguguuaga

SEQ ID NO: 18566 - RNA, 22 nt, Homo sapiens
gaugguuuuucuccgauuuaua

SEQ ID NO: 18567 - RNA, 22 nt, Homo sapiens
gaugugaaaucauaguuucuag

SEQ ID NO: 18568 - RNA, 22 nt, Homo sapiens
gauuccauugcgaauuuucaga

SEQ ID NO: 18569 - RNA, 22 nt, Homo sapiens
gauuuugguuagggaaggauac

SEQ ID NO: 18570 - RNA, 22 nt, Homo sapiens
gcaaaauugagaagggaauaua

SEQ ID NO: 18571 - RNA, 20 nt, Homo sapiens
gcaaauggaucccacaagcc

SEQ ID NO: 18572 - RNA, 22 nt, Homo sapiens
gcaagagguaucuuauuuuccc

SEQ ID NO: 18573 - RNA, 21 nt, Homo sapiens
gcaaguacuaucaucauuauc

SEQ ID NO: 18574 - RNA, 22 nt, Homo sapiens
gcaauacugacagcauuaguuu

SEQ ID NO: 18575 - RNA, 22 nt, Homo sapiens
gcacacuuacacgaaccuagau

SEQ ID NO: 18576 - RNA, 22 nt, Homo sapiens
gcacauggccccaucgugccga

SEQ ID NO: 18577 - RNA, 22 nt, Homo sapiens
gcacccugucaaaauggaccaa

SEQ ID NO: 18578 - RNA, 22 nt, Homo sapiens
gcagcaguggcaguuaauauuu

SEQ ID NO: 18579 - RNA, 22 nt, Homo sapiens
gcagcagugugggcugaaccua

SEQ ID NO: 18580 - RNA, 22 nt, Homo sapiens
gcaguggugugugccagccuag

SEQ ID NO: 18581 - RNA, 22 nt, Homo sapiens
ccagccgggugcaguggcucac

SEQ ID NO: 18582 - RNA, 23 nt, Homo sapiens
ccaguauuuauguaaggaagugu

SEQ ID NO: 18583 - RNA, 22 nt, Homo sapiens
ccagugaacugcaagguuuuuc

SEQ ID NO: 18584 - RNA, 21 nt, Homo sapiens
ccagugguuggaaacuauggg

SEQ ID NO: 18585 - RNA, 19 nt, Homo sapiens
ccaguguucugauugcacu

SEQ ID NO: 18586 - RNA, 22 nt, Homo sapiens
ccaguucaaugauauggaaacu

SEQ ID NO: 18587 - RNA, 22 nt, Homo sapiens
ccauggcuauucuguaaggguu

SEQ ID NO: 18588 - RNA, 22 nt, Homo sapiens
ccauggcuucugcauucuguca

SEQ ID NO: 18589 - RNA, 22 nt, Homo sapiens
ccauugcacuccagccuaggca

SEQ ID NO: 18590 - RNA, 23 nt, Homo sapiens
ccauugcacuccagccucaguga

SEQ ID NO: 18591 - RNA, 22 nt, Homo sapiens
ccauuucacucuuccugaagga

SEQ ID NO: 18592 - RNA, 22 nt, Homo sapiens
cccaguguuacgugacagccug

SEQ ID NO: 18593 - RNA, 22 nt, Homo sapiens
cccucgagaaaccaucugcuga

SEQ ID NO: 18594 - RNA, 22 nt, Homo sapiens
cccugaagaaagccuaggacau

SEQ ID NO: 18595 - RNA, 22 nt, Homo sapiens
cccugaagauacagaguuuggg

SEQ ID NO: 18596 - RNA, 22 nt, Homo sapiens
cccugagaugcuguuaaucugu

SEQ ID NO: 18597 - RNA, 19 nt, Homo sapiens
cccuggcacauggaaaaug

SEQ ID NO: 18598 - RNA, 22 nt, Homo sapiens
cccuucauucaaggguugugag

SEQ ID NO: 18599 - RNA, 21 nt, Homo sapiens
ccugaagaagugaccucugag

SEQ ID NO: 18600 - RNA, 22 nt, Homo sapiens
ccugagacuugagggggcuucu

SEQ ID NO: 18601 - RNA, 22 nt, Homo sapiens
ccugagguagaguuuauauuga

SEQ ID NO: 18602 - RNA, 19 nt, Homo sapiens
ccugcuguucuuuugcacc

SEQ ID NO: 18603 - RNA, 22 nt, Homo sapiens
ccuggcaagagacugaagauag

SEQ ID NO: 18604 - RNA, 22 nt, Homo sapiens
ccuggguuacaggugugagcca

SEQ ID NO: 18605 - RNA, 21 nt, Homo sapiens
ccuugagaacaucaauuugcu

SEQ ID NO: 18606 - RNA, 22 nt, Homo sapiens
ccuugcacuucccaagugaggc

SEQ ID NO: 18607 - RNA, 22 nt, Homo sapiens
ccuugucacugaguggaaugaa

SEQ ID NO: 18608 - RNA, 22 nt, Homo sapiens
cgcuggugucuaagcgacagcu

SEQ ID NO: 18609 - RNA, 22 nt, Homo sapiens
cuaaagugcuuaaaaucucauu

SEQ ID NO: 18610 - RNA, 22 nt, Homo sapiens
cuaagugaacugucacugagaa

SEQ ID NO: 18611 - RNA, 22 nt, Homo sapiens
cuaagugaguauaauuuuaaga

SEQ ID NO: 18612 - RNA, 22 nt, Homo sapiens
cuaauucuguaccuggcacaua

SEQ ID NO: 18613 - RNA, 22 nt, Homo sapiens
cuacccuuaaguuucugugggg

SEQ ID NO: 18614 - RNA, 22 nt, Homo sapiens
cuacucuggagagugacaauca

SEQ ID NO: 18615 - RNA, 22 nt, Homo sapiens
cuagaagcauauucagaacaga

SEQ ID NO: 18616 - RNA, 22 nt, Homo sapiens
cuagaggcacagccuaggcacu

SEQ ID NO: 18617 - RNA, 22 nt, Homo sapiens
cuagauuguuuccauaaugaca

SEQ ID NO: 18618 - RNA, 22 nt, Homo sapiens
uaugacguuuuauuggcgcagu

SEQ ID NO: 18619 - RNA, 22 nt, Homo sapiens
uaugacuguuugcucauucagg

SEQ ID NO: 18620 - RNA, 22 nt, Homo sapiens
uaugaucauuauguuauugcag

SEQ ID NO: 18621 - RNA, 22 nt, Homo sapiens
uaugauuuuugggagaggucaa

SEQ ID NO: 18622 - RNA, 22 nt, Homo sapiens
uaugcagacauuguuccaacca

SEQ ID NO: 18623 - RNA, 19 nt, Homo sapiens
uaugcuagagagggaagcu

SEQ ID NO: 18624 - RNA, 22 nt, Homo sapiens
uauggccccuacaugugcaaaa

SEQ ID NO: 18625 - RNA, 22 nt, Homo sapiens
uaugucuauuauguagcaggaa

SEQ ID NO: 18626 - RNA, 22 nt, Homo sapiens
uaugugcaaauuaauugcuaga

SEQ ID NO: 18627 - RNA, 22 nt, Homo sapiens
uaugugcacaugcccuggugac

SEQ ID NO: 18628 - RNA, 22 nt, Homo sapiens
uauuauuguccuucuauaccca

SEQ ID NO: 18629 - RNA, 22 nt, Homo sapiens
uauucacuguaucauugauggg

SEQ ID NO: 18630 - RNA, 22 nt, Homo sapiens
uauugcaauuggggaaacuggg

SEQ ID NO: 18631 - RNA, 22 nt, Homo sapiens
uauugcacuccucaugcauuug

SEQ ID NO: 18632 - RNA, 22 nt, Homo sapiens
uauugccugucuccaaaaauca

SEQ ID NO: 18633 - RNA, 22 nt, Homo sapiens
uauuguacauguuauagauuuu

SEQ ID NO: 18634 - RNA, 22 nt, Homo sapiens
uauuugguuggugcaaaaguaa

SEQ ID NO: 18635 - RNA, 22 nt, Homo sapiens
ucaaaaucucuuagcugugucu

SEQ ID NO: 18636 - RNA, 22 nt, Homo sapiens
ucaaaugcuguauuguaguaau

SEQ ID NO: 18637 - RNA, 22 nt, Homo sapiens
ucaaauguuuguuuaaggcuua

SEQ ID NO: 18638 - RNA, 20 nt, Homo sapiens
ucaaauucuuggccuccagc

SEQ ID NO: 18639 - RNA, 22 nt, Homo sapiens
ucaagcaauucuccugccucag

SEQ ID NO: 18640 - RNA, 21 nt, Homo sapiens
ucaaggaguauacguaugcca

SEQ ID NO: 18641 - RNA, 22 nt, Homo sapiens
ucaaggcacuagcugagcugca

SEQ ID NO: 18642 - RNA, 22 nt, Homo sapiens
ucaaguaauacucccaucuugg

SEQ ID NO: 18643 - RNA, 22 nt, Homo sapiens
ucaaguaguaacuaacugugac

SEQ ID NO: 18644 - RNA, 22 nt, Homo sapiens
ucaaugaaugaugguugguaug

SEQ ID NO: 18645 - RNA, 22 nt, Homo sapiens
ucacaauggagacucgggcgga

SEQ ID NO: 18646 - RNA, 22 nt, Homo sapiens
ucacaauucucaauuugugaaa

SEQ ID NO: 18647 - RNA, 22 nt, Homo sapiens
ucacaccauucuucuacuucag

SEQ ID NO: 18648 - RNA, 22 nt, Homo sapiens
ucacacucucaccaacauuugg

SEQ ID NO: 18649 - RNA, 22 nt, Homo sapiens
ucacacugcaucuguuggaauu

SEQ ID NO: 18650 - RNA, 19 nt, Homo sapiens
ucacacuguggcuucuuua

SEQ ID NO: 18651 - RNA, 23 nt, Homo sapiens
ucacacuuaagagaaaugcagcu

SEQ ID NO: 18652 - RNA, 22 nt, Homo sapiens
ucacagaggagaagaccuuuaa

SEQ ID NO: 18653 - RNA, 22 nt, Homo sapiens
ucacaguaacuuuguugcuuuu

SEQ ID NO: 18654 - RNA, 22 nt, Homo sapiens
ucacaguguuaaaccuuucuuu

SEQ ID NO: 18655 - RNA, 22 nt, Homo sapiens
ucacaguucagcauggcugagg

SEQ ID NO: 18656 - RNA, 22 nt, Homo sapiens
ucacaugaauugucuuguucca

SEQ ID NO: 18657 - RNA, 22 nt, Homo sapiens
ucacauggauuaacucauuuau

SEQ ID NO: 18658 - RNA, 22 nt, Homo sapiens
ucacaugugaagauugggagua

SEQ ID NO: 18659 - RNA, 22 nt, Homo sapiens
ucacaugugacauauauauuug

SEQ ID NO: 18660 - RNA, 22 nt, Homo sapiens
ucacauuguguagccugcucac

SEQ ID NO: 18661 - RNA, 22 nt, Homo sapiens
ucacccugacaugcggccgaac

SEQ ID NO: 18662 - RNA, 22 nt, Homo sapiens
ucacuagaucaagggagagaaa

SEQ ID NO: 18663 - RNA, 22 nt, Homo sapiens
ucacugagaaugauguuucuga

SEQ ID NO: 18664 - RNA, 22 nt, Homo sapiens
ucacugagcacaggagaugugc

SEQ ID NO: 18665 - RNA, 22 nt, Homo sapiens
ucacugaggucugagcuuuaug

SEQ ID NO: 18666 - RNA, 21 nt, Homo sapiens
ucacugagguuaaauaggguu

SEQ ID NO: 18667 - RNA, 20 nt, Homo sapiens
ucacugaguaucuacgauua

SEQ ID NO: 18668 - RNA, 20 nt, Homo sapiens
ucacugagugguccacagua

SEQ ID NO: 18669 - RNA, 22 nt, Homo sapiens
ucacugcacuucaggcuuucuc

SEQ ID NO: 18670 - RNA, 22 nt, Homo sapiens
ucacuggacagaaauaaaggug

SEQ ID NO: 18671 - RNA, 22 nt, Homo sapiens
ucacugggagaccaaagccauc

SEQ ID NO: 18672 - RNA, 22 nt, Homo sapiens
ucacuggucuaaguggaggggg

SEQ ID NO: 18673 - RNA, 22 nt, Homo sapiens
ucagagcaaagacacuuuauca

SEQ ID NO: 18674 - RNA, 22 nt, Homo sapiens
ucagaguggagucugcagccuu

SEQ ID NO: 18675 - RNA, 22 nt, Homo sapiens
ucagaucacuggcgcuggcgga

SEQ ID NO: 18676 - RNA, 19 nt, Homo sapiens
ucagaucagcccaagggau

SEQ ID NO: 18677 - RNA, 22 nt, Homo sapiens
ucagaucauuaagguagguuua

SEQ ID NO: 18678 - RNA, 22 nt, Homo sapiens
ucagaugaucugguaagaacuu

SEQ ID NO: 18679 - RNA, 22 nt, Homo sapiens
ucagaugauuccguugacgaga

SEQ ID NO: 18680 - RNA, 22 nt, Homo sapiens
ucagauguuugagaaguauacu

SEQ ID NO: 18681 - RNA, 22 nt, Homo sapiens
ucagcaaugcugcacucuacug

SEQ ID NO: 18682 - RNA, 22 nt, Homo sapiens
ucaggcuuuucccagagugaug

SEQ ID NO: 18683 - RNA, 22 nt, Homo sapiens
ucaggugcagagaagaaauggg

SEQ ID NO: 18684 - RNA, 22 nt, Homo sapiens
ucaguaaauguuaggacauuuc

SEQ ID NO: 18685 - RNA, 23 nt, Homo sapiens
ucaguacuccacuuucaauagug

SEQ ID NO: 18686 - RNA, 22 nt, Homo sapiens
ucaguacuuuggagcucacaua

SEQ ID NO: 18687 - RNA, 22 nt, Homo sapiens
ucagucauucaauuguugaaug

SEQ ID NO: 18688 - RNA, 22 nt, Homo sapiens
ucagugcuguaccaucuaagga

SEQ ID NO: 18689 - RNA, 22 nt, Homo sapiens
gugacaucagcuccagguauaa

SEQ ID NO: 18690 - RNA, 22 nt, Homo sapiens
gugacugcauauaaguguaugu

SEQ ID NO: 18691 - RNA, 22 nt, Homo sapiens
gugagauggagucuugcuuugu

SEQ ID NO: 18692 - RNA, 22 nt, Homo sapiens
gugagauuaccauuuaaaucag

SEQ ID NO: 18693 - RNA, 22 nt, Homo sapiens
gugagcagagaucgcgugauug

SEQ ID NO: 18694 - RNA, 22 nt, Homo sapiens
gugagcuauguccugguuuggg

SEQ ID NO: 18695 - RNA, 22 nt, Homo sapiens
gugagguauacugggaucacua

SEQ ID NO: 18696 - RNA, 22 nt, Homo sapiens
gugagucagucuguguagggcu

SEQ ID NO: 18697 - RNA, 21 nt, Homo sapiens
gugaucaugucacugcacucc

SEQ ID NO: 18698 - RNA, 22 nt, Homo sapiens
gugaucucagcucacuggaacc

SEQ ID NO: 18699 - RNA, 22 nt, Homo sapiens
gugaucuucauggaaggugaaa

SEQ ID NO: 18700 - RNA, 22 nt, Homo sapiens
gugauuguuaaacugccucucu

SEQ ID NO: 18701 - RNA, 22 nt, Homo sapiens
gugcacaacaugcaguuuuguu

SEQ ID NO: 18702 - RNA, 22 nt, Homo sapiens
gugcacaacgugcaaguuuguu

SEQ ID NO: 18703 - RNA, 22 nt, Homo sapiens
gugcacaacgugcaggcuuguu

SEQ ID NO: 18704 - RNA, 22 nt, Homo sapiens
gugcacaaugugcagguuuguu

SEQ ID NO: 18705 - RNA, 22 nt, Homo sapiens
gugcagaugucuuuauaguagc

SEQ ID NO: 18706 - RNA, 22 nt, Homo sapiens
gugcaguuugaaaguagaaaca

SEQ ID NO: 18707 - RNA, 22 nt, Homo sapiens
gugcauauaaguuguuucuagu

SEQ ID NO: 18708 - RNA, 22 nt, Homo sapiens
gugccuuuucugagcaaugagc

SEQ ID NO: 18709 - RNA, 22 nt, Homo sapiens
gugcucauuuagagagaagcac

SEQ ID NO: 18710 - RNA, 16 nt, Homo sapiens
gugcuguguuguuagg

SEQ ID NO: 18711 - RNA, 22 nt, Homo sapiens
guggaaagaacacaaaauuagg

SEQ ID NO: 18712 - RNA, 20 nt, Homo sapiens
guggaaguagaaacauaugu

SEQ ID NO: 18713 - RNA, 22 nt, Homo sapiens
guggaaugauaucucauugugg

SEQ ID NO: 18714 - RNA, 22 nt, Homo sapiens
guggaauuauagagacaucuug

SEQ ID NO: 18715 - RNA, 22 nt, Homo sapiens
guggacggagguugcagugagc

SEQ ID NO: 18716 - RNA, 22 nt, Homo sapiens
guggcagaaaagagaagcaaug

SEQ ID NO: 18717 - RNA, 22 nt, Homo sapiens
guggcagugugaggauccugcu

SEQ ID NO: 18718 - RNA, 22 nt, Homo sapiens
guggcuauucaccuuuaugaaa

SEQ ID NO: 18719 - RNA, 22 nt, Homo sapiens
guggcuuuauuuagaagcaggg

SEQ ID NO: 18720 - RNA, 22 nt, Homo sapiens
gugggaugcaaguaaaauuguc

SEQ ID NO: 18721 - RNA, 21 nt, Homo sapiens
gugguucuagagaaacagaau

SEQ ID NO: 18722 - RNA, 22 nt, Homo sapiens
gugguuuuuaaaguaccugugg

SEQ ID NO: 18723 - RNA, 22 nt, Homo sapiens
gugucaguggggagugaucuuc

SEQ ID NO: 18724 - RNA, 22 nt, Homo sapiens
gugucaugggcauguccuuaac

SEQ ID NO: 18725 - RNA, 22 nt, Homo sapiens
guguccuaugaaacaggaucca

SEQ ID NO: 18726 - RNA, 22 nt, Homo sapiens
uguuacacugugcacuaaauuu

SEQ ID NO: 18727 - RNA, 22 nt, Homo sapiens
uguuaguuguucauguuaagag

SEQ ID NO: 18728 - RNA, 19 nt, Homo sapiens
uguugcacauaucaauaug

SEQ ID NO: 18729 - RNA, 22 nt, Homo sapiens
uguugcaccugccuugcuuuag

SEQ ID NO: 18730 - RNA, 22 nt, Homo sapiens
uguugcacuccagccuggguga

SEQ ID NO: 18731 - RNA, 20 nt, Homo sapiens
uguugcacucuagccugggu

SEQ ID NO: 18732 - RNA, 22 nt, Homo sapiens
uguugcacugguaauguacuga

SEQ ID NO: 18733 - RNA, 22 nt, Homo sapiens
uguuuguuugauaugggauaaa

SEQ ID NO: 18734 - RNA, 21 nt, Homo sapiens
uguuuuugcuguguaucucuc

SEQ ID NO: 18735 - RNA, 22 nt, Homo sapiens
uuaaaugcauagaauguguagu

SEQ ID NO: 18736 - RNA, 22 nt, Homo sapiens
uuaacagugucaaucuguagua

SEQ ID NO: 18737 - RNA, 22 nt, Homo sapiens
uuaagacaccaaucauuggauu

SEQ ID NO: 18738 - RNA, 22 nt, Homo sapiens
uuaagaucagugcaaacuggag

SEQ ID NO: 18739 - RNA, 22 nt, Homo sapiens
uuaaggaaggagucuuaaaugg

SEQ ID NO: 18740 - RNA, 22 nt, Homo sapiens
uuaaggcuuguacuuguuuucu

SEQ ID NO: 18741 - RNA, 22 nt, Homo sapiens
uuaaggcuuucccuauguaaaa

SEQ ID NO: 18742 - RNA, 21 nt, Homo sapiens
uuaaguaauuacccaacucuc

SEQ ID NO: 18743 - RNA, 22 nt, Homo sapiens
uuaagugaauuaucuaacaugu

SEQ ID NO: 18744 - RNA, 22 nt, Homo sapiens
uuaaugcuuggggaguaguucu

SEQ ID NO: 18745 - RNA, 22 nt, Homo sapiens
uuaauuguccaaguucaucucu

SEQ ID NO: 18746 - RNA, 22 nt, Homo sapiens
uuacacaguaggucccuaguaa

SEQ ID NO: 18747 - RNA, 20 nt, Homo sapiens
uuacagugggaccuuccuga

SEQ ID NO: 18748 - RNA, 22 nt, Homo sapiens
uuacaugucuugguaagguuag

SEQ ID NO: 18749 - RNA, 22 nt, Homo sapiens
uuacauugcuucaaauucagug

SEQ ID NO: 18750 - RNA, 22 nt, Homo sapiens
uuaccagucuagggcucaguuu

SEQ ID NO: 18751 - RNA, 22 nt, Homo sapiens
uuacuauguuucaaagugucuc

SEQ ID NO: 18752 - RNA, 22 nt, Homo sapiens
uuacugcuagcugugugcucuu

SEQ ID NO: 18753 - RNA, 22 nt, Homo sapiens
uuacugcucuuuugucaugagu

SEQ ID NO: 18754 - RNA, 22 nt, Homo sapiens
uuagaauggaaaugcgagguua

SEQ ID NO: 18755 - RNA, 22 nt, Homo sapiens
uuagauuauugguguuuugcaa

SEQ ID NO: 18756 - RNA, 22 nt, Homo sapiens
uuagcaauagccugcaucugca

SEQ ID NO: 18757 - RNA, 22 nt, Homo sapiens
uuagcacaucuuucuauguaag

SEQ ID NO: 18758 - RNA, 22 nt, Homo sapiens
uuagcagcacaaaagcagacua

SEQ ID NO: 18759 - RNA, 21 nt, Homo sapiens
uuaggcagugucagaggugag

SEQ ID NO: 18760 - RNA, 20 nt, Homo sapiens
uuagucuccucugcccuguc

SEQ ID NO: 18761 - RNA, 21 nt, Homo sapiens
uuagugcucaguuugacaaaa

SEQ ID NO: 18762 - RNA, 22 nt, Homo sapiens
uuauauguuacucccucuagca

SEQ ID NO: 18763 - RNA, 22 nt, Homo sapiens
uuaucacauugacugauuugca

SEQ ID NO: 18764 - RNA, 22 nt, Homo sapiens
uuaucauagugcaguuuucuga

SEQ ID NO: 18765 - RNA, 22 nt, Homo sapiens
uuaugguacaugugcacaaugu

SEQ ID NO: 18766 - RNA, 22 nt, Homo sapiens
uuauguaaaucaaucuggaauc

SEQ ID NO: 18767 - RNA, 22 nt, Homo sapiens
uuauguccuuuaacuucaucac

SEQ ID NO: 18768 - RNA, 22 nt, Homo sapiens
uuaugucuuuuguguucagcua

SEQ ID NO: 18769 - RNA, 22 nt, Homo sapiens
uuauuacuccuauuuuguagau

SEQ ID NO: 18770 - RNA, 22 nt, Homo sapiens
uuauuugguuauuguaauuggg

SEQ ID NO: 18771 - RNA, 22 nt, Homo sapiens
uucaaaguaaaaauguguucac

SEQ ID NO: 18772 - RNA, 22 nt, Homo sapiens
uucaagcuauggugaucuuuuc

SEQ ID NO: 18773 - RNA, 22 nt, Homo sapiens
uucaaguaguucucaugccuca

SEQ ID NO: 18774 - RNA, 22 nt, Homo sapiens
uucaagucaacaagcacuugag

SEQ ID NO: 18775 - RNA, 22 nt, Homo sapiens
uucaaguguucaggagcuacag

SEQ ID NO: 18776 - RNA, 22 nt, Homo sapiens
uucacaaugccuuguugauggu

SEQ ID NO: 18777 - RNA, 22 nt, Homo sapiens
uucacagaaaaaggcgaugagg

SEQ ID NO: 18778 - RNA, 22 nt, Homo sapiens
uucacagucacccuucuccaug

SEQ ID NO: 18779 - RNA, 22 nt, Homo sapiens
uucaccagggaagucucaacuc

SEQ ID NO: 18780 - RNA, 22 nt, Homo sapiens
uucaccaguuuugucacgaaug

SEQ ID NO: 18781 - RNA, 22 nt, Homo sapiens
uucagcaaugacagccuauaua

SEQ ID NO: 18782 - RNA, 22 nt, Homo sapiens
uucaguaaauguucuuacuaua

SEQ ID NO: 18783 - RNA, 22 nt, Homo sapiens
uucaguacuucaaaaucuuuaa

SEQ ID NO: 18784 - RNA, 18 nt, Homo sapiens
uucauaguagcaugauuu

SEQ ID NO: 18785 - RNA, 22 nt, Homo sapiens
uucauagucuaugcaaguaaga

SEQ ID NO: 18786 - RNA, 22 nt, Homo sapiens
uucauagugaaaaauucaaagu

SEQ ID NO: 18787 - RNA, 22 nt, Homo sapiens
uucauguaauuccauaagguaa

SEQ ID NO: 18788 - RNA, 22 nt, Homo sapiens
uucauugaaugauuuuuagaag

SEQ ID NO: 18789 - RNA, 22 nt, Homo sapiens
uucauuggauguuacacugugu

SEQ ID NO: 18790 - RNA, 22 nt, Homo sapiens
uuccaagugggaaacaaaaaug

SEQ ID NO: 18791 - RNA, 22 nt, Homo sapiens
uuccaguaauagcacagcauug

SEQ ID NO: 18792 - RNA, 22 nt, Homo sapiens
uucccagagagggacuucuaau

SEQ ID NO: 18793 - RNA, 22 nt, Homo sapiens
uucccagugccaggcacuggga

SEQ ID NO: 18794 - RNA, 22 nt, Homo sapiens
uucccagugguuagcucugguc

SEQ ID NO: 18795 - RNA, 22 nt, Homo sapiens
uucccucagaaacacacagccc

SEQ ID NO: 18796 - RNA, 22 nt, Homo sapiens
uucccugaaguguuacucuaga

SEQ ID NO: 18797 - RNA, 23 nt, Homo sapiens
uuguucccuuccacucagucucc

SEQ ID NO: 18798 - RNA, 22 nt, Homo sapiens
uuguugcacugcuuuccuggcc

SEQ ID NO: 18799 - RNA, 22 nt, Homo sapiens
uuguuuagagacuggaauuaaa

SEQ ID NO: 18800 - RNA, 20 nt, Homo sapiens
uuuaagacaugcugaauuga

SEQ ID NO: 18801 - RNA, 22 nt, Homo sapiens
uuuaaggcaugccuguacaugc

SEQ ID NO: 18802 - RNA, 22 nt, Homo sapiens
uuuaauacugcaucuuuacucu

SEQ ID NO: 18803 - RNA, 22 nt, Homo sapiens
uuuaaugcugcccagucauggg

SEQ ID NO: 18804 - RNA, 22 nt, Homo sapiens
uuuacugucuucagucccucug

SEQ ID NO: 18805 - RNA, 19 nt, Homo sapiens
uuuagaucuuuuaugcagc

SEQ ID NO: 18806 - RNA, 22 nt, Homo sapiens
uuuagcagcaaagagcuguguu

SEQ ID NO: 18807 - RNA, 22 nt, Homo sapiens
uuuagggcaggccuggugguga

SEQ ID NO: 18808 - RNA, 22 nt, Homo sapiens
uuuaucuguuuaaaacuguuca

SEQ ID NO: 18809 - RNA, 22 nt, Homo sapiens
uuuaugcuacauguguuggaaa

SEQ ID NO: 18810 - RNA, 22 nt, Homo sapiens
uuuauguggagcacuugacaca

SEQ ID NO: 18811 - RNA, 22 nt, Homo sapiens
uuucaacaggucuggggugguc

SEQ ID NO: 18812 - RNA, 22 nt, Homo sapiens
uuucacagcaauugccuauugu

SEQ ID NO: 18813 - RNA, 20 nt, Homo sapiens
uuucaguacuuucuacuggc

SEQ ID NO: 18814 - RNA, 22 nt, Homo sapiens
uuucauagccuuugucgucuga

SEQ ID NO: 18815 - RNA, 22 nt, Homo sapiens
uuucaucaagcacagaguagau

SEQ ID NO: 18816 - RNA, 22 nt, Homo sapiens
uuucauggcgaggcuucauggg

SEQ ID NO: 18817 - RNA, 22 nt, Homo sapiens
uuuccaagaugcuuacuuucuc

SEQ ID NO: 18818 - RNA, 22 nt, Homo sapiens
uuuccauguuggugaaaugagg

SEQ ID NO: 18819 - RNA, 22 nt, Homo sapiens
uuucccugaaggcucugaaguc

SEQ ID NO: 18820 - RNA, 22 nt, Homo sapiens
uuuccuguagggggcaaggccu

SEQ ID NO: 18821 - RNA, 22 nt, Homo sapiens
uuucucaguguuucaggguagg

SEQ ID NO: 18822 - RNA, 22 nt, Homo sapiens
uuucugaggccucaccagaagc

SEQ ID NO: 18823 - RNA, 22 nt, Homo sapiens
uuugacuacugaugguguacgc

SEQ ID NO: 18824 - RNA, 22 nt, Homo sapiens
uuugauguccaccucagcccac

SEQ ID NO: 18825 - RNA, 22 nt, Homo sapiens
uuugcaagaugaaaaaguucua

SEQ ID NO: 18826 - RNA, 22 nt, Homo sapiens
uuugcacauauuugggcaaaag

SEQ ID NO: 18827 - RNA, 22 nt, Homo sapiens
uuugcacuggagauucaauggg

SEQ ID NO: 18828 - RNA, 22 nt, Homo sapiens
uuugcacuucugagugugacau

SEQ ID NO: 18829 - RNA, 23 nt, Homo sapiens
uuugcacuugcuccuucuauggc

SEQ ID NO: 18830 - RNA, 22 nt, Homo sapiens
uuugcagagucuuucgcugggc

SEQ ID NO: 18831 - RNA, 22 nt, Homo sapiens
uuugcagugucagcuucugugu

SEQ ID NO: 18832 - RNA, 22 nt, Homo sapiens
uuugccaauauuuuacugagga

SEQ ID NO: 18833 - RNA, 18 nt, Homo sapiens
uuugccacuucccagaaa

SEQ ID NO: 18834 - RNA, 22 nt, Homo sapiens
aagugcuguaugggagccuagg

SEQ ID NO: 18835 - RNA, 22 nt, Homo sapiens
aagugcuuaggauagugugugg

SEQ ID NO: 18836 - RNA, 22 nt, Homo sapiens
aagugguuuuuacaaagacaga

SEQ ID NO: 18837 - RNA, 22 nt, Homo sapiens
aauacugaaaguauuuucaaau

SEQ ID NO: 18838 - RNA, 22 nt, Homo sapiens
aauagcacuguagauggaggaa

SEQ ID NO: 18839 - RNA, 22 nt, Homo sapiens
aauaucacaggguguacacuca

SEQ ID NO: 18840 - RNA, 22 nt, Homo sapiens
aauaucacaguuggguguacac

SEQ ID NO: 18841 - RNA, 22 nt, Homo sapiens
aaucaacauuguuuuaagucaa

SEQ ID NO: 18842 - RNA, 22 nt, Homo sapiens
aaucccugagcuagacacaaag

SEQ ID NO: 18843 - RNA, 22 nt, Homo sapiens
aaucugauguuaucagcuuaag

SEQ ID NO: 18844 - RNA, 22 nt, Homo sapiens
aaucuguagaaggugcacauuc

SEQ ID NO: 18845 - RNA, 22 nt, Homo sapiens
aaugacugugauauuuuucuuc

SEQ ID NO: 18846 - RNA, 22 nt, Homo sapiens
aaugccacugugccugccaagg

SEQ ID NO: 18847 - RNA, 22 nt, Homo sapiens
aaugccuagugugugacaggug

SEQ ID NO: 18848 - RNA, 22 nt, Homo sapiens
aauggcaaauguuuucuguuga

SEQ ID NO: 18849 - RNA, 18 nt, Homo sapiens
aauggcucuggguucuaa

SEQ ID NO: 18850 - RNA, 22 nt, Homo sapiens
aauggcuucuuauugugguuca

SEQ ID NO: 18851 - RNA, 22 nt, Homo sapiens
aauuacauggcaauugggaaau

SEQ ID NO: 18852 - RNA, 22 nt, Homo sapiens
aauuaguaaccuaauuccaucu

SEQ ID NO: 18853 - RNA, 22 nt, Homo sapiens
aauuaguugaaagucugcuuuu

SEQ ID NO: 18854 - RNA, 22 nt, Homo sapiens
aauuaguuggcugccuaugauu

SEQ ID NO: 18855 - RNA, 22 nt, Homo sapiens
aauucacuucuuuuaggcaggg

SEQ ID NO: 18856 - RNA, 22 nt, Homo sapiens
aauugcaauggacaaugcagca

SEQ ID NO: 18857 - RNA, 22 nt, Homo sapiens
aauugcacuacugcacucccac

SEQ ID NO: 18858 - RNA, 22 nt, Homo sapiens
aauuguacucccaucauuccua

SEQ ID NO: 18859 - RNA, 22 nt, Homo sapiens
acaaagcuagggaauccaucuu

SEQ ID NO: 18860 - RNA, 21 nt, Homo sapiens
acaaagcuggagggagacugc

SEQ ID NO: 18861 - RNA, 22 nt, Homo sapiens
acaaagugccuccuuuuagagu

SEQ ID NO: 18862 - RNA, 17 nt, Homo sapiens
acaaauugccagcuagg

SEQ ID NO: 18863 - RNA, 22 nt, Homo sapiens
acacaugugcguagacucuuua

SEQ ID NO: 18864 - RNA, 22 nt, Homo sapiens
acacauuagcaagugcuguuau

SEQ ID NO: 18865 - RNA, 22 nt, Homo sapiens
acacuggaguuaaaggugauuu

SEQ ID NO: 18866 - RNA, 22 nt, Homo sapiens
acacuggguaacauaucuguua

SEQ ID NO: 18867 - RNA, 22 nt, Homo sapiens
acacugucaugucucacaggca

SEQ ID NO: 18868 - RNA, 22 nt, Homo sapiens
acacuguugacauuuuguagug

SEQ ID NO: 18869 - RNA, 22 nt, Homo sapiens
acagaccuauuucaaucauuua

SEQ ID NO: 18870 - RNA, 22 nt, Homo sapiens
acagcagugccccacucuacug

SEQ ID NO: 18871 - RNA, 22 nt, Homo sapiens
acaguacaugauaaauaaggua

SEQ ID NO: 18872 - RNA, 22 nt, Homo sapiens
acagucacaauuuguaccuuuu

SEQ ID NO: 18873 - RNA, 22 nt, Homo sapiens
acagugacagaaagcugauuau

SEQ ID NO: 18874 - RNA, 22 nt, Homo sapiens
acagugcuuuuguuccucuccu

SEQ ID NO: 18875 - RNA, 22 nt, Homo sapiens
acaguggaauguaggguuugag

SEQ ID NO: 18876 - RNA, 18 nt, Homo sapiens
acagugucauggcucaau

SEQ ID NO: 18877 - RNA, 22 nt, Homo sapiens
acauccauuugcuuuauuugcu

SEQ ID NO: 18878 - RNA, 22 nt, Homo sapiens
acauugcauauggcacccucuu

SEQ ID NO: 18879 - RNA, 22 nt, Homo sapiens
accacagugcuuccugcucacg

SEQ ID NO: 18880 - RNA, 22 nt, Homo sapiens
accagucucagguaugucuuua

SEQ ID NO: 18881 - RNA, 22 nt, Homo sapiens
accauugcacuccagcccaggc

SEQ ID NO: 18882 - RNA, 22 nt, Homo sapiens
acccaguagucauucaggagca

SEQ ID NO: 18883 - RNA, 22 nt, Homo sapiens
acccaguguucagacuaccugu

SEQ ID NO: 18884 - RNA, 21 nt, Homo sapiens
acccccacaccuccuuaguuc

SEQ ID NO: 18885 - RNA, 22 nt, Homo sapiens
acccugucagcuggccugggca

SEQ ID NO: 18886 - RNA, 22 nt, Homo sapiens
accugcacagccgaacauagac

SEQ ID NO: 18887 - RNA, 22 nt, Homo sapiens
accuggguguauguucaguuug

SEQ ID NO: 18888 - RNA, 22 nt, Homo sapiens
acggcacugguggaaguguagc

SEQ ID NO: 18889 - RNA, 22 nt, Homo sapiens
acuacaugugaugucaguauau

SEQ ID NO: 18890 - RNA, 18 nt, Homo sapiens
acucuguauguggagugg

SEQ ID NO: 18891 - RNA, 23 nt, Homo sapiens
acugagcaauguuuacauacuug

SEQ ID NO: 18892 - RNA, 22 nt, Homo sapiens
acugcacuccaaccuguugggc

SEQ ID NO: 18893 - RNA, 22 nt, Homo sapiens
acugcacuccacccuuggcagc

SEQ ID NO: 18894 - RNA, 18 nt, Homo sapiens
acugcacuccaccuuggg

SEQ ID NO: 18895 - RNA, 22 nt, Homo sapiens
acugcacuccagacucugucuc

SEQ ID NO: 18896 - RNA, 22 nt, Homo sapiens
acugcacuccagccugcccaac

SEQ ID NO: 18897 - RNA, 22 nt, Homo sapiens
acugcacuccagccuuggcggc

SEQ ID NO: 18898 - RNA, 22 nt, Homo sapiens
acugcacuccagcuuuggugac

SEQ ID NO: 18899 - RNA, 18 nt, Homo sapiens
acugcacuccauccuagg

SEQ ID NO: 18900 - RNA, 22 nt, Homo sapiens
acugcacucuagccuuggcaac

SEQ ID NO: 18901 - RNA, 22 nt, Homo sapiens
acugcacugcagccuggccaac

SEQ ID NO: 18902 - RNA, 22 nt, Homo sapiens
acugcacuuauccuccaauguu

SEQ ID NO: 18903 - RNA, 22 nt, Homo sapiens
acugcacuucagccuuggggac

SEQ ID NO: 18904 - RNA, 22 nt, Homo sapiens
acuggaguuuguucaagaaaua

SEQ ID NO: 18905 - RNA, 20 nt, Homo sapiens
acuggcacugguaggugugg

SEQ ID NO: 18906 - RNA, 22 nt, Homo sapiens
acuggcuuuugagaaaaacacu

SEQ ID NO: 18907 - RNA, 22 nt, Homo sapiens
acugggauauuauugguaauau

SEQ ID NO: 18908 - RNA, 22 nt, Homo sapiens
acuguacucuacccugggcaac

SEQ ID NO: 18909 - RNA, 22 nt, Homo sapiens
acuuuuugauggggagaacauu

SEQ ID NO: 18910 - RNA, 22 nt, Homo sapiens
acuuuuugcaaccauuuggacc

SEQ ID NO: 18911 - RNA, 22 nt, Homo sapiens
agaaacacagguggaauugcuu

SEQ ID NO: 18912 - RNA, 22 nt, Homo sapiens
agaaugugaacaucuugaaagu

SEQ ID NO: 18913 - RNA, 22 nt, Homo sapiens
agacacugaaauguauugaaga

SEQ ID NO: 18914 - RNA, 21 nt, Homo sapiens
agacacuuggaagguuuuaga

SEQ ID NO: 18915 - RNA, 22 nt, Homo sapiens
agacagcugggaaauggagugu

SEQ ID NO: 18916 - RNA, 20 nt, Homo sapiens
agacaguguggagauuccuu

SEQ ID NO: 18917 - RNA, 22 nt, Homo sapiens
ucccagugcuaugcaaaagccu

SEQ ID NO: 18918 - RNA, 17 nt, Homo sapiens
ucccauguuucuucuac

SEQ ID NO: 18919 - RNA, 22 nt, Homo sapiens
ucccauugucucugaccuugcc

SEQ ID NO: 18920 - RNA, 23 nt, Homo sapiens
uccccgggagcaccagcuuguug

SEQ ID NO: 18921 - RNA, 22 nt, Homo sapiens
uccccugagaccccucagcacu

SEQ ID NO: 18922 - RNA, 20 nt, Homo sapiens
ucccuaagagccuuuccuuc

SEQ ID NO: 18923 - RNA, 22 nt, Homo sapiens
ucccugaaaauuagcauuuuaa

SEQ ID NO: 18924 - RNA, 22 nt, Homo sapiens
ucccugaagcugcagcaacaca

SEQ ID NO: 18925 - RNA, 18 nt, Homo sapiens
ucccugacucaaauucuu

SEQ ID NO: 18926 - RNA, 22 nt, Homo sapiens
ucccugagcaaaguuuucugua

SEQ ID NO: 18927 - RNA, 19 nt, Homo sapiens
ucccugagucuuagcuuga

SEQ ID NO: 18928 - RNA, 22 nt, Homo sapiens
ucccuguguuccuuuugaauug

SEQ ID NO: 18929 - RNA, 18 nt, Homo sapiens
ucccuuuguagaugaccc

SEQ ID NO: 18930 - RNA, 19 nt, Homo sapiens
ucccuuuguauggacauac

SEQ ID NO: 18931 - RNA, 22 nt, Homo sapiens
uccugagucagcauccguuugu

SEQ ID NO: 18932 - RNA, 22 nt, Homo sapiens
uccugcauucauccugguguug

SEQ ID NO: 18933 - RNA, 22 nt, Homo sapiens
uccuucacucuacaucuuuguu

SEQ ID NO: 18934 - RNA, 22 nt, Homo sapiens
uccuucauuugucaacucuagu

SEQ ID NO: 18935 - RNA, 22 nt, Homo sapiens
ucgugccacugcacuccagccu

SEQ ID NO: 18936 - RNA, 22 nt, Homo sapiens
ucuaaaguacuacuacuguugg

SEQ ID NO: 18937 - RNA, 17 nt, Homo sapiens
ucuaauaauaugcauuu

SEQ ID NO: 18938 - RNA, 22 nt, Homo sapiens
ucuauuugggguaccuguggua

SEQ ID NO: 18939 - RNA, 22 nt, Homo sapiens
ucucacagaguugaauguuucu

SEQ ID NO: 18940 - RNA, 22 nt, Homo sapiens
ucucagcacagucagggcgccu

SEQ ID NO: 18941 - RNA, 22 nt, Homo sapiens
ucucauagaggcagagaguaaa

SEQ ID NO: 18942 - RNA, 22 nt, Homo sapiens
ucucaugaagauagagaauaga

SEQ ID NO: 18943 - RNA, 22 nt, Homo sapiens
ucucauggcucacccugcauag

SEQ ID NO: 18944 - RNA, 22 nt, Homo sapiens
ucuccaguuuccuucgucuauc

SEQ ID NO: 18945 - RNA, 20 nt, Homo sapiens
ucucccaaacagcaggcccu

SEQ ID NO: 18946 - RNA, 22 nt, Homo sapiens
ucucccauccguacacggauug

SEQ ID NO: 18947 - RNA, 22 nt, Homo sapiens
ucucugaaacucuugacauccu

SEQ ID NO: 18948 - RNA, 22 nt, Homo sapiens
ucucugacacugaccccaaaaa

SEQ ID NO: 18949 - RNA, 22 nt, Homo sapiens
ucucugagaccacuccaaacuc

SEQ ID NO: 18950 - RNA, 22 nt, Homo sapiens
ucucugguuuucaaagcaguau

SEQ ID NO: 18951 - RNA, 22 nt, Homo sapiens
ucucuguuuauuuuugguguau

SEQ ID NO: 18952 - RNA, 22 nt, Homo sapiens
ucucuguuugucuguuacuggu

SEQ ID NO: 18953 - RNA, 22 nt, Homo sapiens
ucugacucuggagucucagguu

SEQ ID NO: 18954 - RNA, 22 nt, Homo sapiens
ucugagacuguuucuaacaagc

SEQ ID NO: 18955 - RNA, 22 nt, Homo sapiens
ucugagaugagacuuugaauuu

SEQ ID NO: 18956 - RNA, 22 nt, Homo sapiens
ucugagcaauagauguggauau

SEQ ID NO: 18957 - RNA, 22 nt, Homo sapiens
ucugagguuacugcuuuguaga

SEQ ID NO: 18958 - RNA, 22 nt, Homo sapiens
ucugcaagucuaaacuagccau

SEQ ID NO: 18959 - RNA, 22 nt, Homo sapiens
ucugccacugucauugugugau

SEQ ID NO: 18960 - RNA, 22 nt, Homo sapiens
ucuggagugugaaguggauaug

SEQ ID NO: 18961 - RNA, 21 nt, Homo sapiens
ucuggcccccucaaaucucau

SEQ ID NO: 18962 - RNA, 22 nt, Homo sapiens
ucuggcuuucuuuacuuaaugu

SEQ ID NO: 18963 - RNA, 22 nt, Homo sapiens
ucuggcuuuuaacaucuauaaa

SEQ ID NO: 18964 - RNA, 22 nt, Homo sapiens
ucugggguuuccacuuuuacuu

SEQ ID NO: 18965 - RNA, 20 nt, Homo sapiens
ucuggguuuuggccacgccc

SEQ ID NO: 18966 - RNA, 23 nt, Homo sapiens
ucugguguugucaaaugcugguu

SEQ ID NO: 18967 - RNA, 22 nt, Homo sapiens
ucuguaacauccaccuucuggg

SEQ ID NO: 18968 - RNA, 22 nt, Homo sapiens
ucugucaaaucuuauguuguag

SEQ ID NO: 18969 - RNA, 22 nt, Homo sapiens
ucugugcauggcagaggaauga

SEQ ID NO: 18970 - RNA, 22 nt, Homo sapiens
ucugugcugagaguugaaaguu

SEQ ID NO: 18971 - RNA, 22 nt, Homo sapiens
ucuguggucagaguccuuggcc

SEQ ID NO: 18972 - RNA, 22 nt, Homo sapiens
ucuguggucagcauccgccacu

SEQ ID NO: 18973 - RNA, 18 nt, Homo sapiens
ucugugguguaaauacgu

SEQ ID NO: 18974 - RNA, 17 nt, Homo sapiens
ucuucuguuacuguggc

SEQ ID NO: 18975 - RNA, 19 nt, Homo sapiens
ucuuuagucacauuuuuau

SEQ ID NO: 18976 - RNA, 22 nt, Homo sapiens
ucuuuggcugugaagaauaaug

SEQ ID NO: 18977 - RNA, 22 nt, Homo sapiens
ucuuuguuuucugauccugaag

SEQ ID NO: 18978 - RNA, 22 nt, Homo sapiens
ucuuuugggccucuugucagac

SEQ ID NO: 18979 - RNA, 22 nt, Homo sapiens
ugaaacacaccuccucuccauc

SEQ ID NO: 18980 - RNA, 22 nt, Homo sapiens
ugaaagguauagguucuggagg

SEQ ID NO: 18981 - RNA, 20 nt, Homo sapiens
ugaaaucuucacuaagucuc

SEQ ID NO: 18982 - RNA, 22 nt, Homo sapiens
ugaaaugauuauaugguguuug

SEQ ID NO: 18983 - RNA, 22 nt, Homo sapiens
ugaacacagccugccucugcca

SEQ ID NO: 18984 - RNA, 22 nt, Homo sapiens
ugaacugagacuagacuuguuc

SEQ ID NO: 18985 - RNA, 22 nt, Homo sapiens
ugaagacucauacuugaaucag

SEQ ID NO: 18986 - RNA, 20 nt, Homo sapiens
ugaaggaggucauuuauacc

SEQ ID NO: 18987 - RNA, 22 nt, Homo sapiens
ugaaggaguauggauaagucgu

SEQ ID NO: 18988 - RNA, 22 nt, Homo sapiens
uuaauaccgucacauggcugaa

SEQ ID NO: 18989 - RNA, 22 nt, Homo sapiens
uuaauacucuucuaaguagucc

SEQ ID NO: 18990 - RNA, 22 nt, Homo sapiens
uuaaucaggccguuuccuaaga

SEQ ID NO: 18991 - RNA, 22 nt, Homo sapiens
uuaauguaauugauugauugac

SEQ ID NO: 18992 - RNA, 22 nt, Homo sapiens
uuaauguaucuaucacaucaca

SEQ ID NO: 18993 - RNA, 22 nt, Homo sapiens
uuaauucugucugcccucaucc

SEQ ID NO: 18994 - RNA, 22 nt, Homo sapiens
uuacaacugucuuacugguuau

SEQ ID NO: 18995 - RNA, 21 nt, Homo sapiens
uuacaauggcuccuugaaggu

SEQ ID NO: 18996 - RNA, 22 nt, Homo sapiens
uuacacaguugguaggggcaga

SEQ ID NO: 18997 - RNA, 22 nt, Homo sapiens
uuacagauggauggcagcuggc

SEQ ID NO: 18998 - RNA, 22 nt, Homo sapiens
uuacaguagaugaggguauaau

SEQ ID NO: 18999 - RNA, 22 nt, Homo sapiens
uuacagucuuaggcagugcuuu

SEQ ID NO: 19000 - RNA, 22 nt, Homo sapiens
uuaccagagaagacgaggggga

SEQ ID NO: 19001 - RNA, 22 nt, Homo sapiens
uuagaacaguguuugccucgcu

SEQ ID NO: 19002 - RNA, 22 nt, Homo sapiens
uuagaacuagaggaguuugagu

SEQ ID NO: 19003 - RNA, 22 nt, Homo sapiens
uuagacacacauacauuuaucu

SEQ ID NO: 19004 - RNA, 19 nt, Homo sapiens
uuagagaucaucugcuuca

SEQ ID NO: 19005 - RNA, 22 nt, Homo sapiens
uuagagcacugaucugcucuuu

SEQ ID NO: 19006 - RNA, 18 nt, Homo sapiens
uuagaugguuuuaaaacu

SEQ ID NO: 19007 - RNA, 22 nt, Homo sapiens
uuaggagacuggauaucucuuu

SEQ ID NO: 19008 - RNA, 22 nt, Homo sapiens
uuaggcaggauaguuacauauu

SEQ ID NO: 19009 - RNA, 22 nt, Homo sapiens
uuaguagagacgagcguuccac

SEQ ID NO: 19010 - RNA, 22 nt, Homo sapiens
uuagugcugaguggaauguucu

SEQ ID NO: 19011 - RNA, 22 nt, Homo sapiens
uuaguggaugcugaauaaagaa

SEQ ID NO: 19012 - RNA, 22 nt, Homo sapiens
uuauagcagugcaggaacagac

SEQ ID NO: 19013 - RNA, 20 nt, Homo sapiens
uuauagcuacaucuugacug

SEQ ID NO: 19014 - RNA, 22 nt, Homo sapiens
uuauggauuuauauucuguagu

SEQ ID NO: 19015 - RNA, 22 nt, Homo sapiens
uuauggcuauugaugacaauug

SEQ ID NO: 19016 - RNA, 23 nt, Homo sapiens
uuauggcuuuuauuauguugagg

SEQ ID NO: 19017 - RNA, 22 nt, Homo sapiens
uuaugucuuugagcaaugcugu

SEQ ID NO: 19018 - RNA, 22 nt, Homo sapiens
uuauugcacuccagccugggua

SEQ ID NO: 19019 - RNA, 22 nt, Homo sapiens
uuauuugguugcugacuuggaa

SEQ ID NO: 19020 - RNA, 22 nt, Homo sapiens
uucaaaucuuuggcucccacua

SEQ ID NO: 19021 - RNA, 22 nt, Homo sapiens
uucaacagugauggccuuugua

SEQ ID NO: 19022 - RNA, 22 nt, Homo sapiens
uucaagaauuaaaguggcuuuu

SEQ ID NO: 19023 - RNA, 22 nt, Homo sapiens
uucaagucaauuuuugaaugac

SEQ ID NO: 19024 - RNA, 22 nt, Homo sapiens
uucaagucuuggcuuugccacc

SEQ ID NO: 19025 - RNA, 22 nt, Homo sapiens
uucaauaugucauuggcaggca

SEQ ID NO: 19026 - RNA, 22 nt, Homo sapiens
uucacagugugaucuaugggca

SEQ ID NO: 19027 - RNA, 16 nt, Homo sapiens
uucacauggcagcagg

SEQ ID NO: 19028 - RNA, 22 nt, Homo sapiens
uucacaugguugccuuuugauc

SEQ ID NO: 19029 - RNA, 21 nt, Homo sapiens
uucaccauggcuccacacucu

SEQ ID NO: 19030 - RNA, 23 nt, Homo sapiens
uucaccguguuggccaggcuggu

SEQ ID NO: 19031 - RNA, 22 nt, Homo sapiens
uucacugcacuccagccugagc

SEQ ID NO: 19032 - RNA, 22 nt, Homo sapiens
uucacugcacuccagccugggu

SEQ ID NO: 19033 - RNA, 22 nt, Homo sapiens
uucacuguagccucagccucuu

SEQ ID NO: 19034 - RNA, 22 nt, Homo sapiens
uucacuguuaagcaguuaaacu

SEQ ID NO: 19035 - RNA, 22 nt, Homo sapiens
uucagcaggccaggcccugacu

SEQ ID NO: 19036 - RNA, 22 nt, Homo sapiens
uucagcaguggccaguggaaau

SEQ ID NO: 19037 - RNA, 22 nt, Homo sapiens
uucaggcaccauggucauugau

SEQ ID NO: 19038 - RNA, 22 nt, Homo sapiens
uucaggcaccauugucauugau

SEQ ID NO: 19039 - RNA, 22 nt, Homo sapiens
uucagggcauuggaguuucuga

SEQ ID NO: 19040 - RNA, 23 nt, Homo sapiens
uucaguauugaaugauggcgcug

SEQ ID NO: 19041 - RNA, 22 nt, Homo sapiens
uucaguccauuuccuuggucac

SEQ ID NO: 19042 - RNA, 22 nt, Homo sapiens
uucaguggguggaugaauauga

SEQ ID NO: 19043 - RNA, 19 nt, Homo sapiens
uucauacagugagagcagc

SEQ ID NO: 19044 - RNA, 22 nt, Homo sapiens
uucauaguaacaguaacuaugg

SEQ ID NO: 19045 - RNA, 22 nt, Homo sapiens
uucauaguguuuccuuccagug

SEQ ID NO: 19046 - RNA, 22 nt, Homo sapiens
uucaucagcuguagaugucaug

SEQ ID NO: 19047 - RNA, 22 nt, Homo sapiens
uucaucagggagaaauaauuuc

SEQ ID NO: 19048 - RNA, 22 nt, Homo sapiens
uucaucagggguauuggccaau

SEQ ID NO: 19049 - RNA, 22 nt, Homo sapiens
uucauggugguacaaaagcaau

SEQ ID NO: 19050 - RNA, 22 nt, Homo sapiens
uuccacagggauuugcauugau

SEQ ID NO: 19051 - RNA, 22 nt, Homo sapiens
uuccagagucaccuuucugucg

SEQ ID NO: 19052 - RNA, 20 nt, Homo sapiens
uuccagcacauuagggaagc

SEQ ID NO: 19053 - RNA, 22 nt, Homo sapiens
uuccaguggacuacuucauccu

SEQ ID NO: 19054 - RNA, 22 nt, Homo sapiens
uuccaguggaguaaauggacaa

SEQ ID NO: 19055 - RNA, 22 nt, Homo sapiens
uuccaguguguucauccucaga

SEQ ID NO: 19056 - RNA, 22 nt, Homo sapiens
uuccaguguuugacucaccuuu

SEQ ID NO: 19057 - RNA, 22 nt, Homo sapiens
uuccaguugugagcuauccggg

SEQ ID NO: 19058 - RNA, 22 nt, Homo sapiens
uucccaguaaacucuaucccuc

SEQ ID NO: 19059 - RNA, 22 nt, Homo sapiens
uucccagucaaacgaaggacuu

SEQ ID NO: 19060 - RNA, 22 nt, Homo sapiens
uucccaguuggggaaagcgacc

SEQ ID NO: 19061 - RNA, 22 nt, Homo sapiens
uucccugaaauauucacuuuca

SEQ ID NO: 19062 - RNA, 23 nt, Homo sapiens
uucccuuagaagaaggggagaaa

SEQ ID NO: 19063 - RNA, 22 nt, Homo sapiens
uucccuuugaaacuaaacuugc

SEQ ID NO: 19064 - RNA, 22 nt, Homo sapiens
uuccuacugcccauuaaaaugg

SEQ ID NO: 19065 - RNA, 22 nt, Homo sapiens
uuccuacugugcaaaguugcaa

SEQ ID NO: 19066 - RNA, 22 nt, Homo sapiens
uuccugagagggcugggugcag

SEQ ID NO: 19067 - RNA, 22 nt, Homo sapiens
uuccuugugacuaguagugacc

SEQ ID NO: 19068 - RNA, 20 nt, Homo sapiens
uucuacagucacaggaagau

SEQ ID NO: 19069 - RNA, 22 nt, Homo sapiens
uucuacagugacugcagccaua

SEQ ID NO: 19070 - RNA, 22 nt, Homo sapiens
uucuacaugggucgucggugag

SEQ ID NO: 19071 - RNA, 23 nt, Homo sapiens
uucuaucaggcccaggagcccug

SEQ ID NO: 19072 - RNA, 22 nt, Homo sapiens
uucucagugaacuccagcuugu

SEQ ID NO: 19073 - RNA, 22 nt, Homo sapiens
uucucaguuccuacuuugguga

SEQ ID NO: 19074 - RNA, 17 nt, Homo sapiens
uucucaguucugaucuc

SEQ ID NO: 19075 - RNA, 22 nt, Homo sapiens
uucucuguggauugggugagag

SEQ ID NO: 19076 - RNA, 22 nt, Homo sapiens
uucugugcugaaucaaagacug

SEQ ID NO: 19077 - RNA, 22 nt, Homo sapiens
uucugugguagaaaucucaaau

SEQ ID NO: 19078 - RNA, 22 nt, Homo sapiens
uucugugguugaaaggagagau

SEQ ID NO: 19079 - RNA, 22 nt, Homo sapiens
uucuuagucauguaauagucca

SEQ ID NO: 19080 - RNA, 22 nt, Homo sapiens
uucuugcuguauccucacaugg

SEQ ID NO: 19081 - RNA, 18 nt, Homo sapiens
uucuuguguugauauuuu

SEQ ID NO: 19082 - RNA, 21 nt, Homo sapiens
uucuuugcucaguguuagagu

SEQ ID NO: 19083 - RNA, 22 nt, Homo sapiens
uugaacuagaaccugcaaauuu

SEQ ID NO: 19084 - RNA, 22 nt, Homo sapiens
uugaacugguaguuggaaaucu

SEQ ID NO: 19085 - RNA, 22 nt, Homo sapiens
uugaagacuaccuaccauacuu

SEQ ID NO: 19086 - RNA, 22 nt, Homo sapiens
uugaagacuauaugauucuuca

SEQ ID NO: 19087 - RNA, 19 nt, Homo sapiens
uugaaggccgccuugcaga

SEQ ID NO: 19088 - RNA, 22 nt, Homo sapiens
uugaaguaguacuuuauuauag

SEQ ID NO: 19089 - RNA, 22 nt, Homo sapiens
uugaauagaagguuuuuuguuc

SEQ ID NO: 19090 - RNA, 22 nt, Homo sapiens
uugaauagugacuuugauucug

SEQ ID NO: 19091 - RNA, 18 nt, Homo sapiens
uugaauaguguccaaucu

SEQ ID NO: 19092 - RNA, 22 nt, Homo sapiens
uugacagagaaaagugugacuu

SEQ ID NO: 19093 - RNA, 22 nt, Homo sapiens
uugacaguggcuuaaauugguu

SEQ ID NO: 19094 - RNA, 22 nt, Homo sapiens
uugaccaaagaagagucauugc

SEQ ID NO: 19095 - RNA, 21 nt, Homo sapiens
uugagaagaauuagcucuucc

SEQ ID NO: 19096 - RNA, 22 nt, Homo sapiens
ugcugcuguuaucauuuuacca

SEQ ID NO: 19097 - RNA, 22 nt, Homo sapiens
ugcuggcguuacucuccaucag

SEQ ID NO: 19098 - RNA, 22 nt, Homo sapiens
ugcugguguuuaggaauaagaa

SEQ ID NO: 19099 - RNA, 22 nt, Homo sapiens
ugcuguguugcuggcuuaaaga

SEQ ID NO: 19100 - RNA, 22 nt, Homo sapiens
ugcuuaguuguauguuccacau

SEQ ID NO: 19101 - RNA, 20 nt, Homo sapiens
uggaaaguaagucaugauau

SEQ ID NO: 19102 - RNA, 22 nt, Homo sapiens
uggaaauaaaugugccaagauc

SEQ ID NO: 19103 - RNA, 22 nt, Homo sapiens
uggaacacauaaauagcauagu

SEQ ID NO: 19104 - RNA, 22 nt, Homo sapiens
uggaagauuacuuuuuguugaa

SEQ ID NO: 19105 - RNA, 22 nt, Homo sapiens
uggaagccuagauucuuuucuu

SEQ ID NO: 19106 - RNA, 22 nt, Homo sapiens
uggaaguaaucaugagguagca

SEQ ID NO: 19107 - RNA, 22 nt, Homo sapiens
uggaagucuauggcauuugagu

SEQ ID NO: 19108 - RNA, 22 nt, Homo sapiens
uggaauaucaugagaguuuguu

SEQ ID NO: 19109 - RNA, 19 nt, Homo sapiens
uggaaugaaauguuagggg

SEQ ID NO: 19110 - RNA, 22 nt, Homo sapiens
uggaaugcuaagcaugugggag

SEQ ID NO: 19111 - RNA, 22 nt, Homo sapiens
uggaauggagagagggugcacg

SEQ ID NO: 19112 - RNA, 19 nt, Homo sapiens
uggaauggauuuaaaugug

SEQ ID NO: 19113 - RNA, 22 nt, Homo sapiens
uggacuguaauagagaacagaa

SEQ ID NO: 19114 - RNA, 22 nt, Homo sapiens
uggacuguaauuuuauaggcau

SEQ ID NO: 19115 - RNA, 22 nt, Homo sapiens
uggagacaaagauagaaaagca

SEQ ID NO: 19116 - RNA, 22 nt, Homo sapiens
uggagagucauuuauaguauuu

SEQ ID NO: 19117 - RNA, 18 nt, Homo sapiens
uggagauaagaagaacuu

SEQ ID NO: 19118 - RNA, 22 nt, Homo sapiens
uggaggacugcagaacugaggc

SEQ ID NO: 19119 - RNA, 22 nt, Homo sapiens
uggagguagacauugggaagag

SEQ ID NO: 19120 - RNA, 22 nt, Homo sapiens
uggagucuugaugauuuucaaa

SEQ ID NO: 19121 - RNA, 22 nt, Homo sapiens
uggaguguguugcagaugaagg

SEQ ID NO: 19122 - RNA, 20 nt, Homo sapiens
uggaguuugaguucuuggag

SEQ ID NO: 19123 - RNA, 22 nt, Homo sapiens
uggaucuguucuauuuaucuga

SEQ ID NO: 19124 - RNA, 22 nt, Homo sapiens
uggaugacuguuauaugcauau

SEQ ID NO: 19125 - RNA, 22 nt, Homo sapiens
uggauggagaggcuugugaugc

SEQ ID NO: 19126 - RNA, 18 nt, Homo sapiens
uggauuggaaaaguuccu

SEQ ID NO: 19127 - RNA, 22 nt, Homo sapiens
uggcaaaaaaccgcaguugccu

SEQ ID NO: 19128 - RNA, 22 nt, Homo sapiens
uggcaaagugugacgugggggu

SEQ ID NO: 19129 - RNA, 22 nt, Homo sapiens
uggcaagagcaaaauguacagu

SEQ ID NO: 19130 - RNA, 22 nt, Homo sapiens
uggcaagagcugcauucaucug

SEQ ID NO: 19131 - RNA, 22 nt, Homo sapiens
uggcaagagggaugcaagguuu

SEQ ID NO: 19132 - RNA, 22 nt, Homo sapiens
uggcaagauuguuccgguuugg

SEQ ID NO: 19133 - RNA, 19 nt, Homo sapiens
uggcaaugucagcagagau

SEQ ID NO: 19134 - RNA, 22 nt, Homo sapiens
uggcaauguggaaugguccagg

SEQ ID NO: 19135 - RNA, 20 nt, Homo sapiens
uggcaccugacagauagcca

SEQ ID NO: 19136 - RNA, 22 nt, Homo sapiens
uggcaguuuacagcuuuaggag

SEQ ID NO: 19137 - RNA, 22 nt, Homo sapiens
uggcauggaguggauggcccca

SEQ ID NO: 19138 - RNA, 23 nt, Homo sapiens
uggcauuuuaguuagcuucagug

SEQ ID NO: 19139 - RNA, 22 nt, Homo sapiens
uggcauuuucucuguucuuaga

SEQ ID NO: 19140 - RNA, 22 nt, Homo sapiens
uggcauuuuguuuuagaauuag

SEQ ID NO: 19141 - RNA, 22 nt, Homo sapiens
uggcuacagaaaguacuaguga

SEQ ID NO: 19142 - RNA, 20 nt, Homo sapiens
uggcucuuugcugcuaaagu

SEQ ID NO: 19143 - RNA, 20 nt, Homo sapiens
uggcuucuuaauugcaggca

SEQ ID NO: 19144 - RNA, 22 nt, Homo sapiens
uggcuuucuggggcuucuguuc

SEQ ID NO: 19145 - RNA, 20 nt, Homo sapiens
ugggaacaugugguauaugg

SEQ ID NO: 19146 - RNA, 22 nt, Homo sapiens
ugggaagagggagcgauuuugg

SEQ ID NO: 19147 - RNA, 22 nt, Homo sapiens
ugggaagauucuguguuuuucc

SEQ ID NO: 19148 - RNA, 22 nt, Homo sapiens
ugggaauaugauacaggucuuu

SEQ ID NO: 19149 - RNA, 22 nt, Homo sapiens
ugggaugauguuaaacguacuc

SEQ ID NO: 19150 - RNA, 22 nt, Homo sapiens
ugggcagugggacagcuuugug

SEQ ID NO: 19151 - RNA, 22 nt, Homo sapiens
ugggcuagaugcuuugggguca

SEQ ID NO: 19152 - RNA, 22 nt, Homo sapiens
uggggcaaugaacauuuuugca

SEQ ID NO: 19153 - RNA, 22 nt, Homo sapiens
uggggucguaggugcccgccag

SEQ ID NO: 19154 - RNA, 23 nt, Homo sapiens
ugggucaguuuuucugacaucau

SEQ ID NO: 19155 - RNA, 23 nt, Homo sapiens
uggguucauucuugaagucagug

SEQ ID NO: 19156 - RNA, 22 nt, Homo sapiens
ugguaaaaugucauuuaccaga

SEQ ID NO: 19157 - RNA, 22 nt, Homo sapiens
ugguauguauacuagcgacacu

SEQ ID NO: 19158 - RNA, 19 nt, Homo sapiens
uggucaguucugggagcug

SEQ ID NO: 19159 - RNA, 22 nt, Homo sapiens
ugguccacuaacccucaguauc

SEQ ID NO: 19160 - RNA, 20 nt, Homo sapiens
ugguccccugagucuggcuu

SEQ ID NO: 19161 - RNA, 22 nt, Homo sapiens
uggucccucugaaaauugggug

SEQ ID NO: 19162 - RNA, 22 nt, Homo sapiens
uggucguggagucccuggcuuc

SEQ ID NO: 19163 - RNA, 22 nt, Homo sapiens
uggucuucuggccuccagaacc

SEQ ID NO: 19164 - RNA, 19 nt, Homo sapiens
uggugccuuguucuuggau

SEQ ID NO: 19165 - RNA, 22 nt, Homo sapiens
uggugcuuaaauaaggcuuuca

SEQ ID NO: 19166 - RNA, 22 nt, Homo sapiens
uguaaaaagcccagccgcugag

SEQ ID NO: 19167 - RNA, 22 nt, Homo sapiens
uguaaaucuauuuuuaguguuu

SEQ ID NO: 19168 - RNA, 22 nt, Homo sapiens
uguaagcauuauauaauuguug

SEQ ID NO: 19169 - RNA, 22 nt, Homo sapiens
uguaaugaucaaaucagaguaa

SEQ ID NO: 19170 - RNA, 22 nt, Homo sapiens
uguagcagccauaaacacagug

SEQ ID NO: 19171 - RNA, 22 nt, Homo sapiens
uguagguguacauacaugguua

SEQ ID NO: 19172 - RNA, 22 nt, Homo sapiens
uguaugagagugaaagcauuuc

SEQ ID NO: 19173 - RNA, 22 nt, Homo sapiens
uguauguugauguuauauucug

SEQ ID NO: 19174 - RNA, 22 nt, Homo sapiens
ugucaaaugcagugauauuuga

SEQ ID NO: 19175 - RNA, 22 nt, Homo sapiens
ugucaacauuuaucaaguuauu

SEQ ID NO: 19176 - RNA, 22 nt, Homo sapiens
ugucaagaaaucaaggugugag

SEQ ID NO: 19177 - RNA, 22 nt, Homo sapiens
ugucacugugcagucaugcauu

SEQ ID NO: 19178 - RNA, 22 nt, Homo sapiens
ugucaggaugcuccuuuuggcu

SEQ ID NO: 19179 - RNA, 22 nt, Homo sapiens
ugucauagauugcuuggaaaaa

SEQ ID NO: 19180 - RNA, 22 nt, Homo sapiens
ugucaucauuggaaucugccuc

SEQ ID NO: 19181 - RNA, 22 nt, Homo sapiens
ugucauguaaagaguaaauggu

SEQ ID NO: 19182 - RNA, 22 nt, Homo sapiens
ugucaugucuuuguguaucaau

SEQ ID NO: 19183 - RNA, 22 nt, Homo sapiens
ugucauguugguguacugcacc

SEQ ID NO: 19184 - RNA, 22 nt, Homo sapiens
ugucauucaggaaauucuaagu

SEQ ID NO: 19185 - RNA, 22 nt, Homo sapiens
uguccaaauugaaucaucuggu

SEQ ID NO: 19186 - RNA, 22 nt, Homo sapiens
ugucccugagccuggauuccug

SEQ ID NO: 19187 - RNA, 22 nt, Homo sapiens
ugucugagacuguuuuacuuuc

SEQ ID NO: 19188 - RNA, 22 nt, Homo sapiens
ugugaaauguuaucccgucgug

SEQ ID NO: 19189 - RNA, 22 nt, Homo sapiens
ugugaacacagaggcuauggca

SEQ ID NO: 19190 - RNA, 22 nt, Homo sapiens
ugugaacagaauuagucaccua

SEQ ID NO: 19191 - RNA, 21 nt, Homo sapiens
ugugaacauguuggguggcau

SEQ ID NO: 19192 - RNA, 22 nt, Homo sapiens
ugugaacauuuuguauauauua

SEQ ID NO: 19193 - RNA, 22 nt, Homo sapiens
ugugacagguagguaauuuuug

SEQ ID NO: 19194 - RNA, 22 nt, Homo sapiens
ugugacaguuaguuugguguua

SEQ ID NO: 19195 - RNA, 18 nt, Homo sapiens
ugugacauugagcauguc

SEQ ID NO: 19196 - RNA, 17 nt, Homo sapiens
ugugacccugggcuacc

SEQ ID NO: 19197 - RNA, 22 nt, Homo sapiens
ugugacugguugucccgcuuuc

SEQ ID NO: 19198 - RNA, 22 nt, Homo sapiens
ugugagacugguucugaaccca

SEQ ID NO: 19199 - RNA, 19 nt, Homo sapiens
ugugagcauuagcauuuag

SEQ ID NO: 19200 - RNA, 22 nt, Homo sapiens
ugugaguguguacuaguuauca

SEQ ID NO: 19201 - RNA, 22 nt, Homo sapiens
ugugaucauuucaggaauuuug

SEQ ID NO: 19202 - RNA, 22 nt, Homo sapiens
ugugcaaucagcuucauuacau

SEQ ID NO: 19203 - RNA, 22 nt, Homo sapiens
ugugcacaacaugcagguuugu

SEQ ID NO: 19204 - RNA, 22 nt, Homo sapiens
ugaaggcaggagggagaaaagu

SEQ ID NO: 19205 - RNA, 22 nt, Homo sapiens
ugaagggcauuguuuugccaaa

SEQ ID NO: 19206 - RNA, 22 nt, Homo sapiens
ugaagugcugugggccaggcgu

SEQ ID NO: 19207 - RNA, 22 nt, Homo sapiens
ugaauauguuaauuagcaucau

SEQ ID NO: 19208 - RNA, 22 nt, Homo sapiens
ugaaugcuucaugucugggcug

SEQ ID NO: 19209 - RNA, 22 nt, Homo sapiens
ugaaugguaaagaaaagcacug

SEQ ID NO: 19210 - RNA, 22 nt, Homo sapiens
ugaaugguaauuuaguaggcac

SEQ ID NO: 19211 - RNA, 22 nt, Homo sapiens
ugaaugguuuuuagagaacaau

SEQ ID NO: 19212 - RNA, 22 nt, Homo sapiens
ugacaaguaaacagucagcacc

SEQ ID NO: 19213 - RNA, 20 nt, Homo sapiens
ugacaagugagaauuauggg

SEQ ID NO: 19214 - RNA, 22 nt, Homo sapiens
ugacagcaucaggauuggagag

SEQ ID NO: 19215 - RNA, 22 nt, Homo sapiens
ugacagguugauaggugcagca

SEQ ID NO: 19216 - RNA, 22 nt, Homo sapiens
ugacagguuggaauuaugggag

SEQ ID NO: 19217 - RNA, 22 nt, Homo sapiens
ugacagugaauaagucucuuaa

SEQ ID NO: 19218 - RNA, 22 nt, Homo sapiens
ugacaguguccucauucccaac

SEQ ID NO: 19219 - RNA, 22 nt, Homo sapiens
ugacagugugagauccugucuc

SEQ ID NO: 19220 - RNA, 20 nt, Homo sapiens
ugacaucagcaauguaauaa

SEQ ID NO: 19221 - RNA, 19 nt, Homo sapiens
ugacaugaaacccaagauc

SEQ ID NO: 19222 - RNA, 22 nt, Homo sapiens
ugacauguccaggugguccugu

SEQ ID NO: 19223 - RNA, 21 nt, Homo sapiens
ugacauuauuucaugucagua

SEQ ID NO: 19224 - RNA, 22 nt, Homo sapiens
ugacuaaaacugaguuucauua

SEQ ID NO: 19225 - RNA, 22 nt, Homo sapiens
ugacuagacuugcaagguugca

SEQ ID NO: 19226 - RNA, 22 nt, Homo sapiens
ugacuaggaggcuggaggauga

SEQ ID NO: 19227 - RNA, 22 nt, Homo sapiens
ugacuagugcccuuugcugccu

SEQ ID NO: 19228 - RNA, 22 nt, Homo sapiens
ugacuauaggauaacaugcauu

SEQ ID NO: 19229 - RNA, 22 nt, Homo sapiens
ugacucaguuguuagucuucau

SEQ ID NO: 19230 - RNA, 22 nt, Homo sapiens
ugacuggaaacaguguuauuug

SEQ ID NO: 19231 - RNA, 22 nt, Homo sapiens
ugacugguguuuaaugagucaa

SEQ ID NO: 19232 - RNA, 22 nt, Homo sapiens
ugacuugauccauggggcucca

SEQ ID NO: 19233 - RNA, 22 nt, Homo sapiens
ugagaacaugcacuugagguug

SEQ ID NO: 19234 - RNA, 17 nt, Homo sapiens
ugagaacaugugguauu

SEQ ID NO: 19235 - RNA, 22 nt, Homo sapiens
ugagaacucaugaaucuuucca

SEQ ID NO: 19236 - RNA, 22 nt, Homo sapiens
ugagaacuuauggugauuuuuu

SEQ ID NO: 19237 - RNA, 22 nt, Homo sapiens
ugagaauauuuuccaugucuca

SEQ ID NO: 19238 - RNA, 21 nt, Homo sapiens
ugagacaauccuggucaauau

SEQ ID NO: 19239 - RNA, 22 nt, Homo sapiens
ugagacgaagucuugcucuguu

SEQ ID NO: 19240 - RNA, 22 nt, Homo sapiens
ugagacggagucucgcucuguc

SEQ ID NO: 19241 - RNA, 22 nt, Homo sapiens
ugagacugagucucgcucuauu

SEQ ID NO: 19242 - RNA, 22 nt, Homo sapiens
ugagacugagucuugcucuauu

SEQ ID NO: 19243 - RNA, 22 nt, Homo sapiens
ugagacugaguuuccaucuugu

SEQ ID NO: 19244 - RNA, 22 nt, Homo sapiens
ugagacugaguuuugcucuugu

SEQ ID NO: 19245 - RNA, 22 nt, Homo sapiens
ugagacuguuuuggggaacuuc

SEQ ID NO: 19246 - RNA, 22 nt, Homo sapiens
ugagaguagggguugggauugg

SEQ ID NO: 19247 - RNA, 22 nt, Homo sapiens
ugagauaaggaaauugaggcuc

SEQ ID NO: 19248 - RNA, 22 nt, Homo sapiens
ugagauaauuuacuuguugagg

SEQ ID NO: 19249 - RNA, 22 nt, Homo sapiens
ugagauagcauaagggacagaa

SEQ ID NO: 19250 - RNA, 22 nt, Homo sapiens
ugagauauugggaguaauguca

SEQ ID NO: 19251 - RNA, 22 nt, Homo sapiens
ugagaucaaggugggcccuggg

SEQ ID NO: 19252 - RNA, 22 nt, Homo sapiens
ugagaucaagguuaauauaauc

SEQ ID NO: 19253 - RNA, 22 nt, Homo sapiens
ugagaucaugucauuugcacuc

SEQ ID NO: 19254 - RNA, 22 nt, Homo sapiens
ugagaucuuugcuguccucacc

SEQ ID NO: 19255 - RNA, 22 nt, Homo sapiens
ugagaugaaagcagaaagacuu

SEQ ID NO: 19256 - RNA, 19 nt, Homo sapiens
ugagaugaagacagggguu

SEQ ID NO: 19257 - RNA, 22 nt, Homo sapiens
ugagaugaagugauguaaaaca

SEQ ID NO: 19258 - RNA, 22 nt, Homo sapiens
ugagaugacgacacaccucagu

SEQ ID NO: 19259 - RNA, 22 nt, Homo sapiens
ugagaugaggucucgcucuguc

SEQ ID NO: 19260 - RNA, 22 nt, Homo sapiens
ugagaugaguucucgcucuguc

SEQ ID NO: 19261 - RNA, 22 nt, Homo sapiens
ugagaugauaucuuauuguaau

SEQ ID NO: 19262 - RNA, 22 nt, Homo sapiens
ugagaugaucaaaguauaggcu

SEQ ID NO: 19263 - RNA, 21 nt, Homo sapiens
ugagaugauccugcaugcaug

SEQ ID NO: 19264 - RNA, 22 nt, Homo sapiens
ugagaugauuuaauggagccca

SEQ ID NO: 19265 - RNA, 22 nt, Homo sapiens
ugagaugcauauucuggcuccu

SEQ ID NO: 19266 - RNA, 22 nt, Homo sapiens
ugagaugcucgccggccagcau

SEQ ID NO: 19267 - RNA, 22 nt, Homo sapiens
ugagauggagucuugucgccua

SEQ ID NO: 19268 - RNA, 22 nt, Homo sapiens
ugagauguaaucucgcucuguc

SEQ ID NO: 19269 - RNA, 22 nt, Homo sapiens
ugagauguagauauggauuaga

SEQ ID NO: 19270 - RNA, 23 nt, Homo sapiens
ugagaugucugauugcgaggguc

SEQ ID NO: 19271 - RNA, 22 nt, Homo sapiens
ugagauguugcucugaaacaag

SEQ ID NO: 19272 - RNA, 22 nt, Homo sapiens
ugagauguuuagauuguugucu

SEQ ID NO: 19273 - RNA, 23 nt, Homo sapiens
ugagauuacccagaaagaguaua

SEQ ID NO: 19274 - RNA, 23 nt, Homo sapiens
ugagauuauaaucuuuuacuucu

SEQ ID NO: 19275 - RNA, 21 nt, Homo sapiens
ugagauuauauuaacauggua

SEQ ID NO: 19276 - RNA, 23 nt, Homo sapiens
ugagcaauauucuacuauugagu

SEQ ID NO: 19277 - RNA, 22 nt, Homo sapiens
ugagcuagagaguuuaguguca

SEQ ID NO: 19278 - RNA, 22 nt, Homo sapiens
ugagcuaggaucacaccugcau

SEQ ID NO: 19279 - RNA, 22 nt, Homo sapiens
ugagcuaggucuugcucuguca

SEQ ID NO: 19280 - RNA, 22 nt, Homo sapiens
ugaggagugagaaauugguuuc

SEQ ID NO: 19281 - RNA, 22 nt, Homo sapiens
ugaggaguguauuucauucgcu

SEQ ID NO: 19282 - RNA, 17 nt, Homo sapiens
ugagggaugccugguuc

SEQ ID NO: 19283 - RNA, 22 nt, Homo sapiens
ugagggaugccugguuuguuuu

SEQ ID NO: 19284 - RNA, 22 nt, Homo sapiens
ugagggaugcguacccuaugcc

SEQ ID NO: 19285 - RNA, 22 nt, Homo sapiens
ugagguagguaccauuaucacu

SEQ ID NO: 19286 - RNA, 22 nt, Homo sapiens
ugaggucacuuguuuuaugcuu

SEQ ID NO: 19287 - RNA, 22 nt, Homo sapiens
ugaguagaacuagucuagagcu

SEQ ID NO: 19288 - RNA, 22 nt, Homo sapiens
ugaguagaacuccuggagaugu

SEQ ID NO: 19289 - RNA, 22 nt, Homo sapiens
ugaguagcuaagacgauaggca

SEQ ID NO: 19290 - RNA, 22 nt, Homo sapiens
ugagucuguucucacauugcua

SEQ ID NO: 19291 - RNA, 22 nt, Homo sapiens
ugagugaacgcugagaccaaau

SEQ ID NO: 19292 - RNA, 22 nt, Homo sapiens
ugagugugaggaagaauuagaa

SEQ ID NO: 19293 - RNA, 22 nt, Homo sapiens
ugaguucuuccuaucucugccu

SEQ ID NO: 19294 - RNA, 23 nt, Homo sapiens
ugauaacagcauaugaagauucu

SEQ ID NO: 19295 - RNA, 22 nt, Homo sapiens
ugauaugucccucgacaucagg

SEQ ID NO: 19296 - RNA, 22 nt, Homo sapiens
ugauauguggauucagcucaaa

SEQ ID NO: 19297 - RNA, 20 nt, Homo sapiens
ugauauuucuggaaguggag

SEQ ID NO: 19298 - RNA, 22 nt, Homo sapiens
ugaucucagcucacugguugaa

SEQ ID NO: 19299 - RNA, 22 nt, Homo sapiens
ugaucucauuagcaccuuuagc

SEQ ID NO: 19300 - RNA, 22 nt, Homo sapiens
ugaucuguguaacauaggaguc

SEQ ID NO: 19301 - RNA, 20 nt, Homo sapiens
ugaugcaaaucuuuaaaagu

SEQ ID NO: 19302 - RNA, 21 nt, Homo sapiens
ugaugcuuuucuuaaccuugc

SEQ ID NO: 19303 - RNA, 22 nt, Homo sapiens
ugauggcaauggcauucauuuu

SEQ ID NO: 19304 - RNA, 22 nt, Homo sapiens
ugauugacauacauaggugugg

SEQ ID NO: 19305 - RNA, 20 nt, Homo sapiens
ugauugaccagagcaguuuu

SEQ ID NO: 19306 - RNA, 18 nt, Homo sapiens
ugcaaacauguguguguu

SEQ ID NO: 19307 - RNA, 22 nt, Homo sapiens
ugcaaagaaauuuuggugacca

SEQ ID NO: 19308 - RNA, 22 nt, Homo sapiens
ugcaaaugcugcuauuucucuu

SEQ ID NO: 19309 - RNA, 22 nt, Homo sapiens
ugcaauauccucuacuauaggu

SEQ ID NO: 19310 - RNA, 22 nt, Homo sapiens
ugcaaucauuuggaggagaaga

SEQ ID NO: 19311 - RNA, 19 nt, Homo sapiens
ugcagcaauguaaaagaca

SEQ ID NO: 19312 - RNA, 22 nt, Homo sapiens
uugagaaucuuucgaauguucu

SEQ ID NO: 19313 - RNA, 22 nt, Homo sapiens
uugagacggagucuugcucuuu

SEQ ID NO: 19314 - RNA, 22 nt, Homo sapiens
uugagacugaacauuuguguac

SEQ ID NO: 19315 - RNA, 22 nt, Homo sapiens
uugagauaggaacucacuaugc

SEQ ID NO: 19316 - RNA, 22 nt, Homo sapiens
uugagaugauggauaugcuaau

SEQ ID NO: 19317 - RNA, 22 nt, Homo sapiens
uugagauggagucucgcugugu

SEQ ID NO: 19318 - RNA, 22 nt, Homo sapiens
uugagauggaguuucaauauug

SEQ ID NO: 19319 - RNA, 22 nt, Homo sapiens
uugagauggauagacauagcau

SEQ ID NO: 19320 - RNA, 22 nt, Homo sapiens
uugagauggugccacuguacuc

SEQ ID NO: 19321 - RNA, 22 nt, Homo sapiens
uugagcaaugucacugaggcuu

SEQ ID NO: 19322 - RNA, 22 nt, Homo sapiens
uugagcacaggaguuuugagac

SEQ ID NO: 19323 - RNA, 22 nt, Homo sapiens
uugagcaucauguuagcacuca

SEQ ID NO: 19324 - RNA, 22 nt, Homo sapiens
uugagcuaugaguuaauaggac

SEQ ID NO: 19325 - RNA, 22 nt, Homo sapiens
uugagcucaucuucagggguga

SEQ ID NO: 19326 - RNA, 22 nt, Homo sapiens
uugagcuuuuuacuuguccaau

SEQ ID NO: 19327 - RNA, 22 nt, Homo sapiens
uugaggaucauuguuuucggag

SEQ ID NO: 19328 - RNA, 22 nt, Homo sapiens
uugaggcaaugaggagaagcug

SEQ ID NO: 19329 - RNA, 22 nt, Homo sapiens
uugagggagcacagauucuuau

SEQ ID NO: 19330 - RNA, 22 nt, Homo sapiens
uugagggagccuguuagucccg

SEQ ID NO: 19331 - RNA, 22 nt, Homo sapiens
uugagguaauaaacagccauuc

SEQ ID NO: 19332 - RNA, 22 nt, Homo sapiens
uugaggugaagggcagagcagc

SEQ ID NO: 19333 - RNA, 22 nt, Homo sapiens
uugaguaguaagugguucaccg

SEQ ID NO: 19334 - RNA, 22 nt, Homo sapiens
uugaguccauucgaugcugauu

SEQ ID NO: 19335 - RNA, 22 nt, Homo sapiens
uugauaauguuaacuuugguca

SEQ ID NO: 19336 - RNA, 22 nt, Homo sapiens
uugauagacacauauccaugug

SEQ ID NO: 19337 - RNA, 22 nt, Homo sapiens
uugauagaucagggauuugauu

SEQ ID NO: 19338 - RNA, 22 nt, Homo sapiens
uugauauguuguuagauucagu

SEQ ID NO: 19339 - RNA, 22 nt, Homo sapiens
uugaucacuguacuaugacuau

SEQ ID NO: 19340 - RNA, 22 nt, Homo sapiens
uugaucugugucccugcccaau

SEQ ID NO: 19341 - RNA, 22 nt, Homo sapiens
uugaugauguuucugccuugcc

SEQ ID NO: 19342 - RNA, 22 nt, Homo sapiens
uugauguguuuccaggauuugu

SEQ ID NO: 19343 - RNA, 22 nt, Homo sapiens
uugcaaaguugccaaggaagga

SEQ ID NO: 19344 - RNA, 22 nt, Homo sapiens
uugcaagaaaucagagccuucc

SEQ ID NO: 19345 - RNA, 22 nt, Homo sapiens
uugcaagauguucaugggcugu

SEQ ID NO: 19346 - RNA, 22 nt, Homo sapiens
uugcacagugcuuucuuugccc

SEQ ID NO: 19347 - RNA, 22 nt, Homo sapiens
uugcacagugguuuagagccug

SEQ ID NO: 19348 - RNA, 22 nt, Homo sapiens
uugcacauggcaggugcucaau

SEQ ID NO: 19349 - RNA, 22 nt, Homo sapiens
uugcacauugauuuuguauccu

SEQ ID NO: 19350 - RNA, 22 nt, Homo sapiens
uugcacuccagccuggaugaca

SEQ ID NO: 19351 - RNA, 22 nt, Homo sapiens
uugcagugguuucacuggcaaa

SEQ ID NO: 19352 - RNA, 22 nt, Homo sapiens
uugccauagugcugccagauau

SEQ ID NO: 19353 - RNA, 22 nt, Homo sapiens
uugcuaagucaagagaaaugau

SEQ ID NO: 19354 - RNA, 22 nt, Homo sapiens
uuggaaauauguuaagugucau

SEQ ID NO: 19355 - RNA, 22 nt, Homo sapiens
uuggaaauguguuugcauucag

SEQ ID NO: 19356 - RNA, 22 nt, Homo sapiens
uuggaauuaaccuggugcugga

SEQ ID NO: 19357 - RNA, 19 nt, Homo sapiens
uuggaauuuuagaguuuga

SEQ ID NO: 19358 - RNA, 22 nt, Homo sapiens
uuggauuauaaacugagauuug

SEQ ID NO: 19359 - RNA, 22 nt, Homo sapiens
uuggcaaauagguuuuauugca

SEQ ID NO: 19360 - RNA, 21 nt, Homo sapiens
uuggcacucuucucuccuuau

SEQ ID NO: 19361 - RNA, 22 nt, Homo sapiens
uuggcaguaucuacuacagcua

SEQ ID NO: 19362 - RNA, 22 nt, Homo sapiens
uuggcauagaggcucucaagcu

SEQ ID NO: 19363 - RNA, 22 nt, Homo sapiens
uuggcauugaguuucaaaucau

SEQ ID NO: 19364 - RNA, 22 nt, Homo sapiens
uuggccccucccaaauuucaug

SEQ ID NO: 19365 - RNA, 22 nt, Homo sapiens
uuggcccugcugaccauucccu

SEQ ID NO: 19366 - RNA, 23 nt, Homo sapiens
uuggccuccuugugucuagggcu

SEQ ID NO: 19367 - RNA, 22 nt, Homo sapiens
uuggcuaagaucacgugagaau

SEQ ID NO: 19368 - RNA, 22 nt, Homo sapiens
uuggcuacagauuaugaauuuc

SEQ ID NO: 19369 - RNA, 22 nt, Homo sapiens
uuggcuauagauacauggauua

SEQ ID NO: 19370 - RNA, 22 nt, Homo sapiens
uuggcucuggcugggcuccagc

SEQ ID NO: 19371 - RNA, 22 nt, Homo sapiens
uuggcuguguuuauaugcugga

SEQ ID NO: 19372 - RNA, 22 nt, Homo sapiens
uugggcaaguggcaugaccaug

SEQ ID NO: 19373 - RNA, 22 nt, Homo sapiens
uuggguccucugguccuugguu

SEQ ID NO: 19374 - RNA, 22 nt, Homo sapiens
uuggucagcucaauggagaggg

SEQ ID NO: 19375 - RNA, 22 nt, Homo sapiens
uuggucaggcuagaguguggug

SEQ ID NO: 19376 - RNA, 21 nt, Homo sapiens
uugguccacaugucauaguua

SEQ ID NO: 19377 - RNA, 22 nt, Homo sapiens
uuggucucuuaaucacacuuuu

SEQ ID NO: 19378 - RNA, 22 nt, Homo sapiens
uugguucaguuuaacgaguaau

SEQ ID NO: 19379 - RNA, 22 nt, Homo sapiens
uuguacaggaguguaagcuuca

SEQ ID NO: 19380 - RNA, 22 nt, Homo sapiens
uuguacuauuuuuaucagugau

SEQ ID NO: 19381 - RNA, 22 nt, Homo sapiens
uuguacuucagacaugccaaag

SEQ ID NO: 19382 - RNA, 22 nt, Homo sapiens
uuguagaucuucaguugcuaca

SEQ ID NO: 19383 - RNA, 22 nt, Homo sapiens
uuguaguagucucguucuuuua

SEQ ID NO: 19384 - RNA, 22 nt, Homo sapiens
uuguauugucuugaugaguuga

SEQ ID NO: 19385 - RNA, 22 nt, Homo sapiens
uugucacccuacauaacaggga

SEQ ID NO: 19386 - RNA, 16 nt, Homo sapiens
uugucccuucccaaau

SEQ ID NO: 19387 - RNA, 22 nt, Homo sapiens
uuguccuccacauuugaucagu

SEQ ID NO: 19388 - RNA, 22 nt, Homo sapiens
uuguccucuccaaaucucaugu

SEQ ID NO: 19389 - RNA, 22 nt, Homo sapiens
uugucuccuagacgaccaggcg

SEQ ID NO: 19390 - RNA, 19 nt, Homo sapiens
uugucuuagaguugucauu

SEQ ID NO: 19391 - RNA, 22 nt, Homo sapiens
uugugaaaaaccucucguggaa

SEQ ID NO: 19392 - RNA, 22 nt, Homo sapiens
uugugaaaucuaggcagagguu

SEQ ID NO: 19393 - RNA, 22 nt, Homo sapiens
uugugaucuucagaaaguggcu

SEQ ID NO: 19394 - RNA, 22 nt, Homo sapiens
uugugcauguauauuaguucac

SEQ ID NO: 19395 - RNA, 22 nt, Homo sapiens
uugugcuuaauaaaaaguggua

SEQ ID NO: 19396 - RNA, 22 nt, Homo sapiens
uugugcuuaaugaguguaaggu

SEQ ID NO: 19397 - RNA, 22 nt, Homo sapiens
uugugcuucaucaccuagcaga

SEQ ID NO: 19398 - RNA, 22 nt, Homo sapiens
uuguggcuuaucucauuuagcg

SEQ ID NO: 19399 - RNA, 22 nt, Homo sapiens
uuguguccccacccaaaucuca

SEQ ID NO: 19400 - RNA, 22 nt, Homo sapiens
uuguucaggagguuggggaugc

SEQ ID NO: 19401 - RNA, 22 nt, Homo sapiens
uuuaacauuggaugagaucguc

SEQ ID NO: 19402 - RNA, 22 nt, Homo sapiens
uuuagcaaugcuguggggaagu

SEQ ID NO: 19403 - RNA, 22 nt, Homo sapiens
uuuagcaauucauuuugugucu

SEQ ID NO: 19404 - RNA, 22 nt, Homo sapiens
uuuauggagagauauuuauggu

SEQ ID NO: 19405 - RNA, 18 nt, Homo sapiens
uuucaagucuuaggugac

SEQ ID NO: 19406 - RNA, 23 nt, Homo sapiens
uuucacagaaggauuguagggcc

SEQ ID NO: 19407 - RNA, 22 nt, Homo sapiens
uuucacaguguucucccccaga

SEQ ID NO: 19408 - RNA, 22 nt, Homo sapiens
uuucaccguguuggccaggcug

SEQ ID NO: 19409 - RNA, 18 nt, Homo sapiens
uuucaggguggacaugag

SEQ ID NO: 19410 - RNA, 22 nt, Homo sapiens
uuucaguagagacacgguuuug

SEQ ID NO: 19411 - RNA, 16 nt, Homo sapiens
uuucaucaguuuuaau

SEQ ID NO: 19412 - RNA, 22 nt, Homo sapiens
uuucauggacgcaaugccuuuu

SEQ ID NO: 19413 - RNA, 22 nt, Homo sapiens
uuucccauuguucugcucugug

SEQ ID NO: 19414 - RNA, 19 nt, Homo sapiens
uuucccugcagaccuacua

SEQ ID NO: 19415 - RNA, 22 nt, Homo sapiens
uuuccuggagaaucuuaacaaa

SEQ ID NO: 19416 - RNA, 21 nt, Homo sapiens
uuuccuggagcguauggcuuc

SEQ ID NO: 19417 - RNA, 22 nt, Homo sapiens
uuuccuguaggaaggaaauaga

SEQ ID NO: 19418 - RNA, 22 nt, Homo sapiens
uuucuuggagcucuuagggucg

SEQ ID NO: 19419 - RNA, 23 nt, Homo sapiens
uuucuugggcaugcuaugucagu

SEQ ID NO: 19420 - RNA, 22 nt, Homo sapiens
ugugcacaaugugcagguuuga

SEQ ID NO: 19421 - RNA, 22 nt, Homo sapiens
ugugcacaaugugcagguuugu

SEQ ID NO: 19422 - RNA, 22 nt, Homo sapiens
ugugcacaugauauaucacaua

SEQ ID NO: 19423 - RNA, 22 nt, Homo sapiens
ugugcaccucuucacacaggga

SEQ ID NO: 19424 - RNA, 22 nt, Homo sapiens
ugugcacuggaccuugucuucu

SEQ ID NO: 19425 - RNA, 22 nt, Homo sapiens
ugugccacuccagcucuagcuu

SEQ ID NO: 19426 - RNA, 22 nt, Homo sapiens
ugugccacugcacuccugccug

SEQ ID NO: 19427 - RNA, 22 nt, Homo sapiens
ugugccacuguucuguaaagug

SEQ ID NO: 19428 - RNA, 22 nt, Homo sapiens
ugugcgugugccuguaagaauu

SEQ ID NO: 19429 - RNA, 22 nt, Homo sapiens
ugugcuuguaaaggccagagca

SEQ ID NO: 19430 - RNA, 22 nt, Homo sapiens
uguggaguguaugugacagaga

SEQ ID NO: 19431 - RNA, 22 nt, Homo sapiens
uguguaauaccuuugacuauau

SEQ ID NO: 19432 - RNA, 22 nt, Homo sapiens
ugugucuuguuuauagcuuucu

SEQ ID NO: 19433 - RNA, 22 nt, Homo sapiens
uguuaacauggucucagucugu

SEQ ID NO: 19434 - RNA, 22 nt, Homo sapiens
uguuauuuuguguuagggcaca

SEQ ID NO: 19435 - RNA, 22 nt, Homo sapiens
uguucaugaguucucauuuuua

SEQ ID NO: 19436 - RNA, 22 nt, Homo sapiens
uguucuggagaggcaggccaca

SEQ ID NO: 19437 - RNA, 22 nt, Homo sapiens
uguucuggagaguuuagucugg

SEQ ID NO: 19438 - RNA, 22 nt, Homo sapiens
uguugcacuccagccuagguga

SEQ ID NO: 19439 - RNA, 22 nt, Homo sapiens
uguuugcuguuuucuccaauga

SEQ ID NO: 19440 - RNA, 22 nt, Homo sapiens
uguuugguggucucuucacaug

SEQ ID NO: 19441 - RNA, 22 nt, Homo sapiens
uguuuguuugagauggagucuc

SEQ ID NO: 19442 - RNA, 22 nt, Homo sapiens
uguuuguuugugauacgguaca

SEQ ID NO: 19443 - RNA, 22 nt, Homo sapiens
uuaaaguaauugaaauggccuu

SEQ ID NO: 19444 - RNA, 22 nt, Homo sapiens
uuaaaugcacauacuugagaaa

SEQ ID NO: 19445 - RNA, 22 nt, Homo sapiens
uuaagaagugauuuuccucauu

SEQ ID NO: 19446 - RNA, 22 nt, Homo sapiens
uuaagcaaagguaacaugagaa

SEQ ID NO: 19447 - RNA, 22 nt, Homo sapiens
uuaaggaaagcauuuaauucag

SEQ ID NO: 19448 - RNA, 19 nt, Homo sapiens
uuaagguacuuagaugugu

SEQ ID NO: 19449 - RNA, 22 nt, Homo sapiens
uuaaguuguagcuacaaauaca

SEQ ID NO: 19450 - RNA, 22 nt, Homo sapiens
uuaaucuguucucuguauucua

SEQ ID NO: 19451 - RNA, 22 nt, Homo sapiens
uuaaugaacuuuauuuuguaga

SEQ ID NO: 19452 - RNA, 21 nt, Homo sapiens
uuaaugcuaugcagaaaaucu

SEQ ID NO: 19453 - RNA, 22 nt, Homo sapiens
uuacagauggcacacucaaggg

SEQ ID NO: 19454 - RNA, 22 nt, Homo sapiens
uuacaguguuuguucuguuacu

SEQ ID NO: 19455 - RNA, 21 nt, Homo sapiens
uuacaguugguugugaggugg

SEQ ID NO: 19456 - RNA, 19 nt, Homo sapiens
uuacauccauugcauuuca

SEQ ID NO: 19457 - RNA, 22 nt, Homo sapiens
uuacauguuguggguuguggcc

SEQ ID NO: 19458 - RNA, 22 nt, Homo sapiens
uuacuacucucuaugaccaguu

SEQ ID NO: 19459 - RNA, 22 nt, Homo sapiens
uuagcaauugauucucauaagc

SEQ ID NO: 19460 - RNA, 22 nt, Homo sapiens
uuagcacaguucauucauguua

SEQ ID NO: 19461 - RNA, 22 nt, Homo sapiens
uuaggcaguuuauugauuuuca

SEQ ID NO: 19462 - RNA, 22 nt, Homo sapiens
uuagguagucucugucagaggg

SEQ ID NO: 19463 - RNA, 22 nt, Homo sapiens
uuagguauuuuguuaugucagc

SEQ ID NO: 19464 - RNA, 22 nt, Homo sapiens
uuaguagcacagaguaucagca

SEQ ID NO: 19465 - RNA, 22 nt, Homo sapiens
uuaguaguugugauagguaccu

SEQ ID NO: 19466 - RNA, 22 nt, Homo sapiens
uuaguaguuugauaggaauagc

SEQ ID NO: 19467 - RNA, 22 nt, Homo sapiens
uuagugcuuacgaugagcuaag

SEQ ID NO: 19468 - RNA, 22 nt, Homo sapiens
uuauaaacaugaagauuugggg

SEQ ID NO: 19469 - RNA, 22 nt, Homo sapiens
uuauaacagagacuccugugcu

SEQ ID NO: 19470 - RNA, 22 nt, Homo sapiens
uuauacacugugggaguguaaa

SEQ ID NO: 19471 - RNA, 22 nt, Homo sapiens
uuaucucagugaacugagugga

SEQ ID NO: 19472 - RNA, 17 nt, Homo sapiens
uuaugagacuucuuagc

SEQ ID NO: 19473 - RNA, 22 nt, Homo sapiens
uuaugcuguuuucuggagauuu

SEQ ID NO: 19474 - RNA, 22 nt, Homo sapiens
uuaugugccuuuuugccauuca

SEQ ID NO: 19475 - RNA, 22 nt, Homo sapiens
uuauguguuuaauguuucugaa

SEQ ID NO: 19476 - RNA, 22 nt, Homo sapiens
uuauucauuaacagggaccaaa

SEQ ID NO: 19477 - RNA, 16 nt, Homo sapiens
uuauugcauucuucuc

SEQ ID NO: 19478 - RNA, 22 nt, Homo sapiens
uucaaauguucuuucaccaccc

SEQ ID NO: 19479 - RNA, 22 nt, Homo sapiens
uucaaguaagaaagacaucagg

SEQ ID NO: 19480 - RNA, 22 nt, Homo sapiens
uucaagugaacaaaaugaggag

SEQ ID NO: 19481 - RNA, 22 nt, Homo sapiens
uucacaauuaaaugugguuauu

SEQ ID NO: 19482 - RNA, 22 nt, Homo sapiens
uucacacuagccacucugguag

SEQ ID NO: 19483 - RNA, 22 nt, Homo sapiens
uucacagcuuaauaaggcucag

SEQ ID NO: 19484 - RNA, 20 nt, Homo sapiens
uucacaggcagcuucuuucu

SEQ ID NO: 19485 - RNA, 22 nt, Homo sapiens
uucacaugacagggugaagcau

SEQ ID NO: 19486 - RNA, 22 nt, Homo sapiens
uucaccuugggucccacuugcu

SEQ ID NO: 19487 - RNA, 22 nt, Homo sapiens
uucacugcaugaaaaggacagc

SEQ ID NO: 19488 - RNA, 22 nt, Homo sapiens
uucacugcauuucagccugggc

SEQ ID NO: 19489 - RNA, 22 nt, Homo sapiens
uucacugugcuuaaauucugcu

SEQ ID NO: 19490 - RNA, 22 nt, Homo sapiens
uucagauugcauaccgaaagua

SEQ ID NO: 19491 - RNA, 20 nt, Homo sapiens
uucagcaaaggaaugggagu

SEQ ID NO: 19492 - RNA, 22 nt, Homo sapiens
uucagcacaguguggaucauuc

SEQ ID NO: 19493 - RNA, 22 nt, Homo sapiens
uucagggacuuuagacaagaga

SEQ ID NO: 19494 - RNA, 22 nt, Homo sapiens
uucagggagaaggcaaacguug

SEQ ID NO: 19495 - RNA, 18 nt, Homo sapiens
uucagugaauucuuuuga

SEQ ID NO: 19496 - RNA, 22 nt, Homo sapiens
uucaguggacuuaguagugcuu

SEQ ID NO: 19497 - RNA, 22 nt, Homo sapiens
uucaguggagaggcugaguggu

SEQ ID NO: 19498 - RNA, 22 nt, Homo sapiens
uucagugguuauuugugagauu

SEQ ID NO: 19499 - RNA, 22 nt, Homo sapiens
uucaguugcaucaguugaccag

SEQ ID NO: 19500 - RNA, 22 nt, Homo sapiens
uucauagaggacauuacuggag

SEQ ID NO: 19501 - RNA, 22 nt, Homo sapiens
uucauaguauuuuucuccaaau

SEQ ID NO: 19502 - RNA, 22 nt, Homo sapiens
uucauagucuaauuuuuuccac

SEQ ID NO: 19503 - RNA, 22 nt, Homo sapiens
uucauggaauauugaccauuuu

SEQ ID NO: 19504 - RNA, 22 nt, Homo sapiens
uucauggaguugagaaggcuaa

SEQ ID NO: 19505 - RNA, 22 nt, Homo sapiens
uucauggauggaaaugauuuug

SEQ ID NO: 19506 - RNA, 22 nt, Homo sapiens
uucaugucuuggcuguuagagu

SEQ ID NO: 19507 - RNA, 22 nt, Homo sapiens
uuccagcugggggcaacucugc

SEQ ID NO: 19508 - RNA, 22 nt, Homo sapiens
uuccagugggacgagaugugga

SEQ ID NO: 19509 - RNA, 22 nt, Homo sapiens
uucccagagccugggagugagg

SEQ ID NO: 19510 - RNA, 22 nt, Homo sapiens
uucccaguggaacauguaguca

SEQ ID NO: 19511 - RNA, 22 nt, Homo sapiens
uucccugagcaucuguugagcc

SEQ ID NO: 19512 - RNA, 22 nt, Homo sapiens
uucccuuucugaaaaucucauu

SEQ ID NO: 19513 - RNA, 22 nt, Homo sapiens
uucccuuucugccuugaaucuu

SEQ ID NO: 19514 - RNA, 22 nt, Homo sapiens
uuccuagagauuagcaagcugc

SEQ ID NO: 19515 - RNA, 19 nt, Homo sapiens
uuccugagaacaagggcuu

SEQ ID NO: 19516 - RNA, 22 nt, Homo sapiens
uuccugagaucagaauucaaau

SEQ ID NO: 19517 - RNA, 22 nt, Homo sapiens
uuccugagccuuguaucuagua

SEQ ID NO: 19518 - RNA, 22 nt, Homo sapiens
uuccugugacuguguggcaccc

SEQ ID NO: 19519 - RNA, 21 nt, Homo sapiens
uucuaaguaaauguuggacau

SEQ ID NO: 19520 - RNA, 22 nt, Homo sapiens
uucuagcaauggcagagugucu

SEQ ID NO: 19521 - RNA, 22 nt, Homo sapiens
uucuagcacuuugggagacuga

SEQ ID NO: 19522 - RNA, 22 nt, Homo sapiens
uucuauggucacagaugcuuga

SEQ ID NO: 19523 - RNA, 22 nt, Homo sapiens
uucuauguuugaaaaugccaaa

SEQ ID NO: 19524 - RNA, 22 nt, Homo sapiens
uucucaaggagccuucguaacu

SEQ ID NO: 19525 - RNA, 22 nt, Homo sapiens
uucucaguaauuccagauuuuu

SEQ ID NO: 19526 - RNA, 22 nt, Homo sapiens
uucucaguucgguggcagugcu

SEQ ID NO: 19527 - RNA, 22 nt, Homo sapiens
uucucugggacauaggucgggu

SEQ ID NO: 19528 - RNA, 22 nt, Homo sapiens
ugcagcacaguagguuugcaau

SEQ ID NO: 19529 - RNA, 23 nt, Homo sapiens
ugcagcuacauguggccaugugc

SEQ ID NO: 19530 - RNA, 18 nt, Homo sapiens
ugcagcuuugugauuggc

SEQ ID NO: 19531 - RNA, 22 nt, Homo sapiens
ugcaguagugugaucuuggcuc

SEQ ID NO: 19532 - RNA, 22 nt, Homo sapiens
ugcagugcaugacuguguuaug

SEQ ID NO: 19533 - RNA, 22 nt, Homo sapiens
ugcauacuguaugcgugcauac

SEQ ID NO: 19534 - RNA, 22 nt, Homo sapiens
ugcauauucuaggauuuuguau

SEQ ID NO: 19535 - RNA, 22 nt, Homo sapiens
ugcaugcaucuuuuauaguagc

SEQ ID NO: 19536 - RNA, 22 nt, Homo sapiens
ugcauggagauauacaguuuuu

SEQ ID NO: 19537 - RNA, 21 nt, Homo sapiens
ugcaugguagucacaugauuc

SEQ ID NO: 19538 - RNA, 22 nt, Homo sapiens
ugcauugcacuugcaugagaua

SEQ ID NO: 19539 - RNA, 22 nt, Homo sapiens
ugccaguauuuuguugaggauu

SEQ ID NO: 19540 - RNA, 22 nt, Homo sapiens
ugccaguguugccuuucacuag

SEQ ID NO: 19541 - RNA, 22 nt, Homo sapiens
ugccaugaagaucccugaaaug

SEQ ID NO: 19542 - RNA, 22 nt, Homo sapiens
ugcccuguaucccacuguuuca

SEQ ID NO: 19543 - RNA, 22 nt, Homo sapiens
ugccuaguagaaggugaacaug

SEQ ID NO: 19544 - RNA, 22 nt, Homo sapiens
ugccuaguggaaggagagcaaa

SEQ ID NO: 19545 - RNA, 22 nt, Homo sapiens
ugcgccauugcacuccagucuu

SEQ ID NO: 19546 - RNA, 22 nt, Homo sapiens
ugcuacccuucgucucucuggu

SEQ ID NO: 19547 - RNA, 22 nt, Homo sapiens
ugcuaugucuucucucacagag

SEQ ID NO: 19548 - RNA, 22 nt, Homo sapiens
ugcucaccugcugcucaccucc

SEQ ID NO: 19549 - RNA, 21 nt, Homo sapiens
ugcuccauuuucuagccugaa

SEQ ID NO: 19550 - RNA, 22 nt, Homo sapiens
ugcugaguguuaccggacaccg

SEQ ID NO: 19551 - RNA, 22 nt, Homo sapiens
ugcugcaaacaggcaucugugg

SEQ ID NO: 19552 - RNA, 22 nt, Homo sapiens
ugcugcacuuauggcucugagg

SEQ ID NO: 19553 - RNA, 22 nt, Homo sapiens
ugcuggugauucagauucaaau

SEQ ID NO: 19554 - RNA, 22 nt, Homo sapiens
ugcuguuguuugaugaaguaau

SEQ ID NO: 19555 - RNA, 21 nt, Homo sapiens
ugcuuacugaauguuaauuuc

SEQ ID NO: 19556 - RNA, 22 nt, Homo sapiens
ugcuugagacacauaugaauuu

SEQ ID NO: 19557 - RNA, 22 nt, Homo sapiens
uggaaacuuauguucuucugug

SEQ ID NO: 19558 - RNA, 22 nt, Homo sapiens
uggaaaguacuugaguuuguau

SEQ ID NO: 19559 - RNA, 22 nt, Homo sapiens
uggaaaguaguucuaaucuaag

SEQ ID NO: 19560 - RNA, 22 nt, Homo sapiens
uggaaauuaacagggauugucc

SEQ ID NO: 19561 - RNA, 22 nt, Homo sapiens
uggaaauuaagucuuuccugag

SEQ ID NO: 19562 - RNA, 22 nt, Homo sapiens
uggaacugauauugauggaaaa

SEQ ID NO: 19563 - RNA, 19 nt, Homo sapiens
uggaacugauucaguucug

SEQ ID NO: 19564 - RNA, 22 nt, Homo sapiens
uggaagacaaguguuagcaugg

SEQ ID NO: 19565 - RNA, 22 nt, Homo sapiens
uggaagacacauaccugauaac

SEQ ID NO: 19566 - RNA, 22 nt, Homo sapiens
uggaagacucaagguggugaau

SEQ ID NO: 19567 - RNA, 22 nt, Homo sapiens
uggaagauucuagaagauucca

SEQ ID NO: 19568 - RNA, 20 nt, Homo sapiens
uggaaggcaucugcauuauu

SEQ ID NO: 19569 - RNA, 22 nt, Homo sapiens
uggaaggcuucauauguaaaga

SEQ ID NO: 19570 - RNA, 22 nt, Homo sapiens
uggaagguaaguuuugagcauu

SEQ ID NO: 19571 - RNA, 23 nt, Homo sapiens
uggaaguauggaggaggcagaau

SEQ ID NO: 19572 - RNA, 22 nt, Homo sapiens
uggaaucaucaacgaaugaaau

SEQ ID NO: 19573 - RNA, 21 nt, Homo sapiens
uggaauuaauggagagguguu

SEQ ID NO: 19574 - RNA, 22 nt, Homo sapiens
uggaauuuagguugauaguaua

SEQ ID NO: 19575 - RNA, 22 nt, Homo sapiens
uggacagacaagguuauagauc

SEQ ID NO: 19576 - RNA, 22 nt, Homo sapiens
uggacauguacauauguguaug

SEQ ID NO: 19577 - RNA, 22 nt, Homo sapiens
uggagcccuaaacuucuaauau

SEQ ID NO: 19578 - RNA, 22 nt, Homo sapiens
uggaguaggccuaagaaugaca

SEQ ID NO: 19579 - RNA, 22 nt, Homo sapiens
uggagucuugcucuguugccca

SEQ ID NO: 19580 - RNA, 22 nt, Homo sapiens
uggagugaaaacacacuaaucu

SEQ ID NO: 19581 - RNA, 21 nt, Homo sapiens
uggagugaagaguuuauugac

SEQ ID NO: 19582 - RNA, 22 nt, Homo sapiens
uggagugcaauggugagaucuu

SEQ ID NO: 19583 - RNA, 22 nt, Homo sapiens
uggaguguaaauuaguucagcc

SEQ ID NO: 19584 - RNA, 22 nt, Homo sapiens
uggauugaaagcuuuaauauug

SEQ ID NO: 19585 - RNA, 22 nt, Homo sapiens
uggauugagaagcuguggcuca

SEQ ID NO: 19586 - RNA, 22 nt, Homo sapiens
uggcaaauagcaauaggagggu

SEQ ID NO: 19587 - RNA, 22 nt, Homo sapiens
uggcaaaucagaggcauggaca

SEQ ID NO: 19588 - RNA, 21 nt, Homo sapiens
uggcaacauggauggauucug

SEQ ID NO: 19589 - RNA, 22 nt, Homo sapiens
uggcaagaagagcaugagacca

SEQ ID NO: 19590 - RNA, 22 nt, Homo sapiens
uggcaagaaggauuuauuccuu

SEQ ID NO: 19591 - RNA, 22 nt, Homo sapiens
uggcaagaucacaauuacuuuu

SEQ ID NO: 19592 - RNA, 20 nt, Homo sapiens
uggcaagugggaauuguggg

SEQ ID NO: 19593 - RNA, 22 nt, Homo sapiens
uggcacaaugacccuugugggc

SEQ ID NO: 19594 - RNA, 22 nt, Homo sapiens
uggcaccugacuccgagaugca

SEQ ID NO: 19595 - RNA, 22 nt, Homo sapiens
uggcagauaggauacaggacua

SEQ ID NO: 19596 - RNA, 22 nt, Homo sapiens
uggcagcgugaaagacuuuuuc

SEQ ID NO: 19597 - RNA, 22 nt, Homo sapiens
uggcagcgugaauguggcugaa

SEQ ID NO: 19598 - RNA, 22 nt, Homo sapiens
uggcagugggagauauuuuauu

SEQ ID NO: 19599 - RNA, 22 nt, Homo sapiens
uggcauaugguauuugauaucu

SEQ ID NO: 19600 - RNA, 19 nt, Homo sapiens
uggcaugaaugugaacuaa

SEQ ID NO: 19601 - RNA, 17 nt, Homo sapiens
uggcaugaggguguggg

SEQ ID NO: 19602 - RNA, 22 nt, Homo sapiens
uggcauggggcagaacauuaca

SEQ ID NO: 19603 - RNA, 22 nt, Homo sapiens
uggcccccucccaaaucucaua

SEQ ID NO: 19604 - RNA, 22 nt, Homo sapiens
uggcuaagaugcacacuucacu

SEQ ID NO: 19605 - RNA, 22 nt, Homo sapiens
uggcuacugacugaugauuaua

SEQ ID NO: 19606 - RNA, 21 nt, Homo sapiens
uggcuauuucuguggcauaca

SEQ ID NO: 19607 - RNA, 22 nt, Homo sapiens
uggcucauuucuaaacccagcu

SEQ ID NO: 19608 - RNA, 22 nt, Homo sapiens
uggcuccguuguacaggcugga

SEQ ID NO: 19609 - RNA, 22 nt, Homo sapiens
uggcuguguccucucccaaauc

SEQ ID NO: 19610 - RNA, 21 nt, Homo sapiens
uggcuguuuucaugcuagaac

SEQ ID NO: 19611 - RNA, 21 nt, Homo sapiens
uggcuuauuugaaucuggcuu

SEQ ID NO: 19612 - RNA, 22 nt, Homo sapiens
uggcuuuguaagguuucauuuu

SEQ ID NO: 19613 - RNA, 22 nt, Homo sapiens
uggcuuuuauuauguugaggua

SEQ ID NO: 19614 - RNA, 18 nt, Homo sapiens
ugggaagaaauucuucuc

SEQ ID NO: 19615 - RNA, 22 nt, Homo sapiens
ugggaccccuacucuuuccaca

SEQ ID NO: 19616 - RNA, 22 nt, Homo sapiens
ugggaugaauacaaugggauca

SEQ ID NO: 19617 - RNA, 22 nt, Homo sapiens
ugggaugaugaaaaggcuuucu

SEQ ID NO: 19618 - RNA, 22 nt, Homo sapiens
ugggcaagagagcaugacccug

SEQ ID NO: 19619 - RNA, 23 nt, Homo sapiens
uggguucccuaagcgcaugcugc

SEQ ID NO: 19620 - RNA, 22 nt, Homo sapiens
ugguacuucaugcucacagaua

SEQ ID NO: 19621 - RNA, 22 nt, Homo sapiens
uggucagaaaauuacuugauau

SEQ ID NO: 19622 - RNA, 22 nt, Homo sapiens
uggucagaugcugaguggaucu

SEQ ID NO: 19623 - RNA, 21 nt, Homo sapiens
uggucccauaagauuacaaug

SEQ ID NO: 19624 - RNA, 22 nt, Homo sapiens
uggucccaugaacuuuagguca

SEQ ID NO: 19625 - RNA, 20 nt, Homo sapiens
ugguccccaccaaaucucau

SEQ ID NO: 19626 - RNA, 22 nt, Homo sapiens
uggucuccuuuguacccugggc

SEQ ID NO: 19627 - RNA, 22 nt, Homo sapiens
ugguucaguugcacaggcuguu

SEQ ID NO: 19628 - RNA, 18 nt, Homo sapiens
uguaaacuaccucaaccu

SEQ ID NO: 19629 - RNA, 22 nt, Homo sapiens
uguaaaucugguuaauuggaua

SEQ ID NO: 19630 - RNA, 22 nt, Homo sapiens
uguaacaggaggaaaaugugaa

SEQ ID NO: 19631 - RNA, 22 nt, Homo sapiens
uguaagcagcagagacuauccu

SEQ ID NO: 19632 - RNA, 22 nt, Homo sapiens
uguacaugggacaggaggagag

SEQ ID NO: 19633 - RNA, 22 nt, Homo sapiens
uguacccuuagagagugaucga

SEQ ID NO: 19634 - RNA, 22 nt, Homo sapiens
uguagucauuuggaguccagcu

SEQ ID NO: 19635 - RNA, 22 nt, Homo sapiens
ugucaaagagacaucugcacuc

SEQ ID NO: 19636 - RNA, 19 nt, Homo sapiens
uucucugguuguacuaccc

SEQ ID NO: 19637 - RNA, 22 nt, Homo sapiens
uucugauggaguaguccacaga

SEQ ID NO: 19638 - RNA, 22 nt, Homo sapiens
uucuggaaaucagcagagggug

SEQ ID NO: 19639 - RNA, 22 nt, Homo sapiens
uucuguguuuaggucacggcua

SEQ ID NO: 19640 - RNA, 22 nt, Homo sapiens
uugaaagacagaggggcaaguu

SEQ ID NO: 19641 - RNA, 22 nt, Homo sapiens
uugaaagcuaucagagauucca

SEQ ID NO: 19642 - RNA, 22 nt, Homo sapiens
uugaaccauucuuuugauagag

SEQ ID NO: 19643 - RNA, 22 nt, Homo sapiens
uugaaggaacgcuguucccuug

SEQ ID NO: 19644 - RNA, 22 nt, Homo sapiens
uugaaguagcauuucaugucua

SEQ ID NO: 19645 - RNA, 22 nt, Homo sapiens
uugaaguagguaccguucaauu

SEQ ID NO: 19646 - RNA, 22 nt, Homo sapiens
uugaaguauagaguuuaagaac

SEQ ID NO: 19647 - RNA, 22 nt, Homo sapiens
uugaagugaagaacaauaucac

SEQ ID NO: 19648 - RNA, 22 nt, Homo sapiens
uugaauagcauguuuagugcau

SEQ ID NO: 19649 - RNA, 22 nt, Homo sapiens
uugacaaguuguccaguaugag

SEQ ID NO: 19650 - RNA, 22 nt, Homo sapiens
uugacacuaauuauuauaggug

SEQ ID NO: 19651 - RNA, 20 nt, Homo sapiens
uugacagagggaaaguugcu

SEQ ID NO: 19652 - RNA, 20 nt, Homo sapiens
uugacaguggguuguuaaag

SEQ ID NO: 19653 - RNA, 22 nt, Homo sapiens
uugacauaaucauuucacagug

SEQ ID NO: 19654 - RNA, 22 nt, Homo sapiens
uugaccacugggcacaguaagu

SEQ ID NO: 19655 - RNA, 23 nt, Homo sapiens
uugacuguggguacaaugugaua

SEQ ID NO: 19656 - RNA, 22 nt, Homo sapiens
uugagagcugaugaaagauaaa

SEQ ID NO: 19657 - RNA, 22 nt, Homo sapiens
uugagauagaauaggaauggga

SEQ ID NO: 19658 - RNA, 22 nt, Homo sapiens
uugagauaucuuggccuuugca

SEQ ID NO: 19659 - RNA, 22 nt, Homo sapiens
uugagauggagucucacgcauu

SEQ ID NO: 19660 - RNA, 22 nt, Homo sapiens
uugagauggagucucacugugu

SEQ ID NO: 19661 - RNA, 22 nt, Homo sapiens
uugagcaacauagugagacugu

SEQ ID NO: 19662 - RNA, 22 nt, Homo sapiens
uugagcaauccuccugccaugu

SEQ ID NO: 19663 - RNA, 22 nt, Homo sapiens
uugagcacugucugugugcagu

SEQ ID NO: 19664 - RNA, 22 nt, Homo sapiens
uugagcucuucuagcaauucua

SEQ ID NO: 19665 - RNA, 22 nt, Homo sapiens
uugaggaaugucauuuguguuu

SEQ ID NO: 19666 - RNA, 22 nt, Homo sapiens
uugaggaggcagucuucccauu

SEQ ID NO: 19667 - RNA, 23 nt, Homo sapiens
uugaggcauguaccaucaauauc

SEQ ID NO: 19668 - RNA, 22 nt, Homo sapiens
uugagggaggccucaguuuaca

SEQ ID NO: 19669 - RNA, 22 nt, Homo sapiens
uugagguagcuuugauggaggu

SEQ ID NO: 19670 - RNA, 22 nt, Homo sapiens
uugaggucuucaggaucaggcu

SEQ ID NO: 19671 - RNA, 22 nt, Homo sapiens
uugagugaaugaaugauuaaau

SEQ ID NO: 19672 - RNA, 22 nt, Homo sapiens
uugaguuugaguauucuaaagc

SEQ ID NO: 19673 - RNA, 22 nt, Homo sapiens
uuuaaguguuuguuccugaaaa

SEQ ID NO: 19674 - RNA, 22 nt, Homo sapiens
uuuaggcaugcaguucuauuua

SEQ ID NO: 19675 - RNA, 22 nt, Homo sapiens
uuuagguaauauuaaguagcug

SEQ ID NO: 19676 - RNA, 22 nt, Homo sapiens
uuuagguauuugguauagcagu

SEQ ID NO: 19677 - RNA, 22 nt, Homo sapiens
uuuaguacugcuuuaugugugu

SEQ ID NO: 19678 - RNA, 22 nt, Homo sapiens
uuucacagagggcuucuuucua

SEQ ID NO: 19679 - RNA, 23 nt, Homo sapiens
uuucacaguagcuggaucagccu

SEQ ID NO: 19680 - RNA, 23 nt, Homo sapiens
uuucaguaguuguauccuguugc

SEQ ID NO: 19681 - RNA, 22 nt, Homo sapiens
uuucauggaauauagucauuuu

SEQ ID NO: 19682 - RNA, 22 nt, Homo sapiens
uuucauggaggauuugcuucuu

SEQ ID NO: 19683 - RNA, 18 nt, Homo sapiens
uuucauugagugugauau

SEQ ID NO: 19684 - RNA, 22 nt, Homo sapiens
uuucccuuacuuaaacuuacuc

SEQ ID NO: 19685 - RNA, 22 nt, Homo sapiens
uuucccuuuagcuuagugauuu

SEQ ID NO: 19686 - RNA, 22 nt, Homo sapiens
uuucccuuugcuuugucagcca

SEQ ID NO: 19687 - RNA, 16 nt, Homo sapiens
uuucccuuugguguuu

SEQ ID NO: 19688 - RNA, 20 nt, Homo sapiens
uuucuccccuauaaaucuca

SEQ ID NO: 19689 - RNA, 22 nt, Homo sapiens
uuucugagaccaaaacuuguaa

SEQ ID NO: 19690 - RNA, 21 nt, Homo sapiens
uuucugggggagcauggcagg

SEQ ID NO: 19691 - RNA, 22 nt, Homo sapiens
uuucuugguuguauuuagacuu

SEQ ID NO: 19692 - RNA, 20 nt, Homo sapiens
uuugaauguaaagcauguca

SEQ ID NO: 19693 - RNA, 22 nt, Homo sapiens
uuugacaaugugugcuuguauu

SEQ ID NO: 19694 - RNA, 22 nt, Homo sapiens
uuugacuagaguguuuuacaac

SEQ ID NO: 19695 - RNA, 16 nt, Homo sapiens
uuugcaagaucagaag

SEQ ID NO: 19696 - RNA, 22 nt, Homo sapiens
uuugcacucaguaagugggagc

SEQ ID NO: 19697 - RNA, 22 nt, Homo sapiens
uuugcuugaggucuagcuaccc

SEQ ID NO: 19698 - RNA, 22 nt, Homo sapiens
uuuggauagugugguccuuuua

SEQ ID NO: 19699 - RNA, 22 nt, Homo sapiens
uuuggcaaagaucaacauguua

SEQ ID NO: 19700 - RNA, 21 nt, Homo sapiens
uuuggcauuaugucaccagag

SEQ ID NO: 19701 - RNA, 22 nt, Homo sapiens
uuuggcauuuuacuacucaaau

SEQ ID NO: 19702 - RNA, 22 nt, Homo sapiens
uuuggcuuaagauugacugcaa

SEQ ID NO: 19703 - RNA, 22 nt, Homo sapiens
uuuggucacugccgccgccagc

SEQ ID NO: 19704 - RNA, 22 nt, Homo sapiens
uuugguccaguguucagguccu

SEQ ID NO: 19705 - RNA, 22 nt, Homo sapiens
uuuguacuaugguuuuucacua

SEQ ID NO: 19706 - RNA, 22 nt, Homo sapiens
uuuguacuugaaacccagggcc

SEQ ID NO: 19707 - RNA, 22 nt, Homo sapiens
uuugucauagcagcaggaaugg

SEQ ID NO: 19708 - RNA, 22 nt, Homo sapiens
uuugucccuuugcaguggcaca

SEQ ID NO: 19709 - RNA, 22 nt, Homo sapiens
uuugugagguggauagauugca

SEQ ID NO: 19710 - RNA, 22 nt, Homo sapiens
uuugugcuccucucaguaugug

SEQ ID NO: 19711 - RNA, 22 nt, Homo sapiens
uuuguuugaagucgagacaacu

SEQ ID NO: 19712 - RNA, 22 nt, Homo sapiens
uuuuaguggaauauuuacaguu

SEQ ID NO: 19713 - RNA, 22 nt, Homo sapiens
uuuugcucuucauagguccugu

SEQ ID NO: 19714 - RNA, 22 nt, Homo sapiens
uuuugcuugugaauagccacau

SEQ ID NO: 19715 - RNA, 22 nt, Homo sapiens
uuuuggacuucaauuugacacu

SEQ ID NO: 19716 - RNA, 22 nt, Homo sapiens
uuuuggacuugcuccccugucc

SEQ ID NO: 19717 - RNA, 22 nt, Homo sapiens
uuuuggcucugucuguaucuuu

SEQ ID NO: 19718 - RNA, 22 nt, Homo sapiens
uuuugucccaugggcuguuccc

SEQ ID NO: 19719 - RNA, 22 nt, Homo sapiens
uuuuuggaggagguuagaucau

SEQ ID NO: 19720 - RNA, 23 nt, Homo sapiens
uuuuuguguuucauggaaauagg

SEQ ID NO: 19721 - RNA, 22 nt, Homo sapiens
agugcaguggcacaaucuuggc

SEQ ID NO: 19722 - RNA, 22 nt, Homo sapiens
agugcaguugucacgugccuuc

SEQ ID NO: 19723 - RNA, 22 nt, Homo sapiens
aguggaaucuguuauacuaacu

SEQ ID NO: 19724 - RNA, 22 nt, Homo sapiens
agugguuuuggaauggaauuca

SEQ ID NO: 19725 - RNA, 22 nt, Homo sapiens
aguguuuuuaacaagaaagggu

SEQ ID NO: 19726 - RNA, 22 nt, Homo sapiens
aguucaauggguuuucacucau

SEQ ID NO: 19727 - RNA, 21 nt, Homo sapiens
aguucacauggcuccuguguu

SEQ ID NO: 19728 - RNA, 18 nt, Homo sapiens
cauagcacuucagcacau

SEQ ID NO: 19729 - RNA, 21 nt, Homo sapiens
caucaaauugucauggugggu

SEQ ID NO: 19730 - RNA, 22 nt, Homo sapiens
cauccccugcaccaaccuuuac

SEQ ID NO: 19731 - RNA, 22 nt, Homo sapiens
caucgcacuccagcuugggcaa

SEQ ID NO: 19732 - RNA, 22 nt, Homo sapiens
caugaaagacugaggaauugga

SEQ ID NO: 19733 - RNA, 22 nt, Homo sapiens
caugcauuggucuauuauguga

SEQ ID NO: 19734 - RNA, 22 nt, Homo sapiens
cauggcacuggugggagugucu

SEQ ID NO: 19735 - RNA, 22 nt, Homo sapiens
cauggcucuuguuuacucccag

SEQ ID NO: 19736 - RNA, 22 nt, Homo sapiens
cauggcucuuugcugcuaaagu

SEQ ID NO: 19737 - RNA, 22 nt, Homo sapiens
cauguauagauuccauaguggu

SEQ ID NO: 19738 - RNA, 21 nt, Homo sapiens
caugucacugcacucuagccu

SEQ ID NO: 19739 - RNA, 22 nt, Homo sapiens
caugucacuuccucucugaugg

SEQ ID NO: 19740 - RNA, 22 nt, Homo sapiens
caugucuuuuaaacauucaacu

SEQ ID NO: 19741 - RNA, 22 nt, Homo sapiens
caugugcaugcuuucuuaugug

SEQ ID NO: 19742 - RNA, 22 nt, Homo sapiens
cauuccacauguaggacaauuu

SEQ ID NO: 19743 - RNA, 22 nt, Homo sapiens
cauugcacuccagccugcacga

SEQ ID NO: 19744 - RNA, 22 nt, Homo sapiens
cauugcacuccagccuggcaac

SEQ ID NO: 19745 - RNA, 22 nt, Homo sapiens
cauugcacuuagacaacuuuug

SEQ ID NO: 19746 - RNA, 22 nt, Homo sapiens
cauugcaugcauauggcuuggu

SEQ ID NO: 19747 - RNA, 22 nt, Homo sapiens
cauuugguggcuacagaguaac

SEQ ID NO: 19748 - RNA, 22 nt, Homo sapiens
cauuuuacuuuccagacgugga

SEQ ID NO: 19749 - RNA, 22 nt, Homo sapiens
ccaaaucucauguugaaaugug

SEQ ID NO: 19750 - RNA, 22 nt, Homo sapiens
ccagaguucuaggcauuggaaa

SEQ ID NO: 19751 - RNA, 22 nt, Homo sapiens
ccaggguuccacgccuggcugu

SEQ ID NO: 19752 - RNA, 22 nt, Homo sapiens
ccagugcugugcaguguaugag

SEQ ID NO: 19753 - RNA, 22 nt, Homo sapiens
ccaucccuuucugagcaguucc

SEQ ID NO: 19754 - RNA, 22 nt, Homo sapiens
ccauggcaauggucagucuauu

SEQ ID NO: 19755 - RNA, 22 nt, Homo sapiens
ccauuugguuauguaucgaaac

SEQ ID NO: 19756 - RNA, 22 nt, Homo sapiens
cccacaguggccucauauccuu

SEQ ID NO: 19757 - RNA, 22 nt, Homo sapiens
cccagugugcugggugacagcu

SEQ ID NO: 19758 - RNA, 22 nt, Homo sapiens
ccccagugguugcaacagcaga

SEQ ID NO: 19759 - RNA, 22 nt, Homo sapiens
ccccaguguguaaaggccuugc

SEQ ID NO: 19760 - RNA, 22 nt, Homo sapiens
ccccugaaacucacucauuauc

SEQ ID NO: 19761 - RNA, 17 nt, Homo sapiens
ccccugagcgaugcagu

SEQ ID NO: 19762 - RNA, 22 nt, Homo sapiens
cccuagaucucagcgccuucau

SEQ ID NO: 19763 - RNA, 23 nt, Homo sapiens
cccucagaagugcagggagagaa

SEQ ID NO: 19764 - RNA, 22 nt, Homo sapiens
cccucauucauucauccuaugu

SEQ ID NO: 19765 - RNA, 22 nt, Homo sapiens
cccugaagacuccaccgucaug

SEQ ID NO: 19766 - RNA, 22 nt, Homo sapiens
cccugacauucggagauguagu

SEQ ID NO: 19767 - RNA, 22 nt, Homo sapiens
cccugagaaaacuuuguccuua

SEQ ID NO: 19768 - RNA, 22 nt, Homo sapiens
ccucaguguuuaucauuauuuu

SEQ ID NO: 19769 - RNA, 22 nt, Homo sapiens
ccugagacgaauggagugaaca

SEQ ID NO: 19770 - RNA, 21 nt, Homo sapiens
ccugaugaccucugagaguua

SEQ ID NO: 19771 - RNA, 22 nt, Homo sapiens
ccuggcacugggccccguggcu

SEQ ID NO: 19772 - RNA, 22 nt, Homo sapiens
ccuuggcacuuugccacagugc

SEQ ID NO: 19773 - RNA, 22 nt, Homo sapiens
ccuuuuuguaguggaaguagga

SEQ ID NO: 19774 - RNA, 22 nt, Homo sapiens
cgccugagcugaggaagcugca

SEQ ID NO: 19775 - RNA, 22 nt, Homo sapiens
cgugaggaaaacagaggguguu

SEQ ID NO: 19776 - RNA, 22 nt, Homo sapiens
cuaaaacuuucugagugcagca

SEQ ID NO: 19777 - RNA, 22 nt, Homo sapiens
cuaaaguauugagugguaaaga

SEQ ID NO: 19778 - RNA, 22 nt, Homo sapiens
cuaaaugcacugucaaaggaag

SEQ ID NO: 19779 - RNA, 22 nt, Homo sapiens
cuaacacagagguuuauuucuc

SEQ ID NO: 19780 - RNA, 18 nt, Homo sapiens
cuaauacuauucaacaag

SEQ ID NO: 19781 - RNA, 22 nt, Homo sapiens
cuaaucuagccuuauaaguauu

SEQ ID NO: 19782 - RNA, 22 nt, Homo sapiens
cuaaugcagucaggagaaggaa

SEQ ID NO: 19783 - RNA, 22 nt, Homo sapiens
cuacugacacuacugcaaucau

SEQ ID NO: 19784 - RNA, 22 nt, Homo sapiens
cuagcacauaguuauucacuca

SEQ ID NO: 19785 - RNA, 22 nt, Homo sapiens
cuagcuccauauaaagcaggau

SEQ ID NO: 19786 - RNA, 22 nt, Homo sapiens
cuaugagucugcagaucuauua

SEQ ID NO: 19787 - RNA, 22 nt, Homo sapiens
cuaugucuuucauauuuugggg

SEQ ID NO: 19788 - RNA, 22 nt, Homo sapiens
cuauuagguuggugcaaaaguc

SEQ ID NO: 19789 - RNA, 22 nt, Homo sapiens
cuauucacaauagccaagauuu

SEQ ID NO: 19790 - RNA, 22 nt, Homo sapiens
cucaaagugcugggacuggcug

SEQ ID NO: 19791 - RNA, 22 nt, Homo sapiens
cucaaaugguccagcuaguggu

SEQ ID NO: 19792 - RNA, 22 nt, Homo sapiens
cucaaguacaugggauuacagg

SEQ ID NO: 19793 - RNA, 22 nt, Homo sapiens
cucacaugcucaccugguguuc

SEQ ID NO: 19794 - RNA, 22 nt, Homo sapiens
cucagagcacaguuuaugacag

SEQ ID NO: 19795 - RNA, 22 nt, Homo sapiens
cucagcaguggauuuaccacca

SEQ ID NO: 19796 - RNA, 22 nt, Homo sapiens
cucagcuacuugggaagcugag

SEQ ID NO: 19797 - RNA, 22 nt, Homo sapiens
cucagugguugauuuauuuauc

SEQ ID NO: 19798 - RNA, 22 nt, Homo sapiens
cucaugcugucuucugggguaa

SEQ ID NO: 19799 - RNA, 22 nt, Homo sapiens
cucauugcaaucucugccuccc

SEQ ID NO: 19800 - RNA, 22 nt, Homo sapiens
cucccauugcaaacaacagaag

SEQ ID NO: 19801 - RNA, 22 nt, Homo sapiens
cucucaguguggaggccagaaa

SEQ ID NO: 19802 - RNA, 22 nt, Homo sapiens
cucucaguugucuaauuaguuu

SEQ ID NO: 19803 - RNA, 17 nt, Homo sapiens
cucucugguuuaaagca

SEQ ID NO: 19804 - RNA, 22 nt, Homo sapiens
cucugagccugagguuccuacu

SEQ ID NO: 19805 - RNA, 22 nt, Homo sapiens
cucugguucugcagugcacccu

SEQ ID NO: 19806 - RNA, 22 nt, Homo sapiens
cucuuuaguaagcaguugauga

SEQ ID NO: 19807 - RNA, 22 nt, Homo sapiens
cugaaaagcaucugcauagcug

SEQ ID NO: 19808 - RNA, 22 nt, Homo sapiens
cugaauagucaacgauggacug

SEQ ID NO: 19809 - RNA, 22 nt, Homo sapiens
cugaauguccaggcagagguuu

SEQ ID NO: 19810 - RNA, 22 nt, Homo sapiens
cugagaauguaaaugaagcuuu

SEQ ID NO: 19811 - RNA, 22 nt, Homo sapiens
cugagaucguggggcugcuguc

SEQ ID NO: 19812 - RNA, 22 nt, Homo sapiens
cugagauggagucucgcauugu

SEQ ID NO: 19813 - RNA, 22 nt, Homo sapiens
cugagcaagucauuuuguuaaa

SEQ ID NO: 19814 - RNA, 22 nt, Homo sapiens
cugaggcacggcgaccuuaagu

SEQ ID NO: 19815 - RNA, 22 nt, Homo sapiens
cugaggucugaauccagguauc

SEQ ID NO: 19816 - RNA, 18 nt, Homo sapiens
cugagucauuccuggguc

SEQ ID NO: 19817 - RNA, 22 nt, Homo sapiens
cugauuguuugccucuaaaauc

SEQ ID NO: 19818 - RNA, 22 nt, Homo sapiens
cugcaauggagaaagugagacu

SEQ ID NO: 19819 - RNA, 22 nt, Homo sapiens
cugcaguaaacuuucccauuca

SEQ ID NO: 19820 - RNA, 22 nt, Homo sapiens
cugcaguaaccacuguaggugu

SEQ ID NO: 19821 - RNA, 22 nt, Homo sapiens
cugcauaaucaucucucugcau

SEQ ID NO: 19822 - RNA, 22 nt, Homo sapiens
cuggaaagaaucaggcuaaacu

SEQ ID NO: 19823 - RNA, 22 nt, Homo sapiens
cuggaaagcaaguccauugcuc

SEQ ID NO: 19824 - RNA, 22 nt, Homo sapiens
cuggagauuaaccaauugccau

SEQ ID NO: 19825 - RNA, 22 nt, Homo sapiens
cuggagcauugguggauuuguu

SEQ ID NO: 19826 - RNA, 22 nt, Homo sapiens
cuggaggccugaacauaaaugg

SEQ ID NO: 19827 - RNA, 22 nt, Homo sapiens
cuggcaagaggauaaaguccua

SEQ ID NO: 19828 - RNA, 22 nt, Homo sapiens
cuggcacagugucagaaacaca

SEQ ID NO: 19829 - RNA, 22 nt, Homo sapiens
cuggcaccauacacuguuguug

SEQ ID NO: 19830 - RNA, 22 nt, Homo sapiens
cuggcaucuaaauacuugaugu

SEQ ID NO: 19831 - RNA, 22 nt, Homo sapiens
cuggcccaguucugcguuuugc

SEQ ID NO: 19832 - RNA, 22 nt, Homo sapiens
cuguaaagaucacagagcuggu

SEQ ID NO: 19833 - RNA, 22 nt, Homo sapiens
cuguaaaguucucauuguagcc

SEQ ID NO: 19834 - RNA, 22 nt, Homo sapiens
cuguccugcagagucagaauga

SEQ ID NO: 19835 - RNA, 22 nt, Homo sapiens
cugucucagugaauugguuuua

SEQ ID NO: 19836 - RNA, 22 nt, Homo sapiens
gucacugagauugguauuaaug

SEQ ID NO: 19837 - RNA, 22 nt, Homo sapiens
gucacugagcagaaggaagcga

SEQ ID NO: 19838 - RNA, 20 nt, Homo sapiens
gucacuggcccagggcuugu

SEQ ID NO: 19839 - RNA, 22 nt, Homo sapiens
gucacuggcugucuuguaugau

SEQ ID NO: 19840 - RNA, 21 nt, Homo sapiens
gucacuggggcuggauaauuc

SEQ ID NO: 19841 - RNA, 22 nt, Homo sapiens
gucacuguggagaagaaagugg

SEQ ID NO: 19842 - RNA, 22 nt, Homo sapiens
gucaggcaccgauacaguuuuu

SEQ ID NO: 19843 - RNA, 22 nt, Homo sapiens
gucagggagucucuaucagugg

SEQ ID NO: 19844 - RNA, 22 nt, Homo sapiens
gucaguggagaaaaggacaugu

SEQ ID NO: 19845 - RNA, 22 nt, Homo sapiens
gucaguucuugugguugcauuc

SEQ ID NO: 19846 - RNA, 22 nt, Homo sapiens
gucaguuugguuaaucauucca

SEQ ID NO: 19847 - RNA, 18 nt, Homo sapiens
gucauagaaugaugguuc

SEQ ID NO: 19848 - RNA, 22 nt, Homo sapiens
gucauggaaaucuacauuguua

SEQ ID NO: 19849 - RNA, 22 nt, Homo sapiens
gucaugucugcacauaguaaaa

SEQ ID NO: 19850 - RNA, 22 nt, Homo sapiens
gucauugagucagggaguaucu

SEQ ID NO: 19851 - RNA, 22 nt, Homo sapiens
guccaaauccaugggauguaca

SEQ ID NO: 19852 - RNA, 22 nt, Homo sapiens
gucccugcgauugugggauccu

SEQ ID NO: 19853 - RNA, 22 nt, Homo sapiens
gucucccaaccccugugcccag

SEQ ID NO: 19854 - RNA, 22 nt, Homo sapiens
gucucccagccuacauauuucu

SEQ ID NO: 19855 - RNA, 22 nt, Homo sapiens
gucucccagccuacaucuuucu

SEQ ID NO: 19856 - RNA, 22 nt, Homo sapiens
uucacagaguuauuuuuaugcu

SEQ ID NO: 19857 - RNA, 22 nt, Homo sapiens
uucacagccgcaccccaucacu

SEQ ID NO: 19858 - RNA, 22 nt, Homo sapiens
uucacaguacucccuggaauua

SEQ ID NO: 19859 - RNA, 22 nt, Homo sapiens
uucacaguguguacaccagggg

SEQ ID NO: 19860 - RNA, 22 nt, Homo sapiens
uucaccuguagcaugcccuugg

SEQ ID NO: 19861 - RNA, 22 nt, Homo sapiens
uucaccuugcccacagcagucu

SEQ ID NO: 19862 - RNA, 22 nt, Homo sapiens
uucacuggagcccaggaguugg

SEQ ID NO: 19863 - RNA, 22 nt, Homo sapiens
uucacugugaacucauauucag

SEQ ID NO: 19864 - RNA, 22 nt, Homo sapiens
uucagaguggacagaaauuaag

SEQ ID NO: 19865 - RNA, 19 nt, Homo sapiens
uucagcagugucugcucuu

SEQ ID NO: 19866 - RNA, 22 nt, Homo sapiens
uucaggcuccugugagaaucua

SEQ ID NO: 19867 - RNA, 22 nt, Homo sapiens
uucaguagucaaaagauaaggg

SEQ ID NO: 19868 - RNA, 21 nt, Homo sapiens
uucaucagccagaaaucaagc

SEQ ID NO: 19869 - RNA, 22 nt, Homo sapiens
uucaucaguugagcugguugcu

SEQ ID NO: 19870 - RNA, 22 nt, Homo sapiens
uucaucuggcaauucagagauu

SEQ ID NO: 19871 - RNA, 22 nt, Homo sapiens
uucauggaacaaguggguucaa

SEQ ID NO: 19872 - RNA, 22 nt, Homo sapiens
uucauggacucaauaguuucgc

SEQ ID NO: 19873 - RNA, 22 nt, Homo sapiens
uucauggaugcauuugaggggu

SEQ ID NO: 19874 - RNA, 22 nt, Homo sapiens
uucauguaauauauuucaggcc

SEQ ID NO: 19875 - RNA, 22 nt, Homo sapiens
uuccacgugaaguauucuaaag

SEQ ID NO: 19876 - RNA, 21 nt, Homo sapiens
uuccagugagccuagaugccu

SEQ ID NO: 19877 - RNA, 22 nt, Homo sapiens
uuccaguuauuauaccucuuaa

SEQ ID NO: 19878 - RNA, 22 nt, Homo sapiens
uuccaguuuuauggguauagag

SEQ ID NO: 19879 - RNA, 22 nt, Homo sapiens
uuccaugagaugcaucaaagcu

SEQ ID NO: 19880 - RNA, 22 nt, Homo sapiens
uucccuagaacacauggaggga

SEQ ID NO: 19881 - RNA, 20 nt, Homo sapiens
uucccucagccuugagggua

SEQ ID NO: 19882 - RNA, 22 nt, Homo sapiens
uucccugugggaguaggaaagu

SEQ ID NO: 19883 - RNA, 22 nt, Homo sapiens
uucccuugcaggaugaucugga

SEQ ID NO: 19884 - RNA, 22 nt, Homo sapiens
uuccugaggccuccccagaagc

SEQ ID NO: 19885 - RNA, 22 nt, Homo sapiens
uucuccugguggacccuaaacg

SEQ ID NO: 19886 - RNA, 22 nt, Homo sapiens
uucucgcuuuuuccaccuguau

SEQ ID NO: 19887 - RNA, 22 nt, Homo sapiens
uucugacuggugugagauggua

SEQ ID NO: 19888 - RNA, 22 nt, Homo sapiens
uucuggcucaggucaacacuuc

SEQ ID NO: 19889 - RNA, 22 nt, Homo sapiens
uucuggcucgauucucugaccg

SEQ ID NO: 19890 - RNA, 22 nt, Homo sapiens
uucuuagucaaguuguauuuca

SEQ ID NO: 19891 - RNA, 20 nt, Homo sapiens
uucuugaguuaacaaguuac

SEQ ID NO: 19892 - RNA, 22 nt, Homo sapiens
uucuugcacuuaacugacauuc

SEQ ID NO: 19893 - RNA, 22 nt, Homo sapiens
uucuuugcaugaucucaaaguc

SEQ ID NO: 19894 - RNA, 22 nt, Homo sapiens
uugaaagucauggcacaggcaa

SEQ ID NO: 19895 - RNA, 22 nt, Homo sapiens
uugaaagucauuucuucuaagu

SEQ ID NO: 19896 - RNA, 22 nt, Homo sapiens
uugaaaucuuccacagcccaag

SEQ ID NO: 19897 - RNA, 22 nt, Homo sapiens
uugaaauguuuagaaguuugga

SEQ ID NO: 19898 - RNA, 22 nt, Homo sapiens
uugaaggaggugcucacucucg

SEQ ID NO: 19899 - RNA, 22 nt, Homo sapiens
uugaauaggcucaugcuuauca

SEQ ID NO: 19900 - RNA, 18 nt, Homo sapiens
uugaaugcgucccagaga

SEQ ID NO: 19901 - RNA, 22 nt, Homo sapiens
uugaauggaauguuggaacuau

SEQ ID NO: 19902 - RNA, 22 nt, Homo sapiens
uugaauguguugggaagcccuu

SEQ ID NO: 19903 - RNA, 22 nt, Homo sapiens
uugacaguugggcagggaaguu

SEQ ID NO: 19904 - RNA, 22 nt, Homo sapiens
uugacauauguguguccacaua

SEQ ID NO: 19905 - RNA, 22 nt, Homo sapiens
uugacuguaagauggcuauuac

SEQ ID NO: 19906 - RNA, 22 nt, Homo sapiens
uugacuuuuaggaggaaaauga

SEQ ID NO: 19907 - RNA, 22 nt, Homo sapiens
uugagaagugucuguucauguc

SEQ ID NO: 19908 - RNA, 22 nt, Homo sapiens
uugagacggaguuuugcucuug

SEQ ID NO: 19909 - RNA, 22 nt, Homo sapiens
uugagauacauaauuaugaaug

SEQ ID NO: 19910 - RNA, 22 nt, Homo sapiens
uugagauauccauaaaugggaa

SEQ ID NO: 19911 - RNA, 22 nt, Homo sapiens
uugagaucuugauauguuugaa

SEQ ID NO: 19912 - RNA, 22 nt, Homo sapiens
uugagauggagucuugcacugu

SEQ ID NO: 19913 - RNA, 22 nt, Homo sapiens
uugagauguaagauguuaauau

SEQ ID NO: 19914 - RNA, 22 nt, Homo sapiens
uugagcaaugaacgauucaggg

SEQ ID NO: 19915 - RNA, 19 nt, Homo sapiens
uugagcacugccggaguua

SEQ ID NO: 19916 - RNA, 22 nt, Homo sapiens
uugagcccuggagguggaggcu

SEQ ID NO: 19917 - RNA, 22 nt, Homo sapiens
uugagcucaucaagauagagaa

SEQ ID NO: 19918 - RNA, 22 nt, Homo sapiens
uugaggacugcuaagcauuuga

SEQ ID NO: 19919 - RNA, 22 nt, Homo sapiens
uugagggaagccagaggucugc

SEQ ID NO: 19920 - RNA, 22 nt, Homo sapiens
uugagggaggcagggcuugucu

SEQ ID NO: 19921 - RNA, 22 nt, Homo sapiens
uugaggugggaggaucacuuga

SEQ ID NO: 19922 - RNA, 21 nt, Homo sapiens
uugaguugaagcaaggaggga

SEQ ID NO: 19923 - RNA, 22 nt, Homo sapiens
uugauaagaaaugccaguuugg

SEQ ID NO: 19924 - RNA, 22 nt, Homo sapiens
uugauauguaguuggacuugau

SEQ ID NO: 19925 - RNA, 22 nt, Homo sapiens
uugauauucugagaagcugaag

SEQ ID NO: 19926 - RNA, 22 nt, Homo sapiens
uugaucaucagcuuugucaucu

SEQ ID NO: 19927 - RNA, 22 nt, Homo sapiens
uugaucuguguuagaagcuaag

SEQ ID NO: 19928 - RNA, 22 nt, Homo sapiens
uugauuagauccaguugauuga

SEQ ID NO: 19929 - RNA, 22 nt, Homo sapiens
uugcaaagaccucuucacuucc

SEQ ID NO: 19930 - RNA, 18 nt, Homo sapiens
uugcaaauucuucccugu

SEQ ID NO: 19931 - RNA, 22 nt, Homo sapiens
uugcaacuuagaaaaaucauuu

SEQ ID NO: 19932 - RNA, 22 nt, Homo sapiens
uugcaaugugaugugauuugga

SEQ ID NO: 19933 - RNA, 20 nt, Homo sapiens
uugcacagagaaggaggcag

SEQ ID NO: 19934 - RNA, 22 nt, Homo sapiens
uugcacagucuagcuccaccuu

SEQ ID NO: 19935 - RNA, 22 nt, Homo sapiens
uugcacaguguguacagcacca

SEQ ID NO: 19936 - RNA, 22 nt, Homo sapiens
uugcacauugauuuuguaucuu

SEQ ID NO: 19937 - RNA, 22 nt, Homo sapiens
uugcacauugcaccuuuuguau

SEQ ID NO: 19938 - RNA, 22 nt, Homo sapiens
uugcacugagauuuugcuuaca

SEQ ID NO: 19939 - RNA, 22 nt, Homo sapiens
uugcagagccccugcaaggguc

SEQ ID NO: 19940 - RNA, 22 nt, Homo sapiens
uugcaggcaugagccaccgugc

SEQ ID NO: 19941 - RNA, 19 nt, Homo sapiens
uugcaguauccuauauguu

SEQ ID NO: 19942 - RNA, 22 nt, Homo sapiens
uugcauaagugcauucugugau

SEQ ID NO: 19943 - RNA, 23 nt, Homo sapiens
uugcauagacauccucauagauu

SEQ ID NO: 19944 - RNA, 22 nt, Homo sapiens
uugcauagaggugaguauagua

SEQ ID NO: 19945 - RNA, 19 nt, Homo sapiens
uugcauauguugaaccagc

SEQ ID NO: 19946 - RNA, 22 nt, Homo sapiens
uugcauauguugaaccagccuu

SEQ ID NO: 19947 - RNA, 22 nt, Homo sapiens
uugcaugucugcuucuccuccu

SEQ ID NO: 19948 - RNA, 22 nt, Homo sapiens
uugcauugacacaugaagcuca

SEQ ID NO: 19949 - RNA, 22 nt, Homo sapiens
uugcauuuucuaggagggcaaa

SEQ ID NO: 19950 - RNA, 22 nt, Homo sapiens
uugccaacauggugaacuccca

SEQ ID NO: 19951 - RNA, 22 nt, Homo sapiens
uugccauggaguagaauugaag

SEQ ID NO: 19952 - RNA, 22 nt, Homo sapiens
uugccuuuguuggaaacaagug

SEQ ID NO: 19953 - RNA, 22 nt, Homo sapiens
ucugagaucaugucugugcugu

SEQ ID NO: 19954 - RNA, 22 nt, Homo sapiens
ucugagcaugcaucuugccugg

SEQ ID NO: 19955 - RNA, 22 nt, Homo sapiens
ucugagguuaaauuuuauaguu

SEQ ID NO: 19956 - RNA, 22 nt, Homo sapiens
ucugaguggcagaaugagcuga

SEQ ID NO: 19957 - RNA, 22 nt, Homo sapiens
ucugcauaucaugcagaacuau

SEQ ID NO: 19958 - RNA, 22 nt, Homo sapiens
ucugccuuuucaugugggaugg

SEQ ID NO: 19959 - RNA, 22 nt, Homo sapiens
ucuggaauguaaaguuuauggg

SEQ ID NO: 19960 - RNA, 22 nt, Homo sapiens
ucuggcaagagccgagggcagu

SEQ ID NO: 19961 - RNA, 22 nt, Homo sapiens
ucuggcauuuucucugcuugca

SEQ ID NO: 19962 - RNA, 21 nt, Homo sapiens
ucuggccccuccaaaucucau

SEQ ID NO: 19963 - RNA, 20 nt, Homo sapiens
ucuggccccucuaaaucuca

SEQ ID NO: 19964 - RNA, 22 nt, Homo sapiens
ucuggccccucucaaaucucau

SEQ ID NO: 19965 - RNA, 18 nt, Homo sapiens
ucuggcuucuuuguucca

SEQ ID NO: 19966 - RNA, 22 nt, Homo sapiens
ucuggcuugugaacugucuucu

SEQ ID NO: 19967 - RNA, 22 nt, Homo sapiens
ucuggcuuuagcaugugggaag

SEQ ID NO: 19968 - RNA, 17 nt, Homo sapiens
ucuggcuuucacaccug

SEQ ID NO: 19969 - RNA, 21 nt, Homo sapiens
ucuggcuuucauuccccuucu

SEQ ID NO: 19970 - RNA, 22 nt, Homo sapiens
ucuggcuuugugaguugccaga

SEQ ID NO: 19971 - RNA, 22 nt, Homo sapiens
ucugucacugaaucccugucac

SEQ ID NO: 19972 - RNA, 22 nt, Homo sapiens
ucugucuuguccucacccuaga

SEQ ID NO: 19973 - RNA, 22 nt, Homo sapiens
ucugugaaugaacacuugaaaa

SEQ ID NO: 19974 - RNA, 22 nt, Homo sapiens
ucuguggugggcuccacccagu

SEQ ID NO: 19975 - RNA, 22 nt, Homo sapiens
ucugugguucaaaccagcaacu

SEQ ID NO: 19976 - RNA, 22 nt, Homo sapiens
ucugugguucaggcuggagugc

SEQ ID NO: 19977 - RNA, 22 nt, Homo sapiens
ucuugcacaaauuauuuuaacu

SEQ ID NO: 19978 - RNA, 22 nt, Homo sapiens
ucuuggcauggcugaagauucc

SEQ ID NO: 19979 - RNA, 22 nt, Homo sapiens
ucuuggguuugccuugcugcug

SEQ ID NO: 19980 - RNA, 22 nt, Homo sapiens
ucuugguaaugucacauuuccu

SEQ ID NO: 19981 - RNA, 22 nt, Homo sapiens
ucuugguugaaaauucauaaua

SEQ ID NO: 19982 - RNA, 22 nt, Homo sapiens
ucuugucacugcauccccagcu

SEQ ID NO: 19983 - RNA, 22 nt, Homo sapiens
ucuuugauguucugaaagaugg

SEQ ID NO: 19984 - RNA, 19 nt, Homo sapiens
ucuuugcuuuucuaagagg

SEQ ID NO: 19985 - RNA, 22 nt, Homo sapiens
ucuuuguugcauaggcuuguuc

SEQ ID NO: 19986 - RNA, 20 nt, Homo sapiens
ucuuuuuguggccccagagu

SEQ ID NO: 19987 - RNA, 22 nt, Homo sapiens
ugaaaaguuguugaaggcuuca

SEQ ID NO: 19988 - RNA, 22 nt, Homo sapiens
ugaaacauacacucugaugggg

SEQ ID NO: 19989 - RNA, 22 nt, Homo sapiens
ugaaauacuuuggcucuuuguu

SEQ ID NO: 19990 - RNA, 22 nt, Homo sapiens
ugaaaugaucaguuugguuacu

SEQ ID NO: 19991 - RNA, 22 nt, Homo sapiens
ugaaaugcugucuaggggaaau

SEQ ID NO: 19992 - RNA, 22 nt, Homo sapiens
ugaaaugguuaugugaggagau

SEQ ID NO: 19993 - RNA, 22 nt, Homo sapiens
ugaaauguaaguugucuagucu

SEQ ID NO: 19994 - RNA, 22 nt, Homo sapiens
ugaaauuguuugcaaggauagg

SEQ ID NO: 19995 - RNA, 22 nt, Homo sapiens
ugaagcuuguuucuguaccuuu

SEQ ID NO: 19996 - RNA, 22 nt, Homo sapiens
ugaagugaaugguaaguaugcc

SEQ ID NO: 19997 - RNA, 22 nt, Homo sapiens
ugaagugggaaaugaguauuaa

SEQ ID NO: 19998 - RNA, 21 nt, Homo sapiens
ugaaguguaaccgugcagggc

SEQ ID NO: 19999 - RNA, 22 nt, Homo sapiens
ugaaguguuuuuucaggcaugu

SEQ ID NO: 20000 - RNA, 22 nt, Homo sapiens
ugaauacuucaaaaaaauagcu

SEQ ID NO: 20001 - RNA, 22 nt, Homo sapiens
ugaauagaaguggcaggaguag

SEQ ID NO: 20002 - RNA, 22 nt, Homo sapiens
ugaaucauuucuugucuucagu

SEQ ID NO: 20003 - RNA, 21 nt, Homo sapiens
ugaaugucuaggcagaaguuu

SEQ ID NO: 20004 - RNA, 22 nt, Homo sapiens
ugaauucuguccaaaauaacug

SEQ ID NO: 20005 - RNA, 22 nt, Homo sapiens
ugaauuguuucauucuuuacau

SEQ ID NO: 20006 - RNA, 18 nt, Homo sapiens
ugacaaugcuaguccugg

SEQ ID NO: 20007 - RNA, 22 nt, Homo sapiens
ugacacagugggggauccuuuu

SEQ ID NO: 20008 - RNA, 17 nt, Homo sapiens
ugacagaaacuuguugu

SEQ ID NO: 20009 - RNA, 22 nt, Homo sapiens
ugacagcugaagauguugaacc

SEQ ID NO: 20010 - RNA, 22 nt, Homo sapiens
ugacaggauggagaucgguauu

SEQ ID NO: 20011 - RNA, 22 nt, Homo sapiens
ugacaguaaacagucuugauua

SEQ ID NO: 20012 - RNA, 23 nt, Homo sapiens
ugacagucucccgauggcuaggc

SEQ ID NO: 20013 - RNA, 22 nt, Homo sapiens
ugacaguguccuccuccugaga

SEQ ID NO: 20014 - RNA, 22 nt, Homo sapiens
ugacaucaccaccuccgucauc

SEQ ID NO: 20015 - RNA, 22 nt, Homo sapiens
ugacauggagagagaagccuuu

SEQ ID NO: 20016 - RNA, 22 nt, Homo sapiens
ugacauggagguggaggaagau

SEQ ID NO: 20017 - RNA, 22 nt, Homo sapiens
ugacauguauaucuuacgcuau

SEQ ID NO: 20018 - RNA, 22 nt, Homo sapiens
ugaccacugucuaagauaggug

SEQ ID NO: 20019 - RNA, 22 nt, Homo sapiens
ugacuaggaaauuagaacuuuu

SEQ ID NO: 20020 - RNA, 22 nt, Homo sapiens
ugacuagucauaggcauggggg

SEQ ID NO: 20021 - RNA, 22 nt, Homo sapiens
ugacuauaaauaagcaagggcu

SEQ ID NO: 20022 - RNA, 22 nt, Homo sapiens
ugagaacagauggcuuuauuau

SEQ ID NO: 20023 - RNA, 16 nt, Homo sapiens
ugagaacaugcagcau

SEQ ID NO: 20024 - RNA, 22 nt, Homo sapiens
ugagaaccucugugugcccacu

SEQ ID NO: 20025 - RNA, 22 nt, Homo sapiens
ugagaacugccuguauuuaucu

SEQ ID NO: 20026 - RNA, 22 nt, Homo sapiens
ugagaagaugaacuccuugguc

SEQ ID NO: 20027 - RNA, 22 nt, Homo sapiens
ugagaagugacgcagcaggguu

SEQ ID NO: 20028 - RNA, 22 nt, Homo sapiens
ugagaauauuugaagauguuag

SEQ ID NO: 20029 - RNA, 22 nt, Homo sapiens
ugagaaugaugauuuccaguuu

SEQ ID NO: 20030 - RNA, 19 nt, Homo sapiens
ugagaauguuaccaggucc

SEQ ID NO: 20031 - RNA, 22 nt, Homo sapiens
ugagacauauuauacugcuuuu

SEQ ID NO: 20032 - RNA, 23 nt, Homo sapiens
ugagacauuggaaaguuaggcag

SEQ ID NO: 20033 - RNA, 22 nt, Homo sapiens
ugagacggagucucgcucuguu

SEQ ID NO: 20034 - RNA, 22 nt, Homo sapiens
ugagacggagucuugcucuguc

SEQ ID NO: 20035 - RNA, 22 nt, Homo sapiens
ugagauagaaaacauaggagaa

SEQ ID NO: 20036 - RNA, 22 nt, Homo sapiens
ugagaucagaaggauuucucug

SEQ ID NO: 20037 - RNA, 19 nt, Homo sapiens
ugagauccacugaagauuc

SEQ ID NO: 20038 - RNA, 22 nt, Homo sapiens
ugagaucuucgcucuucacaga

SEQ ID NO: 20039 - RNA, 22 nt, Homo sapiens
ugagaucuuggaggcuuuguga

SEQ ID NO: 20040 - RNA, 22 nt, Homo sapiens
ugagaugaguugcuggcucuga

SEQ ID NO: 20041 - RNA, 22 nt, Homo sapiens
ugagaugaugggauaagagggc

SEQ ID NO: 20042 - RNA, 22 nt, Homo sapiens
ugagauggaucuuggauuugaa

SEQ ID NO: 20043 - RNA, 22 nt, Homo sapiens
ugagauggcuuuauugcugaau

SEQ ID NO: 20044 - RNA, 22 nt, Homo sapiens
ugagaugugugcauucaacuca

SEQ ID NO: 20045 - RNA, 22 nt, Homo sapiens
ugagauguuccaaugacuauua

SEQ ID NO: 20046 - RNA, 22 nt, Homo sapiens
uuagguaauauauugcugcuuu

SEQ ID NO: 20047 - RNA, 20 nt, Homo sapiens
uuaguucauuuagaagguuu

SEQ ID NO: 20048 - RNA, 22 nt, Homo sapiens
uuaucaaacccuaggagguggu

SEQ ID NO: 20049 - RNA, 22 nt, Homo sapiens
uuaugacauugacaguuuuuag

SEQ ID NO: 20050 - RNA, 22 nt, Homo sapiens
uuaugcagcaaagugcuugaaa

SEQ ID NO: 20051 - RNA, 22 nt, Homo sapiens
uuauuagagauauuugguuagg

SEQ ID NO: 20052 - RNA, 22 nt, Homo sapiens
uuauucagcaccugcuguguuc

SEQ ID NO: 20053 - RNA, 22 nt, Homo sapiens
uuauucauuaauugcuaagguu

SEQ ID NO: 20054 - RNA, 22 nt, Homo sapiens
uucaagcugggcaaauaagggg

SEQ ID NO: 20055 - RNA, 22 nt, Homo sapiens
uucaaggacuaaggauuuuugg

SEQ ID NO: 20056 - RNA, 22 nt, Homo sapiens
uucaagucaaggaaagaggucu

SEQ ID NO: 20057 - RNA, 22 nt, Homo sapiens
uucaauuaauauuauacucuca

SEQ ID NO: 20058 - RNA, 22 nt, Homo sapiens
uucacacugggccuacucugug

SEQ ID NO: 20059 - RNA, 22 nt, Homo sapiens
agaccacuuuagagauuguuca

SEQ ID NO: 20060 - RNA, 22 nt, Homo sapiens
agacucauuuccauagucagcu

SEQ ID NO: 20061 - RNA, 22 nt, Homo sapiens
agacuguaaugcauaauuuacu

SEQ ID NO: 20062 - RNA, 22 nt, Homo sapiens
agagauaaagauuuuaauuuug

SEQ ID NO: 20063 - RNA, 22 nt, Homo sapiens
agagauaguuuccaacucauac

SEQ ID NO: 20064 - RNA, 22 nt, Homo sapiens
agagguaugccugggcuggagc

SEQ ID NO: 20065 - RNA, 22 nt, Homo sapiens
agagugcaaagguuggggcugg

SEQ ID NO: 20066 - RNA, 22 nt, Homo sapiens
agauacaucuaugugucugugu

SEQ ID NO: 20067 - RNA, 22 nt, Homo sapiens
agaucauaugcaguaaugaacu

SEQ ID NO: 20068 - RNA, 23 nt, Homo sapiens
agauggcauuucaguucuuuagg

SEQ ID NO: 20069 - RNA, 22 nt, Homo sapiens
agaugguauuauagguuucugu

SEQ ID NO: 20070 - RNA, 18 nt, Homo sapiens
agaugguguugcuucugu

SEQ ID NO: 20071 - RNA, 23 nt, Homo sapiens
agcaaaugcucuagcacuccaac

SEQ ID NO: 20072 - RNA, 22 nt, Homo sapiens
agcacauauauuucccaaaaca

SEQ ID NO: 20073 - RNA, 22 nt, Homo sapiens
agcaccacauacuacagagaua

SEQ ID NO: 20074 - RNA, 22 nt, Homo sapiens
agcaccauuguacuccagccug

SEQ ID NO: 20075 - RNA, 19 nt, Homo sapiens
agcagaacaaauguguggg

SEQ ID NO: 20076 - RNA, 22 nt, Homo sapiens
agcagagcauauucauucgggg

SEQ ID NO: 20077 - RNA, 21 nt, Homo sapiens
agcagaguggcagcucuuuug

SEQ ID NO: 20078 - RNA, 22 nt, Homo sapiens
agcagcaugcaaauggacuaau

SEQ ID NO: 20079 - RNA, 22 nt, Homo sapiens
agcagguguccacaauguuugc

SEQ ID NO: 20080 - RNA, 22 nt, Homo sapiens
agcaucacaugggcugcuuggg

SEQ ID NO: 20081 - RNA, 22 nt, Homo sapiens
agcaucauaccaaucugguccu

SEQ ID NO: 20082 - RNA, 22 nt, Homo sapiens
agcauuacaugguacagagaag

SEQ ID NO: 20083 - RNA, 22 nt, Homo sapiens
agccaguuuggcuaauuuuggc

SEQ ID NO: 20084 - RNA, 22 nt, Homo sapiens
agccauacaacguaugcaugua

SEQ ID NO: 20085 - RNA, 22 nt, Homo sapiens
agcuccaucuucagggguucag

SEQ ID NO: 20086 - RNA, 22 nt, Homo sapiens
agcuccaugauaguaugucugu

SEQ ID NO: 20087 - RNA, 22 nt, Homo sapiens
agcuccauuguaaucaccuggu

SEQ ID NO: 20088 - RNA, 22 nt, Homo sapiens
cuagcagacaggcugggagcag

SEQ ID NO: 20089 - RNA, 22 nt, Homo sapiens
cuauauacugccugcugauuag

SEQ ID NO: 20090 - RNA, 22 nt, Homo sapiens
cuaugcuucuuaaauuaguuau

SEQ ID NO: 20091 - RNA, 22 nt, Homo sapiens
cuauuugcauucagaggcaugu

SEQ ID NO: 20092 - RNA, 18 nt, Homo sapiens
cucaaccucaugcagggc

SEQ ID NO: 20093 - RNA, 22 nt, Homo sapiens
cucaaguagugguuuucauuga

SEQ ID NO: 20094 - RNA, 22 nt, Homo sapiens
cucacaguucuaaaggcaagaa

SEQ ID NO: 20095 - RNA, 20 nt, Homo sapiens
cucaccagguguaggcugag

SEQ ID NO: 20096 - RNA, 22 nt, Homo sapiens
cucaccuugugauccuccugcc

SEQ ID NO: 20097 - RNA, 22 nt, Homo sapiens
cucacugcauuucaguuuuguu

SEQ ID NO: 20098 - RNA, 22 nt, Homo sapiens
cucacugggaccacucugaagu

SEQ ID NO: 20099 - RNA, 22 nt, Homo sapiens
cucaguguuaaggccaccucug

SEQ ID NO: 20100 - RNA, 22 nt, Homo sapiens
cucaguguucccauucuaccuu

SEQ ID NO: 20101 - RNA, 22 nt, Homo sapiens
cucaguuuugccuuguuuaagg

SEQ ID NO: 20102 - RNA, 22 nt, Homo sapiens
cucauggaauacuucacagcca

SEQ ID NO: 20103 - RNA, 22 nt, Homo sapiens
cucauggagaaccucugcuagg

SEQ ID NO: 20104 - RNA, 22 nt, Homo sapiens
cuccaggugucauccaccuccu

SEQ ID NO: 20105 - RNA, 23 nt, Homo sapiens
cucccugaacaugacacaccaga

SEQ ID NO: 20106 - RNA, 20 nt, Homo sapiens
cucccugacaaauguggaaa

SEQ ID NO: 20107 - RNA, 22 nt, Homo sapiens
cuccuguagccccaucaucuuu

SEQ ID NO: 20108 - RNA, 20 nt, Homo sapiens
cuccuucauuccuuuggacc

SEQ ID NO: 20109 - RNA, 22 nt, Homo sapiens
cucucaagaugcugggauuaca

SEQ ID NO: 20110 - RNA, 22 nt, Homo sapiens
cucucugagccccagacaccuu

SEQ ID NO: 20111 - RNA, 21 nt, Homo sapiens
cucucugcuuaugaauaguga

SEQ ID NO: 20112 - RNA, 22 nt, Homo sapiens
cucucuguuugucuguuauugg

SEQ ID NO: 20113 - RNA, 22 nt, Homo sapiens
cucugacagugguuagcacugu

SEQ ID NO: 20114 - RNA, 22 nt, Homo sapiens
cugaaaguuauucaggggcaag

SEQ ID NO: 20115 - RNA, 22 nt, Homo sapiens
cugaaggcagguagaauagaga

SEQ ID NO: 20116 - RNA, 22 nt, Homo sapiens
cugacauggggauccaccuuag

SEQ ID NO: 20117 - RNA, 22 nt, Homo sapiens
cugacauuguugaucacagcca

SEQ ID NO: 20118 - RNA, 22 nt, Homo sapiens
cugacugaggaucaguucauca

SEQ ID NO: 20119 - RNA, 22 nt, Homo sapiens
cugacugugcaugcccagcccc

SEQ ID NO: 20120 - RNA, 22 nt, Homo sapiens
cugagaaugaugauuuccaguu

SEQ ID NO: 20121 - RNA, 22 nt, Homo sapiens
cugagaguugaugaaauauggu

SEQ ID NO: 20122 - RNA, 22 nt, Homo sapiens
cugagcacugagauccucuagc

SEQ ID NO: 20123 - RNA, 22 nt, Homo sapiens
cugagcaugacaucaugugacu

SEQ ID NO: 20124 - RNA, 22 nt, Homo sapiens
cugaggacaucagggaagcauc

SEQ ID NO: 20125 - RNA, 22 nt, Homo sapiens
cugagguacccacuucaucuca

SEQ ID NO: 20126 - RNA, 22 nt, Homo sapiens
cugagguacugggggccaggau

SEQ ID NO: 20127 - RNA, 22 nt, Homo sapiens
cugagguuguucuucucagugg

SEQ ID NO: 20128 - RNA, 22 nt, Homo sapiens
cugauauuuuaaaauuggcugg

SEQ ID NO: 20129 - RNA, 22 nt, Homo sapiens
cugaucuaugaacacaggauau

SEQ ID NO: 20130 - RNA, 22 nt, Homo sapiens
cugauuguagagccccagggcu

SEQ ID NO: 20131 - RNA, 22 nt, Homo sapiens
cugcaaauacuugugggauuuu

SEQ ID NO: 20132 - RNA, 21 nt, Homo sapiens
cugcaaaugcugcugccugau

SEQ ID NO: 20133 - RNA, 22 nt, Homo sapiens
cugcaagaaucguaguauuuga

SEQ ID NO: 20134 - RNA, 19 nt, Homo sapiens
cugcaagguaauaggucag

SEQ ID NO: 20135 - RNA, 22 nt, Homo sapiens
cuggaaagcaaagggugcauug

SEQ ID NO: 20136 - RNA, 22 nt, Homo sapiens
cuggauagagauugaugaugcu

SEQ ID NO: 20137 - RNA, 22 nt, Homo sapiens
cuggcagucugccucuucacug

SEQ ID NO: 20138 - RNA, 22 nt, Homo sapiens
cuggcucugagguguuuagggc

SEQ ID NO: 20139 - RNA, 22 nt, Homo sapiens
cuggcucuguuagaagaaccag

SEQ ID NO: 20140 - RNA, 22 nt, Homo sapiens
cugggcaaugcggcuggauaga

SEQ ID NO: 20141 - RNA, 21 nt, Homo sapiens
cugguccccuuuauguaugug

SEQ ID NO: 20142 - RNA, 22 nt, Homo sapiens
cuggugugugacuuuucauuau

SEQ ID NO: 20143 - RNA, 22 nt, Homo sapiens
cugucacuggggcacauguccc

SEQ ID NO: 20144 - RNA, 22 nt, Homo sapiens
cugucucagccucuccaguagc

SEQ ID NO: 20145 - RNA, 22 nt, Homo sapiens
cugucuggaguccuucgugugc

SEQ ID NO: 20146 - RNA, 22 nt, Homo sapiens
cugugccaagcuugcgaugugc

SEQ ID NO: 20147 - RNA, 22 nt, Homo sapiens
cugugguauuauuagaaauauc

SEQ ID NO: 20148 - RNA, 22 nt, Homo sapiens
cuguguaguacuagauugagca

SEQ ID NO: 20149 - RNA, 22 nt, Homo sapiens
cuguucaggaggcauuuggugg

SEQ ID NO: 20150 - RNA, 22 nt, Homo sapiens
cuguuugaggguuugcuuucag

SEQ ID NO: 20151 - RNA, 22 nt, Homo sapiens
cuguuuguuuaggguacucaga

SEQ ID NO: 20152 - RNA, 22 nt, Homo sapiens
cuuaaugcuacggcucuguguu

SEQ ID NO: 20153 - RNA, 22 nt, Homo sapiens
cuuagcaugucagcaccggguu

SEQ ID NO: 20154 - RNA, 22 nt, Homo sapiens
cuucaaguguggccaccugacc

SEQ ID NO: 20155 - RNA, 22 nt, Homo sapiens
cuuccagcuggguucagucagu

SEQ ID NO: 20156 - RNA, 22 nt, Homo sapiens
cuucuguuaguucugauaacuu

SEQ ID NO: 20157 - RNA, 20 nt, Homo sapiens
cuugaagacuaugcugcuga

SEQ ID NO: 20158 - RNA, 22 nt, Homo sapiens
cuugaccaauauggugaaaccc

SEQ ID NO: 20159 - RNA, 22 nt, Homo sapiens
gugagacugguucugaacccag

SEQ ID NO: 20160 - RNA, 22 nt, Homo sapiens
gugagagaaugacuauguguuu

SEQ ID NO: 20161 - RNA, 22 nt, Homo sapiens
gugagauggaguuggugucuuu

SEQ ID NO: 20162 - RNA, 22 nt, Homo sapiens
gugagaugguaucucauugugg

SEQ ID NO: 20163 - RNA, 22 nt, Homo sapiens
gugagauuuucuccagguucag

SEQ ID NO: 20164 - RNA, 19 nt, Homo sapiens
gugagcacagacaauacaa

SEQ ID NO: 20165 - RNA, 22 nt, Homo sapiens
gugagcgaggaaacgacggcgc

SEQ ID NO: 20166 - RNA, 22 nt, Homo sapiens
gugaggaaggaaaccugcuagc

SEQ ID NO: 20167 - RNA, 20 nt, Homo sapiens
gugagguagaggguuaccug

SEQ ID NO: 20168 - RNA, 21 nt, Homo sapiens
gugaggucauugggcuuucug

SEQ ID NO: 20169 - RNA, 22 nt, Homo sapiens
gugaguggacgugaccaauaaa

SEQ ID NO: 20170 - RNA, 23 nt, Homo sapiens
gugaucauuguuguggguugaau

SEQ ID NO: 20171 - RNA, 22 nt, Homo sapiens
gugaucuuucaggcuugaccau

SEQ ID NO: 20172 - RNA, 22 nt, Homo sapiens
gugcaaaucucugaguaucuuu

SEQ ID NO: 20173 - RNA, 22 nt, Homo sapiens
gugcaaguguaauacagcuagg

SEQ ID NO: 20174 - RNA, 22 nt, Homo sapiens
gugcaaugagaaggggcucugg

SEQ ID NO: 20175 - RNA, 22 nt, Homo sapiens
gugcacaacgugcagguuaguu

SEQ ID NO: 20176 - RNA, 22 nt, Homo sapiens
gugcacaugguagguauugagu

SEQ ID NO: 20177 - RNA, 22 nt, Homo sapiens
gugcacuguagaacccuuuguu

SEQ ID NO: 20178 - RNA, 23 nt, Homo sapiens
gugcaguggcgagauuucggcuc

SEQ ID NO: 20179 - RNA, 22 nt, Homo sapiens
gugcaguuuuaagugaguuucu

SEQ ID NO: 20180 - RNA, 22 nt, Homo sapiens
gugcaguuuugagugaguuucu

SEQ ID NO: 20181 - RNA, 22 nt, Homo sapiens
gugcaugcaucuuuauaguagc

SEQ ID NO: 20182 - RNA, 22 nt, Homo sapiens
gugcccacugucuguccuguag

SEQ ID NO: 20183 - RNA, 23 nt, Homo sapiens
gugccuucugagccuagucucca

SEQ ID NO: 20184 - RNA, 22 nt, Homo sapiens
guggaaaucucugugugacuua

SEQ ID NO: 20185 - RNA, 22 nt, Homo sapiens
guggaagugucuggggccaggg

SEQ ID NO: 20186 - RNA, 22 nt, Homo sapiens
guggaauggaaugauuguguau

SEQ ID NO: 20187 - RNA, 17 nt, Homo sapiens
guggaaugucaugucaa

SEQ ID NO: 20188 - RNA, 22 nt, Homo sapiens
guggacaugaauuuuggaggca

SEQ ID NO: 20189 - RNA, 22 nt, Homo sapiens
guggagacaaaggcugagugag

SEQ ID NO: 20190 - RNA, 22 nt, Homo sapiens
guggaggagaaagaagcauuuc

SEQ ID NO: 20191 - RNA, 22 nt, Homo sapiens
guggcagaacagguaggguucu

SEQ ID NO: 20192 - RNA, 22 nt, Homo sapiens
guggcaguuuuaaauaugaaaa

SEQ ID NO: 20193 - RNA, 22 nt, Homo sapiens
guggcuaaagauuuggaaucug

SEQ ID NO: 20194 - RNA, 22 nt, Homo sapiens
guggcuauuguucccugguugc

SEQ ID NO: 20195 - RNA, 20 nt, Homo sapiens
gugggcaaauccuuuccucu

SEQ ID NO: 20196 - RNA, 22 nt, Homo sapiens
ggaucacuugagaccaggaguu

SEQ ID NO: 20197 - RNA, 23 nt, Homo sapiens
ggauucaucuguuuguucgcugu

SEQ ID NO: 20198 - RNA, 22 nt, Homo sapiens
ggauugcuuaagaaguuucauu

SEQ ID NO: 20199 - RNA, 22 nt, Homo sapiens
ggcaaaugaagauggagaggcu

SEQ ID NO: 20200 - RNA, 20 nt, Homo sapiens
ggcaagacccaaagugugug

SEQ ID NO: 20201 - RNA, 22 nt, Homo sapiens
ggcaagaucuuggcucacugaa

SEQ ID NO: 20202 - RNA, 22 nt, Homo sapiens
ggcaaggauguuuuucuggcaa

SEQ ID NO: 20203 - RNA, 19 nt, Homo sapiens
ggcacugugugagugagga

SEQ ID NO: 20204 - RNA, 22 nt, Homo sapiens
ggcagcucaggccccgcgcuga

SEQ ID NO: 20205 - RNA, 22 nt, Homo sapiens
ggcagcuguguccuucguaagg

SEQ ID NO: 20206 - RNA, 22 nt, Homo sapiens
ggcaguuuggcaguuucauaaa

SEQ ID NO: 20207 - RNA, 22 nt, Homo sapiens
ggcaguuuguuugugaggucca

SEQ ID NO: 20208 - RNA, 22 nt, Homo sapiens
ggcccugagacaggaaaaagcu

SEQ ID NO: 20209 - RNA, 22 nt, Homo sapiens
ggcgguguccuccaagugcuuc

SEQ ID NO: 20210 - RNA, 22 nt, Homo sapiens
ggcucaguuuccuccgucugcu

SEQ ID NO: 20211 - RNA, 22 nt, Homo sapiens
ggcuguguguuaaaauaggcuu

SEQ ID NO: 20212 - RNA, 22 nt, Homo sapiens
ggcuuuggucacacaggggcaa

SEQ ID NO: 20213 - RNA, 22 nt, Homo sapiens
gggaggucauuguaaggucuua

SEQ ID NO: 20214 - RNA, 22 nt, Homo sapiens
gggagguuguauguaugcgggg

SEQ ID NO: 20215 - RNA, 22 nt, Homo sapiens
gggagugugcacacaugguaua

SEQ ID NO: 20216 - RNA, 22 nt, Homo sapiens
gggcaacauugaguacccugaa

SEQ ID NO: 20217 - RNA, 22 nt, Homo sapiens
gggugguuuuauuaucagugac

SEQ ID NO: 20218 - RNA, 22 nt, Homo sapiens
gguaucuuggagagagaaguga

SEQ ID NO: 20219 - RNA, 22 nt, Homo sapiens
ggucauagagaauucaccagga

SEQ ID NO: 20220 - RNA, 22 nt, Homo sapiens
ggugagaaagggauuccuguuc

SEQ ID NO: 20221 - RNA, 19 nt, Homo sapiens
ggugagaaauuaugggucu

SEQ ID NO: 20222 - RNA, 23 nt, Homo sapiens
ggugaggaguacagagucuucau

SEQ ID NO: 20223 - RNA, 22 nt, Homo sapiens
guaaauaccaguuucuggaaca

SEQ ID NO: 20224 - RNA, 22 nt, Homo sapiens
guaacccuguaggccuaaagua

SEQ ID NO: 20225 - RNA, 22 nt, Homo sapiens
guaagagcauguaguggcucua

SEQ ID NO: 20226 - RNA, 22 nt, Homo sapiens
guaagugguagagcugggcuau

SEQ ID NO: 20227 - RNA, 19 nt, Homo sapiens
guaaucucaguacuuuggu

SEQ ID NO: 20228 - RNA, 22 nt, Homo sapiens
guacaugcaugcaugggugugc

SEQ ID NO: 20229 - RNA, 22 nt, Homo sapiens
guacauguaugcaugcaugcau

SEQ ID NO: 20230 - RNA, 22 nt, Homo sapiens
guagaagcacagggccuguauu

SEQ ID NO: 20231 - RNA, 22 nt, Homo sapiens
guagaagcacaggugaguuggu

SEQ ID NO: 20232 - RNA, 22 nt, Homo sapiens
guaguuuaucagaaagaauagg

SEQ ID NO: 20233 - RNA, 22 nt, Homo sapiens
guauacaguugacccuugaacc

SEQ ID NO: 20234 - RNA, 22 nt, Homo sapiens
guauagaucguagaccaauaaa

SEQ ID NO: 20235 - RNA, 22 nt, Homo sapiens
guauagcacauaauacuugaug

SEQ ID NO: 20236 - RNA, 22 nt, Homo sapiens
guaugacacaggaagcuuaacc

SEQ ID NO: 20237 - RNA, 22 nt, Homo sapiens
guauggcacuauccucucugau

SEQ ID NO: 20238 - RNA, 22 nt, Homo sapiens
guaugucuuuauagcagugugg

SEQ ID NO: 20239 - RNA, 22 nt, Homo sapiens
guauuugauuauagcaugcuua

SEQ ID NO: 20240 - RNA, 22 nt, Homo sapiens
guauuuguugcagcagcacuau

SEQ ID NO: 20241 - RNA, 22 nt, Homo sapiens
gucacauugaugcccauggugg

SEQ ID NO: 20242 - RNA, 22 nt, Homo sapiens
gucacugacaagagagaagaac

SEQ ID NO: 20243 - RNA, 22 nt, Homo sapiens
gucacugccugaggcugaugca

SEQ ID NO: 20244 - RNA, 22 nt, Homo sapiens
gucacugggugcugcgccuguc

SEQ ID NO: 20245 - RNA, 22 nt, Homo sapiens
gucagagcacugaguugugggc

SEQ ID NO: 20246 - RNA, 22 nt, Homo sapiens
gucagcaaaguucuccugcaga

SEQ ID NO: 20247 - RNA, 22 nt, Homo sapiens
gucagggagggauagaugauua

SEQ ID NO: 20248 - RNA, 22 nt, Homo sapiens
gucaguggauacugucucuguc

SEQ ID NO: 20249 - RNA, 22 nt, Homo sapiens
gucaguuucacucagcuggaac

SEQ ID NO: 20250 - RNA, 22 nt, Homo sapiens
gucaugaacuguacuacuccua

SEQ ID NO: 20251 - RNA, 22 nt, Homo sapiens
gucauguuuaacuucuugagga

SEQ ID NO: 20252 - RNA, 21 nt, Homo sapiens
guccaaaacaguguccaaugc

SEQ ID NO: 20253 - RNA, 22 nt, Homo sapiens
gucccugaggaacauccagggc

SEQ ID NO: 20254 - RNA, 22 nt, Homo sapiens
guccugaagaccuuccucugga

SEQ ID NO: 20255 - RNA, 22 nt, Homo sapiens
gucucugguugcuuuuguacca

SEQ ID NO: 20256 - RNA, 22 nt, Homo sapiens
gucugagcauggggccggcagg

SEQ ID NO: 20257 - RNA, 22 nt, Homo sapiens
gucuggcaauggcagacuggca

SEQ ID NO: 20258 - RNA, 21 nt, Homo sapiens
gucugguguuuuaaugaggac

SEQ ID NO: 20259 - RNA, 22 nt, Homo sapiens
gucugucuuuugucuuugaaau

SEQ ID NO: 20260 - RNA, 21 nt, Homo sapiens
gucuuacagccagaugccucu

SEQ ID NO: 20261 - RNA, 22 nt, Homo sapiens
gucuuuguuuggucuguaucag

SEQ ID NO: 20262 - RNA, 22 nt, Homo sapiens
gugaaacuggguggugagagac

SEQ ID NO: 20263 - RNA, 22 nt, Homo sapiens
gugaaagacagcauuaauggcu

SEQ ID NO: 20264 - RNA, 22 nt, Homo sapiens
gugaaagcaucugacugugcca

SEQ ID NO: 20265 - RNA, 22 nt, Homo sapiens
gugaaguuuuuugcugagaguc

SEQ ID NO: 20266 - RNA, 22 nt, Homo sapiens
gugaauugagagaacuguguua

SEQ ID NO: 20267 - RNA, 22 nt, Homo sapiens
cuugaccuauggaucuguuuuu

SEQ ID NO: 20268 - RNA, 22 nt, Homo sapiens
cuugagcuugagauccuuucug

SEQ ID NO: 20269 - RNA, 22 nt, Homo sapiens
cuugcacuccacuguucuccug

SEQ ID NO: 20270 - RNA, 22 nt, Homo sapiens
cuugcagaggcccuggggagag

SEQ ID NO: 20271 - RNA, 22 nt, Homo sapiens
cuuggacaccucaugcccaccu

SEQ ID NO: 20272 - RNA, 22 nt, Homo sapiens
cuuggcacugcucacccuccuu

SEQ ID NO: 20273 - RNA, 22 nt, Homo sapiens
cuuggcauugccccuggaauuu

SEQ ID NO: 20274 - RNA, 22 nt, Homo sapiens
cuuuacaguuggacucacgagg

SEQ ID NO: 20275 - RNA, 21 nt, Homo sapiens
cuuuaugcuguguuagaaaag

SEQ ID NO: 20276 - RNA, 22 nt, Homo sapiens
cuuucucagugagacccgagau

SEQ ID NO: 20277 - RNA, 22 nt, Homo sapiens
cuuuggcacuuccuaagugcca

SEQ ID NO: 20278 - RNA, 22 nt, Homo sapiens
cuuuguguggacauuucaggca

SEQ ID NO: 20279 - RNA, 22 nt, Homo sapiens
cuuuuacacuguuggcaggauu

SEQ ID NO: 20280 - RNA, 22 nt, Homo sapiens
cuuuuggugugaagaagcucuu

SEQ ID NO: 20281 - RNA, 22 nt, Homo sapiens
cuuuugugauuccucaguuacu

SEQ ID NO: 20282 - RNA, 22 nt, Homo sapiens
cuuuuguggaucuucuguugcu

SEQ ID NO: 20283 - RNA, 22 nt, Homo sapiens
gaaaauccauccccagggagua

SEQ ID NO: 20284 - RNA, 22 nt, Homo sapiens
gaaagcugguauagauacauua

SEQ ID NO: 20285 - RNA, 21 nt, Homo sapiens
gaaauacugccuuaggagcug

SEQ ID NO: 20286 - RNA, 22 nt, Homo sapiens
gaaaugcucagggguuuuccag

SEQ ID NO: 20287 - RNA, 22 nt, Homo sapiens
gaaauggaucagagcaagcuuu

SEQ ID NO: 20288 - RNA, 22 nt, Homo sapiens
gaacuguaaagaaauucuaagg

SEQ ID NO: 20289 - RNA, 22 nt, Homo sapiens
gaagaucacacuguagaucuau

SEQ ID NO: 20290 - RNA, 22 nt, Homo sapiens
gaagcgaggugauuagcagaca

SEQ ID NO: 20291 - RNA, 22 nt, Homo sapiens
gaaggcaugcugcauggccaga

SEQ ID NO: 20292 - RNA, 22 nt, Homo sapiens
gaagguaguuuauagauguggu

SEQ ID NO: 20293 - RNA, 22 nt, Homo sapiens
gaaggugcuuggugaaugcauu

SEQ ID NO: 20294 - RNA, 17 nt, Homo sapiens
gaaguguuucuucauga

SEQ ID NO: 20295 - RNA, 22 nt, Homo sapiens
gaaucacagauuaugaguaucu

SEQ ID NO: 20296 - RNA, 22 nt, Homo sapiens
gaaucacaguuauuagagcagc

SEQ ID NO: 20297 - RNA, 22 nt, Homo sapiens
gaaucccuugcauuaucccuuu

SEQ ID NO: 20298 - RNA, 22 nt, Homo sapiens
gaaugugcuguuggcugggcgu

SEQ ID NO: 20299 - RNA, 22 nt, Homo sapiens
gaauucugucgcuuacuagaug

SEQ ID NO: 20300 - RNA, 22 nt, Homo sapiens
gaauuguacugcaaucagggga

SEQ ID NO: 20301 - RNA, 22 nt, Homo sapiens
gacacagugaagucucuacuug

SEQ ID NO: 20302 - RNA, 22 nt, Homo sapiens
gacagugugauacuuagucuca

SEQ ID NO: 20303 - RNA, 20 nt, Homo sapiens
gacaugacuaggagauagcc

SEQ ID NO: 20304 - RNA, 22 nt, Homo sapiens
gugugacagcuauagacaugau

SEQ ID NO: 20305 - RNA, 22 nt, Homo sapiens
gugugauuguuaauuuuaggug

SEQ ID NO: 20306 - RNA, 21 nt, Homo sapiens
gugugcuugaauucagcuguc

SEQ ID NO: 20307 - RNA, 22 nt, Homo sapiens
guguugcacauucuguggaugu

SEQ ID NO: 20308 - RNA, 22 nt, Homo sapiens
guguuugauugcaaauaaucua

SEQ ID NO: 20309 - RNA, 22 nt, Homo sapiens
guuaagaaguguaacuuaaguu

SEQ ID NO: 20310 - RNA, 22 nt, Homo sapiens
guuacugucuuccugauugcuu

SEQ ID NO: 20311 - RNA, 22 nt, Homo sapiens
guuauguuaguuacaaggcuag

SEQ ID NO: 20312 - RNA, 22 nt, Homo sapiens
guuauguuauguuauguuaugu

SEQ ID NO: 20313 - RNA, 21 nt, Homo sapiens
guucaagugauccuccugucu

SEQ ID NO: 20314 - RNA, 22 nt, Homo sapiens
guucacaguuucuaaucccagc

SEQ ID NO: 20315 - RNA, 22 nt, Homo sapiens
guucaguaguucauucauuuau

SEQ ID NO: 20316 - RNA, 20 nt, Homo sapiens
guucauguaauuaguucagg

SEQ ID NO: 20317 - RNA, 22 nt, Homo sapiens
guucucacuggugcugguaagu

SEQ ID NO: 20318 - RNA, 22 nt, Homo sapiens
guugagcaagcuuuggagccua

SEQ ID NO: 20319 - RNA, 22 nt, Homo sapiens
guugcucaggccggagugcagu

SEQ ID NO: 20320 - RNA, 22 nt, Homo sapiens
guuggcuguuucccccaaguga

SEQ ID NO: 20321 - RNA, 22 nt, Homo sapiens
guuuaacugguacuucaagucu

SEQ ID NO: 20322 - RNA, 22 nt, Homo sapiens
uaaacugucuugcaguuacaug

SEQ ID NO: 20323 - RNA, 22 nt, Homo sapiens
uaaagcuacagagcggaaaauu

SEQ ID NO: 20324 - RNA, 22 nt, Homo sapiens
uaaagcuagaauuguuccagca

SEQ ID NO: 20325 - RNA, 22 nt, Homo sapiens
uaaagcuaucacauuggugauu

SEQ ID NO: 20326 - RNA, 22 nt, Homo sapiens
uaaagcuaugagaacaccguag

SEQ ID NO: 20327 - RNA, 22 nt, Homo sapiens
uaaagcuuggauuuaggcuaau

SEQ ID NO: 20328 - RNA, 18 nt, Homo sapiens
uaaaggcacuguguuguu

SEQ ID NO: 20329 - RNA, 22 nt, Homo sapiens
uaaaguuauugccccucaguua

SEQ ID NO: 20330 - RNA, 22 nt, Homo sapiens
uaacagcucuacagcugcucuu

SEQ ID NO: 20331 - RNA, 22 nt, Homo sapiens
uaacaggcaaggucacaccuug

SEQ ID NO: 20332 - RNA, 22 nt, Homo sapiens
uaacagucaagguuugaccagg

SEQ ID NO: 20333 - RNA, 20 nt, Homo sapiens
uaagccacacagucuaaggu

SEQ ID NO: 20334 - RNA, 22 nt, Homo sapiens
uaagcuaauguguuuucucuua

SEQ ID NO: 20335 - RNA, 22 nt, Homo sapiens
uaaggcuugaucuuggugagau

SEQ ID NO: 20336 - RNA, 22 nt, Homo sapiens
uaaggcuugcuucagucuugaa

SEQ ID NO: 20337 - RNA, 22 nt, Homo sapiens
uaaguauuaugugcugcauuuu

SEQ ID NO: 20338 - RNA, 18 nt, Homo sapiens
uaauaacugugaccuuga

SEQ ID NO: 20339 - RNA, 22 nt, Homo sapiens
uaauacuugucauaaaggcauu

SEQ ID NO: 20340 - RNA, 22 nt, Homo sapiens
uacaaagcuuucugcaaaucau

SEQ ID NO: 20341 - RNA, 22 nt, Homo sapiens
uacagcacugugcauagugguu

SEQ ID NO: 20342 - RNA, 19 nt, Homo sapiens
uacaggacugagcugaggu

SEQ ID NO: 20343 - RNA, 22 nt, Homo sapiens
uacaggcaccuggcuaauuuuu

SEQ ID NO: 20344 - RNA, 22 nt, Homo sapiens
uacaggcagguguucccugguu

SEQ ID NO: 20345 - RNA, 22 nt, Homo sapiens
uacaguccaugcauuauccucc

SEQ ID NO: 20346 - RNA, 22 nt, Homo sapiens
uacaguggcaugucaggugcuu

SEQ ID NO: 20347 - RNA, 20 nt, Homo sapiens
uacauaguaaacugagagca

SEQ ID NO: 20348 - RNA, 19 nt, Homo sapiens
uacaugcagcaggcacgca

SEQ ID NO: 20349 - RNA, 22 nt, Homo sapiens
uacauguauacaggguuuacuu

SEQ ID NO: 20350 - RNA, 22 nt, Homo sapiens
uaccucuguaaguaaagauuca

SEQ ID NO: 20351 - RNA, 22 nt, Homo sapiens
uacguuaucagguaugcaagag

SEQ ID NO: 20352 - RNA, 22 nt, Homo sapiens
uacugcacuccacccuggguga

SEQ ID NO: 20353 - RNA, 22 nt, Homo sapiens
uacugcacuccagccuggguga

SEQ ID NO: 20354 - RNA, 19 nt, Homo sapiens
uacuggcucgggaauuuuc

SEQ ID NO: 20355 - RNA, 20 nt, Homo sapiens
uagaaaguagaguggugguu

SEQ ID NO: 20356 - RNA, 22 nt, Homo sapiens
uagaagcuacucuucuuguggc

SEQ ID NO: 20357 - RNA, 22 nt, Homo sapiens
uagaccauucuauuuccuaugc

SEQ ID NO: 20358 - RNA, 22 nt, Homo sapiens
uagacccauuacguaguuucca

SEQ ID NO: 20359 - RNA, 22 nt, Homo sapiens
uagagcuagggacucgcaaugu

SEQ ID NO: 20360 - RNA, 22 nt, Homo sapiens
uagagcuugacacuuuccaugg

SEQ ID NO: 20361 - RNA, 20 nt, Homo sapiens
uagaugcauuuagauucauu

SEQ ID NO: 20362 - RNA, 22 nt, Homo sapiens
uagcaaaucaauggaauugaag

SEQ ID NO: 20363 - RNA, 21 nt, Homo sapiens
uagcaaauugcuauuaaggca

SEQ ID NO: 20364 - RNA, 22 nt, Homo sapiens
uagcaagaugaauuugugcaaa

SEQ ID NO: 20365 - RNA, 20 nt, Homo sapiens
uagcacacauguagaauagu

SEQ ID NO: 20366 - RNA, 19 nt, Homo sapiens
uagcacagggucccagacu

SEQ ID NO: 20367 - RNA, 17 nt, Homo sapiens
uagcacagugccuggua

SEQ ID NO: 20368 - RNA, 22 nt, Homo sapiens
uagcacagugucauucuaggua

SEQ ID NO: 20369 - RNA, 22 nt, Homo sapiens
uagcacaugucagguaauuugc

SEQ ID NO: 20370 - RNA, 22 nt, Homo sapiens
uagcaccuuagcauuucuagug

SEQ ID NO: 20371 - RNA, 20 nt, Homo sapiens
uagcagcagacagagggagg

SEQ ID NO: 20372 - RNA, 22 nt, Homo sapiens
uagcagcagugguguauuuaga

SEQ ID NO: 20373 - RNA, 22 nt, Homo sapiens
uagcagcauaaauggacuaaga

SEQ ID NO: 20374 - RNA, 19 nt, Homo sapiens
uagcagcaugauuuauaau

SEQ ID NO: 20375 - RNA, 22 nt, Homo sapiens
gcagugugugaggaauuugggu

SEQ ID NO: 20376 - RNA, 20 nt, Homo sapiens
gcaguguucacuguauuccu

SEQ ID NO: 20377 - RNA, 22 nt, Homo sapiens
gcaucacagcuccugugcuggc

SEQ ID NO: 20378 - RNA, 20 nt, Homo sapiens
gcaugagucuuuauaguaga

SEQ ID NO: 20379 - RNA, 22 nt, Homo sapiens
gcaugcacuguauuuaaguauc

SEQ ID NO: 20380 - RNA, 22 nt, Homo sapiens
gccaaaaugcugggauuacagg

SEQ ID NO: 20381 - RNA, 22 nt, Homo sapiens
gccaacauggcgcuccauucuu

SEQ ID NO: 20382 - RNA, 18 nt, Homo sapiens
gccaacauguaaacaggu

SEQ ID NO: 20383 - RNA, 22 nt, Homo sapiens
gccaagaucugaauaauuaaga

SEQ ID NO: 20384 - RNA, 22 nt, Homo sapiens
gccaagauuuaauucaucaguu

SEQ ID NO: 20385 - RNA, 22 nt, Homo sapiens
gccagauuguccaguuuuuuau

SEQ ID NO: 20386 - RNA, 22 nt, Homo sapiens
gccaguguuuuauugagaauuu

SEQ ID NO: 20387 - RNA, 22 nt, Homo sapiens
gcccuuugugucuggcuggggu

SEQ ID NO: 20388 - RNA, 22 nt, Homo sapiens
gcgguagcauagacugcaggac

SEQ ID NO: 20389 - RNA, 22 nt, Homo sapiens
gcuaugguuuuuagcuccauca

SEQ ID NO: 20390 - RNA, 22 nt, Homo sapiens
gcucguccccuccugacucugc

SEQ ID NO: 20391 - RNA, 22 nt, Homo sapiens
gcugagguucaagaagguuaaa

SEQ ID NO: 20392 - RNA, 22 nt, Homo sapiens
gcugauggugcaguucuagccu

SEQ ID NO: 20393 - RNA, 22 nt, Homo sapiens
gcugcacuuuaaggcauccccu

SEQ ID NO: 20394 - RNA, 22 nt, Homo sapiens
gcugcuuuugaugacaaaaaca

SEQ ID NO: 20395 - RNA, 22 nt, Homo sapiens
gcugguauuacaggcaugagcc

SEQ ID NO: 20396 - RNA, 22 nt, Homo sapiens
gcuggugacuuuaaguugaagc

SEQ ID NO: 20397 - RNA, 22 nt, Homo sapiens
gcugguguucaggcccucaguc

SEQ ID NO: 20398 - RNA, 22 nt, Homo sapiens
gcugucaugagcaacacaugaa

SEQ ID NO: 20399 - RNA, 22 nt, Homo sapiens
gcugugauucuguguagauagu

SEQ ID NO: 20400 - RNA, 20 nt, Homo sapiens
gcugugcuuaauacacuuuc

SEQ ID NO: 20401 - RNA, 22 nt, Homo sapiens
ggaaagacuauuguaaaggaug

SEQ ID NO: 20402 - RNA, 23 nt, Homo sapiens
ggaaauguuuaagggguugggag

SEQ ID NO: 20403 - RNA, 23 nt, Homo sapiens
ggaaugaaaccugguuaugauau

SEQ ID NO: 20404 - RNA, 17 nt, Homo sapiens
ggaaugaauuccagccc

SEQ ID NO: 20405 - RNA, 19 nt, Homo sapiens
ggaaugcaccaguccuugc

SEQ ID NO: 20406 - RNA, 22 nt, Homo sapiens
ggaaugcuaaaauaggaugcug

SEQ ID NO: 20407 - RNA, 19 nt, Homo sapiens
ggaaugcuauucaaccuuu

SEQ ID NO: 20408 - RNA, 21 nt, Homo sapiens
ggaauuuagggaaugauuuag

SEQ ID NO: 20409 - RNA, 22 nt, Homo sapiens
ggacaaaguauuuucaaaugua

SEQ ID NO: 20410 - RNA, 22 nt, Homo sapiens
ggacagaaaggguucaccaaac

SEQ ID NO: 20411 - RNA, 22 nt, Homo sapiens
ggacugagaggacuacagugua

SEQ ID NO: 20412 - RNA, 22 nt, Homo sapiens
uuugcuauagugaauagugcug

SEQ ID NO: 20413 - RNA, 22 nt, Homo sapiens
uuugcugagucugacuucaugg

SEQ ID NO: 20414 - RNA, 22 nt, Homo sapiens
uuugcuuaaaguccuuguggga

SEQ ID NO: 20415 - RNA, 22 nt, Homo sapiens
uuugcuuaguaaauguagaaaa

SEQ ID NO: 20416 - RNA, 22 nt, Homo sapiens
uuuggcuauguuguaucuuucc

SEQ ID NO: 20417 - RNA, 18 nt, Homo sapiens
uuuggcuguucaugacuc

SEQ ID NO: 20418 - RNA, 22 nt, Homo sapiens
uuugggaaugguuugucuccca

SEQ ID NO: 20419 - RNA, 22 nt, Homo sapiens
uuuggucagcugcgggucagcu

SEQ ID NO: 20420 - RNA, 22 nt, Homo sapiens
uuuggucuuuuguaaguuaucu

SEQ ID NO: 20421 - RNA, 22 nt, Homo sapiens
uuugguguauaaaaaugcuagu

SEQ ID NO: 20422 - RNA, 22 nt, Homo sapiens
uuugguugccucuaugagccug

SEQ ID NO: 20423 - RNA, 22 nt, Homo sapiens
uuuguacuccuuggccagcuuc

SEQ ID NO: 20424 - RNA, 19 nt, Homo sapiens
uuuguauguuuccaguaau

SEQ ID NO: 20425 - RNA, 22 nt, Homo sapiens
uuugugcuccuaugagaaucua

SEQ ID NO: 20426 - RNA, 22 nt, Homo sapiens
uuugugcuccugugagaaucua

SEQ ID NO: 20427 - RNA, 22 nt, Homo sapiens
uuuguguccccacccaaaucuc

SEQ ID NO: 20428 - RNA, 20 nt, Homo sapiens
uuuuagcacuuguuauggug

SEQ ID NO: 20429 - RNA, 20 nt, Homo sapiens
uuuuagcuuuuauugaaagc

SEQ ID NO: 20430 - RNA, 22 nt, Homo sapiens
uuuuaugggcuauuugcauuag

SEQ ID NO: 20431 - RNA, 22 nt, Homo sapiens
uuuugcaggcauuggaaguuua

SEQ ID NO: 20432 - RNA, 22 nt, Homo sapiens
uuuugcaguuacagagagugag

SEQ ID NO: 20433 - RNA, 22 nt, Homo sapiens
uuuugcucuucggaagagcuug

SEQ ID NO: 20434 - RNA, 19 nt, Homo sapiens
uuuuggaaaugugaacagc

SEQ ID NO: 20435 - RNA, 20 nt, Homo sapiens
uuuuggacuaaaggcauccc

SEQ ID NO: 20436 - RNA, 22 nt, Homo sapiens
uuuuggcacuuugucugauucu

SEQ ID NO: 20437 - RNA, 20 nt, Homo sapiens
uuuuggcuuaaagcagucug

SEQ ID NO: 20438 - RNA, 22 nt, Homo sapiens
uuuugugcauggcccaguggua

SEQ ID NO: 20439 - RNA, 22 nt, Homo sapiens
uuuuugguugguaggcuauuaa

SEQ ID NO: 20440 - RNA, 22 nt, Homo sapiens
uuuuugugguauauugcaacaa

SEQ ID NO: 20441 - RNA, 22 nt, Homo sapiens
aaaagcuuagaugggcuuguau

SEQ ID NO: 20442 - RNA, 18 nt, Homo sapiens
aaacagugucucuuucug

SEQ ID NO: 20443 - RNA, 22 nt, Homo sapiens
aaacauugaccucauccuggca

SEQ ID NO: 20444 - RNA, 22 nt, Homo sapiens
aaacugaucugaaggccaggcu

SEQ ID NO: 20445 - RNA, 22 nt, Homo sapiens
aaagagaucuaugggcacuaug

SEQ ID NO: 20446 - RNA, 22 nt, Homo sapiens
aaaggauucuaauggaaaugcu

SEQ ID NO: 20447 - RNA, 22 nt, Homo sapiens
aaaggcacacacuccuuguuau

SEQ ID NO: 20448 - RNA, 22 nt, Homo sapiens
aaaggcaucauuaguaccaagu

SEQ ID NO: 20449 - RNA, 22 nt, Homo sapiens
aaaguaauugcaguuuuugcaa

SEQ ID NO: 20450 - RNA, 22 nt, Homo sapiens
aaaguacucaguucaguuccgu

SEQ ID NO: 20451 - RNA, 22 nt, Homo sapiens
aaaguacugggauuggccgggu

SEQ ID NO: 20452 - RNA, 17 nt, Homo sapiens
aaaguccuuugcuaucu

SEQ ID NO: 20453 - RNA, 22 nt, Homo sapiens
aaagugaauguaucccguaagu

SEQ ID NO: 20454 - RNA, 22 nt, Homo sapiens
aaagugccugacucauaguuag

SEQ ID NO: 20455 - RNA, 22 nt, Homo sapiens
aaaguucuguugauagugcuga

SEQ ID NO: 20456 - RNA, 22 nt, Homo sapiens
aaaugcagucuuuguucugggc

SEQ ID NO: 20457 - RNA, 22 nt, Homo sapiens
aaaugcaugaauaagcucgugu

SEQ ID NO: 20458 - RNA, 22 nt, Homo sapiens
aaaugcccuaaaauggagcauc

SEQ ID NO: 20459 - RNA, 22 nt, Homo sapiens
aaaugcuuucuuggaccauuug

SEQ ID NO: 20460 - RNA, 22 nt, Homo sapiens
aaauggauuaaguucacuugcu

SEQ ID NO: 20461 - RNA, 22 nt, Homo sapiens
aaauugcaaugcgaggcagagg

SEQ ID NO: 20462 - RNA, 22 nt, Homo sapiens
aacagagcuggugacuccaggu

SEQ ID NO: 20463 - RNA, 22 nt, Homo sapiens
aacagcacacccgcugcuucca

SEQ ID NO: 20464 - RNA, 22 nt, Homo sapiens
aacaucaaccaugaggguugga

SEQ ID NO: 20465 - RNA, 22 nt, Homo sapiens
aaccuuuagucagcucuuagga

SEQ ID NO: 20466 - RNA, 22 nt, Homo sapiens
aacucacauucuuucuugguac

SEQ ID NO: 20467 - RNA, 22 nt, Homo sapiens
aacuccauuuuagacccuagau

SEQ ID NO: 20468 - RNA, 22 nt, Homo sapiens
aacuggcacuacaucaagagcu

SEQ ID NO: 20469 - RNA, 22 nt, Homo sapiens
aagagaugaagguccugacugu

SEQ ID NO: 20470 - RNA, 22 nt, Homo sapiens
aagaggccuaggaaucuguauu

SEQ ID NO: 20471 - RNA, 22 nt, Homo sapiens
aagagguagucugucccuuagc

SEQ ID NO: 20472 - RNA, 22 nt, Homo sapiens
aagagguuuaacugacucacag

SEQ ID NO: 20473 - RNA, 21 nt, Homo sapiens
aagcaugguguaucuuuccau

SEQ ID NO: 20474 - RNA, 22 nt, Homo sapiens
aagcaugguuuccaggggucac

SEQ ID NO: 20475 - RNA, 22 nt, Homo sapiens
aagcuacauuuuauuuauguca

SEQ ID NO: 20476 - RNA, 22 nt, Homo sapiens
aagcuccauuucugccaugaga

SEQ ID NO: 20477 - RNA, 20 nt, Homo sapiens
aagcugaguguuuuuuuaau

SEQ ID NO: 20478 - RNA, 22 nt, Homo sapiens
aagcugccaggcaugguggcug

SEQ ID NO: 20479 - RNA, 22 nt, Homo sapiens
aagcuggagugcaguggugcga

SEQ ID NO: 20480 - RNA, 22 nt, Homo sapiens
aaggaaguaauuugguuuauag

SEQ ID NO: 20481 - RNA, 22 nt, Homo sapiens
aaggaauucaaauuuucucugg

SEQ ID NO: 20482 - RNA, 22 nt, Homo sapiens
aaggcaagaagagaaccaucgg

SEQ ID NO: 20483 - RNA, 22 nt, Homo sapiens
aaggcaagagaaaauuucgagu

SEQ ID NO: 20484 - RNA, 22 nt, Homo sapiens
aaggcaagauacugguugcuga

SEQ ID NO: 20485 - RNA, 22 nt, Homo sapiens
agaugauguuuacugagcauca

SEQ ID NO: 20486 - RNA, 22 nt, Homo sapiens
agaugcauugguggcauauuca

SEQ ID NO: 20487 - RNA, 22 nt, Homo sapiens
agauguuguucaucugauuguu

SEQ ID NO: 20488 - RNA, 22 nt, Homo sapiens
agauucauccaaguuguugcau

SEQ ID NO: 20489 - RNA, 22 nt, Homo sapiens
agcacagccuuguguuuucuug

SEQ ID NO: 20490 - RNA, 22 nt, Homo sapiens
agcacagugaaugguuuacuca

SEQ ID NO: 20491 - RNA, 22 nt, Homo sapiens
agcacauuaguaucuaagaaca

SEQ ID NO: 20492 - RNA, 22 nt, Homo sapiens
agcaccaccguugcucuauccc

SEQ ID NO: 20493 - RNA, 22 nt, Homo sapiens
agcaccauugcacuccagccug

SEQ ID NO: 20494 - RNA, 22 nt, Homo sapiens
agcagauguuuagugagcgccu

SEQ ID NO: 20495 - RNA, 22 nt, Homo sapiens
agcagcacaucccuuucuggcc

SEQ ID NO: 20496 - RNA, 22 nt, Homo sapiens
agcagcuuugaucugaaugauu

SEQ ID NO: 20497 - RNA, 22 nt, Homo sapiens
agcagguguggcuuauccugaa

SEQ ID NO: 20498 - RNA, 19 nt, Homo sapiens
agccaguuuucccagcacc

SEQ ID NO: 20499 - RNA, 22 nt, Homo sapiens
agcccauguggcugaggcuucu

SEQ ID NO: 20500 - RNA, 22 nt, Homo sapiens
agcggcuguuccccuggucuau

SEQ ID NO: 20501 - RNA, 22 nt, Homo sapiens
agcuaaaucucauguugaauug

SEQ ID NO: 20502 - RNA, 21 nt, Homo sapiens
agcuccacucguucccaaagc

SEQ ID NO: 20503 - RNA, 20 nt, Homo sapiens
agcuccauuccugaaggcug

SEQ ID NO: 20504 - RNA, 22 nt, Homo sapiens
agcugauggucuuguaugaugu

SEQ ID NO: 20505 - RNA, 22 nt, Homo sapiens
agcugcacaaauggaugugagg

SEQ ID NO: 20506 - RNA, 22 nt, Homo sapiens
agcugcacgugguaaauguaaa

SEQ ID NO: 20507 - RNA, 22 nt, Homo sapiens
agcugcauuuacuuuugcacaa

SEQ ID NO: 20508 - RNA, 16 nt, Homo sapiens
agcuggaauuacaggc

SEQ ID NO: 20509 - RNA, 17 nt, Homo sapiens
agcuggaauuacgggag

SEQ ID NO: 20510 - RNA, 22 nt, Homo sapiens
agcuggaauuuaagguagauag

SEQ ID NO: 20511 - RNA, 22 nt, Homo sapiens
agcugguauuuguuagggaguu

SEQ ID NO: 20512 - RNA, 22 nt, Homo sapiens
agcugguccugugacuugcuuc

SEQ ID NO: 20513 - RNA, 22 nt, Homo sapiens
agcuggucugauacuuaccucc

SEQ ID NO: 20514 - RNA, 22 nt, Homo sapiens
agcuguuuuugugggcauguga

SEQ ID NO: 20515 - RNA, 22 nt, Homo sapiens
agcuuaugcuuggaagagauga

SEQ ID NO: 20516 - RNA, 20 nt, Homo sapiens
agcuugguuuggaugaucac

SEQ ID NO: 20517 - RNA, 22 nt, Homo sapiens
agcuuguauuuguagccuguug

SEQ ID NO: 20518 - RNA, 22 nt, Homo sapiens
agcuugugauuuagagugagag

SEQ ID NO: 20519 - RNA, 22 nt, Homo sapiens
aggaagcuagcauuuguucagu

SEQ ID NO: 20520 - RNA, 23 nt, Homo sapiens
aggaauggaaaaccaaguaucau

SEQ ID NO: 20521 - RNA, 22 nt, Homo sapiens
aggacacugauguaugcugugg

SEQ ID NO: 20522 - RNA, 22 nt, Homo sapiens
aggaggauugcuuucaucuuuu

SEQ ID NO: 20523 - RNA, 22 nt, Homo sapiens
aggagguagaacauugccauuu

SEQ ID NO: 20524 - RNA, 22 nt, Homo sapiens
aggagguaggaauugugcuagg

SEQ ID NO: 20525 - RNA, 22 nt, Homo sapiens
aggcaagaaugcuuguuucacc

SEQ ID NO: 20526 - RNA, 22 nt, Homo sapiens
aggcaaugugagaguuuauuca

SEQ ID NO: 20527 - RNA, 22 nt, Homo sapiens
aggcagcuguuauauacugagu

SEQ ID NO: 20528 - RNA, 23 nt, Homo sapiens
aggccaguuuuuccugcuugcug

SEQ ID NO: 20529 - RNA, 22 nt, Homo sapiens
aggcuuuauuacagggucucag

SEQ ID NO: 20530 - RNA, 22 nt, Homo sapiens
aggugaaugcucacauucuaau

SEQ ID NO: 20531 - RNA, 22 nt, Homo sapiens
aggugacugguuuaucuggcag

SEQ ID NO: 20532 - RNA, 22 nt, Homo sapiens
aggugguguuggguuccagccc

SEQ ID NO: 20533 - RNA, 22 nt, Homo sapiens
aggugguuuuaggcagagacau

SEQ ID NO: 20534 - RNA, 22 nt, Homo sapiens
aguacaauguugaguagaagug

SEQ ID NO: 20535 - RNA, 20 nt, Homo sapiens
aguauucacuuuuuucaugg

SEQ ID NO: 20536 - RNA, 22 nt, Homo sapiens
agucaagaaucucagcaucuuu

SEQ ID NO: 20537 - RNA, 22 nt, Homo sapiens
agucaaguuuuuucagagaaua

SEQ ID NO: 20538 - RNA, 22 nt, Homo sapiens
agucacagccuuuuacuuuaga

SEQ ID NO: 20539 - RNA, 22 nt, Homo sapiens
aguccauuugaugaugauucca

SEQ ID NO: 20540 - RNA, 23 nt, Homo sapiens
agucuguguuuacaggcucucug

SEQ ID NO: 20541 - RNA, 22 nt, Homo sapiens
agugaaaucugaagaaggucau

SEQ ID NO: 20542 - RNA, 22 nt, Homo sapiens
agugaaaugucaccuuuuagga

SEQ ID NO: 20543 - RNA, 22 nt, Homo sapiens
agugagcuguuuuuacuuucug

SEQ ID NO: 20544 - RNA, 22 nt, Homo sapiens
agugcaauaaggauguagaacu

SEQ ID NO: 20545 - RNA, 22 nt, Homo sapiens
agugcacugcccgcuuccuguc

SEQ ID NO: 20546 - RNA, 22 nt, Homo sapiens
agugcaguggcucaaaaugccu

SEQ ID NO: 20547 - RNA, 22 nt, Homo sapiens
agugcauuuguucugugucagg

SEQ ID NO: 20548 - RNA, 22 nt, Homo sapiens
aguggaguguaaagcgucuuuu

SEQ ID NO: 20549 - RNA, 22 nt, Homo sapiens
aguggcacuauucucagaguca

SEQ ID NO: 20550 - RNA, 22 nt, Homo sapiens
agugguauaauauuauuuugaa

SEQ ID NO: 20551 - RNA, 22 nt, Homo sapiens
aguguuuuuaucaugaaagggu

SEQ ID NO: 20552 - RNA, 22 nt, Homo sapiens
aguucaaugcucuuucuacuau

SEQ ID NO: 20553 - RNA, 22 nt, Homo sapiens
auaaagcuauuccucucuuuuu

SEQ ID NO: 20554 - RNA, 22 nt, Homo sapiens
auaaagguaagcacuauccuga

SEQ ID NO: 20555 - RNA, 22 nt, Homo sapiens
auaaauaguaguugugguggcc

SEQ ID NO: 20556 - RNA, 19 nt, Homo sapiens
auaaaugccuacaagggug

SEQ ID NO: 20557 - RNA, 22 nt, Homo sapiens
acucacagcaaccuccgccucc

SEQ ID NO: 20558 - RNA, 22 nt, Homo sapiens
acucagagugggccccuagaua

SEQ ID NO: 20559 - RNA, 22 nt, Homo sapiens
acucauugcucauaccuuaucu

SEQ ID NO: 20560 - RNA, 22 nt, Homo sapiens
acuccauuucauuuuagcucuu

SEQ ID NO: 20561 - RNA, 22 nt, Homo sapiens
acugagccuuuaaaugacuuca

SEQ ID NO: 20562 - RNA, 19 nt, Homo sapiens
acugagcuaccugggggca

SEQ ID NO: 20563 - RNA, 23 nt, Homo sapiens
acugcaauuacguuugcaccaac

SEQ ID NO: 20564 - RNA, 22 nt, Homo sapiens
acugcacuccaaccuuggugac

SEQ ID NO: 20565 - RNA, 22 nt, Homo sapiens
acugcacuccagccuccugggu

SEQ ID NO: 20566 - RNA, 22 nt, Homo sapiens
acugcacuccagccucggcaau

SEQ ID NO: 20567 - RNA, 22 nt, Homo sapiens
acugcacuccagccugagccug

SEQ ID NO: 20568 - RNA, 22 nt, Homo sapiens
acugcacuccagccugaugaaa

SEQ ID NO: 20569 - RNA, 22 nt, Homo sapiens
acugcacuccagccugugagac

SEQ ID NO: 20570 - RNA, 22 nt, Homo sapiens
acugcacuccagccuuggagac

SEQ ID NO: 20571 - RNA, 22 nt, Homo sapiens
acugcacuccagccuuggcaac

SEQ ID NO: 20572 - RNA, 22 nt, Homo sapiens
acugcacuccaucuuagguggc

SEQ ID NO: 20573 - RNA, 22 nt, Homo sapiens
acugcacucuagcuugggugac

SEQ ID NO: 20574 - RNA, 22 nt, Homo sapiens
acuggcuuaaggaugggccacu

SEQ ID NO: 20575 - RNA, 22 nt, Homo sapiens
acuggcuuauuucacuuagcau

SEQ ID NO: 20576 - RNA, 22 nt, Homo sapiens
acugugcuguuuuaauuauuga

SEQ ID NO: 20577 - RNA, 22 nt, Homo sapiens
acuguguguuugucuagcacag

SEQ ID NO: 20578 - RNA, 20 nt, Homo sapiens
acuuuuugaugaggucguuu

SEQ ID NO: 20579 - RNA, 22 nt, Homo sapiens
agaacacugaguucagggucag

SEQ ID NO: 20580 - RNA, 22 nt, Homo sapiens
agaaccaaucccacauggauac

SEQ ID NO: 20581 - RNA, 19 nt, Homo sapiens
agaaucuaaauuauuucug

SEQ ID NO: 20582 - RNA, 22 nt, Homo sapiens
agaauguauauucuguaguugu

SEQ ID NO: 20583 - RNA, 22 nt, Homo sapiens
agaaugucaguauuggcuaaaa

SEQ ID NO: 20584 - RNA, 22 nt, Homo sapiens
agacagcuggaguaucauagcu

SEQ ID NO: 20585 - RNA, 22 nt, Homo sapiens
agagacauugcuccaacucacc

SEQ ID NO: 20586 - RNA, 22 nt, Homo sapiens
agagaucaauaugaaggaaaug

SEQ ID NO: 20587 - RNA, 22 nt, Homo sapiens
agagaugauuaacauuuuggua

SEQ ID NO: 20588 - RNA, 22 nt, Homo sapiens
agagauuauccuggcuucucug

SEQ ID NO: 20589 - RNA, 22 nt, Homo sapiens
agagccacacucuccuaacuca

SEQ ID NO: 20590 - RNA, 22 nt, Homo sapiens
agagguauuggaaggaguguca

SEQ ID NO: 20591 - RNA, 22 nt, Homo sapiens
agaguacugacguuugcaaauu

SEQ ID NO: 20592 - RNA, 22 nt, Homo sapiens
agaguauagcaacuuaguaaaa

SEQ ID NO: 20593 - RNA, 22 nt, Homo sapiens
auauucacagguaucagagauu

SEQ ID NO: 20594 - RNA, 22 nt, Homo sapiens
auauugacuuucucuuagauca

SEQ ID NO: 20595 - RNA, 18 nt, Homo sapiens
auauugcauuggauggau

SEQ ID NO: 20596 - RNA, 22 nt, Homo sapiens
aucaaaguaucucaauauggua

SEQ ID NO: 20597 - RNA, 22 nt, Homo sapiens
aucaaaguuucccagaaguugu

SEQ ID NO: 20598 - RNA, 22 nt, Homo sapiens
aucaagccaaagaaaguccuug

SEQ ID NO: 20599 - RNA, 22 nt, Homo sapiens
aucaagcuacacccuuuggaaa

SEQ ID NO: 20600 - RNA, 22 nt, Homo sapiens
aucaaguaaucugaguaagagu

SEQ ID NO: 20601 - RNA, 22 nt, Homo sapiens
aucacaggcaaaauuccuucuc

SEQ ID NO: 20602 - RNA, 22 nt, Homo sapiens
aucacuggucaugagagaagua

SEQ ID NO: 20603 - RNA, 22 nt, Homo sapiens
aucacugugauuucuacugugc

SEQ ID NO: 20604 - RNA, 23 nt, Homo sapiens
aucacuguuaacaauuucuuccu

SEQ ID NO: 20605 - RNA, 22 nt, Homo sapiens
aucacuuucuauuucugugcca

SEQ ID NO: 20606 - RNA, 20 nt, Homo sapiens
aucagagacuaggauugcca

SEQ ID NO: 20607 - RNA, 22 nt, Homo sapiens
aucagcagcaugaaaacggacu

SEQ ID NO: 20608 - RNA, 22 nt, Homo sapiens
aucagugauugauuuaaagacg

SEQ ID NO: 20609 - RNA, 22 nt, Homo sapiens
aucauaucaucugcaaacaaag

SEQ ID NO: 20610 - RNA, 22 nt, Homo sapiens
aucauaucauuggugaacagug

SEQ ID NO: 20611 - RNA, 22 nt, Homo sapiens
aucauccagccccagaagggag

SEQ ID NO: 20612 - RNA, 22 nt, Homo sapiens
aucauccugucaggagcuguga

SEQ ID NO: 20613 - RNA, 22 nt, Homo sapiens
auccaguguuuucuuuugucac

SEQ ID NO: 20614 - RNA, 22 nt, Homo sapiens
auccauguggauaaauguguau

SEQ ID NO: 20615 - RNA, 22 nt, Homo sapiens
aucccaguaaaaauggcuucua

SEQ ID NO: 20616 - RNA, 22 nt, Homo sapiens
aucccaguucagccucugacac

SEQ ID NO: 20617 - RNA, 22 nt, Homo sapiens
auccccugcacggggugucauu

SEQ ID NO: 20618 - RNA, 22 nt, Homo sapiens
aucccgagacuuugcugaaguu

SEQ ID NO: 20619 - RNA, 22 nt, Homo sapiens
aucccugagaacuuuuaauguu

SEQ ID NO: 20620 - RNA, 22 nt, Homo sapiens
aucccugaggaauuucugcacu

SEQ ID NO: 20621 - RNA, 22 nt, Homo sapiens
aucccuguaacuagcagccccu

SEQ ID NO: 20622 - RNA, 22 nt, Homo sapiens
aucccuguguccagcaccugug

SEQ ID NO: 20623 - RNA, 22 nt, Homo sapiens
aucccuuucugauacuuucccu

SEQ ID NO: 20624 - RNA, 22 nt, Homo sapiens
auccugagacuuugcugaaguu

SEQ ID NO: 20625 - RNA, 21 nt, Homo sapiens
auccuucuuuuucaaccugug

SEQ ID NO: 20626 - RNA, 22 nt, Homo sapiens
aucuaaucaucgcaaccuucaa

SEQ ID NO: 20627 - RNA, 22 nt, Homo sapiens
aucucauggagguagagaguaa

SEQ ID NO: 20628 - RNA, 22 nt, Homo sapiens
aucugcaaauaaugaagauugg

SEQ ID NO: 20629 - RNA, 22 nt, Homo sapiens
aucugcuccuggugaggguuuc

SEQ ID NO: 20630 - RNA, 22 nt, Homo sapiens
aucuguagauucagcacaagcu

SEQ ID NO: 20631 - RNA, 21 nt, Homo sapiens
aucugugagaccuuggggguu

SEQ ID NO: 20632 - RNA, 22 nt, Homo sapiens
aucugugguuguaugcauauua

SEQ ID NO: 20633 - RNA, 22 nt, Homo sapiens
aucuguguuuaaggucccagaa

SEQ ID NO: 20634 - RNA, 22 nt, Homo sapiens
aucuuugauuguagguacaaug

SEQ ID NO: 20635 - RNA, 22 nt, Homo sapiens
augaaaucacugugaugcccua

SEQ ID NO: 20636 - RNA, 22 nt, Homo sapiens
augaaauugcuaucgcaguacu

SEQ ID NO: 20637 - RNA, 20 nt, Homo sapiens
augaagugaaguuagggaac

SEQ ID NO: 20638 - RNA, 22 nt, Homo sapiens
augacaguguggauuauuguaa

SEQ ID NO: 20639 - RNA, 22 nt, Homo sapiens
augacauguauuuccaggauuu

SEQ ID NO: 20640 - RNA, 22 nt, Homo sapiens
augacugaguagcauuccauua

SEQ ID NO: 20641 - RNA, 22 nt, Homo sapiens
augagacauuaaaguguguuug

SEQ ID NO: 20642 - RNA, 22 nt, Homo sapiens
augagagcaacaccuucacuug

SEQ ID NO: 20643 - RNA, 22 nt, Homo sapiens
augagauauguuaaaaguuaaa

SEQ ID NO: 20644 - RNA, 22 nt, Homo sapiens
augaggcaggaaaggcguaucu

SEQ ID NO: 20645 - RNA, 22 nt, Homo sapiens
augagguaguagaaagucaggu

SEQ ID NO: 20646 - RNA, 22 nt, Homo sapiens
augaguaugagaauacauuaag

SEQ ID NO: 20647 - RNA, 22 nt, Homo sapiens
augaucacuguggaaauucagc

SEQ ID NO: 20648 - RNA, 22 nt, Homo sapiens
augcaaacaucugaagagacau

SEQ ID NO: 20649 - RNA, 22 nt, Homo sapiens
augcaagacaccgauuagcuuu

SEQ ID NO: 20650 - RNA, 22 nt, Homo sapiens
augcaauucuagauugauagua

SEQ ID NO: 20651 - RNA, 22 nt, Homo sapiens
augcacauauguacugcccuau

SEQ ID NO: 20652 - RNA, 22 nt, Homo sapiens
augcacuguuguuauuggauaa

SEQ ID NO: 20653 - RNA, 22 nt, Homo sapiens
augcacuguuuucuugaugaga

SEQ ID NO: 20654 - RNA, 22 nt, Homo sapiens
augcacuuggcaggaugauucc

SEQ ID NO: 20655 - RNA, 22 nt, Homo sapiens
augcauagcaucugcaaauguu

SEQ ID NO: 20656 - RNA, 19 nt, Homo sapiens
augccucaguuuuguacuu

SEQ ID NO: 20657 - RNA, 22 nt, Homo sapiens
augcuacuggacaauggugacu

SEQ ID NO: 20658 - RNA, 19 nt, Homo sapiens
augcugguguugcucaaac

SEQ ID NO: 20659 - RNA, 22 nt, Homo sapiens
auggaagaauugucggggaugu

SEQ ID NO: 20660 - RNA, 22 nt, Homo sapiens
auggaaggagaggaaugaauga

SEQ ID NO: 20661 - RNA, 22 nt, Homo sapiens
auggaauguauagucauguagg

SEQ ID NO: 20662 - RNA, 22 nt, Homo sapiens
auggagagaauuauucucucag

SEQ ID NO: 20663 - RNA, 22 nt, Homo sapiens
auggagguguggggagugaguu

SEQ ID NO: 20664 - RNA, 22 nt, Homo sapiens
auggagugagaauggagguucc

SEQ ID NO: 20665 - RNA, 22 nt, Homo sapiens
auacugccuuuagcaaaacagu

SEQ ID NO: 20666 - RNA, 22 nt, Homo sapiens
auacuggcuuuccaauugugau

SEQ ID NO: 20667 - RNA, 22 nt, Homo sapiens
auagacugaguggcuuaaacca

SEQ ID NO: 20668 - RNA, 22 nt, Homo sapiens
auagcacaguguguguacacca

SEQ ID NO: 20669 - RNA, 22 nt, Homo sapiens
auagcagaagaagggacaauuc

SEQ ID NO: 20670 - RNA, 21 nt, Homo sapiens
auagugcuagagaguagcagg

SEQ ID NO: 20671 - RNA, 22 nt, Homo sapiens
auagugcugcaaaaaacauacg

SEQ ID NO: 20672 - RNA, 22 nt, Homo sapiens
auagugcugcaauaaacauacg

SEQ ID NO: 20673 - RNA, 22 nt, Homo sapiens
auagugcugcaaucaacauaca

SEQ ID NO: 20674 - RNA, 22 nt, Homo sapiens
auagugcugcaaugaacauaca

SEQ ID NO: 20675 - RNA, 22 nt, Homo sapiens
auagugcugcaauuaacauaca

SEQ ID NO: 20676 - RNA, 22 nt, Homo sapiens
auagugcugcagucaauguacg

SEQ ID NO: 20677 - RNA, 22 nt, Homo sapiens
auagugcuuuugaaucuuguug

SEQ ID NO: 20678 - RNA, 22 nt, Homo sapiens
auaucaacaugguaggguuggu

SEQ ID NO: 20679 - RNA, 22 nt, Homo sapiens
auaucacaggaaaggaagauac

SEQ ID NO: 20680 - RNA, 22 nt, Homo sapiens
auaucacucccaauaucgcagg

SEQ ID NO: 20681 - RNA, 22 nt, Homo sapiens
auaucagugucuuacuguuuuu

SEQ ID NO: 20682 - RNA, 22 nt, Homo sapiens
auaugcauacauguaugcagga

SEQ ID NO: 20683 - RNA, 22 nt, Homo sapiens
auauguaguauggaaacauugu

SEQ ID NO: 20684 - RNA, 22 nt, Homo sapiens
auauuagcacuaaugucacgau

SEQ ID NO: 20685 - RNA, 22 nt, Homo sapiens
auauucacuauaugcagaacca

SEQ ID NO: 20686 - RNA, 22 nt, Homo sapiens
auauuggacugugcuaguuaga

SEQ ID NO: 20687 - RNA, 22 nt, Homo sapiens
auauuguacugcuacugguucu

SEQ ID NO: 20688 - RNA, 20 nt, Homo sapiens
aucaaagacuuagaggggga

SEQ ID NO: 20689 - RNA, 22 nt, Homo sapiens
aucaagcugcuuguuugaaucu

SEQ ID NO: 20690 - RNA, 22 nt, Homo sapiens
aucaagcuggcauauguaguuc

SEQ ID NO: 20691 - RNA, 22 nt, Homo sapiens
aucaaguaguuauacguaaagg

SEQ ID NO: 20692 - RNA, 22 nt, Homo sapiens
aucacagugaaaacagucaauu

SEQ ID NO: 20693 - RNA, 22 nt, Homo sapiens
aucacauggccagguaguaauc

SEQ ID NO: 20694 - RNA, 22 nt, Homo sapiens
aucacugggagcagccauuaau

SEQ ID NO: 20695 - RNA, 22 nt, Homo sapiens
aucacuuugcucuccagugugg

SEQ ID NO: 20696 - RNA, 19 nt, Homo sapiens
aucagcacaagugugcuuu

SEQ ID NO: 20697 - RNA, 22 nt, Homo sapiens
aucagcagcaugaaaacaggcu

SEQ ID NO: 20698 - RNA, 22 nt, Homo sapiens
aucauugugcaucuucauucca

SEQ ID NO: 20699 - RNA, 22 nt, Homo sapiens
auccacagugucaauguuguga

SEQ ID NO: 20700 - RNA, 22 nt, Homo sapiens
auccucugagaucuaggcagag

SEQ ID NO: 20701 - RNA, 22 nt, Homo sapiens
auuaauguaauuaguaaaguug

SEQ ID NO: 20702 - RNA, 23 nt, Homo sapiens
auucaaguagugagagugguuau

SEQ ID NO: 20703 - RNA, 22 nt, Homo sapiens
auucacuguggcuuucucugau

SEQ ID NO: 20704 - RNA, 22 nt, Homo sapiens
auucaucagggauauuggucug

SEQ ID NO: 20705 - RNA, 22 nt, Homo sapiens
auuccauaguacagugaugagu

SEQ ID NO: 20706 - RNA, 22 nt, Homo sapiens
auuccauuuguuaucacacccg

SEQ ID NO: 20707 - RNA, 22 nt, Homo sapiens
auugacuugauauauagcugau

SEQ ID NO: 20708 - RNA, 22 nt, Homo sapiens
auugagcaaggucuccuaguau

SEQ ID NO: 20709 - RNA, 22 nt, Homo sapiens
auugagcaauuccuaugugcuu

SEQ ID NO: 20710 - RNA, 22 nt, Homo sapiens
auugcaacaguguugagaggug

SEQ ID NO: 20711 - RNA, 21 nt, Homo sapiens
auugcacaauauacccaugua

SEQ ID NO: 20712 - RNA, 22 nt, Homo sapiens
auugcacuccagccugcggaac

SEQ ID NO: 20713 - RNA, 22 nt, Homo sapiens
auugcacuccagccugggcaac

SEQ ID NO: 20714 - RNA, 22 nt, Homo sapiens
auugcacuccagccugggcagc

SEQ ID NO: 20715 - RNA, 22 nt, Homo sapiens
auugcacuccauccuaggugac

SEQ ID NO: 20716 - RNA, 22 nt, Homo sapiens
auugcacuccauccugggcaau

SEQ ID NO: 20717 - RNA, 22 nt, Homo sapiens
auugcacucugaucugcacucc

SEQ ID NO: 20718 - RNA, 22 nt, Homo sapiens
auugcagcccacccugggugau

SEQ ID NO: 20719 - RNA, 22 nt, Homo sapiens
auugcaugucauguuuagugua

SEQ ID NO: 20720 - RNA, 23 nt, Homo sapiens
auugcccuugaaggcuaaacucu

SEQ ID NO: 20721 - RNA, 22 nt, Homo sapiens
auugcugagacauugcuaaucu

SEQ ID NO: 20722 - RNA, 22 nt, Homo sapiens
auugcuuacuaaucaucuucag

SEQ ID NO: 20723 - RNA, 22 nt, Homo sapiens
auuggaacugaaauaauaacuu

SEQ ID NO: 20724 - RNA, 22 nt, Homo sapiens
auuggaguuguacgcacgcuca

SEQ ID NO: 20725 - RNA, 22 nt, Homo sapiens
auuggcagaaaucuuuauagua

SEQ ID NO: 20726 - RNA, 22 nt, Homo sapiens
auuggcuuuauacauaagaaua

SEQ ID NO: 20727 - RNA, 22 nt, Homo sapiens
auuguacucuagccucugggca

SEQ ID NO: 20728 - RNA, 22 nt, Homo sapiens
auugucacugugcuccaccagu

SEQ ID NO: 20729 - RNA, 22 nt, Homo sapiens
auuguucuuguguccuuuuccu

SEQ ID NO: 20730 - RNA, 19 nt, Homo sapiens
auuuccuggagcuggucuc

SEQ ID NO: 20731 - RNA, 22 nt, Homo sapiens
auuuggcaacguagggaggcau

SEQ ID NO: 20732 - RNA, 22 nt, Homo sapiens
auuugucacuauguggcuaaua

SEQ ID NO: 20733 - RNA, 22 nt, Homo sapiens
caaaggauucauuuccaggagu

SEQ ID NO: 20734 - RNA, 22 nt, Homo sapiens
caaagucuucaguugauucuga

SEQ ID NO: 20735 - RNA, 22 nt, Homo sapiens
caaagugcugggaugggccagg

SEQ ID NO: 20736 - RNA, 22 nt, Homo sapiens
caacaguaaagcauuuuuaagu

SEQ ID NO: 20737 - RNA, 22 nt, Homo sapiens
caacugcucacuccuggguuca

SEQ ID NO: 20738 - RNA, 22 nt, Homo sapiens
caagaggcuguguauaaagcca

SEQ ID NO: 20739 - RNA, 22 nt, Homo sapiens
caaggaauucucaauagaguua

SEQ ID NO: 20740 - RNA, 22 nt, Homo sapiens
caagguacuuuuacaauuuccc

SEQ ID NO: 20741 - RNA, 22 nt, Homo sapiens
caauacuguuaccugaaauagg

SEQ ID NO: 20742 - RNA, 21 nt, Homo sapiens
caauggcacgaucuuggcuca

SEQ ID NO: 20743 - RNA, 22 nt, Homo sapiens
cacaggccugucucuuucuaac

SEQ ID NO: 20744 - RNA, 22 nt, Homo sapiens
cacaguagaauagagcacuagg

SEQ ID NO: 20745 - RNA, 22 nt, Homo sapiens
cacagucuugcaauauugagau

SEQ ID NO: 20746 - RNA, 22 nt, Homo sapiens
cacauguuugcuacauuuuucu

SEQ ID NO: 20747 - RNA, 22 nt, Homo sapiens
caccacauuccauugaucaggc

SEQ ID NO: 20748 - RNA, 22 nt, Homo sapiens
cacuaccucuacaggcagcugg

SEQ ID NO: 20749 - RNA, 22 nt, Homo sapiens
cacugcacuccagcuugugggc

SEQ ID NO: 20750 - RNA, 22 nt, Homo sapiens
cacugcacuccagucuggcgac

SEQ ID NO: 20751 - RNA, 22 nt, Homo sapiens
cacugcacuccaguuuggauga

SEQ ID NO: 20752 - RNA, 22 nt, Homo sapiens
cacugcauccucugccuggcgg

SEQ ID NO: 20753 - RNA, 22 nt, Homo sapiens
cacugcgaccuccaccucccgg

SEQ ID NO: 20754 - RNA, 22 nt, Homo sapiens
cagaaguauugguaugcucugu

SEQ ID NO: 20755 - RNA, 20 nt, Homo sapiens
cagagcaaagcaguccuggc

SEQ ID NO: 20756 - RNA, 22 nt, Homo sapiens
cagagugcauguuuagaugagu

SEQ ID NO: 20757 - RNA, 22 nt, Homo sapiens
cagcuaaauuguuaaauccaag

SEQ ID NO: 20758 - RNA, 22 nt, Homo sapiens
cagcuguuguuaugucugcagg

SEQ ID NO: 20759 - RNA, 22 nt, Homo sapiens
caggcacgcuugggagacacac

SEQ ID NO: 20760 - RNA, 22 nt, Homo sapiens
caggugcauuggcugacaccug

SEQ ID NO: 20761 - RNA, 22 nt, Homo sapiens
caguaaauaucugagcgagguc

SEQ ID NO: 20762 - RNA, 22 nt, Homo sapiens
cagugaauuucaggucaagagu

SEQ ID NO: 20763 - RNA, 22 nt, Homo sapiens
cagugcaaccuccaucucucgg

SEQ ID NO: 20764 - RNA, 20 nt, Homo sapiens
cagugcacuuucccacuggu

SEQ ID NO: 20765 - RNA, 22 nt, Homo sapiens
cagugcaugacuguauauuauc

SEQ ID NO: 20766 - RNA, 23 nt, Homo sapiens
cagugguguuagagaaaucuuuu

SEQ ID NO: 20767 - RNA, 22 nt, Homo sapiens
cagugguuuuuagcuugcuggg

SEQ ID NO: 20768 - RNA, 22 nt, Homo sapiens
caguguuuuuaacaggugcccg

SEQ ID NO: 20769 - RNA, 22 nt, Homo sapiens
caguugcacuagccccguuuca

SEQ ID NO: 20770 - RNA, 21 nt, Homo sapiens
cauaaugcuacuuauuuuaug

SEQ ID NO: 20771 - RNA, 22 nt, Homo sapiens
cauaguacuugcauaguacuau

SEQ ID NO: 20772 - RNA, 22 nt, Homo sapiens
cuguugcaguuauggcugcagg

SEQ ID NO: 20773 - RNA, 22 nt, Homo sapiens
cuucaagucuuuggauaauuag

SEQ ID NO: 20774 - RNA, 22 nt, Homo sapiens
cuucaaguuggaagggaccuaa

SEQ ID NO: 20775 - RNA, 22 nt, Homo sapiens
cuucacuuuguuaaacuccaau

SEQ ID NO: 20776 - RNA, 22 nt, Homo sapiens
cuucagcaauauauccccuggg

SEQ ID NO: 20777 - RNA, 20 nt, Homo sapiens
cuuccaguggccccaucuuu

SEQ ID NO: 20778 - RNA, 22 nt, Homo sapiens
cuucucagugcucaucuuauuu

SEQ ID NO: 20779 - RNA, 22 nt, Homo sapiens
cuucuugcuguguccucacaug

SEQ ID NO: 20780 - RNA, 21 nt, Homo sapiens
cuucuuggggcagggcagggu

SEQ ID NO: 20781 - RNA, 22 nt, Homo sapiens
cuugacacugucacucaggcca

SEQ ID NO: 20782 - RNA, 22 nt, Homo sapiens
cuugauagugguaaucauuuuu

SEQ ID NO: 20783 - RNA, 22 nt, Homo sapiens
cuugcacauuacagaucugcau

SEQ ID NO: 20784 - RNA, 22 nt, Homo sapiens
cuugccuuugucuucaaaggcu

SEQ ID NO: 20785 - RNA, 22 nt, Homo sapiens
cuugguuacauuuuccuagaaa

SEQ ID NO: 20786 - RNA, 22 nt, Homo sapiens
cuuguuguggaggggagugcag

SEQ ID NO: 20787 - RNA, 22 nt, Homo sapiens
cuuuacacauccuaaccagugu

SEQ ID NO: 20788 - RNA, 22 nt, Homo sapiens
cuuuccauuguuggagcauaaa

SEQ ID NO: 20789 - RNA, 21 nt, Homo sapiens
cuuugcacugcuccucagcuc

SEQ ID NO: 20790 - RNA, 22 nt, Homo sapiens
cuuuggcaaugucauuuucaau

SEQ ID NO: 20791 - RNA, 21 nt, Homo sapiens
cuuugguuucugacuugcaua

SEQ ID NO: 20792 - RNA, 23 nt, Homo sapiens
cuuuguccccacccaaaucucau

SEQ ID NO: 20793 - RNA, 21 nt, Homo sapiens
cuuuugcacuccagccugggu

SEQ ID NO: 20794 - RNA, 20 nt, Homo sapiens
cuuuuugcugugcugggagc

SEQ ID NO: 20795 - RNA, 22 nt, Homo sapiens
gaaagacuuucugcuguggaua

SEQ ID NO: 20796 - RNA, 22 nt, Homo sapiens
gaaaguaauuaacgauuguugc

SEQ ID NO: 20797 - RNA, 22 nt, Homo sapiens
gaaagugcugcaaggccaugca

SEQ ID NO: 20798 - RNA, 22 nt, Homo sapiens
gaaauguugauagugggcauug

SEQ ID NO: 20799 - RNA, 22 nt, Homo sapiens
gaacuguuucuggugaaagagu

SEQ ID NO: 20800 - RNA, 22 nt, Homo sapiens
gaacuuguguugcuucacaugu

SEQ ID NO: 20801 - RNA, 22 nt, Homo sapiens
gaagaaguacaagacaaauuuu

SEQ ID NO: 20802 - RNA, 22 nt, Homo sapiens
gaagcagcauucugguuuuugg

SEQ ID NO: 20803 - RNA, 22 nt, Homo sapiens
gaaggagcuuaucugccauuuc

SEQ ID NO: 20804 - RNA, 22 nt, Homo sapiens
gaauaaacuagagaggacugag

SEQ ID NO: 20805 - RNA, 22 nt, Homo sapiens
gaauacugacuauuucaucugg

SEQ ID NO: 20806 - RNA, 22 nt, Homo sapiens
gaaucauuguuucuaaguuugu

SEQ ID NO: 20807 - RNA, 22 nt, Homo sapiens
gaauggaacugacuauagcuga

SEQ ID NO: 20808 - RNA, 18 nt, Homo sapiens
gacagugugaagauuccu

SEQ ID NO: 20809 - RNA, 22 nt, Homo sapiens
ucuccggguggcggcgaaggga

SEQ ID NO: 20810 - RNA, 22 nt, Homo sapiens
ucucugguuaugucauuaagca

SEQ ID NO: 20811 - RNA, 22 nt, Homo sapiens
ucugacucugugaugggcccaa

SEQ ID NO: 20812 - RNA, 22 nt, Homo sapiens
ucuggauuuuugaggcaauaua

SEQ ID NO: 20813 - RNA, 22 nt, Homo sapiens
ucuggcacucagaggccuugcu

SEQ ID NO: 20814 - RNA, 20 nt, Homo sapiens
ucuggccccuccaaaucuca

SEQ ID NO: 20815 - RNA, 22 nt, Homo sapiens
ucuggccccucccaaaucucau

SEQ ID NO: 20816 - RNA, 22 nt, Homo sapiens
ucuggccuccuaugagaaucga

SEQ ID NO: 20817 - RNA, 22 nt, Homo sapiens
ucuggcuccaaagucuauuuuu

SEQ ID NO: 20818 - RNA, 22 nt, Homo sapiens
ucuggcuucugacuuaggggac

SEQ ID NO: 20819 - RNA, 23 nt, Homo sapiens
ucuggcuuugggaugcucaaggg

SEQ ID NO: 20820 - RNA, 22 nt, Homo sapiens
ucuggugugcucuggacuugca

SEQ ID NO: 20821 - RNA, 22 nt, Homo sapiens
ucugguguuauucauguaguuu

SEQ ID NO: 20822 - RNA, 19 nt, Homo sapiens
ucugucacuggggguauuc

SEQ ID NO: 20823 - RNA, 22 nt, Homo sapiens
ucugugcauuacacuuuucuca

SEQ ID NO: 20824 - RNA, 22 nt, Homo sapiens
ucugugcuugucauaugcuuug

SEQ ID NO: 20825 - RNA, 22 nt, Homo sapiens
ucugugguucuagcuacuuugg

SEQ ID NO: 20826 - RNA, 22 nt, Homo sapiens
ucugugguuguugcauggaaug

SEQ ID NO: 20827 - RNA, 22 nt, Homo sapiens
ucuguguuuagacccaggguag

SEQ ID NO: 20828 - RNA, 22 nt, Homo sapiens
ucuguuguuguuuuaagagaca

SEQ ID NO: 20829 - RNA, 22 nt, Homo sapiens
ucuuaggugaugauugauguga

SEQ ID NO: 20830 - RNA, 22 nt, Homo sapiens
ucuuaguuuagauuagcaauuc

SEQ ID NO: 20831 - RNA, 22 nt, Homo sapiens
ucuucaugcuugaaauaauagc

SEQ ID NO: 20832 - RNA, 22 nt, Homo sapiens
ucuugcacacaguaaguguuuu

SEQ ID NO: 20833 - RNA, 22 nt, Homo sapiens
ucuugcaccuacaugcuuuguc

SEQ ID NO: 20834 - RNA, 22 nt, Homo sapiens
ucuugcuuuugcagagcuucuc

SEQ ID NO: 20835 - RNA, 22 nt, Homo sapiens
ucuugggugaguuugugaauaa

SEQ ID NO: 20836 - RNA, 22 nt, Homo sapiens
ucuuggguggauucauucuuuc

SEQ ID NO: 20837 - RNA, 22 nt, Homo sapiens
ucuuggguuuguccuucuccua

SEQ ID NO: 20838 - RNA, 22 nt, Homo sapiens
ucuuucacuuagcaugauguuu

SEQ ID NO: 20839 - RNA, 22 nt, Homo sapiens
ucuuugauuuuguuacuaagac

SEQ ID NO: 20840 - RNA, 22 nt, Homo sapiens
ucuuugccuaacccaaggucau

SEQ ID NO: 20841 - RNA, 22 nt, Homo sapiens
ucuuugguuagguuuaguugau

SEQ ID NO: 20842 - RNA, 22 nt, Homo sapiens
ucuuugucuacauccuguuaaa

SEQ ID NO: 20843 - RNA, 22 nt, Homo sapiens
ucuuuuugagucaguuucggua

SEQ ID NO: 20844 - RNA, 22 nt, Homo sapiens
ugaaagcuacagucuccuagga

SEQ ID NO: 20845 - RNA, 22 nt, Homo sapiens
ugaacagucaucucucuuguau

SEQ ID NO: 20846 - RNA, 22 nt, Homo sapiens
ugaagacauuuuugggugugua

SEQ ID NO: 20847 - RNA, 22 nt, Homo sapiens
ugaagacucaauuauuaugaac

SEQ ID NO: 20848 - RNA, 22 nt, Homo sapiens
ugaagaucuuaggagcugaggg

SEQ ID NO: 20849 - RNA, 22 nt, Homo sapiens
ugaaguaauguuuuauucuauu

SEQ ID NO: 20850 - RNA, 18 nt, Homo sapiens
ugaauacagcguugggaa

SEQ ID NO: 20851 - RNA, 22 nt, Homo sapiens
ugaauguccugacgcugcaguu

SEQ ID NO: 20852 - RNA, 22 nt, Homo sapiens
ugaauuguuuacgagaugugag

SEQ ID NO: 20853 - RNA, 22 nt, Homo sapiens
ugacaacugauuaacuccuuua

SEQ ID NO: 20854 - RNA, 22 nt, Homo sapiens
ugacacuugcccuuagaaacau

SEQ ID NO: 20855 - RNA, 22 nt, Homo sapiens
ugacagagaagcauugaguuca

SEQ ID NO: 20856 - RNA, 22 nt, Homo sapiens
ugacaggagauuaugugauguu

SEQ ID NO: 20857 - RNA, 23 nt, Homo sapiens
ugacagugcuugaaauugcucuu

SEQ ID NO: 20858 - RNA, 22 nt, Homo sapiens
ugacagugugagacuuugucuc

SEQ ID NO: 20859 - RNA, 22 nt, Homo sapiens
ugacaugaaggcaccucugucc

SEQ ID NO: 20860 - RNA, 22 nt, Homo sapiens
ugacaugaagucucccucuguu

SEQ ID NO: 20861 - RNA, 22 nt, Homo sapiens
ugacaugauuguauauuuagaa

SEQ ID NO: 20862 - RNA, 22 nt, Homo sapiens
ugacauggagggugcggcugca

SEQ ID NO: 20863 - RNA, 22 nt, Homo sapiens
ugacauuacagucacuugcugu

SEQ ID NO: 20864 - RNA, 22 nt, Homo sapiens
ugacauugggagugaagugaag

SEQ ID NO: 20865 - RNA, 17 nt, Homo sapiens
ugaccacugauucuacu

SEQ ID NO: 20866 - RNA, 22 nt, Homo sapiens
ugacuacacacaauuugucaag

SEQ ID NO: 20867 - RNA, 22 nt, Homo sapiens
ugacuacauaaguaaucucaaa

SEQ ID NO: 20868 - RNA, 22 nt, Homo sapiens
ugacuagagggcuuuuguguag

SEQ ID NO: 20869 - RNA, 22 nt, Homo sapiens
ugacucaagagccugacucauc

SEQ ID NO: 20870 - RNA, 22 nt, Homo sapiens
ugacucaguuucucagguagua

SEQ ID NO: 20871 - RNA, 22 nt, Homo sapiens
ugacuggagaccucaguagggu

SEQ ID NO: 20872 - RNA, 20 nt, Homo sapiens
ugacuggauacccuuuggcu

SEQ ID NO: 20873 - RNA, 18 nt, Homo sapiens
ugacuguccagguggacc

SEQ ID NO: 20874 - RNA, 22 nt, Homo sapiens
ugacugugcagcuccaucaggg

SEQ ID NO: 20875 - RNA, 22 nt, Homo sapiens
ugacuucagacugaaaugauuc

SEQ ID NO: 20876 - RNA, 22 nt, Homo sapiens
ugacuugaggcucgcacaaguu

SEQ ID NO: 20877 - RNA, 22 nt, Homo sapiens
ugacuugaguaacuggcucagg

SEQ ID NO: 20878 - RNA, 22 nt, Homo sapiens
ugacuuuagaauuuuauccaga

SEQ ID NO: 20879 - RNA, 22 nt, Homo sapiens
ugagaagacaucagcuuucgga

SEQ ID NO: 20880 - RNA, 22 nt, Homo sapiens
uagcagccaggaagggcuggcu

SEQ ID NO: 20881 - RNA, 22 nt, Homo sapiens
uagcauaauuuguagaaaauca

SEQ ID NO: 20882 - RNA, 22 nt, Homo sapiens
uagcaugacacuuguugaaugc

SEQ ID NO: 20883 - RNA, 22 nt, Homo sapiens
uagcugcccagcacgaaguugg

SEQ ID NO: 20884 - RNA, 22 nt, Homo sapiens
uagcuggaauuacuugcaccug

SEQ ID NO: 20885 - RNA, 22 nt, Homo sapiens
uagcuggaguuuuuguuauagg

SEQ ID NO: 20886 - RNA, 22 nt, Homo sapiens
uagcugguucuccaggagcuag

SEQ ID NO: 20887 - RNA, 22 nt, Homo sapiens
uaggagcacaaacccuacugug

SEQ ID NO: 20888 - RNA, 22 nt, Homo sapiens
uaggcagccagcuguggauuga

SEQ ID NO: 20889 - RNA, 22 nt, Homo sapiens
uagguaguugugggcuugaaug

SEQ ID NO: 20890 - RNA, 22 nt, Homo sapiens
uagguauguauauacacacaca

SEQ ID NO: 20891 - RNA, 22 nt, Homo sapiens
uaggucaguuuuggcuuggcuu

SEQ ID NO: 20892 - RNA, 23 nt, Homo sapiens
uagguuauuugguaaauauaugu

SEQ ID NO: 20893 - RNA, 22 nt, Homo sapiens
uaguacccuugaagcagacaua

SEQ ID NO: 20894 - RNA, 22 nt, Homo sapiens
uaguaguuuuguguauaauaau

SEQ ID NO: 20895 - RNA, 20 nt, Homo sapiens
uagucaugagauucuccaag

SEQ ID NO: 20896 - RNA, 22 nt, Homo sapiens
uaguuuaucuucuggauggaca

SEQ ID NO: 20897 - RNA, 22 nt, Homo sapiens
uauacaugugccauguuggugu

SEQ ID NO: 20898 - RNA, 20 nt, Homo sapiens
uauagcaauuuuuuucuccu

SEQ ID NO: 20899 - RNA, 22 nt, Homo sapiens
uauauagcuaugucuguccauu

SEQ ID NO: 20900 - RNA, 22 nt, Homo sapiens
uauaucacaugcacucauuuuc

SEQ ID NO: 20901 - RNA, 22 nt, Homo sapiens
uaucaaguuggaagagaaguaa

SEQ ID NO: 20902 - RNA, 22 nt, Homo sapiens
uaucacagauauuaugggccaa

SEQ ID NO: 20903 - RNA, 22 nt, Homo sapiens
uaucacagcaaggacccauuau

SEQ ID NO: 20904 - RNA, 20 nt, Homo sapiens
uaucacaggucagaaacccu

SEQ ID NO: 20905 - RNA, 22 nt, Homo sapiens
uaucacagguggacugcacacc

SEQ ID NO: 20906 - RNA, 22 nt, Homo sapiens
uaucacaguaaaucugggugca

SEQ ID NO: 20907 - RNA, 21 nt, Homo sapiens
uaucagagacauugagaggca

SEQ ID NO: 20908 - RNA, 22 nt, Homo sapiens
uaucagagcugucagccuaccu

SEQ ID NO: 20909 - RNA, 21 nt, Homo sapiens
uaucauggccauccucuucuc

SEQ ID NO: 20910 - RNA, 22 nt, Homo sapiens
uaucauuguguuauuucuucca

SEQ ID NO: 20911 - RNA, 22 nt, Homo sapiens
uauccuguagcucauccaccgc

SEQ ID NO: 20912 - RNA, 22 nt, Homo sapiens
uaucucuuuucauguguaaaug

SEQ ID NO: 20913 - RNA, 22 nt, Homo sapiens
uaugaaucugagagaucuggaa

SEQ ID NO: 20914 - RNA, 23 nt, Homo sapiens
uaugacagaggaagggggagcug

SEQ ID NO: 20915 - RNA, 22 nt, Homo sapiens
uaugacugagacuuaaauugug

SEQ ID NO: 20916 - RNA, 22 nt, Homo sapiens
uaugacuuuugaauacagaugg

SEQ ID NO: 20917 - RNA, 22 nt, Homo sapiens
uaguuguugcagguaggaugua

SEQ ID NO: 20918 - RNA, 22 nt, Homo sapiens
uauacugucuuuguaugccuag

SEQ ID NO: 20919 - RNA, 22 nt, Homo sapiens
uauacuguuuucuauaguggcu

SEQ ID NO: 20920 - RNA, 22 nt, Homo sapiens
uauagcagugaguauugacuaa

SEQ ID NO: 20921 - RNA, 22 nt, Homo sapiens
uauauguucuugcacuggaaag

SEQ ID NO: 20922 - RNA, 22 nt, Homo sapiens
uaucaacaggguggccagugua

SEQ ID NO: 20923 - RNA, 22 nt, Homo sapiens
uaucacacgccuugcuucauuu

SEQ ID NO: 20924 - RNA, 22 nt, Homo sapiens
uaucacacuggaagaaguuaag

SEQ ID NO: 20925 - RNA, 22 nt, Homo sapiens
uaucagcacaguggguucaugg

SEQ ID NO: 20926 - RNA, 22 nt, Homo sapiens
uaucagcagagucauacuucaa

SEQ ID NO: 20927 - RNA, 22 nt, Homo sapiens
uaucccuuagagcggggugguu

SEQ ID NO: 20928 - RNA, 22 nt, Homo sapiens
uaucuacauguagguauguaug

SEQ ID NO: 20929 - RNA, 22 nt, Homo sapiens
uaugaaucuggcuacuccaggg

SEQ ID NO: 20930 - RNA, 20 nt, Homo sapiens
uaugacaaagccuagugagu

SEQ ID NO: 20931 - RNA, 22 nt, Homo sapiens
uaugcacaugcaugcuugaaua

SEQ ID NO: 20932 - RNA, 22 nt, Homo sapiens
uauggauuugccuauucuguau

SEQ ID NO: 20933 - RNA, 22 nt, Homo sapiens
uauggcuacuacgaauaaugcu

SEQ ID NO: 20934 - RNA, 22 nt, Homo sapiens
uauggcugcuuucacacuacaa

SEQ ID NO: 20935 - RNA, 17 nt, Homo sapiens
uauguaguacuuauaaa

SEQ ID NO: 20936 - RNA, 22 nt, Homo sapiens
uaugucacuggacauaaguucu

SEQ ID NO: 20937 - RNA, 22 nt, Homo sapiens
uaugucaugggguuuuugagau

SEQ ID NO: 20938 - RNA, 22 nt, Homo sapiens
uaugucuggaguuacugagcug

SEQ ID NO: 20939 - RNA, 22 nt, Homo sapiens
uauguuaucaaaaagcuaagga

SEQ ID NO: 20940 - RNA, 20 nt, Homo sapiens
uauuacagaguaauggugga

SEQ ID NO: 20941 - RNA, 22 nt, Homo sapiens
uauuccacaauaugauuuuuaa

SEQ ID NO: 20942 - RNA, 22 nt, Homo sapiens
uauuccauuugugaaaggaagu

SEQ ID NO: 20943 - RNA, 22 nt, Homo sapiens
uauugaauuugagcugucucuu

SEQ ID NO: 20944 - RNA, 17 nt, Homo sapiens
uauugaccuuuguaugu

SEQ ID NO: 20945 - RNA, 22 nt, Homo sapiens
uauugcagaaugugaguuggca

SEQ ID NO: 20946 - RNA, 22 nt, Homo sapiens
uauugcccugcuuuguucuaaa

SEQ ID NO: 20947 - RNA, 22 nt, Homo sapiens
uauugcugaugcugaagggaag

SEQ ID NO: 20948 - RNA, 22 nt, Homo sapiens
uauugcuggcacauaguagguc

SEQ ID NO: 20949 - RNA, 22 nt, Homo sapiens
uauugucacuaaaggaagcugg

SEQ ID NO: 20950 - RNA, 22 nt, Homo sapiens
uauuguccacuuugcacugugu

SEQ ID NO: 20951 - RNA, 22 nt, Homo sapiens
uauuguuaaagauguuaaugau

SEQ ID NO: 20952 - RNA, 22 nt, Homo sapiens
uauuugauugacuuuagcagga

SEQ ID NO: 20953 - RNA, 22 nt, Homo sapiens
uauuugcacucccaucauggug

SEQ ID NO: 20954 - RNA, 22 nt, Homo sapiens
ucaaaaccucagagaguagagc

SEQ ID NO: 20955 - RNA, 22 nt, Homo sapiens
ucaaagacacacaaggagaagg

SEQ ID NO: 20956 - RNA, 18 nt, Homo sapiens
ucaaauacuuugggcagu

SEQ ID NO: 20957 - RNA, 17 nt, Homo sapiens
ucaaaugcucccaguga

SEQ ID NO: 20958 - RNA, 22 nt, Homo sapiens
ucaacacaguuaaauggggaaa

SEQ ID NO: 20959 - RNA, 22 nt, Homo sapiens
ucaacagugggcacuguaaaug

SEQ ID NO: 20960 - RNA, 22 nt, Homo sapiens
ucaacauugcugucaggcaucu

SEQ ID NO: 20961 - RNA, 22 nt, Homo sapiens
ucaacguauuuauauagcagag

SEQ ID NO: 20962 - RNA, 20 nt, Homo sapiens
ucaaggcacgaauaaaaguu

SEQ ID NO: 20963 - RNA, 22 nt, Homo sapiens
ucaaguagugacucgaguuauu

SEQ ID NO: 20964 - RNA, 22 nt, Homo sapiens
ucaauguaucuccaagaauuga

SEQ ID NO: 20965 - RNA, 19 nt, Homo sapiens
ucaauucugucaauggcuu

SEQ ID NO: 20966 - RNA, 22 nt, Homo sapiens
ucacaaggcaggaaugaaaggg

SEQ ID NO: 20967 - RNA, 22 nt, Homo sapiens
ucacaauguaaaugaggguugg

SEQ ID NO: 20968 - RNA, 22 nt, Homo sapiens
ucacagacauugaggggaccuu

SEQ ID NO: 20969 - RNA, 22 nt, Homo sapiens
ucacagccuaguuuuauacauu

SEQ ID NO: 20970 - RNA, 22 nt, Homo sapiens
ucacaguccuguuuaggagagg

SEQ ID NO: 20971 - RNA, 22 nt, Homo sapiens
ucacaguugauugaaacacagc

SEQ ID NO: 20972 - RNA, 22 nt, Homo sapiens
ucacauggaaaaguccaguaaa

SEQ ID NO: 20973 - RNA, 22 nt, Homo sapiens
ucacauggaggugauaguugaa

SEQ ID NO: 20974 - RNA, 22 nt, Homo sapiens
ucacauuguacaaacagguaag

SEQ ID NO: 20975 - RNA, 22 nt, Homo sapiens
ucaccaccuuccaggaccacug

SEQ ID NO: 20976 - RNA, 19 nt, Homo sapiens
ucaccaguacacaauacaa

SEQ ID NO: 20977 - RNA, 20 nt, Homo sapiens
ucacccugacaucugcccag

SEQ ID NO: 20978 - RNA, 22 nt, Homo sapiens
ucacccuguguuuugcguuugc

SEQ ID NO: 20979 - RNA, 22 nt, Homo sapiens
ucaccuggagccuucacauucu

SEQ ID NO: 20980 - RNA, 18 nt, Homo sapiens
ucacggggagcagcagcc

SEQ ID NO: 20981 - RNA, 19 nt, Homo sapiens
ucacgugcagcagccacac

SEQ ID NO: 20982 - RNA, 21 nt, Homo sapiens
ucacugagcaucaugguuuca

SEQ ID NO: 20983 - RNA, 22 nt, Homo sapiens
ucacugcgaccucugccucccg

SEQ ID NO: 20984 - RNA, 20 nt, Homo sapiens
ucacugugaacuucuugagg

SEQ ID NO: 20985 - RNA, 22 nt, Homo sapiens
ucacugugguuuugaugugcau

SEQ ID NO: 20986 - RNA, 22 nt, Homo sapiens
ucacuguugaugggcaugcagg

SEQ ID NO: 20987 - RNA, 22 nt, Homo sapiens
ucagaacugaacaaaccagucu

SEQ ID NO: 20988 - RNA, 19 nt, Homo sapiens
uggagucaucaugcugcua

SEQ ID NO: 20989 - RNA, 20 nt, Homo sapiens
uggagugaagguucuggacc

SEQ ID NO: 20990 - RNA, 22 nt, Homo sapiens
uggagugauaugguuauauggg

SEQ ID NO: 20991 - RNA, 22 nt, Homo sapiens
uggagugcaauggcaccaucuu

SEQ ID NO: 20992 - RNA, 22 nt, Homo sapiens
uggaguguaauuagccaucagu

SEQ ID NO: 20993 - RNA, 22 nt, Homo sapiens
uggaguguagcggcaccuauua

SEQ ID NO: 20994 - RNA, 22 nt, Homo sapiens
uggaguguuggggcaggaucuc

SEQ ID NO: 20995 - RNA, 20 nt, Homo sapiens
uggaguuguggcaguuugga

SEQ ID NO: 20996 - RNA, 22 nt, Homo sapiens
uggaucauucuuucuugcaggg

SEQ ID NO: 20997 - RNA, 22 nt, Homo sapiens
uggaugaagagaugguaguugc

SEQ ID NO: 20998 - RNA, 22 nt, Homo sapiens
uggauuuuaauuauucugucau

SEQ ID NO: 20999 - RNA, 22 nt, Homo sapiens
uggcaaaaaucacaaguaccuu

SEQ ID NO: 21000 - RNA, 22 nt, Homo sapiens
uggcaaaugaagucagcuguac

SEQ ID NO: 21001 - RNA, 22 nt, Homo sapiens
uggcaaauuccaaaguuaauuc

SEQ ID NO: 21002 - RNA, 22 nt, Homo sapiens
uggcaacaucuggggacauguu

SEQ ID NO: 21003 - RNA, 22 nt, Homo sapiens
uggcaccauccaggugucucua

SEQ ID NO: 21004 - RNA, 22 nt, Homo sapiens
uggcagacaaauuugagcauau

SEQ ID NO: 21005 - RNA, 22 nt, Homo sapiens
uggcagcgcaguugaaaaagaa

SEQ ID NO: 21006 - RNA, 22 nt, Homo sapiens
uggcaugcauuguggguaauua

SEQ ID NO: 21007 - RNA, 22 nt, Homo sapiens
uggcauggucugcccaaguuuc

SEQ ID NO: 21008 - RNA, 22 nt, Homo sapiens
uggccaagagcacagauauugg

SEQ ID NO: 21009 - RNA, 23 nt, Homo sapiens
uggccaagauaaucucaguuuuc

SEQ ID NO: 21010 - RNA, 22 nt, Homo sapiens
uggcuguuguuacuaacaguuc

SEQ ID NO: 21011 - RNA, 22 nt, Homo sapiens
uggcuguuuauuucacaugggu

SEQ ID NO: 21012 - RNA, 22 nt, Homo sapiens
uggcuuuuaucuacucucaacu

SEQ ID NO: 21013 - RNA, 22 nt, Homo sapiens
ugggagcauugcauuagaagcc

SEQ ID NO: 21014 - RNA, 22 nt, Homo sapiens
ugggaugaaaauagcuucuucc

SEQ ID NO: 21015 - RNA, 22 nt, Homo sapiens
ugggaugaugcuugagaauauc

SEQ ID NO: 21016 - RNA, 22 nt, Homo sapiens
ugggcaguauggucauuuucgu

SEQ ID NO: 21017 - RNA, 22 nt, Homo sapiens
uggguagagaaucaggaucuua

SEQ ID NO: 21018 - RNA, 22 nt, Homo sapiens
ugggugugaccgcucaaggggg

SEQ ID NO: 21019 - RNA, 22 nt, Homo sapiens
ugguauguguucuaaaauuaug

SEQ ID NO: 21020 - RNA, 22 nt, Homo sapiens
ugguauguuuauaaguauagga

SEQ ID NO: 21021 - RNA, 22 nt, Homo sapiens
uggucaguugaguccuugccaa

SEQ ID NO: 21022 - RNA, 21 nt, Homo sapiens
uggucccuucagaucggauuu

SEQ ID NO: 21023 - RNA, 22 nt, Homo sapiens
ugguccuuuccauuggagacac

SEQ ID NO: 21024 - RNA, 22 nt, Homo sapiens
uggucuuuucaacaaaugguau

SEQ ID NO: 21025 - RNA, 22 nt, Homo sapiens
acugagacugagaauguuucuu

SEQ ID NO: 21026 - RNA, 21 nt, Homo sapiens
acugagagaucuggggcacau

SEQ ID NO: 21027 - RNA, 22 nt, Homo sapiens
acugcacuccagccucaugaca

SEQ ID NO: 21028 - RNA, 22 nt, Homo sapiens
acugcacuccagcuccagggug

SEQ ID NO: 21029 - RNA, 22 nt, Homo sapiens
acugcacuccagcuugggugac

SEQ ID NO: 21030 - RNA, 20 nt, Homo sapiens
acugcacuccaggcugccca

SEQ ID NO: 21031 - RNA, 22 nt, Homo sapiens
acugcacuccaguuugggcagc

SEQ ID NO: 21032 - RNA, 22 nt, Homo sapiens
acugcacuccggccuggcaaca

SEQ ID NO: 21033 - RNA, 22 nt, Homo sapiens
acugcacuguccuagaguccuc

SEQ ID NO: 21034 - RNA, 22 nt, Homo sapiens
acugcacuucaaccucauugac

SEQ ID NO: 21035 - RNA, 20 nt, Homo sapiens
acugcauuuaguccucagga

SEQ ID NO: 21036 - RNA, 22 nt, Homo sapiens
acugcauuugucugucucaauu

SEQ ID NO: 21037 - RNA, 22 nt, Homo sapiens
acuggcauagggcgggcacagu

SEQ ID NO: 21038 - RNA, 22 nt, Homo sapiens
acuggcucugcuuuacaaacag

SEQ ID NO: 21039 - RNA, 22 nt, Homo sapiens
acugggucaaaguagaaaacua

SEQ ID NO: 21040 - RNA, 22 nt, Homo sapiens
acuguacuccagccugggcaac

SEQ ID NO: 21041 - RNA, 22 nt, Homo sapiens
acuuauuguggcugacccaaac

SEQ ID NO: 21042 - RNA, 22 nt, Homo sapiens
acuugacacuuauauuacucac

SEQ ID NO: 21043 - RNA, 17 nt, Homo sapiens
acuuuuugaggaggcau

SEQ ID NO: 21044 - RNA, 22 nt, Homo sapiens
acuuuuugaugaggucguuugu

SEQ ID NO: 21045 - RNA, 23 nt, Homo sapiens
agaaaugucuauucagggucccu

SEQ ID NO: 21046 - RNA, 22 nt, Homo sapiens
agaaauguuuacucacccccuu

SEQ ID NO: 21047 - RNA, 22 nt, Homo sapiens
agaaauguuuauucaaacccgu

SEQ ID NO: 21048 - RNA, 22 nt, Homo sapiens
agaagacuauucuggguugggc

SEQ ID NO: 21049 - RNA, 20 nt, Homo sapiens
agaagcauugcucucuucag

SEQ ID NO: 21050 - RNA, 22 nt, Homo sapiens
agacaguguguguauauauggu

SEQ ID NO: 21051 - RNA, 22 nt, Homo sapiens
agacucauuuuuaucgagcaug

SEQ ID NO: 21052 - RNA, 22 nt, Homo sapiens
agagauacauucugagaagugc

SEQ ID NO: 21053 - RNA, 20 nt, Homo sapiens
agagcaaagccgcaccccua

SEQ ID NO: 21054 - RNA, 22 nt, Homo sapiens
agagccacauuaaauaugggaa

SEQ ID NO: 21055 - RNA, 22 nt, Homo sapiens
agagguuuaacuggcuuauggu

SEQ ID NO: 21056 - RNA, 22 nt, Homo sapiens
agagguuuaauugauucacagu

SEQ ID NO: 21057 - RNA, 18 nt, Homo sapiens
agaguaucauuuccccca

SEQ ID NO: 21058 - RNA, 21 nt, Homo sapiens
agagucaucucuaucuguacc

SEQ ID NO: 21059 - RNA, 22 nt, Homo sapiens
agaucacagucuuugguuuuag

SEQ ID NO: 21060 - RNA, 22 nt, Homo sapiens
agaugcuguuaucaacuguagc

SEQ ID NO: 21061 - RNA, 22 nt, Homo sapiens
agaugguguuuucucaccagau

SEQ ID NO: 21062 - RNA, 22 nt, Homo sapiens
agcaauaugacauugcuacauc

SEQ ID NO: 21063 - RNA, 23 nt, Homo sapiens
agcaccuuuccuccacuaucugc

SEQ ID NO: 21064 - RNA, 22 nt, Homo sapiens
agcagagcaguggauuuuguga

SEQ ID NO: 21065 - RNA, 22 nt, Homo sapiens
agcagcaucgggaaguuggcca

SEQ ID NO: 21066 - RNA, 22 nt, Homo sapiens
agcagcauuaguggaaucuugu

SEQ ID NO: 21067 - RNA, 22 nt, Homo sapiens
agcagcauuaugauauaucuua

SEQ ID NO: 21068 - RNA, 21 nt, Homo sapiens
agcagcuuugguugaagcaga

SEQ ID NO: 21069 - RNA, 22 nt, Homo sapiens
agcagguauucgggucaugggg

SEQ ID NO: 21070 - RNA, 16 nt, Homo sapiens
agcagguguuagguga

SEQ ID NO: 21071 - RNA, 20 nt, Homo sapiens
agcaucguuguguuauagcc

SEQ ID NO: 21072 - RNA, 20 nt, Homo sapiens
agcauugguuagaacaguag

SEQ ID NO: 21073 - RNA, 22 nt, Homo sapiens
agccaagacucuguuccccuug

SEQ ID NO: 21074 - RNA, 21 nt, Homo sapiens
agccaguguuccuuguggcuc

SEQ ID NO: 21075 - RNA, 22 nt, Homo sapiens
agcccuuagauggcuccuucca

SEQ ID NO: 21076 - RNA, 23 nt, Homo sapiens
agccugguuucccugcuucuccc

SEQ ID NO: 21077 - RNA, 22 nt, Homo sapiens
agcgccacugcacuccagccug

SEQ ID NO: 21078 - RNA, 21 nt, Homo sapiens
agcuaaauuggaaauuucugu

SEQ ID NO: 21079 - RNA, 22 nt, Homo sapiens
agcuaacauuuuuccucuucca

SEQ ID NO: 21080 - RNA, 22 nt, Homo sapiens
agcucacagccuagcacuguga

SEQ ID NO: 21081 - RNA, 18 nt, Homo sapiens
agcucaguguuugcuuac

SEQ ID NO: 21082 - RNA, 20 nt, Homo sapiens
agcuggguguguuggugcau

SEQ ID NO: 21083 - RNA, 22 nt, Homo sapiens
agcuggucuuggggaagaguag

SEQ ID NO: 21084 - RNA, 19 nt, Homo sapiens
agcuguguugccugugaga

SEQ ID NO: 21085 - RNA, 21 nt, Homo sapiens
agcuuguguguaucacagugu

SEQ ID NO: 21086 - RNA, 22 nt, Homo sapiens
agcuuguuuucccauaacuaga

SEQ ID NO: 21087 - RNA, 22 nt, Homo sapiens
aggaagugugcaauuaauuucu

SEQ ID NO: 21088 - RNA, 21 nt, Homo sapiens
aggagcauucaugacgagguu

SEQ ID NO: 21089 - RNA, 23 nt, Homo sapiens
aggagcuuagaaguugccauugc

SEQ ID NO: 21090 - RNA, 22 nt, Homo sapiens
aggagcuuuggggaaaacagau

SEQ ID NO: 21091 - RNA, 22 nt, Homo sapiens
aggagguagggugugaaacagc

SEQ ID NO: 21092 - RNA, 22 nt, Homo sapiens
aggagguagucugucccuuagc

SEQ ID NO: 21093 - RNA, 22 nt, Homo sapiens
aggcaacaugguaaaacccugu

SEQ ID NO: 21094 - RNA, 22 nt, Homo sapiens
aggcaacgcuucuuucucaggu

SEQ ID NO: 21095 - RNA, 21 nt, Homo sapiens
aggcaagacuuuuagguuugu

SEQ ID NO: 21096 - RNA, 22 nt, Homo sapiens
aggcaagugggagacagcauuu

SEQ ID NO: 21097 - RNA, 22 nt, Homo sapiens
aggcagucucugccggcugagg

SEQ ID NO: 21098 - RNA, 22 nt, Homo sapiens
aggcaugguggcacauacaugu

SEQ ID NO: 21099 - RNA, 22 nt, Homo sapiens
aggcauugugcaucgaugauuu

SEQ ID NO: 21100 - RNA, 22 nt, Homo sapiens
aggcuagaaucuuccaucuugg

SEQ ID NO: 21101 - RNA, 22 nt, Homo sapiens
agggaagugugcuaugcauuua

SEQ ID NO: 21102 - RNA, 22 nt, Homo sapiens
agggagcaaaguggucuuucuc

SEQ ID NO: 21103 - RNA, 22 nt, Homo sapiens
agguaagaugugacuugguguu

SEQ ID NO: 21104 - RNA, 22 nt, Homo sapiens
agguauguaugucuguacagcg

SEQ ID NO: 21105 - RNA, 22 nt, Homo sapiens
aggucaccucaggaaauacuga

SEQ ID NO: 21106 - RNA, 22 nt, Homo sapiens
agguccacuuacuacuccuguu

SEQ ID NO: 21107 - RNA, 22 nt, Homo sapiens
aggucccauguccucccugacc

SEQ ID NO: 21108 - RNA, 22 nt, Homo sapiens
aggugcacucagaaaacagaua

SEQ ID NO: 21109 - RNA, 22 nt, Homo sapiens
agguuaugauuauagagcgagg

SEQ ID NO: 21110 - RNA, 22 nt, Homo sapiens
agguuaugauuguagagcgagg

SEQ ID NO: 21111 - RNA, 18 nt, Homo sapiens
agguuauuucccaagacu

SEQ ID NO: 21112 - RNA, 22 nt, Homo sapiens
aguaacacaccugcauggugug

SEQ ID NO: 21113 - RNA, 22 nt, Homo sapiens
aguaacauuucuaguagagagu

SEQ ID NO: 21114 - RNA, 22 nt, Homo sapiens
aguaagauggcaacucuccaca

SEQ ID NO: 21115 - RNA, 22 nt, Homo sapiens
aguacacuguugaacagaagug

SEQ ID NO: 21116 - RNA, 22 nt, Homo sapiens
aguaccauuagauuaggaugac

SEQ ID NO: 21117 - RNA, 22 nt, Homo sapiens
aguauuaggugaguguauuuca

SEQ ID NO: 21118 - RNA, 22 nt, Homo sapiens
agucaagaugagauuugggugg

SEQ ID NO: 21119 - RNA, 22 nt, Homo sapiens
agucacaugccagcacacccag

SEQ ID NO: 21120 - RNA, 22 nt, Homo sapiens
agucaguguguauugauggcac

SEQ ID NO: 21121 - RNA, 22 nt, Homo sapiens
agucgguguuacugacagaaug

SEQ ID NO: 21122 - RNA, 22 nt, Homo sapiens
agugaauguuggaaaguuauuu

SEQ ID NO: 21123 - RNA, 22 nt, Homo sapiens
agugacaugggaucaaaucuga

SEQ ID NO: 21124 - RNA, 19 nt, Homo sapiens
agugagccaagauccuacc

SEQ ID NO: 21125 - RNA, 22 nt, Homo sapiens
agugauggagccaggauuuaau

SEQ ID NO: 21126 - RNA, 22 nt, Homo sapiens
agugcaaugauccggugcuggg

SEQ ID NO: 21127 - RNA, 22 nt, Homo sapiens
agugcaauggugccaucauagc

SEQ ID NO: 21128 - RNA, 22 nt, Homo sapiens
agugcacuccagccugggcaac

SEQ ID NO: 21129 - RNA, 22 nt, Homo sapiens
acaggagugggauuugaguccu

SEQ ID NO: 21130 - RNA, 22 nt, Homo sapiens
acagguacaagggauuaggaug

SEQ ID NO: 21131 - RNA, 22 nt, Homo sapiens
acagguauagaaagcuaaaggg

SEQ ID NO: 21132 - RNA, 22 nt, Homo sapiens
acaggugaaguauuacacuaag

SEQ ID NO: 21133 - RNA, 22 nt, Homo sapiens
acagucuggagaaugggugcuc

SEQ ID NO: 21134 - RNA, 22 nt, Homo sapiens
acaguggugcgaucucggcuca

SEQ ID NO: 21135 - RNA, 23 nt, Homo sapiens
acaguggugugaucuuggcucag

SEQ ID NO: 21136 - RNA, 19 nt, Homo sapiens
acagugucucuauaaugau

SEQ ID NO: 21137 - RNA, 22 nt, Homo sapiens
acaguguguguguucaccuaga

SEQ ID NO: 21138 - RNA, 22 nt, Homo sapiens
acauaguagacacugaaaauau

SEQ ID NO: 21139 - RNA, 22 nt, Homo sapiens
acauaugaguacaugugccaug

SEQ ID NO: 21140 - RNA, 18 nt, Homo sapiens
acaucccaugcuggggug

SEQ ID NO: 21141 - RNA, 22 nt, Homo sapiens
acaucuguacaguggguguggu

SEQ ID NO: 21142 - RNA, 22 nt, Homo sapiens
acaugguacugauuuacgaaau

SEQ ID NO: 21143 - RNA, 21 nt, Homo sapiens
acauguacacauguaugcaca

SEQ ID NO: 21144 - RNA, 19 nt, Homo sapiens
accagauugcauucuugga

SEQ ID NO: 21145 - RNA, 22 nt, Homo sapiens
accaugcaguccaauaugcaca

SEQ ID NO: 21146 - RNA, 22 nt, Homo sapiens
acccagaguuccuugucuuuca

SEQ ID NO: 21147 - RNA, 17 nt, Homo sapiens
acccagucuuuuugcac

SEQ ID NO: 21148 - RNA, 22 nt, Homo sapiens
acccaguguucaacauucacau

SEQ ID NO: 21149 - RNA, 21 nt, Homo sapiens
acccucuaguuuucaacaggc

SEQ ID NO: 21150 - RNA, 22 nt, Homo sapiens
acccugugagagaguuaauauu

SEQ ID NO: 21151 - RNA, 22 nt, Homo sapiens
accugagauuacaggugcuggc

SEQ ID NO: 21152 - RNA, 22 nt, Homo sapiens
accuggcacuuagcaaaucuga

SEQ ID NO: 21153 - RNA, 22 nt, Homo sapiens
accugguuuuaacauuguauua

SEQ ID NO: 21154 - RNA, 22 nt, Homo sapiens
cugugaucuuuuuucauguggu

SEQ ID NO: 21155 - RNA, 22 nt, Homo sapiens
cugugcaaguuauaggccaggu

SEQ ID NO: 21156 - RNA, 22 nt, Homo sapiens
cugugcauuggaugucucccug

SEQ ID NO: 21157 - RNA, 22 nt, Homo sapiens
cugugcuaggcaaugugguaga

SEQ ID NO: 21158 - RNA, 19 nt, Homo sapiens
cuguggucauuauuuugcu

SEQ ID NO: 21159 - RNA, 22 nt, Homo sapiens
cuguuagguuaaggaauggcaa

SEQ ID NO: 21160 - RNA, 22 nt, Homo sapiens
cuguucaaauuguuugugaagu

SEQ ID NO: 21161 - RNA, 22 nt, Homo sapiens
cuguugguuaaauuccaugcag

SEQ ID NO: 21162 - RNA, 22 nt, Homo sapiens
cuuagguuaugauaaauuuagu

SEQ ID NO: 21163 - RNA, 22 nt, Homo sapiens
cuucaaaguuggcuaggagaca

SEQ ID NO: 21164 - RNA, 17 nt, Homo sapiens
cuucaaauaauuucccc

SEQ ID NO: 21165 - RNA, 22 nt, Homo sapiens
cuucaaguaauucugauggcua

SEQ ID NO: 21166 - RNA, 20 nt, Homo sapiens
cuucacagaaguggaaucau

SEQ ID NO: 21167 - RNA, 22 nt, Homo sapiens
cuucacuggagucccuggauuc

SEQ ID NO: 21168 - RNA, 22 nt, Homo sapiens
cuucugauugaaaauggaguag

SEQ ID NO: 21169 - RNA, 22 nt, Homo sapiens
cuugaauguaaauaauguacag

SEQ ID NO: 21170 - RNA, 22 nt, Homo sapiens
cuugagacauuguuuuccaagu

SEQ ID NO: 21171 - RNA, 22 nt, Homo sapiens
cuugcacucagaagauucaguu

SEQ ID NO: 21172 - RNA, 22 nt, Homo sapiens
cuugcacuguuguaagggacuu

SEQ ID NO: 21173 - RNA, 19 nt, Homo sapiens
cuugccccauucauccucu

SEQ ID NO: 21174 - RNA, 22 nt, Homo sapiens
cuugccuaaucugcaugauuuu

SEQ ID NO: 21175 - RNA, 22 nt, Homo sapiens
cuuggcacucuguggaguuagg

SEQ ID NO: 21176 - RNA, 22 nt, Homo sapiens
cuuggcauuguguugauagaag

SEQ ID NO: 21177 - RNA, 18 nt, Homo sapiens
cuugucaaaucuuuccuc

SEQ ID NO: 21178 - RNA, 21 nt, Homo sapiens
cuugucuugcuuagaauagac

SEQ ID NO: 21179 - RNA, 22 nt, Homo sapiens
cuuguucuccuaagaugaaugc

SEQ ID NO: 21180 - RNA, 22 nt, Homo sapiens
cuuuaugagguuggauggaucu

SEQ ID NO: 21181 - RNA, 22 nt, Homo sapiens
cuuugauuauaaaaggguguuu

SEQ ID NO: 21182 - RNA, 20 nt, Homo sapiens
cuuuggcaaugagaacaggg

SEQ ID NO: 21183 - RNA, 22 nt, Homo sapiens
cuuuggcauuagccuguauaga

SEQ ID NO: 21184 - RNA, 22 nt, Homo sapiens
cuuuggucaauugcugugggga

SEQ ID NO: 21185 - RNA, 20 nt, Homo sapiens
cuuuguccuccugcugugcu

SEQ ID NO: 21186 - RNA, 22 nt, Homo sapiens
cuuuguccuucaagguguguca

SEQ ID NO: 21187 - RNA, 22 nt, Homo sapiens
cuuugugcccuucugcccauca

SEQ ID NO: 21188 - RNA, 22 nt, Homo sapiens
cuuuguguaggugccucuggcu

SEQ ID NO: 21189 - RNA, 22 nt, Homo sapiens
cuuuugugauucuucaguuacu

SEQ ID NO: 21190 - RNA, 22 nt, Homo sapiens
cuuuugugauucuucaguugcu

SEQ ID NO: 21191 - RNA, 22 nt, Homo sapiens
cuuuuugcaaauacaacucuga

SEQ ID NO: 21192 - RNA, 22 nt, Homo sapiens
cuuuuugcuagagucuaggguc

SEQ ID NO: 21193 - RNA, 22 nt, Homo sapiens
gaaaacugcuucucuggguuuc

SEQ ID NO: 21194 - RNA, 22 nt, Homo sapiens
gaaagcuaaugacuuuggguga

SEQ ID NO: 21195 - RNA, 23 nt, Homo sapiens
gaaauguaagugaugccccacag

SEQ ID NO: 21196 - RNA, 22 nt, Homo sapiens
gaaauguauuaaugaguugaaa

SEQ ID NO: 21197 - RNA, 23 nt, Homo sapiens
gaaaugucuuagugaaauugcuu

SEQ ID NO: 21198 - RNA, 22 nt, Homo sapiens
gaagaacuaggugagaucuaga

SEQ ID NO: 21199 - RNA, 18 nt, Homo sapiens
gaagaaguaggcauggca

SEQ ID NO: 21200 - RNA, 22 nt, Homo sapiens
gaagguauauucuguuaaugcu

SEQ ID NO: 21201 - RNA, 22 nt, Homo sapiens
gaaucacugugguaucccaugc

SEQ ID NO: 21202 - RNA, 22 nt, Homo sapiens
gaaugaauguuuauccuuagau

SEQ ID NO: 21203 - RNA, 22 nt, Homo sapiens
gaaugcaugaggggaucagaug

SEQ ID NO: 21204 - RNA, 22 nt, Homo sapiens
gaauugcacaaaaacugcuugu

SEQ ID NO: 21205 - RNA, 22 nt, Homo sapiens
gacaccugguguggaacuggag

SEQ ID NO: 21206 - RNA, 22 nt, Homo sapiens
gacaguuuggugaggaagacga

SEQ ID NO: 21207 - RNA, 22 nt, Homo sapiens
gacauagagccuugacuucauu

SEQ ID NO: 21208 - RNA, 20 nt, Homo sapiens
gacauguugguuugcugcac

SEQ ID NO: 21209 - RNA, 22 nt, Homo sapiens
gacauguuuuuuaagguuuaug

SEQ ID NO: 21210 - RNA, 22 nt, Homo sapiens
gaccacagacuggaaagagggc

SEQ ID NO: 21211 - RNA, 22 nt, Homo sapiens
gacuagaaauuauuuagugagc

SEQ ID NO: 21212 - RNA, 22 nt, Homo sapiens
gacuagggaaaauuauuuuguu

SEQ ID NO: 21213 - RNA, 22 nt, Homo sapiens
gacuauguuaccuuacacauca

SEQ ID NO: 21214 - RNA, 22 nt, Homo sapiens
gagaaccauuuggagaaaaagu

SEQ ID NO: 21215 - RNA, 22 nt, Homo sapiens
gagaaugaacagacugccucuu

SEQ ID NO: 21216 - RNA, 22 nt, Homo sapiens
gagaaugagaggggaaggccac

SEQ ID NO: 21217 - RNA, 22 nt, Homo sapiens
gagacauguuugcuuaucugag

SEQ ID NO: 21218 - RNA, 22 nt, Homo sapiens
gagacauugacuuuguuccaga

SEQ ID NO: 21219 - RNA, 23 nt, Homo sapiens
gagaccagcuucagaaagcacga

SEQ ID NO: 21220 - RNA, 22 nt, Homo sapiens
gagacucuuagauuggaaaucu

SEQ ID NO: 21221 - RNA, 22 nt, Homo sapiens
gagagcaugugcuggcaucagu

SEQ ID NO: 21222 - RNA, 22 nt, Homo sapiens
gagagguaguuuuuuggucguc

SEQ ID NO: 21223 - RNA, 22 nt, Homo sapiens
gagauaaauaggucacaguucu

SEQ ID NO: 21224 - RNA, 22 nt, Homo sapiens
gagaucaaguauucuccacuaa

SEQ ID NO: 21225 - RNA, 23 nt, Homo sapiens
gagaucauucuggaauuagagug

SEQ ID NO: 21226 - RNA, 22 nt, Homo sapiens
gagaucuuggccaaguuucuua

SEQ ID NO: 21227 - RNA, 22 nt, Homo sapiens
gagauggagucuuuuucuguca

SEQ ID NO: 21228 - RNA, 22 nt, Homo sapiens
gagaugguguuccacugccagu

SEQ ID NO: 21229 - RNA, 22 nt, Homo sapiens
gagaugugguucaaggguguuu

SEQ ID NO: 21230 - RNA, 22 nt, Homo sapiens
gagauguuuguuucacugucac

SEQ ID NO: 21231 - RNA, 22 nt, Homo sapiens
gagcuaguagagugcacccggc

SEQ ID NO: 21232 - RNA, 22 nt, Homo sapiens
gagcuggacuucuuaccuuuuc

SEQ ID NO: 21233 - RNA, 22 nt, Homo sapiens
gaggagauauucugcuggaugg

SEQ ID NO: 21234 - RNA, 22 nt, Homo sapiens
gaggcaguguguccguucucgg

SEQ ID NO: 21235 - RNA, 22 nt, Homo sapiens
gaggcuagauggggaugugucc

SEQ ID NO: 21236 - RNA, 22 nt, Homo sapiens
gagguaggaauaaacauuugaa

SEQ ID NO: 21237 - RNA, 22 nt, Homo sapiens
gagguagguuugguuacaaaag

SEQ ID NO: 21238 - RNA, 22 nt, Homo sapiens
gagguaugauugacauauaaaa

SEQ ID NO: 21239 - RNA, 22 nt, Homo sapiens
auggaagcauaguauucuauug

SEQ ID NO: 21240 - RNA, 22 nt, Homo sapiens
auggaggaggaagcugaaacaa

SEQ ID NO: 21241 - RNA, 22 nt, Homo sapiens
auggauagucucacucacauac

SEQ ID NO: 21242 - RNA, 22 nt, Homo sapiens
auggcaauguaagucagaaaaa

SEQ ID NO: 21243 - RNA, 22 nt, Homo sapiens
auggcacuguguccugggguca

SEQ ID NO: 21244 - RNA, 22 nt, Homo sapiens
auggcagcccucuuuauccaug

SEQ ID NO: 21245 - RNA, 22 nt, Homo sapiens
auggcagugucuagggguguuu

SEQ ID NO: 21246 - RNA, 22 nt, Homo sapiens
auggccuuguauaccuggcaaa

SEQ ID NO: 21247 - RNA, 22 nt, Homo sapiens
auggcucuguuuuuuaugcucu

SEQ ID NO: 21248 - RNA, 22 nt, Homo sapiens
auggcuguuuaagaguuucauu

SEQ ID NO: 21249 - RNA, 22 nt, Homo sapiens
auggcuuuguguucagagcuga

SEQ ID NO: 21250 - RNA, 22 nt, Homo sapiens
augggcuaguaaagacaaacuu

SEQ ID NO: 21251 - RNA, 22 nt, Homo sapiens
augguacuagaguaagaauugu

SEQ ID NO: 21252 - RNA, 22 nt, Homo sapiens
auggucccauucauucacguau

SEQ ID NO: 21253 - RNA, 22 nt, Homo sapiens
auguaaacagaugugcagcuug

SEQ ID NO: 21254 - RNA, 22 nt, Homo sapiens
augucaaggugggugauaguuu

SEQ ID NO: 21255 - RNA, 22 nt, Homo sapiens
augucacugcacuccugccugg

SEQ ID NO: 21256 - RNA, 22 nt, Homo sapiens
augugaaugugaucggauaguc

SEQ ID NO: 21257 - RNA, 22 nt, Homo sapiens
augugacugauggagaauaugu

SEQ ID NO: 21258 - RNA, 22 nt, Homo sapiens
augugcaaagcacuguucagca

SEQ ID NO: 21259 - RNA, 22 nt, Homo sapiens
augugcaagaucauuaaagcuc

SEQ ID NO: 21260 - RNA, 22 nt, Homo sapiens
augugcacaacgugcagguuug

SEQ ID NO: 21261 - RNA, 22 nt, Homo sapiens
augugcauaugaagcacagaca

SEQ ID NO: 21262 - RNA, 22 nt, Homo sapiens
augugcuuuuuaaacagaugcu

SEQ ID NO: 21263 - RNA, 22 nt, Homo sapiens
augugggaggacuuggcuguug

SEQ ID NO: 21264 - RNA, 22 nt, Homo sapiens
auguuaacaucuuaguuuucau

SEQ ID NO: 21265 - RNA, 22 nt, Homo sapiens
auguuagcaucuggcacuaugg

SEQ ID NO: 21266 - RNA, 22 nt, Homo sapiens
auuaacaucuagaguuuuggug

SEQ ID NO: 21267 - RNA, 22 nt, Homo sapiens
auuaaggaguggguucauggug

SEQ ID NO: 21268 - RNA, 22 nt, Homo sapiens
auuaagugcuugccagugcugg

SEQ ID NO: 21269 - RNA, 22 nt, Homo sapiens
auuagaugguuauaggugugag

SEQ ID NO: 21270 - RNA, 22 nt, Homo sapiens
auuagguauuuucuggacaggg

SEQ ID NO: 21271 - RNA, 22 nt, Homo sapiens
auuauauguguaugugcauacc

SEQ ID NO: 21272 - RNA, 22 nt, Homo sapiens
auuaucacaguuuugcauaugg

SEQ ID NO: 21273 - RNA, 22 nt, Homo sapiens
auuauuagucggccagcuguua

SEQ ID NO: 21274 - RNA, 22 nt, Homo sapiens
auucaagugaugugauucuucu

SEQ ID NO: 21275 - RNA, 22 nt, Homo sapiens
auucacugugcuuggccaaauu

SEQ ID NO: 21276 - RNA, 20 nt, Homo sapiens
auucauggaggagcaauugg

SEQ ID NO: 21277 - RNA, 22 nt, Homo sapiens
auucuauaguccuaggauuggg

SEQ ID NO: 21278 - RNA, 22 nt, Homo sapiens
auugagucauuucaaauccaag

SEQ ID NO: 21279 - RNA, 22 nt, Homo sapiens
auugcacaucugcacuacagcc

SEQ ID NO: 21280 - RNA, 22 nt, Homo sapiens
auugcacuccacccugggcaac

SEQ ID NO: 21281 - RNA, 21 nt, Homo sapiens
auugcacuccagccugggcga

SEQ ID NO: 21282 - RNA, 22 nt, Homo sapiens
auugcacuccagccuggggaac

SEQ ID NO: 21283 - RNA, 22 nt, Homo sapiens
auugcacuccagccuggugaca

SEQ ID NO: 21284 - RNA, 22 nt, Homo sapiens
auugcacuccagucugggcaac

SEQ ID NO: 21285 - RNA, 22 nt, Homo sapiens
auugcauaaacacauuucuuau

SEQ ID NO: 21286 - RNA, 22 nt, Homo sapiens
auugccacaucucagaggcaga

SEQ ID NO: 21287 - RNA, 22 nt, Homo sapiens
auuggacagcauuucuagacuu

SEQ ID NO: 21288 - RNA, 22 nt, Homo sapiens
auuggcuuuugaaagucugcga

SEQ ID NO: 21289 - RNA, 22 nt, Homo sapiens
auuguaauuuuagagaaagugg

SEQ ID NO: 21290 - RNA, 22 nt, Homo sapiens
auuguaguuugcuauggcaaua

SEQ ID NO: 21291 - RNA, 22 nt, Homo sapiens
auuuagcaauggagguagugua

SEQ ID NO: 21292 - RNA, 22 nt, Homo sapiens
auuucuacuccuguguccagaa

SEQ ID NO: 21293 - RNA, 22 nt, Homo sapiens
auuugggaaugugcauuauacu

SEQ ID NO: 21294 - RNA, 22 nt, Homo sapiens
auuuggguuuuacaucaggcua

SEQ ID NO: 21295 - RNA, 22 nt, Homo sapiens
caaaagugauugcgguuuuugc

SEQ ID NO: 21296 - RNA, 22 nt, Homo sapiens
caaaagugguucuuauccuuuu

SEQ ID NO: 21297 - RNA, 22 nt, Homo sapiens
caaaugacaucauuucauucaa

SEQ ID NO: 21298 - RNA, 22 nt, Homo sapiens
caaaugaucugcuggccucagc

SEQ ID NO: 21299 - RNA, 22 nt, Homo sapiens
caaaugcuucuauggacugucu

SEQ ID NO: 21300 - RNA, 22 nt, Homo sapiens
caaauugcuugucuguagugga

SEQ ID NO: 21301 - RNA, 22 nt, Homo sapiens
caaauugcuuguggaggauaau

SEQ ID NO: 21302 - RNA, 22 nt, Homo sapiens
caacauccaccuccuggguuca

SEQ ID NO: 21303 - RNA, 22 nt, Homo sapiens
caagacuguccaacauauuggg

SEQ ID NO: 21304 - RNA, 21 nt, Homo sapiens
caauggcacaaucucugcuca

SEQ ID NO: 21305 - RNA, 22 nt, Homo sapiens
cacaaugucuaagauguuucua

SEQ ID NO: 21306 - RNA, 22 nt, Homo sapiens
cacacugucuucaauggguggu

SEQ ID NO: 21307 - RNA, 22 nt, Homo sapiens
cacacugucuucauuacuguag

SEQ ID NO: 21308 - RNA, 22 nt, Homo sapiens
cacagagugagacccugucucu

SEQ ID NO: 21309 - RNA, 22 nt, Homo sapiens
cacagcacaggcaugaguguca

SEQ ID NO: 21310 - RNA, 22 nt, Homo sapiens
cacagcuaacaacuguuucuuc

SEQ ID NO: 21311 - RNA, 22 nt, Homo sapiens
cacauagucccugcuaaucuuc

SEQ ID NO: 21312 - RNA, 21 nt, Homo sapiens
cacauggaggcagagagugua

SEQ ID NO: 21313 - RNA, 22 nt, Homo sapiens
cacauguucaggagcacuuaga

SEQ ID NO: 21314 - RNA, 22 nt, Homo sapiens
cacauugcaggaaaguucauua

SEQ ID NO: 21315 - RNA, 22 nt, Homo sapiens
caccaaccucaguagcaucugu

SEQ ID NO: 21316 - RNA, 22 nt, Homo sapiens
caccagguuggagugcaguggu

SEQ ID NO: 21317 - RNA, 22 nt, Homo sapiens
cacugcaauuacuuuugcacca

SEQ ID NO: 21318 - RNA, 22 nt, Homo sapiens
cacugcacucuucuucugggca

SEQ ID NO: 21319 - RNA, 21 nt, Homo sapiens
cacugcacuugccuucugggu

SEQ ID NO: 21320 - RNA, 22 nt, Homo sapiens
cacugcauccuccaccugccag

SEQ ID NO: 21321 - RNA, 22 nt, Homo sapiens
cacugcgacguccgccucccgg

SEQ ID NO: 21322 - RNA, 22 nt, Homo sapiens
cagagaacauucagagcuguag

SEQ ID NO: 21323 - RNA, 22 nt, Homo sapiens
cagagaaugucuuuuuuaacca

SEQ ID NO: 21324 - RNA, 22 nt, Homo sapiens
cagagaucaugcaacugcucgc

SEQ ID NO: 21325 - RNA, 22 nt, Homo sapiens
cagagcaaugcuuuugcuuuga

SEQ ID NO: 21326 - RNA, 22 nt, Homo sapiens
cagagguauugcaaaagccuag

SEQ ID NO: 21327 - RNA, 22 nt, Homo sapiens
cagcacauagcaguugcucagu

SEQ ID NO: 21328 - RNA, 22 nt, Homo sapiens
cagcaucauucaucugggguaa

SEQ ID NO: 21329 - RNA, 22 nt, Homo sapiens
cagcccuacacagacugacuca

SEQ ID NO: 21330 - RNA, 22 nt, Homo sapiens
cagcugcuuuggaaaauauuuu

SEQ ID NO: 21331 - RNA, 23 nt, Homo sapiens
cagcuggugauuuuaaguugaag

SEQ ID NO: 21332 - RNA, 22 nt, Homo sapiens
cagcugguggcaagaagacaga

SEQ ID NO: 21333 - RNA, 23 nt, Homo sapiens
cagcuucauugaacauaacuccu

SEQ ID NO: 21334 - RNA, 22 nt, Homo sapiens
cagcuugugguauugcugguug

SEQ ID NO: 21335 - RNA, 22 nt, Homo sapiens
caggaaugugaggguucccugc

SEQ ID NO: 21336 - RNA, 22 nt, Homo sapiens
caggaccucuugccuggaagcc

SEQ ID NO: 21337 - RNA, 22 nt, Homo sapiens
caggcagucuggggguguaucc

SEQ ID NO: 21338 - RNA, 22 nt, Homo sapiens
caggcagugggagacaaaacug

SEQ ID NO: 21339 - RNA, 22 nt, Homo sapiens
cagguacuucugggcugagcag

SEQ ID NO: 21340 - RNA, 22 nt, Homo sapiens
caggugaaugccucuccuucug

SEQ ID NO: 21341 - RNA, 19 nt, Homo sapiens
caguaucauugcacauagu

SEQ ID NO: 21342 - RNA, 18 nt, Homo sapiens
cagugcaauacaggagag

SEQ ID NO: 21343 - RNA, 22 nt, Homo sapiens
cagugcuuuaucaaguccucca

SEQ ID NO: 21344 - RNA, 22 nt, Homo sapiens
caguuguuuuaugacauaagau

SEQ ID NO: 21345 - RNA, 22 nt, Homo sapiens
cauaaaucuuguugaauagcac

SEQ ID NO: 21346 - RNA, 22 nt, Homo sapiens
cauacaagcuacaaucacaaag

SEQ ID NO: 21347 - RNA, 22 nt, Homo sapiens
gucugcaugucauaugauagua

SEQ ID NO: 21348 - RNA, 22 nt, Homo sapiens
gucuguuugauccagaucaaaa

SEQ ID NO: 21349 - RNA, 22 nt, Homo sapiens
gugaaauauuuaacguccaggu

SEQ ID NO: 21350 - RNA, 22 nt, Homo sapiens
gugaacagcagaugagugagug

SEQ ID NO: 21351 - RNA, 22 nt, Homo sapiens
gugaaucauaugccagucaugc

SEQ ID NO: 21352 - RNA, 22 nt, Homo sapiens
gugaccaaagauagcucaaguu

SEQ ID NO: 21353 - RNA, 22 nt, Homo sapiens
gugaccagaugggcaggggugu

SEQ ID NO: 21354 - RNA, 22 nt, Homo sapiens
gugacuggacucugaagaaaau

SEQ ID NO: 21355 - RNA, 22 nt, Homo sapiens
gugagacugguccugaacccag

SEQ ID NO: 21356 - RNA, 22 nt, Homo sapiens
gugagauccucucuuauauggg

SEQ ID NO: 21357 - RNA, 22 nt, Homo sapiens
gugagauuagcugagauccuug

SEQ ID NO: 21358 - RNA, 22 nt, Homo sapiens
gugagcacugaaagaaggcaag

SEQ ID NO: 21359 - RNA, 22 nt, Homo sapiens
gugaggcacugcugcuuuccag

SEQ ID NO: 21360 - RNA, 22 nt, Homo sapiens
gugagguaauuagcucccuuag

SEQ ID NO: 21361 - RNA, 22 nt, Homo sapiens
gugagguacgugucaagaacca

SEQ ID NO: 21362 - RNA, 17 nt, Homo sapiens
gugagguauccucaaaa

SEQ ID NO: 21363 - RNA, 22 nt, Homo sapiens
gugagguguuaaccaaccugug

SEQ ID NO: 21364 - RNA, 22 nt, Homo sapiens
gugaguaaagguucauugaauu

SEQ ID NO: 21365 - RNA, 20 nt, Homo sapiens
gugagucauuaguaaccaaa

SEQ ID NO: 21366 - RNA, 22 nt, Homo sapiens
gugaguuauuauuuauguaaac

SEQ ID NO: 21367 - RNA, 22 nt, Homo sapiens
gugaucucauuuggaauuagag

SEQ ID NO: 21368 - RNA, 22 nt, Homo sapiens
gugaugguaguuuguauuucug

SEQ ID NO: 21369 - RNA, 22 nt, Homo sapiens
gugcaaauuccagcucaacucc

SEQ ID NO: 21370 - RNA, 18 nt, Homo sapiens
gugcaaugaauagcagag

SEQ ID NO: 21371 - RNA, 22 nt, Homo sapiens
gugcaauucacuguuaugucug

SEQ ID NO: 21372 - RNA, 22 nt, Homo sapiens
gugcacaaaucuuaaauguaca

SEQ ID NO: 21373 - RNA, 22 nt, Homo sapiens
gugcacaacaugcagguuuguu

SEQ ID NO: 21374 - RNA, 22 nt, Homo sapiens
gugcacaacgugcagguuuguu

SEQ ID NO: 21375 - RNA, 22 nt, Homo sapiens
gugcacaacguguagguuuguu

SEQ ID NO: 21376 - RNA, 22 nt, Homo sapiens
gugcacaaucgugcauuccuug

SEQ ID NO: 21377 - RNA, 22 nt, Homo sapiens
gugcacaucgugcagguuuguu

SEQ ID NO: 21378 - RNA, 22 nt, Homo sapiens
gugcacaucuguguuccagcua

SEQ ID NO: 21379 - RNA, 22 nt, Homo sapiens
gugcacaugcgugcgcacauau

SEQ ID NO: 21380 - RNA, 22 nt, Homo sapiens
gugcauacucuggagacauugu

SEQ ID NO: 21381 - RNA, 22 nt, Homo sapiens
gugcauaucugugguuggcuga

SEQ ID NO: 21382 - RNA, 22 nt, Homo sapiens
gugcauaugcaugugcaugcac

SEQ ID NO: 21383 - RNA, 23 nt, Homo sapiens
gugcaugagucuuuauaguagca

SEQ ID NO: 21384 - RNA, 22 nt, Homo sapiens
gugcauguccacuaguccauau

SEQ ID NO: 21385 - RNA, 22 nt, Homo sapiens
gugccacaguguuaagggauuc

SEQ ID NO: 21386 - RNA, 22 nt, Homo sapiens
gugcuuuguuguggcaguggca

SEQ ID NO: 21387 - RNA, 22 nt, Homo sapiens
guggaaaaguaguugcgguuuu

SEQ ID NO: 21388 - RNA, 22 nt, Homo sapiens
guggaagaccagacuuuccaac

SEQ ID NO: 21389 - RNA, 20 nt, Homo sapiens
guggaagauaaguagccuga

SEQ ID NO: 21390 - RNA, 22 nt, Homo sapiens
guggaagguaaugcagcuuacu

SEQ ID NO: 21391 - RNA, 22 nt, Homo sapiens
guggaaguguaaaagcucuugg

SEQ ID NO: 21392 - RNA, 22 nt, Homo sapiens
guggaguacugagggucacuua

SEQ ID NO: 21393 - RNA, 22 nt, Homo sapiens
guggaucacuugaggucaagag

SEQ ID NO: 21394 - RNA, 22 nt, Homo sapiens
gugggauggaaaugggcuucag

SEQ ID NO: 21395 - RNA, 22 nt, Homo sapiens
gugggcucguucguguuagaca

SEQ ID NO: 21396 - RNA, 22 nt, Homo sapiens
guggguaaaucucuggggcucu

SEQ ID NO: 21397 - RNA, 22 nt, Homo sapiens
guggguaaaucucuguuugagg

SEQ ID NO: 21398 - RNA, 22 nt, Homo sapiens
gugguaggaaagugcaaaugua

SEQ ID NO: 21399 - RNA, 22 nt, Homo sapiens
guguaaaucaaucuguugucuu

SEQ ID NO: 21400 - RNA, 22 nt, Homo sapiens
guguaaaucugcugugaacauu

SEQ ID NO: 21401 - RNA, 22 nt, Homo sapiens
guguagagaaauagccugaagg

SEQ ID NO: 21402 - RNA, 22 nt, Homo sapiens
gugucacagcuuccaucucggu

SEQ ID NO: 21403 - RNA, 22 nt, Homo sapiens
gugugcacaaucuggcaugugc

SEQ ID NO: 21404 - RNA, 19 nt, Homo sapiens
gugugcauaucacagagca

SEQ ID NO: 21405 - RNA, 18 nt, Homo sapiens
guuagguaguaugaugcu

SEQ ID NO: 21406 - RNA, 22 nt, Homo sapiens
guucaagcaauucugcugccuc

SEQ ID NO: 21407 - RNA, 22 nt, Homo sapiens
guucaagugauagcugggauua

SEQ ID NO: 21408 - RNA, 22 nt, Homo sapiens
guucaagugauucuacugccuc

SEQ ID NO: 21409 - RNA, 22 nt, Homo sapiens
guucaaguuuucucuugugggu

SEQ ID NO: 21410 - RNA, 22 nt, Homo sapiens
guucacacuugcaaccccagca

SEQ ID NO: 21411 - RNA, 20 nt, Homo sapiens
guucacaggcuuccuuucag

SEQ ID NO: 21412 - RNA, 22 nt, Homo sapiens
guucacaguucagccuguaaca

SEQ ID NO: 21413 - RNA, 22 nt, Homo sapiens
guucucacuggacugugaaaau

SEQ ID NO: 21414 - RNA, 22 nt, Homo sapiens
guugcagcacacaggcugucag

SEQ ID NO: 21415 - RNA, 22 nt, Homo sapiens
guugcucaggcuggagugcagu

SEQ ID NO: 21416 - RNA, 22 nt, Homo sapiens
guugcugagucccaucaccaga

SEQ ID NO: 21417 - RNA, 22 nt, Homo sapiens
guuuacagucgacuugggaaua

SEQ ID NO: 21418 - RNA, 22 nt, Homo sapiens
guuugcagaucaugaagaaccc

SEQ ID NO: 21419 - RNA, 21 nt, Homo sapiens
uaaaacuguaacuuuguccug

SEQ ID NO: 21420 - RNA, 22 nt, Homo sapiens
uaaacacucacuucauagccau

SEQ ID NO: 21421 - RNA, 22 nt, Homo sapiens
uaaagaugcugggaaggcuagg

SEQ ID NO: 21422 - RNA, 22 nt, Homo sapiens
uaaagccauugucaaguuugua

SEQ ID NO: 21423 - RNA, 21 nt, Homo sapiens
uaaagcuagaaccuuagcuuu

SEQ ID NO: 21424 - RNA, 22 nt, Homo sapiens
uaaagcuagagcuggaguggca

SEQ ID NO: 21425 - RNA, 22 nt, Homo sapiens
uaaagcuuagauccaugguggc

SEQ ID NO: 21426 - RNA, 21 nt, Homo sapiens
uaaagcuuagcuauaguggcu

SEQ ID NO: 21427 - RNA, 20 nt, Homo sapiens
uaaaugccucaugcuuuauu

SEQ ID NO: 21428 - RNA, 22 nt, Homo sapiens
uaaaugcuugagaugauggaua

SEQ ID NO: 21429 - RNA, 22 nt, Homo sapiens
uaacaacauucuaacugacggc

SEQ ID NO: 21430 - RNA, 22 nt, Homo sapiens
uaacauagucauauacuugcuu

SEQ ID NO: 21431 - RNA, 22 nt, Homo sapiens
uaacccagugucugugaugggu

SEQ ID NO: 21432 - RNA, 22 nt, Homo sapiens
uaacuacuucugcuucagagua

SEQ ID NO: 21433 - RNA, 22 nt, Homo sapiens
uaacucugccuagugacauggu

SEQ ID NO: 21434 - RNA, 22 nt, Homo sapiens
uaacugccuacugugcaaauau

SEQ ID NO: 21435 - RNA, 22 nt, Homo sapiens
uaacuucaucauaagucaagaa

SEQ ID NO: 21436 - RNA, 22 nt, Homo sapiens
uauuacagaccauaucgccggg

SEQ ID NO: 21437 - RNA, 22 nt, Homo sapiens
uauuacugucaauaucacagaa

SEQ ID NO: 21438 - RNA, 22 nt, Homo sapiens
uauuacuugucugugucucaau

SEQ ID NO: 21439 - RNA, 20 nt, Homo sapiens
uauucacucuccagucuugc

SEQ ID NO: 21440 - RNA, 22 nt, Homo sapiens
uauuccagcccuggugagccag

SEQ ID NO: 21441 - RNA, 22 nt, Homo sapiens
uauuccuuuugcauuuccacau

SEQ ID NO: 21442 - RNA, 22 nt, Homo sapiens
uauugcuggauguauuacaugu

SEQ ID NO: 21443 - RNA, 22 nt, Homo sapiens
uauuguuuuucccaggagucua

SEQ ID NO: 21444 - RNA, 22 nt, Homo sapiens
uauuucccuuaacuuuccugca

SEQ ID NO: 21445 - RNA, 22 nt, Homo sapiens
uauuuguccccuccaaaaguca

SEQ ID NO: 21446 - RNA, 22 nt, Homo sapiens
ucaaacauccccaccagggacu

SEQ ID NO: 21447 - RNA, 22 nt, Homo sapiens
ucaaagugagcuccuucucacu

SEQ ID NO: 21448 - RNA, 22 nt, Homo sapiens
ucaaaugauucuccugccucag

SEQ ID NO: 21449 - RNA, 22 nt, Homo sapiens
ucaacaggucaauugcauagaa

SEQ ID NO: 21450 - RNA, 22 nt, Homo sapiens
ucaaccggugagagcuuccucc

SEQ ID NO: 21451 - RNA, 22 nt, Homo sapiens
ucaacugcuugagaucacaaau

SEQ ID NO: 21452 - RNA, 22 nt, Homo sapiens
ucaagcaauucgccugucucag

SEQ ID NO: 21453 - RNA, 18 nt, Homo sapiens
ucaagcaauugucaugcc

SEQ ID NO: 21454 - RNA, 22 nt, Homo sapiens
ucaaggacucagagagggauua

SEQ ID NO: 21455 - RNA, 22 nt, Homo sapiens
ucaaggcaguggccuuccuucu

SEQ ID NO: 21456 - RNA, 22 nt, Homo sapiens
ucaaguaagaagugggcauaaa

SEQ ID NO: 21457 - RNA, 22 nt, Homo sapiens
ucacaaguguauagacaugucc

SEQ ID NO: 21458 - RNA, 22 nt, Homo sapiens
ucacacgugaacucaucacaga

SEQ ID NO: 21459 - RNA, 22 nt, Homo sapiens
ucacacugucuugguuacucuu

SEQ ID NO: 21460 - RNA, 22 nt, Homo sapiens
ucacacuguuuugauuauuaua

SEQ ID NO: 21461 - RNA, 22 nt, Homo sapiens
ucacagaugaggcgagaggcag

SEQ ID NO: 21462 - RNA, 21 nt, Homo sapiens
ucacagccuaggaccugaaga

SEQ ID NO: 21463 - RNA, 18 nt, Homo sapiens
ucacagguaauuaggauu

SEQ ID NO: 21464 - RNA, 22 nt, Homo sapiens
ucacaguaaauccagaagaaau

SEQ ID NO: 21465 - RNA, 22 nt, Homo sapiens
ucacaguagagcuucuuucaga

SEQ ID NO: 21466 - RNA, 22 nt, Homo sapiens
ucacaguauucaugaacaugga

SEQ ID NO: 21467 - RNA, 22 nt, Homo sapiens
ucacagucuccucuagggaggg

SEQ ID NO: 21468 - RNA, 22 nt, Homo sapiens
ucacagucugcgugaugagaca

SEQ ID NO: 21469 - RNA, 22 nt, Homo sapiens
ucacagugcaggaucaguuaau

SEQ ID NO: 21470 - RNA, 23 nt, Homo sapiens
ucacaguuacuuuugcaucaacc

SEQ ID NO: 21471 - RNA, 20 nt, Homo sapiens
ucacauccucucccaacaug

SEQ ID NO: 21472 - RNA, 22 nt, Homo sapiens
ucacaucucagguuucuugaca

SEQ ID NO: 21473 - RNA, 22 nt, Homo sapiens
ucacaugcacaucucuggaacc

SEQ ID NO: 21474 - RNA, 21 nt, Homo sapiens
ucacauggccagaguaggaac

SEQ ID NO: 21475 - RNA, 18 nt, Homo sapiens
ucacauggccgagagaga

SEQ ID NO: 21476 - RNA, 22 nt, Homo sapiens
ucacaugggugcaauauaauca

SEQ ID NO: 21477 - RNA, 22 nt, Homo sapiens
ucacaugugcguuuuggcaugu

SEQ ID NO: 21478 - RNA, 22 nt, Homo sapiens
ucacauuguauauguaccuauc

SEQ ID NO: 21479 - RNA, 22 nt, Homo sapiens
ucacauuguuauguaaauguuu

SEQ ID NO: 21480 - RNA, 22 nt, Homo sapiens
ucaccaguaauaaagagccugc

SEQ ID NO: 21481 - RNA, 22 nt, Homo sapiens
ucaccuagacucgaucauguag

SEQ ID NO: 21482 - RNA, 22 nt, Homo sapiens
ucaccuggggcacagcugaaga

SEQ ID NO: 21483 - RNA, 22 nt, Homo sapiens
ucaccuuacuugcuucugaacu

SEQ ID NO: 21484 - RNA, 22 nt, Homo sapiens
ucacuagggagaaacugaggcu

SEQ ID NO: 21485 - RNA, 22 nt, Homo sapiens
ucacucagaccuggugauaugc

SEQ ID NO: 21486 - RNA, 22 nt, Homo sapiens
ucacugaaaccuccgccuucug

SEQ ID NO: 21487 - RNA, 22 nt, Homo sapiens
ucacugcacucuccgccuugcg

SEQ ID NO: 21488 - RNA, 22 nt, Homo sapiens
ucacugcgaccuccaccucccg

SEQ ID NO: 21489 - RNA, 22 nt, Homo sapiens
ucacugcgaccuccaccuccug

SEQ ID NO: 21490 - RNA, 22 nt, Homo sapiens
ucacugggagcauuugagccuu

SEQ ID NO: 21491 - RNA, 20 nt, Homo sapiens
ucacuggguucuugaagucu

SEQ ID NO: 21492 - RNA, 22 nt, Homo sapiens
ucacugugcaugaaggaugcug

SEQ ID NO: 21493 - RNA, 22 nt, Homo sapiens
ucacugugugucucuguaucug

SEQ ID NO: 21494 - RNA, 22 nt, Homo sapiens
ucacuuuggguacuauggaaau

SEQ ID NO: 21495 - RNA, 22 nt, Homo sapiens
ucagagucuagaucacucacug

SEQ ID NO: 21496 - RNA, 22 nt, Homo sapiens
ucagagugcagggaguagcagc

SEQ ID NO: 21497 - RNA, 22 nt, Homo sapiens
ucagauguuuuguuuaucugcu

SEQ ID NO: 21498 - RNA, 22 nt, Homo sapiens
ucagcaccauguaacaauugau

SEQ ID NO: 21499 - RNA, 22 nt, Homo sapiens
ucaggcacucagcuuagagucu

SEQ ID NO: 21500 - RNA, 22 nt, Homo sapiens
ucagguagugccaugauugauu

SEQ ID NO: 21501 - RNA, 22 nt, Homo sapiens
ucagguaugucuuuaacagcag

SEQ ID NO: 21502 - RNA, 22 nt, Homo sapiens
ucagguugcuaaguauaauauu

SEQ ID NO: 21503 - RNA, 22 nt, Homo sapiens
ucaguccccucgcugagucuac

SEQ ID NO: 21504 - RNA, 22 nt, Homo sapiens
ucagucuuuuuuuggcaagcau

SEQ ID NO: 21505 - RNA, 23 nt, Homo sapiens
ucagugaaggaacaacuaaauag

SEQ ID NO: 21506 - RNA, 22 nt, Homo sapiens
ucagugaauacauguacucaug

SEQ ID NO: 21507 - RNA, 22 nt, Homo sapiens
ucagugaauguuggccacuacu

SEQ ID NO: 21508 - RNA, 22 nt, Homo sapiens
ucagugacuggguauuaaauca

SEQ ID NO: 21509 - RNA, 22 nt, Homo sapiens
ucagugauugcuuucauggaaa

SEQ ID NO: 21510 - RNA, 20 nt, Homo sapiens
ucagugcagauuguccaagu

SEQ ID NO: 21511 - RNA, 22 nt, Homo sapiens
ucagugcaggaaucucuagcca

SEQ ID NO: 21512 - RNA, 19 nt, Homo sapiens
ucagugcuauguaauguag

SEQ ID NO: 21513 - RNA, 22 nt, Homo sapiens
ucagugcuuuuuguugucauca

SEQ ID NO: 21514 - RNA, 22 nt, Homo sapiens
ucaguggagagcuuccaggauu

SEQ ID NO: 21515 - RNA, 22 nt, Homo sapiens
ucaguggauuuaaccugaauca

SEQ ID NO: 21516 - RNA, 20 nt, Homo sapiens
ucauacuguggaguaccagg

SEQ ID NO: 21517 - RNA, 22 nt, Homo sapiens
ucauagaucaaguaauaagaca

SEQ ID NO: 21518 - RNA, 22 nt, Homo sapiens
ucaucucaguuucuugccguac

SEQ ID NO: 21519 - RNA, 23 nt, Homo sapiens
ucaugaggccauucaaauccauu

SEQ ID NO: 21520 - RNA, 22 nt, Homo sapiens
ucauguaauuuugugucuauga

SEQ ID NO: 21521 - RNA, 22 nt, Homo sapiens
ucaugucuuguuguauuuauuu

SEQ ID NO: 21522 - RNA, 22 nt, Homo sapiens
ucauucauucauccagcuugag

SEQ ID NO: 21523 - RNA, 22 nt, Homo sapiens
ucauucauuugcucacuccaca

SEQ ID NO: 21524 - RNA, 22 nt, Homo sapiens
ucauugcauuccagcccaagca

SEQ ID NO: 21525 - RNA, 22 nt, Homo sapiens
ucauugguagcucauggaaccg

SEQ ID NO: 21526 - RNA, 22 nt, Homo sapiens
uccaauguaaucaucauugaau

SEQ ID NO: 21527 - RNA, 22 nt, Homo sapiens
uccacaguaaggacccugccuu

SEQ ID NO: 21528 - RNA, 22 nt, Homo sapiens
uccacagugguugaacuaguuu

SEQ ID NO: 21529 - RNA, 22 nt, Homo sapiens
uccacguggucuaucuguccuu

SEQ ID NO: 21530 - RNA, 22 nt, Homo sapiens
uccacuuuugugcugaauugga

SEQ ID NO: 21531 - RNA, 22 nt, Homo sapiens
uccagguuuugugaguuuaaau

SEQ ID NO: 21532 - RNA, 22 nt, Homo sapiens
uccauagacauuuuaagguagu

SEQ ID NO: 21533 - RNA, 19 nt, Homo sapiens
uccaugagcccacagugau

SEQ ID NO: 21534 - RNA, 22 nt, Homo sapiens
uccaugaggcuacaguaaucuc

SEQ ID NO: 21535 - RNA, 22 nt, Homo sapiens
uccauuuguagguagugagaca

SEQ ID NO: 21536 - RNA, 22 nt, Homo sapiens
uccauuuguucagcuucaggaa

SEQ ID NO: 21537 - RNA, 20 nt, Homo sapiens
ucccaguaggagaaggaagg

SEQ ID NO: 21538 - RNA, 22 nt, Homo sapiens
ucccaguauucauuuacagaag

SEQ ID NO: 21539 - RNA, 22 nt, Homo sapiens
ucccaguggucuugaaacaggg

SEQ ID NO: 21540 - RNA, 22 nt, Homo sapiens
ucccaguguguagcuugucucu

SEQ ID NO: 21541 - RNA, 22 nt, Homo sapiens
uccccugagaacuugcuagaaa

SEQ ID NO: 21542 - RNA, 22 nt, Homo sapiens
uccccugagucaccugcuucuc

SEQ ID NO: 21543 - RNA, 22 nt, Homo sapiens
ucccgaggacaucugggggcaa

SEQ ID NO: 21544 - RNA, 22 nt, Homo sapiens
ucccugacagucacagagcuac

SEQ ID NO: 21545 - RNA, 22 nt, Homo sapiens
ucccugagguccuggauuauug

SEQ ID NO: 21546 - RNA, 22 nt, Homo sapiens
ucccuuagccaaauccccagcc

SEQ ID NO: 21547 - RNA, 22 nt, Homo sapiens
ugagauguuuguuucagugccu

SEQ ID NO: 21548 - RNA, 22 nt, Homo sapiens
ugagauuaaucuuuaaguaaga

SEQ ID NO: 21549 - RNA, 22 nt, Homo sapiens
ugagauuaucuguacauaggag

SEQ ID NO: 21550 - RNA, 20 nt, Homo sapiens
ugagauuggugugguauaag

SEQ ID NO: 21551 - RNA, 22 nt, Homo sapiens
ugagcagaaguuuugauuggcg

SEQ ID NO: 21552 - RNA, 22 nt, Homo sapiens
ugagcaucauucacaccuuggu

SEQ ID NO: 21553 - RNA, 22 nt, Homo sapiens
ugagcauuguguuugacuguga

SEQ ID NO: 21554 - RNA, 22 nt, Homo sapiens
ugagcauuguuuggacuuggau

SEQ ID NO: 21555 - RNA, 20 nt, Homo sapiens
ugagccccuggacucaagcg

SEQ ID NO: 21556 - RNA, 20 nt, Homo sapiens
ugagcucaauuguugcaagu

SEQ ID NO: 21557 - RNA, 22 nt, Homo sapiens
ugagcugagauuaagcugcugc

SEQ ID NO: 21558 - RNA, 22 nt, Homo sapiens
ugaggagugaacuauuucugau

SEQ ID NO: 21559 - RNA, 22 nt, Homo sapiens
ugaggaucucuaggaauuuauc

SEQ ID NO: 21560 - RNA, 22 nt, Homo sapiens
ugaggugaaguaauauucuaag

SEQ ID NO: 21561 - RNA, 22 nt, Homo sapiens
ugaggugagggguuaggugcua

SEQ ID NO: 21562 - RNA, 22 nt, Homo sapiens
ugaggugcagcaauccucaugu

SEQ ID NO: 21563 - RNA, 22 nt, Homo sapiens
ugagguguuauccagaguucuu

SEQ ID NO: 21564 - RNA, 22 nt, Homo sapiens
ugagguuauuuguucaagaagu

SEQ ID NO: 21565 - RNA, 22 nt, Homo sapiens
ugagguuggggucagggcuagc

SEQ ID NO: 21566 - RNA, 22 nt, Homo sapiens
ugagguugguauuacugucucu

SEQ ID NO: 21567 - RNA, 22 nt, Homo sapiens
ugaguagugcugcaauaaacau

SEQ ID NO: 21568 - RNA, 22 nt, Homo sapiens
ugaguaugaguucaggaaaggc

SEQ ID NO: 21569 - RNA, 22 nt, Homo sapiens
ugaguauguuuagaaguaaagg

SEQ ID NO: 21570 - RNA, 22 nt, Homo sapiens
ugagucagucucacucugcugc

SEQ ID NO: 21571 - RNA, 22 nt, Homo sapiens
ugaguguccaaguaaggugaaa

SEQ ID NO: 21572 - RNA, 22 nt, Homo sapiens
ugaguguguaugugcauacaca

SEQ ID NO: 21573 - RNA, 22 nt, Homo sapiens
ugaguuauuaguagaggcuaug

SEQ ID NO: 21574 - RNA, 22 nt, Homo sapiens
ugaguucaauguuaaugaagca

SEQ ID NO: 21575 - RNA, 22 nt, Homo sapiens
ugaguucauggucauuugucac

SEQ ID NO: 21576 - RNA, 22 nt, Homo sapiens
ugaguuguaggggucaccuggc

SEQ ID NO: 21577 - RNA, 22 nt, Homo sapiens
ugauaacauugggggaagcuga

SEQ ID NO: 21578 - RNA, 22 nt, Homo sapiens
ugauacugugcauuagaggcua

SEQ ID NO: 21579 - RNA, 22 nt, Homo sapiens
ugauaguguccugugccacauu

SEQ ID NO: 21580 - RNA, 22 nt, Homo sapiens
ugauaugcuuugaacucucugg

SEQ ID NO: 21581 - RNA, 22 nt, Homo sapiens
ugauauguaacuacuccuuaua

SEQ ID NO: 21582 - RNA, 20 nt, Homo sapiens
ugauauuuucugagcaggaa

SEQ ID NO: 21583 - RNA, 22 nt, Homo sapiens
ugaucaaagugcuggaauuaca

SEQ ID NO: 21584 - RNA, 21 nt, Homo sapiens
ugaucacaugaaaaccaugca

SEQ ID NO: 21585 - RNA, 22 nt, Homo sapiens
ugauccuguccuuaugauguua

SEQ ID NO: 21586 - RNA, 22 nt, Homo sapiens
ugaucugucacuuaucacauuu

SEQ ID NO: 21587 - RNA, 22 nt, Homo sapiens
ugaugacauugucacagucuga

SEQ ID NO: 21588 - RNA, 22 nt, Homo sapiens
ugaugguuuuauuaauaggacc

SEQ ID NO: 21589 - RNA, 18 nt, Homo sapiens
ugauugacuuauuuaggu

SEQ ID NO: 21590 - RNA, 22 nt, Homo sapiens
ugauuuguuucaggaguuuucu

SEQ ID NO: 21591 - RNA, 22 nt, Homo sapiens
ugcaaagucgaaacugcaguuu

SEQ ID NO: 21592 - RNA, 22 nt, Homo sapiens
ugcaagaaacauauuccacaag

SEQ ID NO: 21593 - RNA, 22 nt, Homo sapiens
ugcaagaggagacuguacucag

SEQ ID NO: 21594 - RNA, 22 nt, Homo sapiens
ugcaagauaggcaguuugcacu

SEQ ID NO: 21595 - RNA, 22 nt, Homo sapiens
ugcaagaugauuucaauugaua

SEQ ID NO: 21596 - RNA, 18 nt, Homo sapiens
ugcaauggagaugcagcc

SEQ ID NO: 21597 - RNA, 22 nt, Homo sapiens
ugcacaguccagugcccacuga

SEQ ID NO: 21598 - RNA, 17 nt, Homo sapiens
ugcagcacacugauggg

SEQ ID NO: 21599 - RNA, 22 nt, Homo sapiens
ugcagcacuguucacaauagcc

SEQ ID NO: 21600 - RNA, 22 nt, Homo sapiens
ugcaguguucuuuagaggaaau

SEQ ID NO: 21601 - RNA, 18 nt, Homo sapiens
ugcauacuaucugauuuu

SEQ ID NO: 21602 - RNA, 22 nt, Homo sapiens
ugcauaugcagcauuuaugauu

SEQ ID NO: 21603 - RNA, 22 nt, Homo sapiens
ugcauauucaaggcaggccauu

SEQ ID NO: 21604 - RNA, 22 nt, Homo sapiens
ugcauauuuuauaaagauggaa

SEQ ID NO: 21605 - RNA, 22 nt, Homo sapiens
ugcauccauucuagacucaucu

SEQ ID NO: 21606 - RNA, 22 nt, Homo sapiens
ugcauggauguuugaacacacu

SEQ ID NO: 21607 - RNA, 19 nt, Homo sapiens
ugccaagaaagucagcuua

SEQ ID NO: 21608 - RNA, 20 nt, Homo sapiens
ugccaagaugacuauagcuc

SEQ ID NO: 21609 - RNA, 22 nt, Homo sapiens
ugccaguauuuuauugaagauu

SEQ ID NO: 21610 - RNA, 22 nt, Homo sapiens
ugccaguauuuuauugagcauu

SEQ ID NO: 21611 - RNA, 22 nt, Homo sapiens
ugccaguauuuuguugaagauu

SEQ ID NO: 21612 - RNA, 22 nt, Homo sapiens
ugccaguguuuuguugaagauu

SEQ ID NO: 21613 - RNA, 22 nt, Homo sapiens
ugccaugaagagaggaagcagu

SEQ ID NO: 21614 - RNA, 22 nt, Homo sapiens
ugccaugaaguaauggcaaaaa

SEQ ID NO: 21615 - RNA, 22 nt, Homo sapiens
ugcuagaagaucacacacauca

SEQ ID NO: 21616 - RNA, 22 nt, Homo sapiens
ugcuagaugcuguagggauuua

SEQ ID NO: 21617 - RNA, 18 nt, Homo sapiens
ugcuccccugggugagca

SEQ ID NO: 21618 - RNA, 23 nt, Homo sapiens
ugcugagaccuagauccuaaaga

SEQ ID NO: 21619 - RNA, 22 nt, Homo sapiens
ugcugcacaguucuuaagauua

SEQ ID NO: 21620 - RNA, 22 nt, Homo sapiens
ugcugguggucccauaugauua

SEQ ID NO: 21621 - RNA, 22 nt, Homo sapiens
ugcuuguguucagguaaccuuu

SEQ ID NO: 21622 - RNA, 22 nt, Homo sapiens
ugcuuugguagaaaucuuuggu

SEQ ID NO: 21623 - RNA, 22 nt, Homo sapiens
uggaaaguccaagccaaccggg

SEQ ID NO: 21624 - RNA, 22 nt, Homo sapiens
uggaacaccaggcuggcguggc

SEQ ID NO: 21625 - RNA, 19 nt, Homo sapiens
uggaacauaaaaguugguu

SEQ ID NO: 21626 - RNA, 22 nt, Homo sapiens
uggaagacaggcuguauuuuaa

SEQ ID NO: 21627 - RNA, 22 nt, Homo sapiens
uggaagacuuuagaggcuuaua

SEQ ID NO: 21628 - RNA, 22 nt, Homo sapiens
uggaagcaugcaaucugugggg

SEQ ID NO: 21629 - RNA, 22 nt, Homo sapiens
uggaagugaacaaccaaggcag

SEQ ID NO: 21630 - RNA, 22 nt, Homo sapiens
uggaauaugagacgggguuguc

SEQ ID NO: 21631 - RNA, 22 nt, Homo sapiens
uggaaugguaucuuguuggggu

SEQ ID NO: 21632 - RNA, 22 nt, Homo sapiens
uggaaugucagcuacaagaggg

SEQ ID NO: 21633 - RNA, 22 nt, Homo sapiens
uggaaugugaauaacuuccuuc

SEQ ID NO: 21634 - RNA, 22 nt, Homo sapiens
uggacaagugcccuccaccuca

SEQ ID NO: 21635 - RNA, 20 nt, Homo sapiens
uggaccagagagguggggac

SEQ ID NO: 21636 - RNA, 21 nt, Homo sapiens
uggaccccuuccagucaucau

SEQ ID NO: 21637 - RNA, 22 nt, Homo sapiens
uggacuagagggugggcgaggu

SEQ ID NO: 21638 - RNA, 22 nt, Homo sapiens
uggacuguaagugccuugagua

SEQ ID NO: 21639 - RNA, 22 nt, Homo sapiens
uggagagcaaagaauuuguuag

SEQ ID NO: 21640 - RNA, 22 nt, Homo sapiens
uggagagugagggccuccuuaa

SEQ ID NO: 21641 - RNA, 22 nt, Homo sapiens
uggagauguuuaaaauccacug

SEQ ID NO: 21642 - RNA, 22 nt, Homo sapiens
uggagcccuaguuccucauaac

SEQ ID NO: 21643 - RNA, 22 nt, Homo sapiens
uggagugagaacuucaaugaug

SEQ ID NO: 21644 - RNA, 22 nt, Homo sapiens
uggagugcgugucugaguuuuu

SEQ ID NO: 21645 - RNA, 22 nt, Homo sapiens
uggaguguagaagccagccucc

SEQ ID NO: 21646 - RNA, 21 nt, Homo sapiens
uggauugagaaccccaggagg

SEQ ID NO: 21647 - RNA, 22 nt, Homo sapiens
uggauugugaagaccaugggaa

SEQ ID NO: 21648 - RNA, 22 nt, Homo sapiens
uggcaaaauauuuugguuucug

SEQ ID NO: 21649 - RNA, 22 nt, Homo sapiens
uggcaaaauggaauauguuggg

SEQ ID NO: 21650 - RNA, 22 nt, Homo sapiens
uggcaaaugaaagaaagccagu

SEQ ID NO: 21651 - RNA, 22 nt, Homo sapiens
uggcaaaugugagaugagaacu

SEQ ID NO: 21652 - RNA, 22 nt, Homo sapiens
uggcaagaacgaaauguagggu

SEQ ID NO: 21653 - RNA, 22 nt, Homo sapiens
uggcaagaacugcaauugcuuu

SEQ ID NO: 21654 - RNA, 23 nt, Homo sapiens
uggcaagaauucuuaccgugugg

SEQ ID NO: 21655 - RNA, 23 nt, Homo sapiens
uggcaagauuuguauugccugga

SEQ ID NO: 21656 - RNA, 22 nt, Homo sapiens
uggcaauauccacaauuacuuu

SEQ ID NO: 21657 - RNA, 22 nt, Homo sapiens
ugggaaugaaauuacauagcuu

SEQ ID NO: 21658 - RNA, 22 nt, Homo sapiens
ugggagugugcacaauuucagc

SEQ ID NO: 21659 - RNA, 22 nt, Homo sapiens
ugggaucuuuccuauuagcgag

SEQ ID NO: 21660 - RNA, 22 nt, Homo sapiens
ugggauguagccuucuauuuuc

SEQ ID NO: 21661 - RNA, 22 nt, Homo sapiens
uggguccccuacucuuuccaca

SEQ ID NO: 21662 - RNA, 22 nt, Homo sapiens
ugguauguaugauuaacaugga

SEQ ID NO: 21663 - RNA, 22 nt, Homo sapiens
uggucaccuucuugcucugucu

SEQ ID NO: 21664 - RNA, 21 nt, Homo sapiens
uggucccauaagauuauaaug

SEQ ID NO: 21665 - RNA, 22 nt, Homo sapiens
ugguccccaauacuucuauaga

SEQ ID NO: 21666 - RNA, 19 nt, Homo sapiens
uggucccccgcaaucucau

SEQ ID NO: 21667 - RNA, 23 nt, Homo sapiens
uguaaaagcauuugucagccugg

SEQ ID NO: 21668 - RNA, 22 nt, Homo sapiens
uguaaacauguauguguuuaug

SEQ ID NO: 21669 - RNA, 22 nt, Homo sapiens
uguaagcauugggcaugcaguc

SEQ ID NO: 21670 - RNA, 19 nt, Homo sapiens
uguacacuguaaaccugug

SEQ ID NO: 21671 - RNA, 20 nt, Homo sapiens
uguagguguacaguaaggag

SEQ ID NO: 21672 - RNA, 22 nt, Homo sapiens
uguauaggcaaauuuccucaug

SEQ ID NO: 21673 - RNA, 22 nt, Homo sapiens
uguauguugggucaaaguacau

SEQ ID NO: 21674 - RNA, 22 nt, Homo sapiens
ugucaagaugguuugauguugu

SEQ ID NO: 21675 - RNA, 20 nt, Homo sapiens
ugucaaggaauucccaaauc

SEQ ID NO: 21676 - RNA, 22 nt, Homo sapiens
ugucaaugggaauuuguuuuag

SEQ ID NO: 21677 - RNA, 22 nt, Homo sapiens
ugucacauccaagaaggugcag

SEQ ID NO: 21678 - RNA, 18 nt, Homo sapiens
ugucacuggauaaugguc

SEQ ID NO: 21679 - RNA, 22 nt, Homo sapiens
ugucaggaggguccagagaaaa

SEQ ID NO: 21680 - RNA, 22 nt, Homo sapiens
ugucaggaguuuuagaaucuua

SEQ ID NO: 21681 - RNA, 22 nt, Homo sapiens
ugucaguggucuggaugcagcc

SEQ ID NO: 21682 - RNA, 22 nt, Homo sapiens
ugucaguguacuguaagaauua

SEQ ID NO: 21683 - RNA, 22 nt, Homo sapiens
ugucaguguaugagccccggau

SEQ ID NO: 21684 - RNA, 22 nt, Homo sapiens
ugucaguuucaguguuagccuu

SEQ ID NO: 21685 - RNA, 21 nt, Homo sapiens
ugucaguuuccagaguucaac

SEQ ID NO: 21686 - RNA, 22 nt, Homo sapiens
ugucauggucacaggcauuuca

SEQ ID NO: 21687 - RNA, 22 nt, Homo sapiens
ugucauggugcucugggcccug

SEQ ID NO: 21688 - RNA, 22 nt, Homo sapiens
ugucauguuucuacugaccaaa

SEQ ID NO: 21689 - RNA, 22 nt, Homo sapiens
ugucccguuuucgaggcugcag

SEQ ID NO: 21690 - RNA, 22 nt, Homo sapiens
uguccuggugaugcccaaauuc

SEQ ID NO: 21691 - RNA, 22 nt, Homo sapiens
ugucuagaucugaauguaauug

SEQ ID NO: 21692 - RNA, 22 nt, Homo sapiens
ugucuaguuuugaaguauagca

SEQ ID NO: 21693 - RNA, 22 nt, Homo sapiens
ugucucccuucccauuaggaag

SEQ ID NO: 21694 - RNA, 22 nt, Homo sapiens
ugucuuugguucaggcaaggag

SEQ ID NO: 21695 - RNA, 22 nt, Homo sapiens
ugucuuuguuaguuguccuagu

SEQ ID NO: 21696 - RNA, 22 nt, Homo sapiens
ugugaaaucagauagccuuuuu

SEQ ID NO: 21697 - RNA, 22 nt, Homo sapiens
ugugaacaaaauuuguugcaua

SEQ ID NO: 21698 - RNA, 22 nt, Homo sapiens
ugugaagauguuucuuaauuga

SEQ ID NO: 21699 - RNA, 22 nt, Homo sapiens
ugugaaugaagaaugcuaaccu

SEQ ID NO: 21700 - RNA, 22 nt, Homo sapiens
ugugaauggugcugccgugaag

SEQ ID NO: 21701 - RNA, 22 nt, Homo sapiens
ugugacacugaauggcagaacu

SEQ ID NO: 21702 - RNA, 22 nt, Homo sapiens
ugugacagcacgguucaacugc

SEQ ID NO: 21703 - RNA, 22 nt, Homo sapiens
ugugacucuggcacauggugag

SEQ ID NO: 21704 - RNA, 19 nt, Homo sapiens
ugugacugggccagccuag

SEQ ID NO: 21705 - RNA, 22 nt, Homo sapiens
ugugagaucucagaauugaacu

SEQ ID NO: 21706 - RNA, 22 nt, Homo sapiens
ugugaugauuugauaaacguau

SEQ ID NO: 21707 - RNA, 22 nt, Homo sapiens
ugugauggaguuucauggacug

SEQ ID NO: 21708 - RNA, 22 nt, Homo sapiens
ugugcaaggcucucaaccugug

SEQ ID NO: 21709 - RNA, 18 nt, Homo sapiens
ugugcaauauuaaccacc

SEQ ID NO: 21710 - RNA, 22 nt, Homo sapiens
ugugcacaaccugcagguuugu

SEQ ID NO: 21711 - RNA, 22 nt, Homo sapiens
ugugcacauugugcagguugau

SEQ ID NO: 21712 - RNA, 22 nt, Homo sapiens
ugugccacugcacucccgccug

SEQ ID NO: 21713 - RNA, 22 nt, Homo sapiens
ugugccacugcacuucagccug

SEQ ID NO: 21714 - RNA, 22 nt, Homo sapiens
ugugcuauguuauucacauggg

SEQ ID NO: 21715 - RNA, 22 nt, Homo sapiens
uguggcacuguguccagagaaa

SEQ ID NO: 21716 - RNA, 22 nt, Homo sapiens
uguggcuuuuucuuggcugagg

SEQ ID NO: 21717 - RNA, 22 nt, Homo sapiens
ugugguagugcuuaccugcagu

SEQ ID NO: 21718 - RNA, 22 nt, Homo sapiens
ugugguuuuuuucuccaauagg

SEQ ID NO: 21719 - RNA, 22 nt, Homo sapiens
uguguaaauauauacacacgug

SEQ ID NO: 21720 - RNA, 22 nt, Homo sapiens
uguguaauacucuaaugaugca

SEQ ID NO: 21721 - RNA, 22 nt, Homo sapiens
uguguagagaaauauuacuuau

SEQ ID NO: 21722 - RNA, 22 nt, Homo sapiens
ugugucacugaggguuagugua

SEQ ID NO: 21723 - RNA, 22 nt, Homo sapiens
uguuaacauuuuagagugggaa

SEQ ID NO: 21724 - RNA, 22 nt, Homo sapiens
uguuaugaagaugccugguaca

SEQ ID NO: 21725 - RNA, 22 nt, Homo sapiens
uguucaauucccaccuaugagu

SEQ ID NO: 21726 - RNA, 22 nt, Homo sapiens
uguugcacacacugaaauacac

SEQ ID NO: 21727 - RNA, 22 nt, Homo sapiens
uguugcacuccagccugggcaa

SEQ ID NO: 21728 - RNA, 19 nt, Homo sapiens
uguugcacuccagcuuggg

SEQ ID NO: 21729 - RNA, 22 nt, Homo sapiens
uguugcacuccauccugggcga

SEQ ID NO: 21730 - RNA, 22 nt, Homo sapiens
uguuugcuguguggaguagcag

SEQ ID NO: 21731 - RNA, 22 nt, Homo sapiens
uguuuuggagguccucacuaga

SEQ ID NO: 21732 - RNA, 22 nt, Homo sapiens
uguuuuguuagcacucugggaa

SEQ ID NO: 21733 - RNA, 22 nt, Homo sapiens
uuaaaaguauaggccuggcaua

SEQ ID NO: 21734 - RNA, 22 nt, Homo sapiens
uuaaagcuggcguuacaguuug

SEQ ID NO: 21735 - RNA, 22 nt, Homo sapiens
uuaaaguguuugcagacaggug

SEQ ID NO: 21736 - RNA, 22 nt, Homo sapiens
uuaaaugcuagaauuuucuuug

SEQ ID NO: 21737 - RNA, 22 nt, Homo sapiens
uuaacacugccauugauacugu

SEQ ID NO: 21738 - RNA, 22 nt, Homo sapiens
uuaagcaguggauuagaauuuu

SEQ ID NO: 21739 - RNA, 22 nt, Homo sapiens
uuaaggaguagugucugguauu

SEQ ID NO: 21740 - RNA, 22 nt, Homo sapiens
uuaaggcuccuguuggcuuuua

SEQ ID NO: 21741 - RNA, 22 nt, Homo sapiens
uuaagucacacuagacaacuga

SEQ ID NO: 21742 - RNA, 22 nt, Homo sapiens
uuaauagugacucauuuuccac

SEQ ID NO: 21743 - RNA, 22 nt, Homo sapiens
uuaauuguccauuauucuguuc

SEQ ID NO: 21744 - RNA, 22 nt, Homo sapiens
uuacagucaaguuacauuucuc

SEQ ID NO: 21745 - RNA, 22 nt, Homo sapiens
uuacaguugugagccaccaugc

SEQ ID NO: 21746 - RNA, 22 nt, Homo sapiens
uuacauguggugugaagaagag

SEQ ID NO: 21747 - RNA, 22 nt, Homo sapiens
uuacuggcuuucacugguguua

SEQ ID NO: 21748 - RNA, 17 nt, Homo sapiens
uuagacagacauccugc

SEQ ID NO: 21749 - RNA, 22 nt, Homo sapiens
uuagcacauuuccagcacaugg

SEQ ID NO: 21750 - RNA, 22 nt, Homo sapiens
uuagcaugucuacuaauuugcu

SEQ ID NO: 21751 - RNA, 22 nt, Homo sapiens
uuagccggguguguuggcgggc

SEQ ID NO: 21752 - RNA, 22 nt, Homo sapiens
aaaaggcuagcuaguaacagaa

SEQ ID NO: 21753 - RNA, 20 nt, Homo sapiens
aaacucugucuucuuuauca

SEQ ID NO: 21754 - RNA, 18 nt, Homo sapiens
aaacugcuuccuuggccu

SEQ ID NO: 21755 - RNA, 22 nt, Homo sapiens
aaagagcugagaccugguggag

SEQ ID NO: 21756 - RNA, 22 nt, Homo sapiens
aaaggcacugugacuuuauagg

SEQ ID NO: 21757 - RNA, 22 nt, Homo sapiens
aaagucuguuuugucagagacu

SEQ ID NO: 21758 - RNA, 22 nt, Homo sapiens
acuagguaguaaucugcagaga

SEQ ID NO: 21759 - RNA, 22 nt, Homo sapiens
acucagagaacauucccagucu

SEQ ID NO: 21760 - RNA, 22 nt, Homo sapiens
acucagagauuagcacauguuu

SEQ ID NO: 21761 - RNA, 22 nt, Homo sapiens
acucuguaagcaagcuggggaa

SEQ ID NO: 21762 - RNA, 22 nt, Homo sapiens
gcaaugcugucugugcacagau

SEQ ID NO: 21763 - RNA, 22 nt, Homo sapiens
gcaauggaaucccuugaucaau

SEQ ID NO: 21764 - RNA, 22 nt, Homo sapiens
gcacacguagaagcaugcauca

SEQ ID NO: 21765 - RNA, 22 nt, Homo sapiens
gcacauauguaaauagcugccu

SEQ ID NO: 21766 - RNA, 22 nt, Homo sapiens
gcacauggccacuaggaauaaa

SEQ ID NO: 21767 - RNA, 22 nt, Homo sapiens
gcacgugcacccacaugcacgu

SEQ ID NO: 21768 - RNA, 22 nt, Homo sapiens
gcacugagagaagccccaagua

SEQ ID NO: 21769 - RNA, 19 nt, Homo sapiens
gcagagaugugguagcuug

SEQ ID NO: 21770 - RNA, 22 nt, Homo sapiens
gcaggaauuucucugcagaccc

SEQ ID NO: 21771 - RNA, 22 nt, Homo sapiens
gcagguguuaugcaaacaacug

SEQ ID NO: 21772 - RNA, 22 nt, Homo sapiens
gcagugugauguuuuaaucuau

SEQ ID NO: 21773 - RNA, 22 nt, Homo sapiens
gcaguucuguaguugaaauuua

SEQ ID NO: 21774 - RNA, 22 nt, Homo sapiens
gcaugauuuuauaucuauguaa

SEQ ID NO: 21775 - RNA, 22 nt, Homo sapiens
gcauggauguugauggcugcug

SEQ ID NO: 21776 - RNA, 22 nt, Homo sapiens
gcaugugaauguguaagaaaau

SEQ ID NO: 21777 - RNA, 22 nt, Homo sapiens
gcauugcacuuggcauagacug

SEQ ID NO: 21778 - RNA, 22 nt, Homo sapiens
gccaagaugcugcccacagaca

SEQ ID NO: 21779 - RNA, 22 nt, Homo sapiens
gccccaguacaggcuccuuaga

SEQ ID NO: 21780 - RNA, 22 nt, Homo sapiens
gccccugagacuugccucgggc

SEQ ID NO: 21781 - RNA, 22 nt, Homo sapiens
gcccugagauucuuggauucug

SEQ ID NO: 21782 - RNA, 22 nt, Homo sapiens
gccucaguuguggccagggauu

SEQ ID NO: 21783 - RNA, 19 nt, Homo sapiens
gcggcacuggagacacagc

SEQ ID NO: 21784 - RNA, 22 nt, Homo sapiens
gcuacugucuaucugugcuucu

SEQ ID NO: 21785 - RNA, 22 nt, Homo sapiens
gcuaugucuguugcucuugggc

SEQ ID NO: 21786 - RNA, 22 nt, Homo sapiens
gcucugguuacaaaggcaaauu

SEQ ID NO: 21787 - RNA, 22 nt, Homo sapiens
gcugaaauguuuaauuugggag

SEQ ID NO: 21788 - RNA, 22 nt, Homo sapiens
gcugagaucucuugccugaacu

SEQ ID NO: 21789 - RNA, 22 nt, Homo sapiens
gcugaguaguauuucauuguau

SEQ ID NO: 21790 - RNA, 22 nt, Homo sapiens
gcugauguugaccuugaucacc

SEQ ID NO: 21791 - RNA, 17 nt, Homo sapiens
gcugcauucauguagaa

SEQ ID NO: 21792 - RNA, 22 nt, Homo sapiens
gcugcuguuauucaucagaacu

SEQ ID NO: 21793 - RNA, 22 nt, Homo sapiens
gcuggugaaggcugaaaagugg

SEQ ID NO: 21794 - RNA, 22 nt, Homo sapiens
gcugguguugugaaucaggccg

SEQ ID NO: 21795 - RNA, 22 nt, Homo sapiens
gcuguauuguugaaggaaaugu

SEQ ID NO: 21796 - RNA, 22 nt, Homo sapiens
gcugucuggagucuguucaaug

SEQ ID NO: 21797 - RNA, 22 nt, Homo sapiens
gcuucauggaggcugggcgcag

SEQ ID NO: 21798 - RNA, 19 nt, Homo sapiens
gcuucuugaggacgaugac

SEQ ID NO: 21799 - RNA, 22 nt, Homo sapiens
gcuugguccccacccaaaucgc

SEQ ID NO: 21800 - RNA, 21 nt, Homo sapiens
gcuuuuucggaagucuuuggc

SEQ ID NO: 21801 - RNA, 22 nt, Homo sapiens
ggaaagcuagguguggguguac

SEQ ID NO: 21802 - RNA, 22 nt, Homo sapiens
ggaauauaaaacuuuugacagg

SEQ ID NO: 21803 - RNA, 22 nt, Homo sapiens
ggaauuaaggcaauugaaagcu

SEQ ID NO: 21804 - RNA, 22 nt, Homo sapiens
ggagaugauuaugaaucacuua

SEQ ID NO: 21805 - RNA, 22 nt, Homo sapiens
ggagaugugccugcucugcucu

SEQ ID NO: 21806 - RNA, 22 nt, Homo sapiens
ggagcugugauuugaguccaga

SEQ ID NO: 21807 - RNA, 22 nt, Homo sapiens
ggaguaggcuguccggcaccca

SEQ ID NO: 21808 - RNA, 22 nt, Homo sapiens
ggagucugauguucuaaggcag

SEQ ID NO: 21809 - RNA, 22 nt, Homo sapiens
ggaguguguuuuccaacuuggu

SEQ ID NO: 21810 - RNA, 22 nt, Homo sapiens
ggaucacagccagcucccagaa

SEQ ID NO: 21811 - RNA, 22 nt, Homo sapiens
ggaugcauuuuugguugucaca

SEQ ID NO: 21812 - RNA, 22 nt, Homo sapiens
ggcaaaaucgcaauuacuuuug

SEQ ID NO: 21813 - RNA, 21 nt, Homo sapiens
ggcaagagaauacaacauaaa

SEQ ID NO: 21814 - RNA, 22 nt, Homo sapiens
ggcagaauugcugaggaugcua

SEQ ID NO: 21815 - RNA, 22 nt, Homo sapiens
ggcagacuguggaguucuuucu

SEQ ID NO: 21816 - RNA, 22 nt, Homo sapiens
ggcagagucuugcaucuuuaga

SEQ ID NO: 21817 - RNA, 22 nt, Homo sapiens
ggcagcaugggugccuuuguga

SEQ ID NO: 21818 - RNA, 22 nt, Homo sapiens
ggcagcgugcacuuucgccacu

SEQ ID NO: 21819 - RNA, 22 nt, Homo sapiens
ggcagcgugguggauugaaaau

SEQ ID NO: 21820 - RNA, 22 nt, Homo sapiens
ggcauguugauagguagaugua

SEQ ID NO: 21821 - RNA, 22 nt, Homo sapiens
ggcucagugggguccugguucu

SEQ ID NO: 21822 - RNA, 22 nt, Homo sapiens
gggaagaaggagugguuuacuc

SEQ ID NO: 21823 - RNA, 22 nt, Homo sapiens
gggaguguguaggacccagugu

SEQ ID NO: 21824 - RNA, 22 nt, Homo sapiens
gggaucaacuuauacuaaaauu

SEQ ID NO: 21825 - RNA, 22 nt, Homo sapiens
gggaugaaguugauguagaaag

SEQ ID NO: 21826 - RNA, 22 nt, Homo sapiens
gggauguaaaagugggcacauu

SEQ ID NO: 21827 - RNA, 19 nt, Homo sapiens
ggucagcaaagucuagcug

SEQ ID NO: 21828 - RNA, 22 nt, Homo sapiens
ggugaguggugcuuaaguucag

SEQ ID NO: 21829 - RNA, 22 nt, Homo sapiens
guaaacuuccccucaugaauga

SEQ ID NO: 21830 - RNA, 22 nt, Homo sapiens
guaaauguccccugugauauug

SEQ ID NO: 21831 - RNA, 22 nt, Homo sapiens
guaacacaugcugcucucuggu

SEQ ID NO: 21832 - RNA, 22 nt, Homo sapiens
guaacagucucaacaguggucu

SEQ ID NO: 21833 - RNA, 16 nt, Homo sapiens
guacacaguaaguaug

SEQ ID NO: 21834 - RNA, 22 nt, Homo sapiens
guacaggcagcaaacaccauaa

SEQ ID NO: 21835 - RNA, 22 nt, Homo sapiens
guacaguggguguagggaccag

SEQ ID NO: 21836 - RNA, 22 nt, Homo sapiens
guacauagucacacauauacau

SEQ ID NO: 21837 - RNA, 22 nt, Homo sapiens
guacuuagagauagggucuuua

SEQ ID NO: 21838 - RNA, 22 nt, Homo sapiens
guagaaagcauuucagauuugc

SEQ ID NO: 21839 - RNA, 22 nt, Homo sapiens
guagaaaguuugcugucacaug

SEQ ID NO: 21840 - RNA, 22 nt, Homo sapiens
guagagugcugggcacuggcuc

SEQ ID NO: 21841 - RNA, 22 nt, Homo sapiens
guagcaugcaauauuauagaga

SEQ ID NO: 21842 - RNA, 22 nt, Homo sapiens
guaguggcaugaucuuggcuca

SEQ ID NO: 21843 - RNA, 22 nt, Homo sapiens
guauacaugucaaaacucacau

SEQ ID NO: 21844 - RNA, 22 nt, Homo sapiens
guauaguaguacaaaaguuuuu

SEQ ID NO: 21845 - RNA, 22 nt, Homo sapiens
guaucauugccuaaugcucuca

SEQ ID NO: 21846 - RNA, 22 nt, Homo sapiens
guauuagaugguauuugaagau

SEQ ID NO: 21847 - RNA, 18 nt, Homo sapiens
guauuccagccugaguga

SEQ ID NO: 21848 - RNA, 22 nt, Homo sapiens
guauugacuaucaaucaugugc

SEQ ID NO: 21849 - RNA, 22 nt, Homo sapiens
gucaaaugcacagaaccauuaa

SEQ ID NO: 21850 - RNA, 22 nt, Homo sapiens
uugcuuuguuacugcaguuucc

SEQ ID NO: 21851 - RNA, 22 nt, Homo sapiens
uuggaaaaauccaccuugaucu

SEQ ID NO: 21852 - RNA, 22 nt, Homo sapiens
uuggaaaguuguuguaguuauu

SEQ ID NO: 21853 - RNA, 22 nt, Homo sapiens
uuggacaagauugcagagaauu

SEQ ID NO: 21854 - RNA, 22 nt, Homo sapiens
uuggcaaucaauucugacgucu

SEQ ID NO: 21855 - RNA, 22 nt, Homo sapiens
uuggcagaauguuagaaacuua

SEQ ID NO: 21856 - RNA, 22 nt, Homo sapiens
uuggccauaugacuugcuuugg

SEQ ID NO: 21857 - RNA, 22 nt, Homo sapiens
uuggccccuuucauccacagcu

SEQ ID NO: 21858 - RNA, 22 nt, Homo sapiens
uuggccuccuggucauauccag

SEQ ID NO: 21859 - RNA, 21 nt, Homo sapiens
uuggccuggaggccugaaugu

SEQ ID NO: 21860 - RNA, 22 nt, Homo sapiens
uuggcucugcgucucgcggacg

SEQ ID NO: 21861 - RNA, 22 nt, Homo sapiens
auugcacucuaaccuaggugac

SEQ ID NO: 21862 - RNA, 22 nt, Homo sapiens
auugcccaggcuggagugcagu

SEQ ID NO: 21863 - RNA, 18 nt, Homo sapiens
auugcccucauggggcuu

SEQ ID NO: 21864 - RNA, 22 nt, Homo sapiens
auugcuaacugaaauaagacca

SEQ ID NO: 21865 - RNA, 22 nt, Homo sapiens
auugcuuacccuguauuagauc

SEQ ID NO: 21866 - RNA, 22 nt, Homo sapiens
auuggauagucuuuaucuguug

SEQ ID NO: 21867 - RNA, 22 nt, Homo sapiens
auuggcaaucgucuccauuuuu

SEQ ID NO: 21868 - RNA, 18 nt, Homo sapiens
auuguaagauguauggga

SEQ ID NO: 21869 - RNA, 22 nt, Homo sapiens
auugucacccgggcaguaagca

SEQ ID NO: 21870 - RNA, 22 nt, Homo sapiens
auugucauuuauaacuguguag

SEQ ID NO: 21871 - RNA, 22 nt, Homo sapiens
auugugauggucaaaggaaaua

SEQ ID NO: 21872 - RNA, 19 nt, Homo sapiens
auuugaucaucaggcacag

SEQ ID NO: 21873 - RNA, 22 nt, Homo sapiens
auuuggcaauuuugaagaugcc

SEQ ID NO: 21874 - RNA, 22 nt, Homo sapiens
auuuggcagugaagggaucaca

SEQ ID NO: 21875 - RNA, 20 nt, Homo sapiens
auuuggcauaguuuaagcaa

SEQ ID NO: 21876 - RNA, 22 nt, Homo sapiens
auuugucacuuaacagccauua

SEQ ID NO: 21877 - RNA, 22 nt, Homo sapiens
auuuguccugccuuuuccuccu

SEQ ID NO: 21878 - RNA, 22 nt, Homo sapiens
auuuugcauugcuguaaaggaa

SEQ ID NO: 21879 - RNA, 22 nt, Homo sapiens
auuuuugguuucaccugcacgc

SEQ ID NO: 21880 - RNA, 22 nt, Homo sapiens
caaaggcuguuauaggccagga

SEQ ID NO: 21881 - RNA, 22 nt, Homo sapiens
caaagucuauucuacccuuacc

SEQ ID NO: 21882 - RNA, 22 nt, Homo sapiens
caaagucuucucauuaugucuu

SEQ ID NO: 21883 - RNA, 19 nt, Homo sapiens
caaaguguucuucuuugcc

SEQ ID NO: 21884 - RNA, 22 nt, Homo sapiens
caacacagugaaacccgucucu

SEQ ID NO: 21885 - RNA, 22 nt, Homo sapiens
caacacuguuuauuggauagcc

SEQ ID NO: 21886 - RNA, 22 nt, Homo sapiens
caacucuguaggauccaggugg

SEQ ID NO: 21887 - RNA, 22 nt, Homo sapiens
caagugcuuucuuggggauuua

SEQ ID NO: 21888 - RNA, 19 nt, Homo sapiens
caauacuucuuggcauaca

SEQ ID NO: 21889 - RNA, 22 nt, Homo sapiens
caauugcacucuuagguguaca

SEQ ID NO: 21890 - RNA, 22 nt, Homo sapiens
cacaaugucugguaggccacuu

SEQ ID NO: 21891 - RNA, 22 nt, Homo sapiens
cacagucugggcuuguuuguac

SEQ ID NO: 21892 - RNA, 22 nt, Homo sapiens
cacagugaacaauauccucugu

SEQ ID NO: 21893 - RNA, 22 nt, Homo sapiens
cacauguuuuagcauggcuguu

SEQ ID NO: 21894 - RNA, 22 nt, Homo sapiens
cacauugaauuucugaugacaa

SEQ ID NO: 21895 - RNA, 22 nt, Homo sapiens
caccacagccauuauugucccc

SEQ ID NO: 21896 - RNA, 22 nt, Homo sapiens
caccaggugcccagcacggcca

SEQ ID NO: 21897 - RNA, 22 nt, Homo sapiens
caccaguuuuucagugauucaa

SEQ ID NO: 21898 - RNA, 22 nt, Homo sapiens
cacccagucaucuuggguuuuu

SEQ ID NO: 21899 - RNA, 22 nt, Homo sapiens
caccgagguuggagugcagugg

SEQ ID NO: 21900 - RNA, 22 nt, Homo sapiens
caccugagcgggaugcucgccu

SEQ ID NO: 21901 - RNA, 22 nt, Homo sapiens
cacugaaugugagguuggggag

SEQ ID NO: 21902 - RNA, 22 nt, Homo sapiens
cacugcacuccagcuuugguga

SEQ ID NO: 21903 - RNA, 22 nt, Homo sapiens
cacugcauccuugaccuucugg

SEQ ID NO: 21904 - RNA, 22 nt, Homo sapiens
cacugcauggccacccauguua

SEQ ID NO: 21905 - RNA, 22 nt, Homo sapiens
cacugcauucuccaccucccag

SEQ ID NO: 21906 - RNA, 22 nt, Homo sapiens
cacuggcacuguguuuagaugg

SEQ ID NO: 21907 - RNA, 22 nt, Homo sapiens
cacugggugccauauguuugcu

SEQ ID NO: 21908 - RNA, 22 nt, Homo sapiens
cacuggucucauggcaugagag

SEQ ID NO: 21909 - RNA, 22 nt, Homo sapiens
cagagaacugaguuauuuucuu

SEQ ID NO: 21910 - RNA, 22 nt, Homo sapiens
cagagguaagcaagucagcauu

SEQ ID NO: 21911 - RNA, 22 nt, Homo sapiens
cagauaguuguagauaugcagc

SEQ ID NO: 21912 - RNA, 20 nt, Homo sapiens
cagcacgcacaugagacugu

SEQ ID NO: 21913 - RNA, 22 nt, Homo sapiens
cagcgaggucugcgucacauug

SEQ ID NO: 21914 - RNA, 20 nt, Homo sapiens
cagcuagugguaggagucgg

SEQ ID NO: 21915 - RNA, 22 nt, Homo sapiens
cagcuggugggagcuggguucc

SEQ ID NO: 21916 - RNA, 22 nt, Homo sapiens
cagcuguuguuccagucuuuua

SEQ ID NO: 21917 - RNA, 22 nt, Homo sapiens
caggcagucuggcucccaagug

SEQ ID NO: 21918 - RNA, 22 nt, Homo sapiens
cagggaauguuauuuaauagca

SEQ ID NO: 21919 - RNA, 22 nt, Homo sapiens
cagucacagugacaggaugugg

SEQ ID NO: 21920 - RNA, 22 nt, Homo sapiens
cagucacugggauuauggucau

SEQ ID NO: 21921 - RNA, 20 nt, Homo sapiens
cagugcaccuggcguguuga

SEQ ID NO: 21922 - RNA, 22 nt, Homo sapiens
cagugguuuucaacccugguug

SEQ ID NO: 21923 - RNA, 22 nt, Homo sapiens
caguucaugguaggcaccauag

SEQ ID NO: 21924 - RNA, 22 nt, Homo sapiens
caucacagcaaguagggagugg

SEQ ID NO: 21925 - RNA, 22 nt, Homo sapiens
caucagagugagauauaagauc

SEQ ID NO: 21926 - RNA, 22 nt, Homo sapiens
caucccauucgaggggcacagc

SEQ ID NO: 21927 - RNA, 21 nt, Homo sapiens
cauccccugccauuguggucu

SEQ ID NO: 21928 - RNA, 19 nt, Homo sapiens
caucccugagcugaagugg

SEQ ID NO: 21929 - RNA, 22 nt, Homo sapiens
caucccugucgucaagucucug

SEQ ID NO: 21930 - RNA, 22 nt, Homo sapiens
caucgcacuccagccugggcaa

SEQ ID NO: 21931 - RNA, 22 nt, Homo sapiens
caucucauugaauugcugagca

SEQ ID NO: 21932 - RNA, 22 nt, Homo sapiens
caugaugcuagguauggaugaa

SEQ ID NO: 21933 - RNA, 22 nt, Homo sapiens
accuugcacugagccgagauug

SEQ ID NO: 21934 - RNA, 22 nt, Homo sapiens
accuuuacaacuuguuagagua

SEQ ID NO: 21935 - RNA, 22 nt, Homo sapiens
acgcagcacauucacagcuaug

SEQ ID NO: 21936 - RNA, 22 nt, Homo sapiens
acgugcaugcacacacaugcgc

SEQ ID NO: 21937 - RNA, 22 nt, Homo sapiens
acugcacuccaccuugggcaac

SEQ ID NO: 21938 - RNA, 22 nt, Homo sapiens
acugcacuccagcccaggugac

SEQ ID NO: 21939 - RNA, 22 nt, Homo sapiens
acugcacuccagccuucggaca

SEQ ID NO: 21940 - RNA, 22 nt, Homo sapiens
acugcacuccagccuugagagc

SEQ ID NO: 21941 - RNA, 22 nt, Homo sapiens
acugcacuccagccuugcgaca

SEQ ID NO: 21942 - RNA, 22 nt, Homo sapiens
acugcacuccagccuuggccac

SEQ ID NO: 21943 - RNA, 22 nt, Homo sapiens
acugcacuccagccuugugaca

SEQ ID NO: 21944 - RNA, 22 nt, Homo sapiens
acugcacuccagcuuuggguga

SEQ ID NO: 21945 - RNA, 22 nt, Homo sapiens
acugcacuccuccuugggugac

SEQ ID NO: 21946 - RNA, 22 nt, Homo sapiens
acugcacucuagcauggguaau

SEQ ID NO: 21947 - RNA, 22 nt, Homo sapiens
acugcacuucagccuugggaaa

SEQ ID NO: 21948 - RNA, 22 nt, Homo sapiens
acugcacuucagccuugugaca

SEQ ID NO: 21949 - RNA, 22 nt, Homo sapiens
acugcauuugguaaagucaaga

SEQ ID NO: 21950 - RNA, 22 nt, Homo sapiens
acugcauuugucccuuuugaac

SEQ ID NO: 21951 - RNA, 22 nt, Homo sapiens
acuggacuuaaugaugaauugu

SEQ ID NO: 21952 - RNA, 20 nt, Homo sapiens
acugggcuaccgaaguaagg

SEQ ID NO: 21953 - RNA, 22 nt, Homo sapiens
acuuaguauggggcuuuugaga

SEQ ID NO: 21954 - RNA, 22 nt, Homo sapiens
acuucauucucuggaucagaau

SEQ ID NO: 21955 - RNA, 21 nt, Homo sapiens
acuuucuguggcaguccauuc

SEQ ID NO: 21956 - RNA, 22 nt, Homo sapiens
agaaagcgcuucccuuugcugg

SEQ ID NO: 21957 - RNA, 22 nt, Homo sapiens
agaauguaaacagaauagagga

SEQ ID NO: 21958 - RNA, 22 nt, Homo sapiens
agaaugugaccuuauuuggaga

SEQ ID NO: 21959 - RNA, 22 nt, Homo sapiens
agacuagagcagagcccucucu

SEQ ID NO: 21960 - RNA, 20 nt, Homo sapiens
agacuagggagcagaaagcc

SEQ ID NO: 21961 - RNA, 22 nt, Homo sapiens
agagauaauuagguuaaaugag

SEQ ID NO: 21962 - RNA, 22 nt, Homo sapiens
agagcacuguggguccaaauau

SEQ ID NO: 21963 - RNA, 23 nt, Homo sapiens
agagguuuaaucaggcaguugcu

SEQ ID NO: 21964 - RNA, 22 nt, Homo sapiens
agaguacaggcaaguuagucau

SEQ ID NO: 21965 - RNA, 22 nt, Homo sapiens
agaguaguaggaugaauggacu

SEQ ID NO: 21966 - RNA, 22 nt, Homo sapiens
agaguaguuuauuaugcuaagg

SEQ ID NO: 21967 - RNA, 22 nt, Homo sapiens
agagugcaauggcaccaucucg

SEQ ID NO: 21968 - RNA, 23 nt, Homo sapiens
agagugcaauggugccaucucgg

SEQ ID NO: 21969 - RNA, 22 nt, Homo sapiens
aucucaguuaauuccaucuuuc

SEQ ID NO: 21970 - RNA, 22 nt, Homo sapiens
aucucugagauguucugauuuu

SEQ ID NO: 21971 - RNA, 22 nt, Homo sapiens
aucugacuuuuaauuugaaaac

SEQ ID NO: 21972 - RNA, 19 nt, Homo sapiens
aucuggaguuccuggggcu

SEQ ID NO: 21973 - RNA, 22 nt, Homo sapiens
aucuggguccguucugcuucuc

SEQ ID NO: 21974 - RNA, 22 nt, Homo sapiens
aucugguguauuggugcugggu

SEQ ID NO: 21975 - RNA, 22 nt, Homo sapiens
augaaaacaugauuugccuguu

SEQ ID NO: 21976 - RNA, 22 nt, Homo sapiens
augaaaucuuuccugugaggau

SEQ ID NO: 21977 - RNA, 22 nt, Homo sapiens
augaaaugcauguuaaguccgu

SEQ ID NO: 21978 - RNA, 18 nt, Homo sapiens
augaacucaucauuuuua

SEQ ID NO: 21979 - RNA, 22 nt, Homo sapiens
augaagauguugccuuuuuaau

SEQ ID NO: 21980 - RNA, 22 nt, Homo sapiens
augaagcuagcugauugcugau

SEQ ID NO: 21981 - RNA, 22 nt, Homo sapiens
augaagucguuacuaccaauug

SEQ ID NO: 21982 - RNA, 22 nt, Homo sapiens
augaaguuagcucauuucuuuu

SEQ ID NO: 21983 - RNA, 22 nt, Homo sapiens
augaauccauuccugccacaga

SEQ ID NO: 21984 - RNA, 22 nt, Homo sapiens
augaccagagagugcgcagggu

SEQ ID NO: 21985 - RNA, 22 nt, Homo sapiens
augacugucagggcagucauug

SEQ ID NO: 21986 - RNA, 22 nt, Homo sapiens
augacugucuugcagaggcuau

SEQ ID NO: 21987 - RNA, 18 nt, Homo sapiens
augagagccgauuccugg

SEQ ID NO: 21988 - RNA, 22 nt, Homo sapiens
augagagcugacuuuaaggcaa

SEQ ID NO: 21989 - RNA, 22 nt, Homo sapiens
augagauauuuuauaagaucau

SEQ ID NO: 21990 - RNA, 22 nt, Homo sapiens
augagaugcaagauuagauggg

SEQ ID NO: 21991 - RNA, 21 nt, Homo sapiens
augagauguuagacuuuagac

SEQ ID NO: 21992 - RNA, 22 nt, Homo sapiens
augagauucuuagagaagucug

SEQ ID NO: 21993 - RNA, 22 nt, Homo sapiens
augaggaaggagccuuugucug

SEQ ID NO: 21994 - RNA, 22 nt, Homo sapiens
augaggcacugcgcccuacuga

SEQ ID NO: 21995 - RNA, 22 nt, Homo sapiens
augagggaagcucacgugucca

SEQ ID NO: 21996 - RNA, 22 nt, Homo sapiens
augaggugaguaaauaaaugaa

SEQ ID NO: 21997 - RNA, 22 nt, Homo sapiens
augauaaguuauuagaagaaga

SEQ ID NO: 21998 - RNA, 22 nt, Homo sapiens
augauagucuugagaagcauuu

SEQ ID NO: 21999 - RNA, 22 nt, Homo sapiens
augauguguucuguguucccau

SEQ ID NO: 22000 - RNA, 22 nt, Homo sapiens
augauuguucucacucaagaga

SEQ ID NO: 22001 - RNA, 19 nt, Homo sapiens
augcaaugucacaggcugc

SEQ ID NO: 22002 - RNA, 22 nt, Homo sapiens
augcacaguccagcccaugugg

SEQ ID NO: 22003 - RNA, 22 nt, Homo sapiens
augcacaucagcuccagggacc

SEQ ID NO: 22004 - RNA, 22 nt, Homo sapiens
augcacaugcgaaaacuugugu

SEQ ID NO: 22005 - RNA, 22 nt, Homo sapiens
augcacauggcuaacuuuuuuc

SEQ ID NO: 22006 - RNA, 22 nt, Homo sapiens
augcacuguauaggaucuugcg

SEQ ID NO: 22007 - RNA, 22 nt, Homo sapiens
augcagagaaaucuaaaauaug

SEQ ID NO: 22008 - RNA, 22 nt, Homo sapiens
augcagauauuuuugugguugc

SEQ ID NO: 22009 - RNA, 22 nt, Homo sapiens
augcagguguuuugcacugagu

SEQ ID NO: 22010 - RNA, 22 nt, Homo sapiens
augcauaugucuuuauaguggc

SEQ ID NO: 22011 - RNA, 22 nt, Homo sapiens
augccaagagacaaagggaauc

SEQ ID NO: 22012 - RNA, 22 nt, Homo sapiens
augccacugcacuucagcuugg

SEQ ID NO: 22013 - RNA, 22 nt, Homo sapiens
augcccauuuguuuucugaaag

SEQ ID NO: 22014 - RNA, 21 nt, Homo sapiens
auggaaagacugccucuucaa

SEQ ID NO: 22015 - RNA, 22 nt, Homo sapiens
auggaaagcuguuccuacacaa

SEQ ID NO: 22016 - RNA, 22 nt, Homo sapiens
auggaagaaaguuggguucuug

SEQ ID NO: 22017 - RNA, 22 nt, Homo sapiens
auggacagaaaaaaauagaugu

SEQ ID NO: 22018 - RNA, 22 nt, Homo sapiens
auggagaugaauaucaucuguu

SEQ ID NO: 22019 - RNA, 22 nt, Homo sapiens
auggagaugugcgaacugagua

SEQ ID NO: 22020 - RNA, 22 nt, Homo sapiens
auggagcuugacaguuguagag

SEQ ID NO: 22021 - RNA, 22 nt, Homo sapiens
auggaguguaauauugagagcu

SEQ ID NO: 22022 - RNA, 22 nt, Homo sapiens
auggaguguggaacugggaauc

SEQ ID NO: 22023 - RNA, 22 nt, Homo sapiens
auggcacugaagcguauugaca

SEQ ID NO: 22024 - RNA, 22 nt, Homo sapiens
auggcaguguaugauuauauua

SEQ ID NO: 22025 - RNA, 22 nt, Homo sapiens
auggcaguuucagcuauaguuu

SEQ ID NO: 22026 - RNA, 22 nt, Homo sapiens
auggcauugaagaguugucccu

SEQ ID NO: 22027 - RNA, 22 nt, Homo sapiens
auggcccaguuugcuaucccua

SEQ ID NO: 22028 - RNA, 22 nt, Homo sapiens
auggcccugaguucaauauauu

SEQ ID NO: 22029 - RNA, 22 nt, Homo sapiens
auggccgggugcgguggcucac

SEQ ID NO: 22030 - RNA, 22 nt, Homo sapiens
auggccuuucuggcacauuucc

SEQ ID NO: 22031 - RNA, 22 nt, Homo sapiens
auggcuuuugaccugguaggau

SEQ ID NO: 22032 - RNA, 22 nt, Homo sapiens
augggcaaauguuggaaauucc

SEQ ID NO: 22033 - RNA, 22 nt, Homo sapiens
augggguaggcuugcuguagua

SEQ ID NO: 22034 - RNA, 22 nt, Homo sapiens
augguauggaaggucuggagga

SEQ ID NO: 22035 - RNA, 22 nt, Homo sapiens
auggucuuuucccuggauuaua

SEQ ID NO: 22036 - RNA, 21 nt, Homo sapiens
auggugagaaaguagugucaa

SEQ ID NO: 22037 - RNA, 22 nt, Homo sapiens
auguaaacuacagauuuugggu

SEQ ID NO: 22038 - RNA, 17 nt, Homo sapiens
auguaauccucaucucu

SEQ ID NO: 22039 - RNA, 22 nt, Homo sapiens
auguaguauuaaugagagauaa

SEQ ID NO: 22040 - RNA, 22 nt, Homo sapiens
augucaacauagacaguagagu

SEQ ID NO: 22041 - RNA, 22 nt, Homo sapiens
auggaucauauucuugaggagg

SEQ ID NO: 22042 - RNA, 22 nt, Homo sapiens
auggcaaaauguuccuaguggu

SEQ ID NO: 22043 - RNA, 22 nt, Homo sapiens
auggcacuaaugggaguuuacu

SEQ ID NO: 22044 - RNA, 22 nt, Homo sapiens
auggcacucaaucaaguugaga

SEQ ID NO: 22045 - RNA, 22 nt, Homo sapiens
auggcacuccagccugggcaac

SEQ ID NO: 22046 - RNA, 22 nt, Homo sapiens
auggcacuguguauuuuucugu

SEQ ID NO: 22047 - RNA, 22 nt, Homo sapiens
auggcagcugguuuuacccuag

SEQ ID NO: 22048 - RNA, 22 nt, Homo sapiens
auggcagugagucucuaguauu

SEQ ID NO: 22049 - RNA, 22 nt, Homo sapiens
auggcaguuucacucugggauu

SEQ ID NO: 22050 - RNA, 22 nt, Homo sapiens
auggcccccuguuugugaacau

SEQ ID NO: 22051 - RNA, 22 nt, Homo sapiens
auggcccugggaaaggaggcau

SEQ ID NO: 22052 - RNA, 22 nt, Homo sapiens
auggcccuguguggagcugcug

SEQ ID NO: 22053 - RNA, 22 nt, Homo sapiens
auggcguggagauauggucagc

SEQ ID NO: 22054 - RNA, 22 nt, Homo sapiens
auggcugagugauuucaaacag

SEQ ID NO: 22055 - RNA, 22 nt, Homo sapiens
auggcuguuccugggaguucua

SEQ ID NO: 22056 - RNA, 22 nt, Homo sapiens
auggcuuaagacaaccuuucau

SEQ ID NO: 22057 - RNA, 22 nt, Homo sapiens
auggcuuuggucucccagugau

SEQ ID NO: 22058 - RNA, 22 nt, Homo sapiens
auggcuuuuauuguguugaggu

SEQ ID NO: 22059 - RNA, 22 nt, Homo sapiens
augggucuccugaauacagcac

SEQ ID NO: 22060 - RNA, 22 nt, Homo sapiens
auggucccuguuccaugcuccu

SEQ ID NO: 22061 - RNA, 22 nt, Homo sapiens
auggugugugaauuaaauguua

SEQ ID NO: 22062 - RNA, 22 nt, Homo sapiens
augguugguuaaaucuguguau

SEQ ID NO: 22063 - RNA, 22 nt, Homo sapiens
augguuuuacugcaaaauggga

SEQ ID NO: 22064 - RNA, 22 nt, Homo sapiens
auguaagugugcucaaauguua

SEQ ID NO: 22065 - RNA, 21 nt, Homo sapiens
auguaaugaagaagccacugg

SEQ ID NO: 22066 - RNA, 22 nt, Homo sapiens
auguagugugauuuucacuaga

SEQ ID NO: 22067 - RNA, 22 nt, Homo sapiens
auguaugagaguuccagcugau

SEQ ID NO: 22068 - RNA, 22 nt, Homo sapiens
augucacagguccuagccaagu

SEQ ID NO: 22069 - RNA, 22 nt, Homo sapiens
auguccauggaaucuguagcaa

SEQ ID NO: 22070 - RNA, 22 nt, Homo sapiens
augugaacugaauuaauucaca

SEQ ID NO: 22071 - RNA, 22 nt, Homo sapiens
augugcuaguaucaaacgagac

SEQ ID NO: 22072 - RNA, 22 nt, Homo sapiens
auguggaaagcagcaugauaug

SEQ ID NO: 22073 - RNA, 22 nt, Homo sapiens
augugugcuugauguaaaaagu

SEQ ID NO: 22074 - RNA, 23 nt, Homo sapiens
augugugcuuggagagcaggaug

SEQ ID NO: 22075 - RNA, 22 nt, Homo sapiens
auguuacggaguuuuuauccag

SEQ ID NO: 22076 - RNA, 22 nt, Homo sapiens
auuaaguaaugguuccaauaau

SEQ ID NO: 22077 - RNA, 22 nt, Homo sapiens
auuguaccccaauguacaauau

SEQ ID NO: 22078 - RNA, 22 nt, Homo sapiens
auugucauuuucugagaaguaa

SEQ ID NO: 22079 - RNA, 22 nt, Homo sapiens
auuguguuugaaugaggcucca

SEQ ID NO: 22080 - RNA, 22 nt, Homo sapiens
auuguuccccggucauuuuugu

SEQ ID NO: 22081 - RNA, 22 nt, Homo sapiens
auuguucuuacaugcugucauc

SEQ ID NO: 22082 - RNA, 22 nt, Homo sapiens
auuuccuguaggggcuugcgaa

SEQ ID NO: 22083 - RNA, 22 nt, Homo sapiens
auuugacacugagagccucagu

SEQ ID NO: 22084 - RNA, 22 nt, Homo sapiens
auuuggcaguauaaugcuuugg

SEQ ID NO: 22085 - RNA, 22 nt, Homo sapiens
auuuggguaaugagugcaaggg

SEQ ID NO: 22086 - RNA, 21 nt, Homo sapiens
auuugguguuagaaauaaauu

SEQ ID NO: 22087 - RNA, 22 nt, Homo sapiens
auuugucaauacacuucuucca

SEQ ID NO: 22088 - RNA, 22 nt, Homo sapiens
caaagcuauagcaccagaggga

SEQ ID NO: 22089 - RNA, 22 nt, Homo sapiens
caaaggcuuccacugcauccuu

SEQ ID NO: 22090 - RNA, 22 nt, Homo sapiens
caaaggugcuuuccagguccaa

SEQ ID NO: 22091 - RNA, 22 nt, Homo sapiens
caaauacuuucauguugucuug

SEQ ID NO: 22092 - RNA, 20 nt, Homo sapiens
caaauugcuuucuugguuuu

SEQ ID NO: 22093 - RNA, 22 nt, Homo sapiens
caaggcacagccccuacuuccu

SEQ ID NO: 22094 - RNA, 22 nt, Homo sapiens
caaugcagcuuuuggagagaaa

SEQ ID NO: 22095 - RNA, 22 nt, Homo sapiens
caaugugcuuggggcacaugag

SEQ ID NO: 22096 - RNA, 22 nt, Homo sapiens
cacaaaguagauuagucuucca

SEQ ID NO: 22097 - RNA, 22 nt, Homo sapiens
cacaguguuccagcuauuugaa

SEQ ID NO: 22098 - RNA, 22 nt, Homo sapiens
cacaguugccuaucuccugaag

SEQ ID NO: 22099 - RNA, 22 nt, Homo sapiens
cacccaguaagcaugaggcccu

SEQ ID NO: 22100 - RNA, 22 nt, Homo sapiens
cacccuugcagggacagcuuug

SEQ ID NO: 22101 - RNA, 22 nt, Homo sapiens
caccuagacuggagugcagugg

SEQ ID NO: 22102 - RNA, 22 nt, Homo sapiens
cacucaguuugugguacuuugu

SEQ ID NO: 22103 - RNA, 18 nt, Homo sapiens
cacugagcccuucacucu

SEQ ID NO: 22104 - RNA, 22 nt, Homo sapiens
cacugcaguaaauugcgucggu

SEQ ID NO: 22105 - RNA, 22 nt, Homo sapiens
cacugcauccuccaccuccugg

SEQ ID NO: 22106 - RNA, 22 nt, Homo sapiens
cacugcauccuccauauccugg

SEQ ID NO: 22107 - RNA, 22 nt, Homo sapiens
cacugcauggucuagcuggguu

SEQ ID NO: 22108 - RNA, 22 nt, Homo sapiens
cacugcauuggaugguuccucc

SEQ ID NO: 22109 - RNA, 21 nt, Homo sapiens
cacuggguucaggcuugugga

SEQ ID NO: 22110 - RNA, 22 nt, Homo sapiens
cagauguaguauuuuagugaaa

SEQ ID NO: 22111 - RNA, 22 nt, Homo sapiens
cagcaaaucauccuauuugagc

SEQ ID NO: 22112 - RNA, 20 nt, Homo sapiens
cagcaaccugcucucuuccu

SEQ ID NO: 22113 - RNA, 22 nt, Homo sapiens
cagcacauuacaaguacuuggu

SEQ ID NO: 22114 - RNA, 22 nt, Homo sapiens
caggcaaggugaaguguacugg

SEQ ID NO: 22115 - RNA, 22 nt, Homo sapiens
caggcauagucuugaguuuuau

SEQ ID NO: 22116 - RNA, 22 nt, Homo sapiens
caggcauuguauuguaaucccc

SEQ ID NO: 22117 - RNA, 20 nt, Homo sapiens
cagggcaaugaggagguaaa

SEQ ID NO: 22118 - RNA, 22 nt, Homo sapiens
cagguacaugcaugugugugca

SEQ ID NO: 22119 - RNA, 22 nt, Homo sapiens
caggugguauuugguuuucugu

SEQ ID NO: 22120 - RNA, 22 nt, Homo sapiens
cagugcaaagccucugcccaga

SEQ ID NO: 22121 - RNA, 22 nt, Homo sapiens
cagugcauagaugugccacauu

SEQ ID NO: 22122 - RNA, 22 nt, Homo sapiens
cagugcuuguuauuguucuauu

SEQ ID NO: 22123 - RNA, 22 nt, Homo sapiens
cauauucacuuuacagagcugu

SEQ ID NO: 22124 - RNA, 19 nt, Homo sapiens
caucacagagucuuccauu

SEQ ID NO: 22125 - RNA, 21 nt, Homo sapiens
caucacauuacucaaaguccu

SEQ ID NO: 22126 - RNA, 22 nt, Homo sapiens
caucccugaaccccagaaaucu

SEQ ID NO: 22127 - RNA, 22 nt, Homo sapiens
caugccacugcacgccauccug

SEQ ID NO: 22128 - RNA, 22 nt, Homo sapiens
cauggcacagagaauguguucu

SEQ ID NO: 22129 - RNA, 23 nt, Homo sapiens
cauggcuguuaacacuguuugag

SEQ ID NO: 22130 - RNA, 22 nt, Homo sapiens
cauggcuuuuauaacaagaaau

SEQ ID NO: 22131 - RNA, 22 nt, Homo sapiens
caugucuuuuauucugugugau

SEQ ID NO: 22132 - RNA, 22 nt, Homo sapiens
cauugcaacuucugccucccag

SEQ ID NO: 22133 - RNA, 22 nt, Homo sapiens
cauugcacacauuuaccuaugu

SEQ ID NO: 22134 - RNA, 20 nt, Homo sapiens
cauugcacuccagccugcug

SEQ ID NO: 22135 - RNA, 22 nt, Homo sapiens
cauugcacuccagcuugggcaa

SEQ ID NO: 22136 - RNA, 22 nt, Homo sapiens
cauugcacuccaucuugggcaa

SEQ ID NO: 22137 - RNA, 22 nt, Homo sapiens
cauugcacugcuucuugggugu

SEQ ID NO: 22138 - RNA, 22 nt, Homo sapiens
cauugcuaaaagucauauauaa

SEQ ID NO: 22139 - RNA, 22 nt, Homo sapiens
cauugucccucaaugacuauga

SEQ ID NO: 22140 - RNA, 22 nt, Homo sapiens
cauuugcacugagacucagcuu

SEQ ID NO: 22141 - RNA, 22 nt, Homo sapiens
cauuuugcaguuucugucucca

SEQ ID NO: 22142 - RNA, 22 nt, Homo sapiens
ccaagugcuuaaaauuucauuu

SEQ ID NO: 22143 - RNA, 22 nt, Homo sapiens
ccaaguguucucauuguucaau

SEQ ID NO: 22144 - RNA, 22 nt, Homo sapiens
ccaaguguuuucauuguuccau

SEQ ID NO: 22145 - RNA, 22 nt, Homo sapiens
ccacccuggagaauuugagguc

SEQ ID NO: 22146 - RNA, 22 nt, Homo sapiens
ccacugugguaucugauacugg

SEQ ID NO: 22147 - RNA, 22 nt, Homo sapiens
ccagaguuucugauucagcagg

SEQ ID NO: 22148 - RNA, 22 nt, Homo sapiens
gcagcacauggcagaacauauu

SEQ ID NO: 22149 - RNA, 22 nt, Homo sapiens
gcagucacagggagauggugac

SEQ ID NO: 22150 - RNA, 22 nt, Homo sapiens
gcagugacaugugccaguuuau

SEQ ID NO: 22151 - RNA, 22 nt, Homo sapiens
gcaguguucugggcaggaagaa

SEQ ID NO: 22152 - RNA, 22 nt, Homo sapiens
gcaguguuggggccggaggcug

SEQ ID NO: 22153 - RNA, 22 nt, Homo sapiens
gcauauuuuaaaguguaaccug

SEQ ID NO: 22154 - RNA, 22 nt, Homo sapiens
gcaugcacaugugaaaaaauga

SEQ ID NO: 22155 - RNA, 22 nt, Homo sapiens
gcauggagaaggggacugauuc

SEQ ID NO: 22156 - RNA, 22 nt, Homo sapiens
gcauggaguggaaauucuuggg

SEQ ID NO: 22157 - RNA, 22 nt, Homo sapiens
gccaagaagugucuaagcagga

SEQ ID NO: 22158 - RNA, 20 nt, Homo sapiens
gccacaguuaagcuucugcc

SEQ ID NO: 22159 - RNA, 19 nt, Homo sapiens
gccaccuggugcguguucu

SEQ ID NO: 22160 - RNA, 22 nt, Homo sapiens
gccauggaggauuuauagaggc

SEQ ID NO: 22161 - RNA, 22 nt, Homo sapiens
gccauugcacuccgcccugggc

SEQ ID NO: 22162 - RNA, 22 nt, Homo sapiens
gccuagagaaguaaauauuauc

SEQ ID NO: 22163 - RNA, 22 nt, Homo sapiens
gccuuuggugacaggcaugugu

SEQ ID NO: 22164 - RNA, 22 nt, Homo sapiens
gcgugguguuagaaugagaagu

SEQ ID NO: 22165 - RNA, 22 nt, Homo sapiens
gcucaguuuccucagcugcaaa

SEQ ID NO: 22166 - RNA, 22 nt, Homo sapiens
gcugcuguuuaguuucuccugg

SEQ ID NO: 22167 - RNA, 22 nt, Homo sapiens
gcuggaauuaacauagaugugc

SEQ ID NO: 22168 - RNA, 22 nt, Homo sapiens
gcuggcaagaugcugaugcaac

SEQ ID NO: 22169 - RNA, 22 nt, Homo sapiens
gcuggcuuucuccugaucucag

SEQ ID NO: 22170 - RNA, 22 nt, Homo sapiens
gcuggucugccguaguaggugc

SEQ ID NO: 22171 - RNA, 22 nt, Homo sapiens
gcugguguagagugcagaaagg

SEQ ID NO: 22172 - RNA, 22 nt, Homo sapiens
gcuguguucucgaggcggggga

SEQ ID NO: 22173 - RNA, 18 nt, Homo sapiens
ggaaaacuuuucuaagua

SEQ ID NO: 22174 - RNA, 22 nt, Homo sapiens
ggaaaguaacccauucucuuac

SEQ ID NO: 22175 - RNA, 19 nt, Homo sapiens
ggaaaugucuauuaagauc

SEQ ID NO: 22176 - RNA, 22 nt, Homo sapiens
ggaagacaguguggugauuccu

SEQ ID NO: 22177 - RNA, 17 nt, Homo sapiens
ggaagccuuugguuuaa

SEQ ID NO: 22178 - RNA, 22 nt, Homo sapiens
ggaaugggauuugaagucuggc

SEQ ID NO: 22179 - RNA, 20 nt, Homo sapiens
ggagagugacauaauucugg

SEQ ID NO: 22180 - RNA, 22 nt, Homo sapiens
ggagauccucugcgggcaaaga

SEQ ID NO: 22181 - RNA, 22 nt, Homo sapiens
ggagaucuuuaggaguuggacu

SEQ ID NO: 22182 - RNA, 22 nt, Homo sapiens
ggagcucaucuagcauagaggu

SEQ ID NO: 22183 - RNA, 22 nt, Homo sapiens
ggagggugagaucaauuuggga

SEQ ID NO: 22184 - RNA, 22 nt, Homo sapiens
ggagucugaacuggacaaugac

SEQ ID NO: 22185 - RNA, 22 nt, Homo sapiens
gugggcaaagcuaguguguaga

SEQ ID NO: 22186 - RNA, 22 nt, Homo sapiens
gugguaucauuuaaccauuaga

SEQ ID NO: 22187 - RNA, 22 nt, Homo sapiens
gugguuuuaauauucagucuag

SEQ ID NO: 22188 - RNA, 22 nt, Homo sapiens
gugguuuuacaaagagaaagau

SEQ ID NO: 22189 - RNA, 22 nt, Homo sapiens
gugguuuuuagauuucuacagu

SEQ ID NO: 22190 - RNA, 22 nt, Homo sapiens
gugguuuuuuucugccuuauag

SEQ ID NO: 22191 - RNA, 22 nt, Homo sapiens
gugucccagugugcauacaggu

SEQ ID NO: 22192 - RNA, 18 nt, Homo sapiens
gugucugguuaugggagu

SEQ ID NO: 22193 - RNA, 22 nt, Homo sapiens
gugugcaauuuugugggaggca

SEQ ID NO: 22194 - RNA, 21 nt, Homo sapiens
gugugcuugagugaugggauu

SEQ ID NO: 22195 - RNA, 22 nt, Homo sapiens
guguguaaauggcagugagcuc

SEQ ID NO: 22196 - RNA, 22 nt, Homo sapiens
guguucaaacccaggucugucu

SEQ ID NO: 22197 - RNA, 22 nt, Homo sapiens
guguucaaagcugauugagauu

SEQ ID NO: 22198 - RNA, 22 nt, Homo sapiens
guuagguagaaguuuacuuuga

SEQ ID NO: 22199 - RNA, 22 nt, Homo sapiens
guuauccugucuuuacauacaa

SEQ ID NO: 22200 - RNA, 22 nt, Homo sapiens
guuauguaucuugauugggugg

SEQ ID NO: 22201 - RNA, 22 nt, Homo sapiens
guuauguuaaauuguuguaugc

SEQ ID NO: 22202 - RNA, 22 nt, Homo sapiens
guuauuguccauuuauuuagca

SEQ ID NO: 22203 - RNA, 20 nt, Homo sapiens
guucacagagguuaugauua

SEQ ID NO: 22204 - RNA, 22 nt, Homo sapiens
guucaguuuugaaauguuaauu

SEQ ID NO: 22205 - RNA, 22 nt, Homo sapiens
guucaucagggauacuggcuua

SEQ ID NO: 22206 - RNA, 20 nt, Homo sapiens
guucccuguaggugugcgga

SEQ ID NO: 22207 - RNA, 22 nt, Homo sapiens
guucuggagauaaagccaaggu

SEQ ID NO: 22208 - RNA, 22 nt, Homo sapiens
guugacuaggagcuacuacuac

SEQ ID NO: 22209 - RNA, 22 nt, Homo sapiens
guugcacagucuuuccuggacu

SEQ ID NO: 22210 - RNA, 22 nt, Homo sapiens
guuggaauguauugcuacuucu

SEQ ID NO: 22211 - RNA, 22 nt, Homo sapiens
guuggucaaugugauuaggcca

SEQ ID NO: 22212 - RNA, 22 nt, Homo sapiens
guuuaggaaugagaauauuuag

SEQ ID NO: 22213 - RNA, 22 nt, Homo sapiens
guuuggcucuuguuucugucaa

SEQ ID NO: 22214 - RNA, 22 nt, Homo sapiens
guuuggcuuucucucuauccug

SEQ ID NO: 22215 - RNA, 22 nt, Homo sapiens
uaaagcauguaauuagguuaga

SEQ ID NO: 22216 - RNA, 16 nt, Homo sapiens
uaaagcuaaucacuuu

SEQ ID NO: 22217 - RNA, 22 nt, Homo sapiens
uaaagcuauuauaguuauguuu

SEQ ID NO: 22218 - RNA, 22 nt, Homo sapiens
uaaagcugaaaugauuaugaca

SEQ ID NO: 22219 - RNA, 22 nt, Homo sapiens
uaaaugcuuaauugaaugugga

SEQ ID NO: 22220 - RNA, 21 nt, Homo sapiens
uaaaugucauacaaagcaaug

SEQ ID NO: 22221 - RNA, 22 nt, Homo sapiens
uaaauugcauaaguacaaauga

SEQ ID NO: 22222 - RNA, 18 nt, Homo sapiens
uaaauugcuucaccugag

SEQ ID NO: 22223 - RNA, 22 nt, Homo sapiens
uaacagcauuugugucuaguag

SEQ ID NO: 22224 - RNA, 21 nt, Homo sapiens
uaacagcuccacuccauucuc

SEQ ID NO: 22225 - RNA, 22 nt, Homo sapiens
uaacaguauaugugguaucuau

SEQ ID NO: 22226 - RNA, 22 nt, Homo sapiens
uaacccuuacaacuacacucgu

SEQ ID NO: 22227 - RNA, 22 nt, Homo sapiens
uaacccuuaguaucuguggguu

SEQ ID NO: 22228 - RNA, 22 nt, Homo sapiens
uaacuaaagagaagucaauguc

SEQ ID NO: 22229 - RNA, 22 nt, Homo sapiens
uaaggaaggcugugugcuuuua

SEQ ID NO: 22230 - RNA, 22 nt, Homo sapiens
uaaggcuucuuggaauacugca

SEQ ID NO: 22231 - RNA, 22 nt, Homo sapiens
uaagggcaugcugcaugagagu

SEQ ID NO: 22232 - RNA, 22 nt, Homo sapiens
uaagguguagacuggucacaag

SEQ ID NO: 22233 - RNA, 22 nt, Homo sapiens
uaaguaauuuguauuuuaccca

SEQ ID NO: 22234 - RNA, 22 nt, Homo sapiens
uaagucacuccagguuaaagug

SEQ ID NO: 22235 - RNA, 22 nt, Homo sapiens
uaagucuuuuuggaguuuauaa

SEQ ID NO: 22236 - RNA, 20 nt, Homo sapiens
uaagugcuugaugaaugaac

SEQ ID NO: 22237 - RNA, 22 nt, Homo sapiens
uaaguucauucaugaaacuuag

SEQ ID NO: 22238 - RNA, 22 nt, Homo sapiens
uaauaguuucagaaguuguuuu

SEQ ID NO: 22239 - RNA, 22 nt, Homo sapiens
uaaucucagcuacucaggaggc

SEQ ID NO: 22240 - RNA, 22 nt, Homo sapiens
uaaucucagcugagcugagauu

SEQ ID NO: 22241 - RNA, 22 nt, Homo sapiens
uaaugguuuugcaccaucccuc

SEQ ID NO: 22242 - RNA, 22 nt, Homo sapiens
uacaaagcuuugaugugucuuu

SEQ ID NO: 22243 - RNA, 22 nt, Homo sapiens
uacacacguguguauauauaca

SEQ ID NO: 22244 - RNA, 22 nt, Homo sapiens
uacacaugugaguucuuuucua

SEQ ID NO: 22245 - RNA, 22 nt, Homo sapiens
uacaccugcacucuagccuggg

SEQ ID NO: 22246 - RNA, 22 nt, Homo sapiens
uacagaauugcagguguggcag

SEQ ID NO: 22247 - RNA, 22 nt, Homo sapiens
uacaggauagacaauuuauuaa

SEQ ID NO: 22248 - RNA, 22 nt, Homo sapiens
uacaguggaaguuaaccccauu

SEQ ID NO: 22249 - RNA, 22 nt, Homo sapiens
uacagugggcacuggcgcccug

SEQ ID NO: 22250 - RNA, 22 nt, Homo sapiens
uacaucagccugaaagagcucg

SEQ ID NO: 22251 - RNA, 22 nt, Homo sapiens
uaccacagucauuacacuugua

SEQ ID NO: 22252 - RNA, 22 nt, Homo sapiens
uaccagcauuucucuuuaagua

SEQ ID NO: 22253 - RNA, 22 nt, Homo sapiens
uacccaguaacaaguauuuugg

SEQ ID NO: 22254 - RNA, 22 nt, Homo sapiens
uacucacauucuguuucuugcu

SEQ ID NO: 22255 - RNA, 22 nt, Homo sapiens
uacucugcagagaugcauaaca

SEQ ID NO: 22256 - RNA, 22 nt, Homo sapiens
ugagacacugaauccggccuga

SEQ ID NO: 22257 - RNA, 22 nt, Homo sapiens
ugagacauacuuacaggggaug

SEQ ID NO: 22258 - RNA, 22 nt, Homo sapiens
ugagacgucuucucuucuucaa

SEQ ID NO: 22259 - RNA, 22 nt, Homo sapiens
ugagagaugaacucugauaugu

SEQ ID NO: 22260 - RNA, 22 nt, Homo sapiens
ugagaggugauaaagcaagggu

SEQ ID NO: 22261 - RNA, 22 nt, Homo sapiens
ugagagucauacaaauaaaaau

SEQ ID NO: 22262 - RNA, 22 nt, Homo sapiens
ugagauaggaucuugcucuguu

SEQ ID NO: 22263 - RNA, 22 nt, Homo sapiens
ugagaucacuaagagguaaugg

SEQ ID NO: 22264 - RNA, 22 nt, Homo sapiens
ugagaucagugaagaaguguuu

SEQ ID NO: 22265 - RNA, 22 nt, Homo sapiens
ugagaucuguaaagucugacau

SEQ ID NO: 22266 - RNA, 22 nt, Homo sapiens
ugagaucuuaccuuccugccuu

SEQ ID NO: 22267 - RNA, 19 nt, Homo sapiens
ugagaucuuuacuggguuu

SEQ ID NO: 22268 - RNA, 22 nt, Homo sapiens
ugagaugaagcuagaagaaugg

SEQ ID NO: 22269 - RNA, 22 nt, Homo sapiens
ugagaugaagucucacucuguc

SEQ ID NO: 22270 - RNA, 22 nt, Homo sapiens
ugagaugaggucucacucuguu

SEQ ID NO: 22271 - RNA, 22 nt, Homo sapiens
ugagaugauagauauguuaauu

SEQ ID NO: 22272 - RNA, 22 nt, Homo sapiens
ugagauggaguuucgcucuugu

SEQ ID NO: 22273 - RNA, 22 nt, Homo sapiens
ugagauggaguuucgcuuuugu

SEQ ID NO: 22274 - RNA, 21 nt, Homo sapiens
ugagaugugaccagggcauca

SEQ ID NO: 22275 - RNA, 22 nt, Homo sapiens
ugagauguguccagaucuaguu

SEQ ID NO: 22276 - RNA, 21 nt, Homo sapiens
ugagauuaaguuguuuagaag

SEQ ID NO: 22277 - RNA, 22 nt, Homo sapiens
ugagauuguucuaugucugguu

SEQ ID NO: 22278 - RNA, 22 nt, Homo sapiens
ugagcaauaaaguuacacaguu

SEQ ID NO: 22279 - RNA, 21 nt, Homo sapiens
ugagcauuaguacaguaggga

SEQ ID NO: 22280 - RNA, 22 nt, Homo sapiens
ugagccauggcaccuugucuaa

SEQ ID NO: 22281 - RNA, 22 nt, Homo sapiens
ugagccaugguuagcuucucau

SEQ ID NO: 22282 - RNA, 22 nt, Homo sapiens
ugagcucagcuuucuuuuucac

SEQ ID NO: 22283 - RNA, 22 nt, Homo sapiens
ugagcugagaaaugcagcagcu

SEQ ID NO: 22284 - RNA, 22 nt, Homo sapiens
ugagcugguacuaauauuauca

SEQ ID NO: 22285 - RNA, 22 nt, Homo sapiens
ugaggacugagaggcacugugg

SEQ ID NO: 22286 - RNA, 17 nt, Homo sapiens
ugaggcacuaguaucac

SEQ ID NO: 22287 - RNA, 22 nt, Homo sapiens
ugaggcuaggauaggcugauuc

SEQ ID NO: 22288 - RNA, 22 nt, Homo sapiens
ugagguaagauguucauuuuuc

SEQ ID NO: 22289 - RNA, 22 nt, Homo sapiens
ugagguaucauugcccaggcug

SEQ ID NO: 22290 - RNA, 22 nt, Homo sapiens
ugaggucauucaugugggcgca

SEQ ID NO: 22291 - RNA, 20 nt, Homo sapiens
ugaggucugagaaagaauga

SEQ ID NO: 22292 - RNA, 22 nt, Homo sapiens
ugaggucuuuauuuagugcuca

SEQ ID NO: 22293 - RNA, 22 nt, Homo sapiens
uggugagaaaagaugucuuugu

SEQ ID NO: 22294 - RNA, 22 nt, Homo sapiens
uggugagaaacuagauauuuuu

SEQ ID NO: 22295 - RNA, 22 nt, Homo sapiens
uggugagaaaugagaugcuuuu

SEQ ID NO: 22296 - RNA, 15 nt, Homo sapiens
uggugguguugagac

SEQ ID NO: 22297 - RNA, 22 nt, Homo sapiens
ugguguuugagaagcugauguc

SEQ ID NO: 22298 - RNA, 21 nt, Homo sapiens
ugguucaguucguuacgugug

SEQ ID NO: 22299 - RNA, 22 nt, Homo sapiens
ugguuccauauuaauuuuagga

SEQ ID NO: 22300 - RNA, 22 nt, Homo sapiens
uguaaacucaguauguuuuacu

SEQ ID NO: 22301 - RNA, 20 nt, Homo sapiens
uguacacaguguacccacau

SEQ ID NO: 22302 - RNA, 22 nt, Homo sapiens
uguagacaccaaagacagcaua

SEQ ID NO: 22303 - RNA, 22 nt, Homo sapiens
uguagcaaaucgauacuauugg

SEQ ID NO: 22304 - RNA, 23 nt, Homo sapiens
uguauacacccugugcaucuggg

SEQ ID NO: 22305 - RNA, 21 nt, Homo sapiens
uguauacauggaagaaugguc

SEQ ID NO: 22306 - RNA, 22 nt, Homo sapiens
uguauauguuuguacauauguc

SEQ ID NO: 22307 - RNA, 22 nt, Homo sapiens
uguaugagagacauggcugcuu

SEQ ID NO: 22308 - RNA, 22 nt, Homo sapiens
uguaugaguuguuuauaaauuu

SEQ ID NO: 22309 - RNA, 22 nt, Homo sapiens
uguaugcuuuugagagauauuu

SEQ ID NO: 22310 - RNA, 22 nt, Homo sapiens
ugucacugugaguuugacugcu

SEQ ID NO: 22311 - RNA, 22 nt, Homo sapiens
ugucagaaucuagaggcugcua

SEQ ID NO: 22312 - RNA, 22 nt, Homo sapiens
ugucagcacaacucagguuccu

SEQ ID NO: 22313 - RNA, 22 nt, Homo sapiens
ugucaggagcaaugauaaauuu

SEQ ID NO: 22314 - RNA, 23 nt, Homo sapiens
ugucaucaagaugaggucacacu

SEQ ID NO: 22315 - RNA, 22 nt, Homo sapiens
ugucauggggaaaauaacagac

SEQ ID NO: 22316 - RNA, 22 nt, Homo sapiens
ugucaugguagcaaggacgagg

SEQ ID NO: 22317 - RNA, 22 nt, Homo sapiens
ugucauuguggugcagauauaa

SEQ ID NO: 22318 - RNA, 22 nt, Homo sapiens
uguccugaagcuuuguuaugua

SEQ ID NO: 22319 - RNA, 22 nt, Homo sapiens
ugucuacugaugauguaguuaa

SEQ ID NO: 22320 - RNA, 22 nt, Homo sapiens
ugucucagugauuggcuuucug

SEQ ID NO: 22321 - RNA, 21 nt, Homo sapiens
ugucugagagaggagaucuac

SEQ ID NO: 22322 - RNA, 18 nt, Homo sapiens
ugucuuagagcuugaccc

SEQ ID NO: 22323 - RNA, 22 nt, Homo sapiens
ugucuugagagaggacaugacu

SEQ ID NO: 22324 - RNA, 21 nt, Homo sapiens
ugugaaaucuaggcagagguu

SEQ ID NO: 22325 - RNA, 23 nt, Homo sapiens
ugugacacuuccgucaguucauu

SEQ ID NO: 22326 - RNA, 22 nt, Homo sapiens
ugugacagguauccuguguucu

SEQ ID NO: 22327 - RNA, 22 nt, Homo sapiens
ugugacaguguuacauuucaug

SEQ ID NO: 22328 - RNA, 22 nt, Homo sapiens
ugugacuaguggugaaugacgc

SEQ ID NO: 22329 - RNA, 22 nt, Homo sapiens
ugugagacugacagggcagggu

SEQ ID NO: 22330 - RNA, 20 nt, Homo sapiens
ugugauuauuuaguugcaug

SEQ ID NO: 22331 - RNA, 22 nt, Homo sapiens
ugugauuauuuauagacaguca

SEQ ID NO: 22332 - RNA, 17 nt, Homo sapiens
ugugauugaagucaucc

SEQ ID NO: 22333 - RNA, 22 nt, Homo sapiens
ugugcaaauguuaaacuaacuu

SEQ ID NO: 22334 - RNA, 22 nt, Homo sapiens
ugugcacauaacauuuuuuuag

SEQ ID NO: 22335 - RNA, 23 nt, Homo sapiens
ugugcacauuuacauauauacac

SEQ ID NO: 22336 - RNA, 22 nt, Homo sapiens
ugugcaugacagcauacaaacg

SEQ ID NO: 22337 - RNA, 22 nt, Homo sapiens
ugugccacuccaaccuggguga

SEQ ID NO: 22338 - RNA, 22 nt, Homo sapiens
ugugccacuccaggaggcuguu

SEQ ID NO: 22339 - RNA, 22 nt, Homo sapiens
ugugccacugcacuccugggug

SEQ ID NO: 22340 - RNA, 22 nt, Homo sapiens
ugugccacugcacucuggccug

SEQ ID NO: 22341 - RNA, 22 nt, Homo sapiens
ugugccacugcacucugggcaa

SEQ ID NO: 22342 - RNA, 22 nt, Homo sapiens
uguggaaauuguuguauuuaau

SEQ ID NO: 22343 - RNA, 22 nt, Homo sapiens
uguggcaaagucuugugaauau

SEQ ID NO: 22344 - RNA, 22 nt, Homo sapiens
uguggccccuagcuacuagaga

SEQ ID NO: 22345 - RNA, 22 nt, Homo sapiens
uguggccuuuguuucaguuggg

SEQ ID NO: 22346 - RNA, 22 nt, Homo sapiens
ugugggaggugcuaauguaaau

SEQ ID NO: 22347 - RNA, 22 nt, Homo sapiens
uguggucaucacuugaagguaa

SEQ ID NO: 22348 - RNA, 22 nt, Homo sapiens
uguguaaauaugauagaggaau

SEQ ID NO: 22349 - RNA, 22 nt, Homo sapiens
uguguacaucucuacacacaug

SEQ ID NO: 22350 - RNA, 22 nt, Homo sapiens
uguguuugauaaguccauaguu

SEQ ID NO: 22351 - RNA, 21 nt, Homo sapiens
uguuaacaugcagauuacugg

SEQ ID NO: 22352 - RNA, 22 nt, Homo sapiens
uguugcacucuagccugggcaa

SEQ ID NO: 22353 - RNA, 22 nt, Homo sapiens
uguugcauuugucaaggucaag

SEQ ID NO: 22354 - RNA, 22 nt, Homo sapiens
uuaaauacagcaugguguuucu

SEQ ID NO: 22355 - RNA, 22 nt, Homo sapiens
uuaaaugcucacauaaagguag

SEQ ID NO: 22356 - RNA, 21 nt, Homo sapiens
uuaacagacaagugucuuccc

SEQ ID NO: 22357 - RNA, 22 nt, Homo sapiens
uuaacagucacuuagcucauuu

SEQ ID NO: 22358 - RNA, 22 nt, Homo sapiens
uuaagaugcauuuugaaguuaa

SEQ ID NO: 22359 - RNA, 23 nt, Homo sapiens
uuaagcaacggcugcuuuucaga

SEQ ID NO: 22360 - RNA, 22 nt, Homo sapiens
uuaagcaguaguuaaggagagg

SEQ ID NO: 22361 - RNA, 22 nt, Homo sapiens
uuaagccacucaagagauagag

SEQ ID NO: 22362 - RNA, 19 nt, Homo sapiens
uuaagugugauaucucagu

SEQ ID NO: 22363 - RNA, 22 nt, Homo sapiens
uuaaguuaggcuucagcagucu

SEQ ID NO: 22364 - RNA, 21 nt, Homo sapiens
ugacagaaaauugaguuugcu

SEQ ID NO: 22365 - RNA, 22 nt, Homo sapiens
ugacagagcaggacuucaucuc

SEQ ID NO: 22366 - RNA, 22 nt, Homo sapiens
ugacagaggucuuuuaauagcu

SEQ ID NO: 22367 - RNA, 22 nt, Homo sapiens
ugacaguaucuacagcuucuua

SEQ ID NO: 22368 - RNA, 22 nt, Homo sapiens
ugacagugaacagguuaccacu

SEQ ID NO: 22369 - RNA, 18 nt, Homo sapiens
ugacaucauuuagaaagg

SEQ ID NO: 22370 - RNA, 22 nt, Homo sapiens
ugacaugaagaaaaacagauuu

SEQ ID NO: 22371 - RNA, 22 nt, Homo sapiens
ugacaugaugagcaauaauggc

SEQ ID NO: 22372 - RNA, 22 nt, Homo sapiens
ugacaugauguuccuacacugu

SEQ ID NO: 22373 - RNA, 21 nt, Homo sapiens
ugacauguuggugugcugcac

SEQ ID NO: 22374 - RNA, 22 nt, Homo sapiens
ugaccacagaaagugagggagc

SEQ ID NO: 22375 - RNA, 22 nt, Homo sapiens
ugacggaggcauuggaagcuug

SEQ ID NO: 22376 - RNA, 22 nt, Homo sapiens
ugacuacagauuugcugccaga

SEQ ID NO: 22377 - RNA, 21 nt, Homo sapiens
ugacuagauuccagauuggcc

SEQ ID NO: 22378 - RNA, 22 nt, Homo sapiens
ugacuaguuuugcuguuguuau

SEQ ID NO: 22379 - RNA, 22 nt, Homo sapiens
ugacuauaucucuguauaaacu

SEQ ID NO: 22380 - RNA, 22 nt, Homo sapiens
ugacugaguaguauuccacuau

SEQ ID NO: 22381 - RNA, 23 nt, Homo sapiens
ugacugaguauauguuuggugcu

SEQ ID NO: 22382 - RNA, 23 nt, Homo sapiens
ugacuggagacuguugauccuuu

SEQ ID NO: 22383 - RNA, 22 nt, Homo sapiens
ugacuggagucuugcucugucg

SEQ ID NO: 22384 - RNA, 22 nt, Homo sapiens
ugacuugaucacccccuaaggg

SEQ ID NO: 22385 - RNA, 18 nt, Homo sapiens
ugagaacauguguacaca

SEQ ID NO: 22386 - RNA, 22 nt, Homo sapiens
ugagaacggauacuaagggcug

SEQ ID NO: 22387 - RNA, 22 nt, Homo sapiens
ugagaacuuugucuuuuacucu

SEQ ID NO: 22388 - RNA, 22 nt, Homo sapiens
ugagaagacaucuuugcuuugu

SEQ ID NO: 22389 - RNA, 22 nt, Homo sapiens
ugagaagcauaccagugucugu

SEQ ID NO: 22390 - RNA, 22 nt, Homo sapiens
ugagaagugauauagaaguuaa

SEQ ID NO: 22391 - RNA, 22 nt, Homo sapiens
ugagaaugacugggcaugcugc

SEQ ID NO: 22392 - RNA, 22 nt, Homo sapiens
ugagacaaaguuguuggauguu

SEQ ID NO: 22393 - RNA, 22 nt, Homo sapiens
ugagacaucucuccugagacag

SEQ ID NO: 22394 - RNA, 22 nt, Homo sapiens
ugagaccaacagauuccaguuc

SEQ ID NO: 22395 - RNA, 22 nt, Homo sapiens
ugagacggagucucgcuguguc

SEQ ID NO: 22396 - RNA, 22 nt, Homo sapiens
ugagacugagucuugcucuugu

SEQ ID NO: 22397 - RNA, 22 nt, Homo sapiens
ugagacugaguuuugcucguug

SEQ ID NO: 22398 - RNA, 22 nt, Homo sapiens
ugagagacaguuucgucggagg

SEQ ID NO: 22399 - RNA, 22 nt, Homo sapiens
ugagagcugcauucuugaaagc

SEQ ID NO: 22400 - RNA, 22 nt, Homo sapiens
ugagaggugaauggcaggcuca

SEQ ID NO: 22401 - RNA, 22 nt, Homo sapiens
gugggcaagucacuucaguucu

SEQ ID NO: 22402 - RNA, 22 nt, Homo sapiens
guggguaaaucucuguucgagg

SEQ ID NO: 22403 - RNA, 22 nt, Homo sapiens
guggucagaaaucucaguggca

SEQ ID NO: 22404 - RNA, 22 nt, Homo sapiens
gugguuuuaucccagaaauuaa

SEQ ID NO: 22405 - RNA, 22 nt, Homo sapiens
gugguuuucaacuccaccugca

SEQ ID NO: 22406 - RNA, 22 nt, Homo sapiens
guguaaaacaauuagaggauuu

SEQ ID NO: 22407 - RNA, 22 nt, Homo sapiens
guguauucaucuggcugaggua

SEQ ID NO: 22408 - RNA, 21 nt, Homo sapiens
gugucacagacaugacagaug

SEQ ID NO: 22409 - RNA, 22 nt, Homo sapiens
gugucacuguugagaaguccac

SEQ ID NO: 22410 - RNA, 22 nt, Homo sapiens
gugucaugaagguuuuaugcag

SEQ ID NO: 22411 - RNA, 22 nt, Homo sapiens
gugugauuauuucaauugaugc

SEQ ID NO: 22412 - RNA, 22 nt, Homo sapiens
gugugcaacuuucauuaauauu

SEQ ID NO: 22413 - RNA, 22 nt, Homo sapiens
guuaugcagcaauugauaaucu

SEQ ID NO: 22414 - RNA, 22 nt, Homo sapiens
guuauugcucucgaagacucuc

SEQ ID NO: 22415 - RNA, 22 nt, Homo sapiens
guucaguuugcugaugcguuga

SEQ ID NO: 22416 - RNA, 22 nt, Homo sapiens
guucaucagggauauuggcuua

SEQ ID NO: 22417 - RNA, 22 nt, Homo sapiens
guugaggcaggagaauuacuug

SEQ ID NO: 22418 - RNA, 22 nt, Homo sapiens
guugcagaguucuuccuccuga

SEQ ID NO: 22419 - RNA, 22 nt, Homo sapiens
guugccuaggcuggagugcagu

SEQ ID NO: 22420 - RNA, 22 nt, Homo sapiens
guuugccuuuuagauaggaaug

SEQ ID NO: 22421 - RNA, 22 nt, Homo sapiens
guuuguaacucuagugacuaga

SEQ ID NO: 22422 - RNA, 22 nt, Homo sapiens
guuugugcuccuaugagaaucu

SEQ ID NO: 22423 - RNA, 22 nt, Homo sapiens
uaaaagucaucacaacuggagu

SEQ ID NO: 22424 - RNA, 22 nt, Homo sapiens
uaaagcuacaguauaugguauu

SEQ ID NO: 22425 - RNA, 22 nt, Homo sapiens
uaaaugacugucaguagaugaa

SEQ ID NO: 22426 - RNA, 22 nt, Homo sapiens
uaaaugcucuuuaaaagugcuu

SEQ ID NO: 22427 - RNA, 22 nt, Homo sapiens
uaaauggauaaaugaauaccua

SEQ ID NO: 22428 - RNA, 22 nt, Homo sapiens
uaacaagagagucagucagucc

SEQ ID NO: 22429 - RNA, 22 nt, Homo sapiens
uaacauuguugauuauacuaag

SEQ ID NO: 22430 - RNA, 22 nt, Homo sapiens
uaacccacgcagaauggacaag

SEQ ID NO: 22431 - RNA, 22 nt, Homo sapiens
uaacugcaaccucugccugcug

SEQ ID NO: 22432 - RNA, 20 nt, Homo sapiens
uaacuguggcuucuuuuggc

SEQ ID NO: 22433 - RNA, 22 nt, Homo sapiens
uaagaauucuguccgguauacu

SEQ ID NO: 22434 - RNA, 23 nt, Homo sapiens
uaagacacuaacuuuaugcuuug

SEQ ID NO: 22435 - RNA, 22 nt, Homo sapiens
uaaggaguagaauaguaaggca

SEQ ID NO: 22436 - RNA, 22 nt, Homo sapiens
uaaggcaaaccuuggcugcagu

SEQ ID NO: 22437 - RNA, 18 nt, Homo sapiens
uaaggcacuauaggcauu

SEQ ID NO: 22438 - RNA, 22 nt, Homo sapiens
uaagggacauguguugccuaag

SEQ ID NO: 22439 - RNA, 22 nt, Homo sapiens
uaagggcacuaaucccauuuau

SEQ ID NO: 22440 - RNA, 22 nt, Homo sapiens
uaaguaauuguuaauagggaag

SEQ ID NO: 22441 - RNA, 22 nt, Homo sapiens
uaagugaauuucacuacugagu

SEQ ID NO: 22442 - RNA, 20 nt, Homo sapiens
uaagugcuugagacuucuga

SEQ ID NO: 22443 - RNA, 22 nt, Homo sapiens
uaaugcauguaaugggcugaua

SEQ ID NO: 22444 - RNA, 22 nt, Homo sapiens
uaaugugcuucucuaccauagg

SEQ ID NO: 22445 - RNA, 22 nt, Homo sapiens
uacaaagugggaaacgaagguu

SEQ ID NO: 22446 - RNA, 22 nt, Homo sapiens
uacagaauucugucccuugagu

SEQ ID NO: 22447 - RNA, 22 nt, Homo sapiens
uacagaguagaagauuugcaga

SEQ ID NO: 22448 - RNA, 22 nt, Homo sapiens
uacagcacaggugcagguguug

SEQ ID NO: 22449 - RNA, 22 nt, Homo sapiens
uacauacuucacagacuuuaaa

SEQ ID NO: 22450 - RNA, 22 nt, Homo sapiens
uacaugcaugggcaugugugca

SEQ ID NO: 22451 - RNA, 22 nt, Homo sapiens
uaccacaggcuggguaaucuau

SEQ ID NO: 22452 - RNA, 22 nt, Homo sapiens
uaccacugccgagaaaacagau

SEQ ID NO: 22453 - RNA, 22 nt, Homo sapiens
uaccaguaaugguucuagagga

SEQ ID NO: 22454 - RNA, 22 nt, Homo sapiens
uaccauguauguuucuccauug

SEQ ID NO: 22455 - RNA, 19 nt, Homo sapiens
uacccagaagcagcauugu

SEQ ID NO: 22456 - RNA, 22 nt, Homo sapiens
uacccuuauguaaucauuauac

SEQ ID NO: 22457 - RNA, 22 nt, Homo sapiens
uaccucagccaaugcccagaag

SEQ ID NO: 22458 - RNA, 22 nt, Homo sapiens
uacuagaaccuuauucagagug

SEQ ID NO: 22459 - RNA, 22 nt, Homo sapiens
uacucaguagacacucauaugu

SEQ ID NO: 22460 - RNA, 19 nt, Homo sapiens
uacugcacuccagucuggg

SEQ ID NO: 22461 - RNA, 22 nt, Homo sapiens
uacugcacucuagccuggguga

SEQ ID NO: 22462 - RNA, 18 nt, Homo sapiens
uacugcacucuccagccu

SEQ ID NO: 22463 - RNA, 22 nt, Homo sapiens
uacugcaucgaaaugcuuuuau

SEQ ID NO: 22464 - RNA, 22 nt, Homo sapiens
uacugcugucagugccaaguag

SEQ ID NO: 22465 - RNA, 22 nt, Homo sapiens
uacuguacugcaguucugcaaa

SEQ ID NO: 22466 - RNA, 22 nt, Homo sapiens
uagaagcugagaauguccucag

SEQ ID NO: 22467 - RNA, 22 nt, Homo sapiens
uagaauguaacuuccaugucau

SEQ ID NO: 22468 - RNA, 22 nt, Homo sapiens
uagaaugucagcuucuugaggg

SEQ ID NO: 22469 - RNA, 23 nt, Homo sapiens
uagaauguuuuuccauguuucuu

SEQ ID NO: 22470 - RNA, 22 nt, Homo sapiens
uagacaacugaaacacugugca

SEQ ID NO: 22471 - RNA, 22 nt, Homo sapiens
uagacuguaagauccaggagag

SEQ ID NO: 22472 - RNA, 22 nt, Homo sapiens
gcagugugaucacagcuuacug

SEQ ID NO: 22473 - RNA, 22 nt, Homo sapiens
gcaguguggguagagggcaaga

SEQ ID NO: 22474 - RNA, 22 nt, Homo sapiens
gcaguguugugauccaggucuu

SEQ ID NO: 22475 - RNA, 20 nt, Homo sapiens
gcauaugucuuuauggcagc

SEQ ID NO: 22476 - RNA, 22 nt, Homo sapiens
gcaucacagggagacaggccuc

SEQ ID NO: 22477 - RNA, 22 nt, Homo sapiens
gcaugaugaauaauaucacaag

SEQ ID NO: 22478 - RNA, 22 nt, Homo sapiens
gccaagauugguuuaauauucc

SEQ ID NO: 22479 - RNA, 22 nt, Homo sapiens
gccauugcacuccagcuugggc

SEQ ID NO: 22480 - RNA, 22 nt, Homo sapiens
gcccaguagcaguacaucccuu

SEQ ID NO: 22481 - RNA, 17 nt, Homo sapiens
gcccuuugugccucuuc

SEQ ID NO: 22482 - RNA, 22 nt, Homo sapiens
gcgagcauuguaggaaguucag

SEQ ID NO: 22483 - RNA, 23 nt, Homo sapiens
gcuaggagagaugaaacacaggu

SEQ ID NO: 22484 - RNA, 19 nt, Homo sapiens
gcucaccuugcugcuccag

SEQ ID NO: 22485 - RNA, 22 nt, Homo sapiens
gcugauguuggccucugggcuu

SEQ ID NO: 22486 - RNA, 22 nt, Homo sapiens
gcugcuguuucucuuucagcau

SEQ ID NO: 22487 - RNA, 22 nt, Homo sapiens
gcuggguucagagugggcugcg

SEQ ID NO: 22488 - RNA, 22 nt, Homo sapiens
gcuguauugacuuuguaucaua

SEQ ID NO: 22489 - RNA, 22 nt, Homo sapiens
gcuguguugugcccagcaucau

SEQ ID NO: 22490 - RNA, 22 nt, Homo sapiens
gcuguugguaaaaaggacauga

SEQ ID NO: 22491 - RNA, 22 nt, Homo sapiens
ggaaagacaccuuacuauguua

SEQ ID NO: 22492 - RNA, 22 nt, Homo sapiens
ggaaagauguaauauuaucuaa

SEQ ID NO: 22493 - RNA, 21 nt, Homo sapiens
ggaaaguuaaggaaauacccc

SEQ ID NO: 22494 - RNA, 22 nt, Homo sapiens
ggaagacuuagaguagcaucag

SEQ ID NO: 22495 - RNA, 22 nt, Homo sapiens
ggaagguaauugucagcucaua

SEQ ID NO: 22496 - RNA, 22 nt, Homo sapiens
ggaagugcuguguggaagucug

SEQ ID NO: 22497 - RNA, 22 nt, Homo sapiens
ggacagugaaugccacuccucc

SEQ ID NO: 22498 - RNA, 22 nt, Homo sapiens
ggacuagaggugaaaagaagac

SEQ ID NO: 22499 - RNA, 22 nt, Homo sapiens
ggagagcuaggcagagguuugu

SEQ ID NO: 22500 - RNA, 22 nt, Homo sapiens
ggagaucuuguuaaaguacaga

SEQ ID NO: 22501 - RNA, 22 nt, Homo sapiens
ggaggcuaguaaaaagguagaa

SEQ ID NO: 22502 - RNA, 22 nt, Homo sapiens
ggagguagguuugugauuugua

SEQ ID NO: 22503 - RNA, 22 nt, Homo sapiens
ggagguagucuuucccuuauca

SEQ ID NO: 22504 - RNA, 16 nt, Homo sapiens
ggaggucaucugggaa

SEQ ID NO: 22505 - RNA, 20 nt, Homo sapiens
ggagguuguauaaguacauc

SEQ ID NO: 22506 - RNA, 22 nt, Homo sapiens
ggagucuugcuauguugccaag

SEQ ID NO: 22507 - RNA, 22 nt, Homo sapiens
ggagugugauuguucucuguua

SEQ ID NO: 22508 - RNA, 22 nt, Homo sapiens
ggaucacagagcuugggaaagg

SEQ ID NO: 22509 - RNA, 22 nt, Homo sapiens
uugauaguuuuaaaauuaaucu

SEQ ID NO: 22510 - RNA, 22 nt, Homo sapiens
uugauaugguauaagauuucau

SEQ ID NO: 22511 - RNA, 22 nt, Homo sapiens
uugauauguggaauauuuaucu

SEQ ID NO: 22512 - RNA, 22 nt, Homo sapiens
uugauauuaaguacugaagugg

SEQ ID NO: 22513 - RNA, 22 nt, Homo sapiens
uugauguccaucucuagguaaa

SEQ ID NO: 22514 - RNA, 22 nt, Homo sapiens
uugcaaaucucuuguguuuggu

SEQ ID NO: 22515 - RNA, 22 nt, Homo sapiens
uugcaccccuacuauuugccaa

SEQ ID NO: 22516 - RNA, 22 nt, Homo sapiens
uugcacuccagcucuaggugac

SEQ ID NO: 22517 - RNA, 22 nt, Homo sapiens
uugcacuguaauuuauuuaugu

SEQ ID NO: 22518 - RNA, 22 nt, Homo sapiens
uugcacuucauguaggccaaag

SEQ ID NO: 22519 - RNA, 22 nt, Homo sapiens
uugcagagccccacacugggcu

SEQ ID NO: 22520 - RNA, 22 nt, Homo sapiens
uugcagaucccacacucacccu

SEQ ID NO: 22521 - RNA, 22 nt, Homo sapiens
uugcagcaaagagggaggggca

SEQ ID NO: 22522 - RNA, 22 nt, Homo sapiens
uugcagcaacauggaugaaacu

SEQ ID NO: 22523 - RNA, 22 nt, Homo sapiens
uugcaguaguaacuccuuaccu

SEQ ID NO: 22524 - RNA, 22 nt, Homo sapiens
uugcauauguugaaccaagcgu

SEQ ID NO: 22525 - RNA, 19 nt, Homo sapiens
uugcauauguugaaccagg

SEQ ID NO: 22526 - RNA, 22 nt, Homo sapiens
uugccaauauuuuacugagaag

SEQ ID NO: 22527 - RNA, 22 nt, Homo sapiens
uugccuaggcuggauugcagug

SEQ ID NO: 22528 - RNA, 22 nt, Homo sapiens
uugccuauucacucugaugaua

SEQ ID NO: 22529 - RNA, 22 nt, Homo sapiens
uugcgcuuuuccuauguugccc

SEQ ID NO: 22530 - RNA, 22 nt, Homo sapiens
uugcucaggcuggaguacaaug

SEQ ID NO: 22531 - RNA, 22 nt, Homo sapiens
uugcugguuuucauaugagcag

SEQ ID NO: 22532 - RNA, 22 nt, Homo sapiens
uugcuuaggcuggagugcagug

SEQ ID NO: 22533 - RNA, 22 nt, Homo sapiens
uugcuuuguugucuggggaaua

SEQ ID NO: 22534 - RNA, 22 nt, Homo sapiens
uuggaaagagguguuuaugacu

SEQ ID NO: 22535 - RNA, 22 nt, Homo sapiens
uuggaagacaaugcugauucuc

SEQ ID NO: 22536 - RNA, 22 nt, Homo sapiens
uuggaagacauucugucugcua

SEQ ID NO: 22537 - RNA, 22 nt, Homo sapiens
uuggaaggcuccuaaugaaugg

SEQ ID NO: 22538 - RNA, 22 nt, Homo sapiens
uuggaagguaaucaaaaguucu

SEQ ID NO: 22539 - RNA, 22 nt, Homo sapiens
uuggacuuuaagauagagaugu

SEQ ID NO: 22540 - RNA, 22 nt, Homo sapiens
uuggagagaaaggcaguuccug

SEQ ID NO: 22541 - RNA, 22 nt, Homo sapiens
uuggagugugagagcagccugg

SEQ ID NO: 22542 - RNA, 22 nt, Homo sapiens
uuggcaaaugucacaaaucagg

SEQ ID NO: 22543 - RNA, 22 nt, Homo sapiens
uuggcaacauagugagaccccc

SEQ ID NO: 22544 - RNA, 22 nt, Homo sapiens
uuggcaaguuucugucagcaaa

SEQ ID NO: 22545 - RNA, 22 nt, Homo sapiens
uuggcacuugauaauauucugg

SEQ ID NO: 22546 - RNA, 22 nt, Homo sapiens
uuggcagugcccgaugcugggg

SEQ ID NO: 22547 - RNA, 22 nt, Homo sapiens
uuggcauugccaaacugucaac

SEQ ID NO: 22548 - RNA, 22 nt, Homo sapiens
uuggcuuaguugaccacagucu

SEQ ID NO: 22549 - RNA, 22 nt, Homo sapiens
uuggcuucuggacuauugugca

SEQ ID NO: 22550 - RNA, 22 nt, Homo sapiens
uuggcuuuuaugcagcuuaggu

SEQ ID NO: 22551 - RNA, 23 nt, Homo sapiens
uugggcaaaucacuaacgucucc

SEQ ID NO: 22552 - RNA, 17 nt, Homo sapiens
uugggcaagguagguga

SEQ ID NO: 22553 - RNA, 22 nt, Homo sapiens
uugggcaauaggaagcaggugg

SEQ ID NO: 22554 - RNA, 22 nt, Homo sapiens
uugguaccccugguguacuaau

SEQ ID NO: 22555 - RNA, 22 nt, Homo sapiens
uuggucacugacauguuugaaa

SEQ ID NO: 22556 - RNA, 22 nt, Homo sapiens
uuggucaucucccuccuuuuag

SEQ ID NO: 22557 - RNA, 22 nt, Homo sapiens
uugguccccuucaaccagcugu

SEQ ID NO: 22558 - RNA, 22 nt, Homo sapiens
uugguucucuuagccaucuuaa

SEQ ID NO: 22559 - RNA, 22 nt, Homo sapiens
uuguaaagucugucucagucag

SEQ ID NO: 22560 - RNA, 22 nt, Homo sapiens
uuguaaaguucucucccgaaaa

SEQ ID NO: 22561 - RNA, 22 nt, Homo sapiens
uuguaaaguucuuaggaagcuc

SEQ ID NO: 22562 - RNA, 22 nt, Homo sapiens
uuguacuuuuaguagagacggg

SEQ ID NO: 22563 - RNA, 22 nt, Homo sapiens
uuguauguuucugugcacauga

SEQ ID NO: 22564 - RNA, 22 nt, Homo sapiens
uugucacuauaaauaagcauuu

SEQ ID NO: 22565 - RNA, 22 nt, Homo sapiens
uugucauuuucagaguguuacg

SEQ ID NO: 22566 - RNA, 22 nt, Homo sapiens
uuguccuggagguucuugcaag

SEQ ID NO: 22567 - RNA, 22 nt, Homo sapiens
uugucuugcagcuuaggcauca

SEQ ID NO: 22568 - RNA, 22 nt, Homo sapiens
uugugaagaaaccagaaaaguu

SEQ ID NO: 22569 - RNA, 22 nt, Homo sapiens
uugugauugagugauccuuguu

SEQ ID NO: 22570 - RNA, 22 nt, Homo sapiens
uugugcaaaguugugguuucug

SEQ ID NO: 22571 - RNA, 22 nt, Homo sapiens
uugugcaugaugcauacauggu

SEQ ID NO: 22572 - RNA, 22 nt, Homo sapiens
uugugcuccuaugagaaucuaa

SEQ ID NO: 22573 - RNA, 22 nt, Homo sapiens
uugugcuuuacuuacuaccaga

SEQ ID NO: 22574 - RNA, 22 nt, Homo sapiens
uugugcuuuugagcugagauga

SEQ ID NO: 22575 - RNA, 22 nt, Homo sapiens
uugugucaaauggcaauuagca

SEQ ID NO: 22576 - RNA, 22 nt, Homo sapiens
uuguguccccacucaaauuaca

SEQ ID NO: 22577 - RNA, 22 nt, Homo sapiens
uugugucccugcccaaaucuca

SEQ ID NO: 22578 - RNA, 22 nt, Homo sapiens
uuguguuugaugcugacacgca

SEQ ID NO: 22579 - RNA, 22 nt, Homo sapiens
uuguuauguaucucaagauaaa

SEQ ID NO: 22580 - RNA, 22 nt, Homo sapiens
uuugaagacuacugggagugaa

SEQ ID NO: 22581 - RNA, 22 nt, Homo sapiens
uuugagcauguaguuuaacccu

SEQ ID NO: 22582 - RNA, 22 nt, Homo sapiens
uuugagcauuagggcaaaggca

SEQ ID NO: 22583 - RNA, 22 nt, Homo sapiens
uuugaguaggcuuauauuuugg

SEQ ID NO: 22584 - RNA, 22 nt, Homo sapiens
uuugauguugauacuaccuuca

SEQ ID NO: 22585 - RNA, 22 nt, Homo sapiens
uuugcaugcuccuuaugagaau

SEQ ID NO: 22586 - RNA, 22 nt, Homo sapiens
uuugccaaugggaauuuuccua

SEQ ID NO: 22587 - RNA, 22 nt, Homo sapiens
uuugccacugcaggcuguuuaa

SEQ ID NO: 22588 - RNA, 23 nt, Homo sapiens
uuugccacuuauuagcugggagg

SEQ ID NO: 22589 - RNA, 22 nt, Homo sapiens
uuugccuuugugauauggucua

SEQ ID NO: 22590 - RNA, 22 nt, Homo sapiens
uuuggaagaugccacuguauca

SEQ ID NO: 22591 - RNA, 22 nt, Homo sapiens
uuuggcagaaaacaagaaucug

SEQ ID NO: 22592 - RNA, 22 nt, Homo sapiens
uuuggcagaugacccucaaguu

SEQ ID NO: 22593 - RNA, 22 nt, Homo sapiens
uuuggcccugagggauggcaua

SEQ ID NO: 22594 - RNA, 22 nt, Homo sapiens
uuuggcuuuuguaauaacugcc

SEQ ID NO: 22595 - RNA, 22 nt, Homo sapiens
uuuggucuuuuauuuaaagcag

SEQ ID NO: 22596 - RNA, 22 nt, Homo sapiens
uuugguuuuuguuaucacucau

SEQ ID NO: 22597 - RNA, 22 nt, Homo sapiens
uuuguacacgugggugaauugu

SEQ ID NO: 22598 - RNA, 22 nt, Homo sapiens
uuuguacucccuuuagauaaaa

SEQ ID NO: 22599 - RNA, 22 nt, Homo sapiens
uuuguacugagccaagauggua

SEQ ID NO: 22600 - RNA, 22 nt, Homo sapiens
uuuguacuugguguucuggaaa

SEQ ID NO: 22601 - RNA, 18 nt, Homo sapiens
uuuguacuuuuucuaaug

SEQ ID NO: 22602 - RNA, 22 nt, Homo sapiens
uuuguccccgcccagaucucau

SEQ ID NO: 22603 - RNA, 22 nt, Homo sapiens
uuugugaaugucauaagcucca

SEQ ID NO: 22604 - RNA, 22 nt, Homo sapiens
uuugugaggugauggauauguc

SEQ ID NO: 22605 - RNA, 22 nt, Homo sapiens
uuugugcaugaagagggggugc

SEQ ID NO: 22606 - RNA, 22 nt, Homo sapiens
uuugugcuauguuauauauucu

SEQ ID NO: 22607 - RNA, 21 nt, Homo sapiens
uuugugguuacugugugagcu

SEQ ID NO: 22608 - RNA, 22 nt, Homo sapiens
uuuguucuucguuccugagcca

SEQ ID NO: 22609 - RNA, 22 nt, Homo sapiens
uuuuagcuuuucccaggacucc

SEQ ID NO: 22610 - RNA, 22 nt, Homo sapiens
uuuucaguuuuccagguagccg

SEQ ID NO: 22611 - RNA, 22 nt, Homo sapiens
uuuuccagugggacucccauua

SEQ ID NO: 22612 - RNA, 19 nt, Homo sapiens
uuuuccccuuucuuaagac

SEQ ID NO: 22613 - RNA, 22 nt, Homo sapiens
uuuugcaccauccuaauaguau

SEQ ID NO: 22614 - RNA, 20 nt, Homo sapiens
uuuugcacuccuacuaaggu

SEQ ID NO: 22615 - RNA, 22 nt, Homo sapiens
uuuugcaggucaggggcagaga

SEQ ID NO: 22616 - RNA, 22 nt, Homo sapiens
uuuugcuccuggcaaacucaua

SEQ ID NO: 22617 - RNA, 22 nt, Homo sapiens
aacuggcauguuuuaaggcuua

SEQ ID NO: 22618 - RNA, 22 nt, Homo sapiens
aagagguaauaacaaagcuucu

SEQ ID NO: 22619 - RNA, 22 nt, Homo sapiens
aagagguagcagucacaaaaga

SEQ ID NO: 22620 - RNA, 22 nt, Homo sapiens
aagagguaggaaauggucauuu

SEQ ID NO: 22621 - RNA, 23 nt, Homo sapiens
aagagguaugacuaugaagugga

SEQ ID NO: 22622 - RNA, 22 nt, Homo sapiens
aagcaaacaucagcuugguuaa

SEQ ID NO: 22623 - RNA, 22 nt, Homo sapiens
aagcaacacaucugccccgguu

SEQ ID NO: 22624 - RNA, 22 nt, Homo sapiens
aagcaucacauaauggaucaug

SEQ ID NO: 22625 - RNA, 22 nt, Homo sapiens
aagcugccuugugaaggcauuc

SEQ ID NO: 22626 - RNA, 22 nt, Homo sapiens
aagcuggagugcaguggugcaa

SEQ ID NO: 22627 - RNA, 22 nt, Homo sapiens
aagcuggauuucgcauccuguu

SEQ ID NO: 22628 - RNA, 22 nt, Homo sapiens
aaggaacuggaauauuuugaac

SEQ ID NO: 22629 - RNA, 22 nt, Homo sapiens
aaggcaauuuguugugaggauu

SEQ ID NO: 22630 - RNA, 22 nt, Homo sapiens
aaggcaguggcagaagauguca

SEQ ID NO: 22631 - RNA, 22 nt, Homo sapiens
aagggagcugcauaaucuugug

SEQ ID NO: 22632 - RNA, 17 nt, Homo sapiens
aaggugcuucgaccucc

SEQ ID NO: 22633 - RNA, 22 nt, Homo sapiens
aaggugguuuucucuuggaguc

SEQ ID NO: 22634 - RNA, 21 nt, Homo sapiens
aagguuuuuagugcuugacuu

SEQ ID NO: 22635 - RNA, 22 nt, Homo sapiens
aaguaauugagguuuuugcugu

SEQ ID NO: 22636 - RNA, 22 nt, Homo sapiens
aaguacuguuuaaauugcagaa

SEQ ID NO: 22637 - RNA, 22 nt, Homo sapiens
aaguagcagaggcaagacuuga

SEQ ID NO: 22638 - RNA, 22 nt, Homo sapiens
aaguaucaggaauaguuauugg

SEQ ID NO: 22639 - RNA, 22 nt, Homo sapiens
aaguauguaucaagucauacuu

SEQ ID NO: 22640 - RNA, 22 nt, Homo sapiens
aagucaaggagagaagcuucag

SEQ ID NO: 22641 - RNA, 22 nt, Homo sapiens
aagucaaggagagaggcgucag

SEQ ID NO: 22642 - RNA, 22 nt, Homo sapiens
agcucuuguuaguauuagcagu

SEQ ID NO: 22643 - RNA, 22 nt, Homo sapiens
agcugaguguuccaagagcgag

SEQ ID NO: 22644 - RNA, 22 nt, Homo sapiens
agcugcaaagggagagaugauu

SEQ ID NO: 22645 - RNA, 22 nt, Homo sapiens
agcugcaauguuuaguauaaua

SEQ ID NO: 22646 - RNA, 22 nt, Homo sapiens
agcugcauucguaucauauugu

SEQ ID NO: 22647 - RNA, 22 nt, Homo sapiens
agcugccagucuuguaaggccu

SEQ ID NO: 22648 - RNA, 22 nt, Homo sapiens
agcugguaugaaaaucucccca

SEQ ID NO: 22649 - RNA, 22 nt, Homo sapiens
agcuggucucaggugcccugcu

SEQ ID NO: 22650 - RNA, 22 nt, Homo sapiens
agcuguaguuugguggauguaa

SEQ ID NO: 22651 - RNA, 22 nt, Homo sapiens
agcugugucuucuuaaagauuu

SEQ ID NO: 22652 - RNA, 20 nt, Homo sapiens
agcuguuguuaaaaaggagg

SEQ ID NO: 22653 - RNA, 20 nt, Homo sapiens
agcuguuguuaugagguuua

SEQ ID NO: 22654 - RNA, 22 nt, Homo sapiens
agcuguuguucucagaggcuuu

SEQ ID NO: 22655 - RNA, 22 nt, Homo sapiens
agcuguuguuuuaagauacuaa

SEQ ID NO: 22656 - RNA, 22 nt, Homo sapiens
agcuucauucugaauagguuga

SEQ ID NO: 22657 - RNA, 22 nt, Homo sapiens
agcuucauuguuaugaauguca

SEQ ID NO: 22658 - RNA, 22 nt, Homo sapiens
aggaagacauauagaacuaaaa

SEQ ID NO: 22659 - RNA, 22 nt, Homo sapiens
aggaagacugaaauugcuguuc

SEQ ID NO: 22660 - RNA, 22 nt, Homo sapiens
aggaaugucaaugguaguuuaa

SEQ ID NO: 22661 - RNA, 22 nt, Homo sapiens
aggaauguuaguacuucuuagu

SEQ ID NO: 22662 - RNA, 22 nt, Homo sapiens
aggacacugagcaugggagguu

SEQ ID NO: 22663 - RNA, 22 nt, Homo sapiens
aggacacugauagucuuuggca

SEQ ID NO: 22664 - RNA, 22 nt, Homo sapiens
aggagcacaggacuuugauuau

SEQ ID NO: 22665 - RNA, 18 nt, Homo sapiens
aggagcauagugcuauga

SEQ ID NO: 22666 - RNA, 21 nt, Homo sapiens
aggagcauuguugugguggag

SEQ ID NO: 22667 - RNA, 22 nt, Homo sapiens
aggaguguguauuaaugaaauu

SEQ ID NO: 22668 - RNA, 21 nt, Homo sapiens
aggcaaaugaagcagccgcuc

SEQ ID NO: 22669 - RNA, 22 nt, Homo sapiens
aggcaaaugccagcaaucacac

SEQ ID NO: 22670 - RNA, 22 nt, Homo sapiens
aggcaagagugacuacgugaaa

SEQ ID NO: 22671 - RNA, 22 nt, Homo sapiens
aggcaggugaaagauaguuuua

SEQ ID NO: 22672 - RNA, 22 nt, Homo sapiens
aggcagucugaguuuugaaagg

SEQ ID NO: 22673 - RNA, 22 nt, Homo sapiens
aggcaguuucagugagagguga

SEQ ID NO: 22674 - RNA, 22 nt, Homo sapiens
aggcuagacuuugagaauuuuu

SEQ ID NO: 22675 - RNA, 22 nt, Homo sapiens
aggcuguguggauaauauuggg

SEQ ID NO: 22676 - RNA, 22 nt, Homo sapiens
agggcacuguagguccugccuc

SEQ ID NO: 22677 - RNA, 22 nt, Homo sapiens
agggcuuuugagcugagauggu

SEQ ID NO: 22678 - RNA, 22 nt, Homo sapiens
agguagaguguuuuguucuucu

SEQ ID NO: 22679 - RNA, 20 nt, Homo sapiens
agguaguuauacaaaugugu

SEQ ID NO: 22680 - RNA, 22 nt, Homo sapiens
agguauguauguaugggagaaa

SEQ ID NO: 22681 - RNA, 22 nt, Homo sapiens
agguauuuucaacuuagaaugg

SEQ ID NO: 22682 - RNA, 22 nt, Homo sapiens
aggugcugacaggauagguuuc

SEQ ID NO: 22683 - RNA, 22 nt, Homo sapiens
aggugcugagcagagaauccug

SEQ ID NO: 22684 - RNA, 22 nt, Homo sapiens
agguuguugcaugcuccuuagg

SEQ ID NO: 22685 - RNA, 22 nt, Homo sapiens
aguaccauuacucacuuauuuu

SEQ ID NO: 22686 - RNA, 22 nt, Homo sapiens
aguaccauuccguuggagcugg

SEQ ID NO: 22687 - RNA, 22 nt, Homo sapiens
aguacugucugguuaccugaca

SEQ ID NO: 22688 - RNA, 22 nt, Homo sapiens
aguagguguugguagagguuuc

SEQ ID NO: 22689 - RNA, 22 nt, Homo sapiens
aguauguagugcaaucagucag

SEQ ID NO: 22690 - RNA, 22 nt, Homo sapiens
agucaagauggcaagguaaggc

SEQ ID NO: 22691 - RNA, 22 nt, Homo sapiens
agucacagguucuugggauuag

SEQ ID NO: 22692 - RNA, 23 nt, Homo sapiens
agucaguaugcuccuuggauccc

SEQ ID NO: 22693 - RNA, 22 nt, Homo sapiens
agucagugucuguaaggagaac

SEQ ID NO: 22694 - RNA, 20 nt, Homo sapiens
agucaguuuauuuucucucu

SEQ ID NO: 22695 - RNA, 22 nt, Homo sapiens
agucauagaguuugcccuucuc

SEQ ID NO: 22696 - RNA, 22 nt, Homo sapiens
aguccagguuuuguaauggcaa

SEQ ID NO: 22697 - RNA, 22 nt, Homo sapiens
agucugguguucucacacuagu

SEQ ID NO: 22698 - RNA, 22 nt, Homo sapiens
agugagcugcagucuggggucc

SEQ ID NO: 22699 - RNA, 22 nt, Homo sapiens
agugaucauuugaauugaugau

SEQ ID NO: 22700 - RNA, 22 nt, Homo sapiens
agugauuuuaacuuccagcaau

SEQ ID NO: 22701 - RNA, 22 nt, Homo sapiens
agugcaguggugccaucauaac

SEQ ID NO: 22702 - RNA, 22 nt, Homo sapiens
aguggaauuaagaaacugaauu

SEQ ID NO: 22703 - RNA, 22 nt, Homo sapiens
agugggccccuagaggugaggu

SEQ ID NO: 22704 - RNA, 22 nt, Homo sapiens
aguguuuuuacaagcacucugg

SEQ ID NO: 22705 - RNA, 22 nt, Homo sapiens
aguugcaagucuugaguaaaga

SEQ ID NO: 22706 - RNA, 22 nt, Homo sapiens
aguuuugguugaguuacuagca

SEQ ID NO: 22707 - RNA, 22 nt, Homo sapiens
auaaaguguuuaguauaggcaa

SEQ ID NO: 22708 - RNA, 22 nt, Homo sapiens
auaaaugcauugagaacugcug

SEQ ID NO: 22709 - RNA, 22 nt, Homo sapiens
auaaaugcuuagaucuguauau

SEQ ID NO: 22710 - RNA, 22 nt, Homo sapiens
auaauagguugauugacauugc

SEQ ID NO: 22711 - RNA, 22 nt, Homo sapiens
auaaucaugucugaaaccuuug

SEQ ID NO: 22712 - RNA, 22 nt, Homo sapiens
auacacauuccugggccucacc

SEQ ID NO: 22713 - RNA, 22 nt, Homo sapiens
auacagguauacaaugcauaau

SEQ ID NO: 22714 - RNA, 20 nt, Homo sapiens
auaccacagacuggguaguu

SEQ ID NO: 22715 - RNA, 22 nt, Homo sapiens
auacuaugagauaauaaagacu

SEQ ID NO: 22716 - RNA, 20 nt, Homo sapiens
auagaagacuagugcagcag

SEQ ID NO: 22717 - RNA, 22 nt, Homo sapiens
auagaagcugccaacguuucag

SEQ ID NO: 22718 - RNA, 22 nt, Homo sapiens
auagaguuagaaagaaauguuu

SEQ ID NO: 22719 - RNA, 22 nt, Homo sapiens
auagaucauugucauuuuagau

SEQ ID NO: 22720 - RNA, 22 nt, Homo sapiens
auaggcacauuaggaacuuuug

SEQ ID NO: 22721 - RNA, 22 nt, Homo sapiens
aaaacgcauccucacaggucug

SEQ ID NO: 22722 - RNA, 22 nt, Homo sapiens
gagguaugugggcagacauuua

SEQ ID NO: 22723 - RNA, 22 nt, Homo sapiens
gagugcaauggcaagaucuugg

SEQ ID NO: 22724 - RNA, 22 nt, Homo sapiens
gagugcaucguggccauuuuaa

SEQ ID NO: 22725 - RNA, 18 nt, Homo sapiens
gaguggugcuucccuugu

SEQ ID NO: 22726 - RNA, 22 nt, Homo sapiens
gaguucaaaucucagcucuguu

SEQ ID NO: 22727 - RNA, 22 nt, Homo sapiens
gaguucauuuugaaaccuugau

SEQ ID NO: 22728 - RNA, 22 nt, Homo sapiens
gaguuccuuugagccugagagg

SEQ ID NO: 22729 - RNA, 19 nt, Homo sapiens
gaguugggguuuacuguaa

SEQ ID NO: 22730 - RNA, 22 nt, Homo sapiens
gaguuguuuuaaggcacugacu

SEQ ID NO: 22731 - RNA, 22 nt, Homo sapiens
gauaacagauaaugucaguuau

SEQ ID NO: 22732 - RNA, 22 nt, Homo sapiens
gauaugugauaagaguuaucuu

SEQ ID NO: 22733 - RNA, 22 nt, Homo sapiens
gauauguguaucuauguacaug

SEQ ID NO: 22734 - RNA, 22 nt, Homo sapiens
gauauguucugagaaaugcauu

SEQ ID NO: 22735 - RNA, 22 nt, Homo sapiens
gauauuacuuccaauauugcaa

SEQ ID NO: 22736 - RNA, 17 nt, Homo sapiens
gaucacagucgucuccu

SEQ ID NO: 22737 - RNA, 22 nt, Homo sapiens
gaucacauuguuucauacauau

SEQ ID NO: 22738 - RNA, 22 nt, Homo sapiens
gaucugagaaagugucauaaca

SEQ ID NO: 22739 - RNA, 19 nt, Homo sapiens
gaucuguugaucaaugugu

SEQ ID NO: 22740 - RNA, 22 nt, Homo sapiens
gaugagaugagcauuugaauug

SEQ ID NO: 22741 - RNA, 22 nt, Homo sapiens
gaugagcuaaguucucacagca

SEQ ID NO: 22742 - RNA, 22 nt, Homo sapiens
gaugguggucuacccuuucccu

SEQ ID NO: 22743 - RNA, 22 nt, Homo sapiens
gauuuuccaguggcccugauca

SEQ ID NO: 22744 - RNA, 22 nt, Homo sapiens
gcaaaugcuaugccauuuuaua

SEQ ID NO: 22745 - RNA, 21 nt, Homo sapiens
uuggggaauggagagguuuuc

SEQ ID NO: 22746 - RNA, 19 nt, Homo sapiens
uuggucccuuuggguucuu

SEQ ID NO: 22747 - RNA, 23 nt, Homo sapiens
uuggucucccaaaguguugagau

SEQ ID NO: 22748 - RNA, 22 nt, Homo sapiens
uugguuaccuucagaaaugagu

SEQ ID NO: 22749 - RNA, 22 nt, Homo sapiens
uuguaaagaucauaugcuguuc

SEQ ID NO: 22750 - RNA, 23 nt, Homo sapiens
uuguacacuaagaaucgcagaug

SEQ ID NO: 22751 - RNA, 22 nt, Homo sapiens
uuguacuagaaaauuauucuuu

SEQ ID NO: 22752 - RNA, 22 nt, Homo sapiens
uuguacuagucauauuuugaaa

SEQ ID NO: 22753 - RNA, 22 nt, Homo sapiens
uuguauaggcucaguaagaauc

SEQ ID NO: 22754 - RNA, 21 nt, Homo sapiens
uuguaugguugaacuugauac

SEQ ID NO: 22755 - RNA, 22 nt, Homo sapiens
uuguaugucuucauuugaaaaa

SEQ ID NO: 22756 - RNA, 22 nt, Homo sapiens
uuguccuugagauaguuugcug

SEQ ID NO: 22757 - RNA, 22 nt, Homo sapiens
uugugaucauugucaaauagug

SEQ ID NO: 22758 - RNA, 22 nt, Homo sapiens
uugugcaaaaguaauugcgguu

SEQ ID NO: 22759 - RNA, 22 nt, Homo sapiens
uugugccauucuucugccucag

SEQ ID NO: 22760 - RNA, 22 nt, Homo sapiens
uugugcuugcuguguucuaugc

SEQ ID NO: 22761 - RNA, 22 nt, Homo sapiens
uugugggaggugauuagaucau

SEQ ID NO: 22762 - RNA, 22 nt, Homo sapiens
uugugguugacuaaauuuguaa

SEQ ID NO: 22763 - RNA, 22 nt, Homo sapiens
uugugguuuuaucuaccuuugg

SEQ ID NO: 22764 - RNA, 22 nt, Homo sapiens
uuuaaagcuaaaauauguuuau

SEQ ID NO: 22765 - RNA, 22 nt, Homo sapiens
uuuaaaguuagaaggaaagggc

SEQ ID NO: 22766 - RNA, 22 nt, Homo sapiens
uuuaagccaggugcaguggcuc

SEQ ID NO: 22767 - RNA, 21 nt, Homo sapiens
uuuacuguggacccauugcuu

SEQ ID NO: 22768 - RNA, 22 nt, Homo sapiens
uuuacugugggguuucuuagag

SEQ ID NO: 22769 - RNA, 22 nt, Homo sapiens
uuuagcagcaaagagccaugcu

SEQ ID NO: 22770 - RNA, 22 nt, Homo sapiens
uuuagguagucaaagguuaguc

SEQ ID NO: 22771 - RNA, 22 nt, Homo sapiens
uuuauccagccucuagcaaggu

SEQ ID NO: 22772 - RNA, 22 nt, Homo sapiens
uuuauucggcuaggagcuucgg

SEQ ID NO: 22773 - RNA, 22 nt, Homo sapiens
uuucaagugcugucuuagcugu

SEQ ID NO: 22774 - RNA, 22 nt, Homo sapiens
uuucacuagccagcccuuuauu

SEQ ID NO: 22775 - RNA, 21 nt, Homo sapiens
uuucacugugaguuuuucugu

SEQ ID NO: 22776 - RNA, 17 nt, Homo sapiens
uuucagaguggaagugu

SEQ ID NO: 22777 - RNA, 22 nt, Homo sapiens
uuucauagaucaugcuuuugga

SEQ ID NO: 22778 - RNA, 22 nt, Homo sapiens
uuucaucagccagggucagucu

SEQ ID NO: 22779 - RNA, 22 nt, Homo sapiens
uuuccacauggacuuaccuucg

SEQ ID NO: 22780 - RNA, 22 nt, Homo sapiens
uuucugggggugcugauggaaa

SEQ ID NO: 22781 - RNA, 22 nt, Homo sapiens
uuugaaaguaauuugguuggug

SEQ ID NO: 22782 - RNA, 22 nt, Homo sapiens
uuugaagugugaugccuugaug

SEQ ID NO: 22783 - RNA, 22 nt, Homo sapiens
uuugaauggaaguuuugugaaa

SEQ ID NO: 22784 - RNA, 22 nt, Homo sapiens
uuugacuaccaggaauguucuu

SEQ ID NO: 22785 - RNA, 22 nt, Homo sapiens
uuugacuuuuagaauaugaguu

SEQ ID NO: 22786 - RNA, 22 nt, Homo sapiens
uuugagauaucuuccaucagua

SEQ ID NO: 22787 - RNA, 22 nt, Homo sapiens
uuugagcauggaaauggcauga

SEQ ID NO: 22788 - RNA, 22 nt, Homo sapiens
uuugaguuugaggugcugauga

SEQ ID NO: 22789 - RNA, 21 nt, Homo sapiens
uuugaucauuaaaagugaauc

SEQ ID NO: 22790 - RNA, 22 nt, Homo sapiens
uuugauguugagacuauaaagc

SEQ ID NO: 22791 - RNA, 22 nt, Homo sapiens
uuugauugguguaccugaaagu

SEQ ID NO: 22792 - RNA, 22 nt, Homo sapiens
uuugcagagacuuguuaggaau

SEQ ID NO: 22793 - RNA, 22 nt, Homo sapiens
uuugcaguguaguuggccagca

SEQ ID NO: 22794 - RNA, 19 nt, Homo sapiens
uuugcauagugagaauaua

SEQ ID NO: 22795 - RNA, 21 nt, Homo sapiens
uuugcauauguugaaccagcc

SEQ ID NO: 22796 - RNA, 22 nt, Homo sapiens
uuugcugagucauuccaugcug

SEQ ID NO: 22797 - RNA, 22 nt, Homo sapiens
uuugcuuguguaaaaaucugga

SEQ ID NO: 22798 - RNA, 22 nt, Homo sapiens
uuuggaaugaaacagcagagcc

SEQ ID NO: 22799 - RNA, 22 nt, Homo sapiens
uuuggaaugugcacucagauug

SEQ ID NO: 22800 - RNA, 22 nt, Homo sapiens
uuuggccauguuggucaggcug

SEQ ID NO: 22801 - RNA, 22 nt, Homo sapiens
uuuggcuguuucuggacuaaga

SEQ ID NO: 22802 - RNA, 22 nt, Homo sapiens
uuuggcuuugagaagcagugga

SEQ ID NO: 22803 - RNA, 22 nt, Homo sapiens
uuugguuauuugaaacuagcau

SEQ ID NO: 22804 - RNA, 22 nt, Homo sapiens
uuuguagcuacaaagugagaug

SEQ ID NO: 22805 - RNA, 22 nt, Homo sapiens
uuugucacccugaauguaagau

SEQ ID NO: 22806 - RNA, 21 nt, Homo sapiens
uuuguccaccuguguucacca

SEQ ID NO: 22807 - RNA, 22 nt, Homo sapiens
uuugucccccguaguucauaua

SEQ ID NO: 22808 - RNA, 22 nt, Homo sapiens
uuugugcaaacuaggauugcga

SEQ ID NO: 22809 - RNA, 22 nt, Homo sapiens
uuugugcuccuguugagaaucu

SEQ ID NO: 22810 - RNA, 23 nt, Homo sapiens
uuuugcaauaagucacuggaaua

SEQ ID NO: 22811 - RNA, 22 nt, Homo sapiens
uuuugcacuguuuuaucugaca

SEQ ID NO: 22812 - RNA, 22 nt, Homo sapiens
uuuugcucuugguaaugaaaga

SEQ ID NO: 22813 - RNA, 22 nt, Homo sapiens
uuuuggcuagaaauauaccucc

SEQ ID NO: 22814 - RNA, 22 nt, Homo sapiens
uuuuggcuuaaagagaauguau

SEQ ID NO: 22815 - RNA, 22 nt, Homo sapiens
uuuugguaaugaacuuaggaag

SEQ ID NO: 22816 - RNA, 22 nt, Homo sapiens
uuuuugauuaauggguagacca

SEQ ID NO: 22817 - RNA, 22 nt, Homo sapiens
uucccugaguaucuuaccaugg

SEQ ID NO: 22818 - RNA, 22 nt, Homo sapiens
uucccugugggcuggugcucca

SEQ ID NO: 22819 - RNA, 22 nt, Homo sapiens
uuccuacuguucaucaggaacc

SEQ ID NO: 22820 - RNA, 22 nt, Homo sapiens
uuccuggaggggaaguguccaa

SEQ ID NO: 22821 - RNA, 22 nt, Homo sapiens
uuccugucuuccaagagagauu

SEQ ID NO: 22822 - RNA, 22 nt, Homo sapiens
uucucacaguacagggagcucu

SEQ ID NO: 22823 - RNA, 21 nt, Homo sapiens
uucucagaggcaggggauaaa

SEQ ID NO: 22824 - RNA, 21 nt, Homo sapiens
uucucaggguguguccuaccc

SEQ ID NO: 22825 - RNA, 22 nt, Homo sapiens
uucucuggucagaggggagguu

SEQ ID NO: 22826 - RNA, 22 nt, Homo sapiens
uucugagguuauauucucucaa

SEQ ID NO: 22827 - RNA, 22 nt, Homo sapiens
uucugaguggcuuucaacacug

SEQ ID NO: 22828 - RNA, 22 nt, Homo sapiens
uucuggcuuauaaacgugacuu

SEQ ID NO: 22829 - RNA, 22 nt, Homo sapiens
uucugugcuuguggaugaagug

SEQ ID NO: 22830 - RNA, 22 nt, Homo sapiens
uucugugguuucauuuaccugu

SEQ ID NO: 22831 - RNA, 21 nt, Homo sapiens
uucuucaggcagaaggauuau

SEQ ID NO: 22832 - RNA, 22 nt, Homo sapiens
uucuugcugaauugugcccuuc

SEQ ID NO: 22833 - RNA, 22 nt, Homo sapiens
uucuuuaguucacuugcuccag

SEQ ID NO: 22834 - RNA, 22 nt, Homo sapiens
uugaaaguaaacaucacaaaga

SEQ ID NO: 22835 - RNA, 22 nt, Homo sapiens
uugaaagucuaggcuuacagua

SEQ ID NO: 22836 - RNA, 22 nt, Homo sapiens
uugaaaguguucacaaugguau

SEQ ID NO: 22837 - RNA, 22 nt, Homo sapiens
uugaagacuaaguuaucaggau

SEQ ID NO: 22838 - RNA, 22 nt, Homo sapiens
uugaauaguggugaaaguuuga

SEQ ID NO: 22839 - RNA, 22 nt, Homo sapiens
uugacaaggagugggguugaga

SEQ ID NO: 22840 - RNA, 21 nt, Homo sapiens
uugacagugacagguaaaguu

SEQ ID NO: 22841 - RNA, 22 nt, Homo sapiens
uugacauaguuucugaaauaga

SEQ ID NO: 22842 - RNA, 22 nt, Homo sapiens
uugacugggccagacagagauc

SEQ ID NO: 22843 - RNA, 22 nt, Homo sapiens
uugacuuagacauucaguugga

SEQ ID NO: 22844 - RNA, 22 nt, Homo sapiens
uugagauaggagcuguuguucu

SEQ ID NO: 22845 - RNA, 22 nt, Homo sapiens
uugagauggagucucgcacugu

SEQ ID NO: 22846 - RNA, 22 nt, Homo sapiens
uugagauggagucuugcgcugu

SEQ ID NO: 22847 - RNA, 22 nt, Homo sapiens
uugagauguauguauauaaugu

SEQ ID NO: 22848 - RNA, 19 nt, Homo sapiens
uugagaugugaacucacac

SEQ ID NO: 22849 - RNA, 22 nt, Homo sapiens
uugagauguggcaguuuaugag

SEQ ID NO: 22850 - RNA, 22 nt, Homo sapiens
uugagauuauuguguuccuuua

SEQ ID NO: 22851 - RNA, 22 nt, Homo sapiens
uugagauuuuccucaaauauuu

SEQ ID NO: 22852 - RNA, 22 nt, Homo sapiens
uugagcacaguagguuguggcu

SEQ ID NO: 22853 - RNA, 22 nt, Homo sapiens
uugagcaccaugccuggccaug

SEQ ID NO: 22854 - RNA, 22 nt, Homo sapiens
uugagccaaggauugucuuucc

SEQ ID NO: 22855 - RNA, 22 nt, Homo sapiens
uaagacacuuaaaauguuacau

SEQ ID NO: 22856 - RNA, 18 nt, Homo sapiens
uaagaugcagccuauucc

SEQ ID NO: 22857 - RNA, 22 nt, Homo sapiens
uaagcuauagugaauaaauugc

SEQ ID NO: 22858 - RNA, 22 nt, Homo sapiens
uaaggcacccuucugaguagag

SEQ ID NO: 22859 - RNA, 20 nt, Homo sapiens
uaaggcacugugcuuuuagg

SEQ ID NO: 22860 - RNA, 22 nt, Homo sapiens
uaaggcuagcaagaugagaaua

SEQ ID NO: 22861 - RNA, 22 nt, Homo sapiens
uaagggacgcccccuucucucu

SEQ ID NO: 22862 - RNA, 22 nt, Homo sapiens
uaaguaaaugaaagguugauuu

SEQ ID NO: 22863 - RNA, 22 nt, Homo sapiens
uaaguaauugcagcaauuugcc

SEQ ID NO: 22864 - RNA, 22 nt, Homo sapiens
uaagugaauuugacagguaaug

SEQ ID NO: 22865 - RNA, 22 nt, Homo sapiens
uaagugcaacauaaguguuaaa

SEQ ID NO: 22866 - RNA, 20 nt, Homo sapiens
uaagugcauaggauauuucu

SEQ ID NO: 22867 - RNA, 22 nt, Homo sapiens
uaagugcaugauuacaugcaua

SEQ ID NO: 22868 - RNA, 22 nt, Homo sapiens
uaagugcuugacuuugauguuu

SEQ ID NO: 22869 - RNA, 23 nt, Homo sapiens
uaaguucaucucuaauaggugga

SEQ ID NO: 22870 - RNA, 22 nt, Homo sapiens
uaaguugcagguugugauucca

SEQ ID NO: 22871 - RNA, 22 nt, Homo sapiens
uaaguuguagaacguuuucuua

SEQ ID NO: 22872 - RNA, 20 nt, Homo sapiens
uaaguuguauuugucaugaa

SEQ ID NO: 22873 - RNA, 22 nt, Homo sapiens
uaaguuguugacauuaggggaa

SEQ ID NO: 22874 - RNA, 22 nt, Homo sapiens
uaauaauguuaggcuuacucaa

SEQ ID NO: 22875 - RNA, 22 nt, Homo sapiens
uaauagcucggauaaacaugau

SEQ ID NO: 22876 - RNA, 22 nt, Homo sapiens
uaauaguuggcacuggagaaag

SEQ ID NO: 22877 - RNA, 22 nt, Homo sapiens
uaaugcaucaugguuggcaaac

SEQ ID NO: 22878 - RNA, 22 nt, Homo sapiens
uaauucacauaaagcacuuaga

SEQ ID NO: 22879 - RNA, 22 nt, Homo sapiens
uaauucuguauguaucagaguu

SEQ ID NO: 22880 - RNA, 22 nt, Homo sapiens
uacaaagcuacucgagggcagg

SEQ ID NO: 22881 - RNA, 16 nt, Homo sapiens
uacaauguagaaaaca

SEQ ID NO: 22882 - RNA, 22 nt, Homo sapiens
uacacagucaaaaauuuccagg

SEQ ID NO: 22883 - RNA, 22 nt, Homo sapiens
uacaccauuugauucuuuaagc

SEQ ID NO: 22884 - RNA, 22 nt, Homo sapiens
uacagccacauaauguaugauu

SEQ ID NO: 22885 - RNA, 23 nt, Homo sapiens
uacagcugcagaaucaggcuaag

SEQ ID NO: 22886 - RNA, 22 nt, Homo sapiens
uacagguauagauguguguucu

SEQ ID NO: 22887 - RNA, 22 nt, Homo sapiens
uacaggugcuuauguggacaua

SEQ ID NO: 22888 - RNA, 22 nt, Homo sapiens
uacagucuagaggagaaucagg

SEQ ID NO: 22889 - RNA, 22 nt, Homo sapiens
uacagugcauagaggcaugaua

SEQ ID NO: 22890 - RNA, 22 nt, Homo sapiens
uacaguggugugaucucagcuc

SEQ ID NO: 22891 - RNA, 22 nt, Homo sapiens
uaccauguaucugggaugcuuu

SEQ ID NO: 22892 - RNA, 22 nt, Homo sapiens
uacguaucagucguuucuguga

SEQ ID NO: 22893 - RNA, 22 nt, Homo sapiens
uacuagaggcgggguuucgcca

SEQ ID NO: 22894 - RNA, 22 nt, Homo sapiens
uacucaauugcagucaccuggc

SEQ ID NO: 22895 - RNA, 22 nt, Homo sapiens
uacucuuuagcuccuuaaggaa

SEQ ID NO: 22896 - RNA, 19 nt, Homo sapiens
uacugcaccucaaccuggg

SEQ ID NO: 22897 - RNA, 22 nt, Homo sapiens
uacuucauucuugaccuugcau

SEQ ID NO: 22898 - RNA, 22 nt, Homo sapiens
uagaauguaaauuccaagggca

SEQ ID NO: 22899 - RNA, 22 nt, Homo sapiens
uagacccauuguucagagagug

SEQ ID NO: 22900 - RNA, 22 nt, Homo sapiens
uagagauaucaauuucauggug

SEQ ID NO: 22901 - RNA, 22 nt, Homo sapiens
uagagguagguguaugaacuag

SEQ ID NO: 22902 - RNA, 22 nt, Homo sapiens
uagagguauuaacaguagaaga

SEQ ID NO: 22903 - RNA, 22 nt, Homo sapiens
uagagguucuaagauucucaga

SEQ ID NO: 22904 - RNA, 22 nt, Homo sapiens
uagaguguaaaccacauaguga

SEQ ID NO: 22905 - RNA, 22 nt, Homo sapiens
uagaguguuuuguuaggcagca

SEQ ID NO: 22906 - RNA, 21 nt, Homo sapiens
uagauaguugguucugaaucu

SEQ ID NO: 22907 - RNA, 22 nt, Homo sapiens
uagcacaucuucuuggccugca

SEQ ID NO: 22908 - RNA, 22 nt, Homo sapiens
uagcaccaggguugacugaccu

SEQ ID NO: 22909 - RNA, 22 nt, Homo sapiens
uagcaccucuuuggccuuucgu

SEQ ID NO: 22910 - RNA, 22 nt, Homo sapiens
uagcaccugugcacaccaggca

SEQ ID NO: 22911 - RNA, 22 nt, Homo sapiens
uagcagaauauaccucuuacuu

SEQ ID NO: 22912 - RNA, 18 nt, Homo sapiens
uagcagacaucauugggg

SEQ ID NO: 22913 - RNA, 22 nt, Homo sapiens
uagcagcauuuuuguagaguau

SEQ ID NO: 22914 - RNA, 22 nt, Homo sapiens
uagcaggaaaggggucagaucu

SEQ ID NO: 22915 - RNA, 20 nt, Homo sapiens
uagcaggugucaggugauau

SEQ ID NO: 22916 - RNA, 22 nt, Homo sapiens
uagcaguagacagacuuuggcu

SEQ ID NO: 22917 - RNA, 22 nt, Homo sapiens
uagcugcacuuacaagugagaa

SEQ ID NO: 22918 - RNA, 23 nt, Homo sapiens
uagcuucucccagaccugcuccc

SEQ ID NO: 22919 - RNA, 22 nt, Homo sapiens
uaggaucauuuuauguugccca

SEQ ID NO: 22920 - RNA, 22 nt, Homo sapiens
uaggugaaugcuggaagaaaug

SEQ ID NO: 22921 - RNA, 22 nt, Homo sapiens
uaggugaauguaguaagguguu

SEQ ID NO: 22922 - RNA, 19 nt, Homo sapiens
uaggugguuuuccccucac

SEQ ID NO: 22923 - RNA, 22 nt, Homo sapiens
uagguucucaggaaugagcuuc

SEQ ID NO: 22924 - RNA, 22 nt, Homo sapiens
uaguauguuuauagcauugagu

SEQ ID NO: 22925 - RNA, 22 nt, Homo sapiens
uagucagcaauguucauguucu

SEQ ID NO: 22926 - RNA, 22 nt, Homo sapiens
uagugcuagaugacuuugccau

SEQ ID NO: 22927 - RNA, 22 nt, Homo sapiens
uauaacaaugcaagaauggccu

SEQ ID NO: 22928 - RNA, 22 nt, Homo sapiens
uauacaugugggcaucaggaga

SEQ ID NO: 22929 - RNA, 21 nt, Homo sapiens
uauaguaguaugauuuacaau

SEQ ID NO: 22930 - RNA, 22 nt, Homo sapiens
uaucaaggccacucauuuuaug

SEQ ID NO: 22931 - RNA, 19 nt, Homo sapiens
uaucaaguaugcacuguac

SEQ ID NO: 22932 - RNA, 22 nt, Homo sapiens
uaucacacuguuggauuugauu

SEQ ID NO: 22933 - RNA, 23 nt, Homo sapiens
uaucacacuuucucugugccaca

SEQ ID NO: 22934 - RNA, 22 nt, Homo sapiens
uaucacagaggguauccuagag

SEQ ID NO: 22935 - RNA, 22 nt, Homo sapiens
uaucacagcauugucuauaaua

SEQ ID NO: 22936 - RNA, 22 nt, Homo sapiens
uaucacagcgggguguacaccc

SEQ ID NO: 22937 - RNA, 22 nt, Homo sapiens
uaucacaggucaggaaucuugc

SEQ ID NO: 22938 - RNA, 22 nt, Homo sapiens
uaucacaguugcauauuuaagg

SEQ ID NO: 22939 - RNA, 22 nt, Homo sapiens
uaucacuguuguuuguuuaagg

SEQ ID NO: 22940 - RNA, 19 nt, Homo sapiens
uaucacuucccuggaaaca

SEQ ID NO: 22941 - RNA, 22 nt, Homo sapiens
uaucacuuugauaguuuaaaug

SEQ ID NO: 22942 - RNA, 22 nt, Homo sapiens
uaucagcagcaggggcugcaga

SEQ ID NO: 22943 - RNA, 22 nt, Homo sapiens
uaucauaguuuggacuuucauu

SEQ ID NO: 22944 - RNA, 18 nt, Homo sapiens
uaucauguagggaaguug

SEQ ID NO: 22945 - RNA, 22 nt, Homo sapiens
uaucaugucuguguguaccuag

SEQ ID NO: 22946 - RNA, 22 nt, Homo sapiens
uaucauugccucaaucuguauu

SEQ ID NO: 22947 - RNA, 22 nt, Homo sapiens
uaucccaguggauguaccccau

SEQ ID NO: 22948 - RNA, 21 nt, Homo sapiens
uaucucaguuuuccuuugugg

SEQ ID NO: 22949 - RNA, 22 nt, Homo sapiens
uaucucauccuccuugauccca

SEQ ID NO: 22950 - RNA, 18 nt, Homo sapiens
uaucucauuucuuagguc

SEQ ID NO: 22951 - RNA, 22 nt, Homo sapiens
uaugacauaguccuuaacccuc

SEQ ID NO: 22952 - RNA, 22 nt, Homo sapiens
uaugacuuuggaaaaauuacuu

SEQ ID NO: 22953 - RNA, 22 nt, Homo sapiens
uaugagacugguuaauuuuugu

SEQ ID NO: 22954 - RNA, 22 nt, Homo sapiens
uaugaugcuguuuagaaucucu

SEQ ID NO: 22955 - RNA, 22 nt, Homo sapiens
uaugcuguuucugauuuaggga

SEQ ID NO: 22956 - RNA, 22 nt, Homo sapiens
uaugcuuauaaacauuugucag

SEQ ID NO: 22957 - RNA, 22 nt, Homo sapiens
uaugcuuauuaaaacagugugu

SEQ ID NO: 22958 - RNA, 22 nt, Homo sapiens
uauggccacugucuuugaguca

SEQ ID NO: 22959 - RNA, 22 nt, Homo sapiens
uauggcugugacuuaucuuguu

SEQ ID NO: 22960 - RNA, 22 nt, Homo sapiens
uauggcuucuauaaggaagcuu

SEQ ID NO: 22961 - RNA, 22 nt, Homo sapiens
uaugucacagguuuuggugaaa

SEQ ID NO: 22962 - RNA, 22 nt, Homo sapiens
uaugucuuuugcuugcaaauag

SEQ ID NO: 22963 - RNA, 22 nt, Homo sapiens
uggcacuggagauacauuaaua

SEQ ID NO: 22964 - RNA, 22 nt, Homo sapiens
uggcagcugcuucaugggaugc

SEQ ID NO: 22965 - RNA, 22 nt, Homo sapiens
uggcaggugcacuggcuuugaa

SEQ ID NO: 22966 - RNA, 22 nt, Homo sapiens
uggcaguuucacauggcucaac

SEQ ID NO: 22967 - RNA, 22 nt, Homo sapiens
uggcaguuuugauguggagaga

SEQ ID NO: 22968 - RNA, 22 nt, Homo sapiens
uggcaugauccuagauucaaca

SEQ ID NO: 22969 - RNA, 22 nt, Homo sapiens
uggcaugucagguuucuggguu

SEQ ID NO: 22970 - RNA, 23 nt, Homo sapiens
uggccagaaacuucuuuucaucc

SEQ ID NO: 22971 - RNA, 22 nt, Homo sapiens
uggccagagggcaauuagcugu

SEQ ID NO: 22972 - RNA, 22 nt, Homo sapiens
uggcgagaugcucgugugcaga

SEQ ID NO: 22973 - RNA, 22 nt, Homo sapiens
uggcuaaguuaaucaaggagau

SEQ ID NO: 22974 - RNA, 22 nt, Homo sapiens
uggcucuguuuguuaacuagac

SEQ ID NO: 22975 - RNA, 22 nt, Homo sapiens
ugggaacaugaagguuaaagag

SEQ ID NO: 22976 - RNA, 22 nt, Homo sapiens
uccugagagcagacccucuaua

SEQ ID NO: 22977 - RNA, 22 nt, Homo sapiens
uccuggcuccacuguuuauucc

SEQ ID NO: 22978 - RNA, 22 nt, Homo sapiens
uccuucaguccaguggguuuug

SEQ ID NO: 22979 - RNA, 22 nt, Homo sapiens
uccuucaugcaucaauguaucc

SEQ ID NO: 22980 - RNA, 22 nt, Homo sapiens
uccuugagccucccagacucag

SEQ ID NO: 22981 - RNA, 22 nt, Homo sapiens
uccuugagucuuugcucagaug

SEQ ID NO: 22982 - RNA, 22 nt, Homo sapiens
uccuuugguggagucuuuaggg

SEQ ID NO: 22983 - RNA, 22 nt, Homo sapiens
ucggcucagugcaagcucugcc

SEQ ID NO: 22984 - RNA, 21 nt, Homo sapiens
ucuaccuacugcucacaggcu

SEQ ID NO: 22985 - RNA, 18 nt, Homo sapiens
ucucacagcaaucuguca

SEQ ID NO: 22986 - RNA, 22 nt, Homo sapiens
ucucacagccauuucucccucu

SEQ ID NO: 22987 - RNA, 19 nt, Homo sapiens
ucucacagcucuacuaugu

SEQ ID NO: 22988 - RNA, 22 nt, Homo sapiens
ucucaguggugcuggcagggga

SEQ ID NO: 22989 - RNA, 23 nt, Homo sapiens
ucucauuccuugaaaauaaugac

SEQ ID NO: 22990 - RNA, 17 nt, Homo sapiens
ucucccaucccuuucuc

SEQ ID NO: 22991 - RNA, 22 nt, Homo sapiens
ucucugauuaaacaagauagug

SEQ ID NO: 22992 - RNA, 22 nt, Homo sapiens
aauggcucuguuggcccaagac

SEQ ID NO: 22993 - RNA, 22 nt, Homo sapiens
aauggcuuuuaauauccauaau

SEQ ID NO: 22994 - RNA, 18 nt, Homo sapiens
aaugggacuacaaagcca

SEQ ID NO: 22995 - RNA, 22 nt, Homo sapiens
aaugggacugacgccucccaga

SEQ ID NO: 22996 - RNA, 22 nt, Homo sapiens
aauggguaguacugugguaaca

SEQ ID NO: 22997 - RNA, 22 nt, Homo sapiens
aaugugccuacagugggcuguu

SEQ ID NO: 22998 - RNA, 22 nt, Homo sapiens
aauuaguuggcugggugcggug

SEQ ID NO: 22999 - RNA, 22 nt, Homo sapiens
aauucacuucuuuuaggcaggg

SEQ ID NO: 23000 - RNA, 22 nt, Homo sapiens
aauucugugagauggugcagau

SEQ ID NO: 23001 - RNA, 22 nt, Homo sapiens
aauugcaccaucuagaucaaga

SEQ ID NO: 23002 - RNA, 22 nt, Homo sapiens
aauugcacuacugcacucccac

SEQ ID NO: 23003 - RNA, 22 nt, Homo sapiens
aauugcuuuuauuuagggccag

SEQ ID NO: 23004 - RNA, 22 nt, Homo sapiens
aauugguuaagauaagaucaua

SEQ ID NO: 23005 - RNA, 22 nt, Homo sapiens
acaaagcuagggaauccaucuu

SEQ ID NO: 23006 - RNA, 22 nt, Homo sapiens
acaaaguaggcagugggcugga

SEQ ID NO: 23007 - RNA, 22 nt, Homo sapiens
acaagacuucuuguauucuagu

SEQ ID NO: 23008 - RNA, 22 nt, Homo sapiens
acaauguauauuuuacuguagg

SEQ ID NO: 23009 - RNA, 22 nt, Homo sapiens
acacaaugguaaguguuugugu

SEQ ID NO: 23010 - RNA, 22 nt, Homo sapiens
acaccaucuccuuauuucucuu

SEQ ID NO: 23011 - RNA, 22 nt, Homo sapiens
acacguguugaaauuuaauugc

SEQ ID NO: 23012 - RNA, 22 nt, Homo sapiens
acacuggaguuaaaggugauuu

SEQ ID NO: 23013 - RNA, 22 nt, Homo sapiens
acacuguagcugagggcaugcg

SEQ ID NO: 23014 - RNA, 22 nt, Homo sapiens
acacuguccaguuaggcuacau

SEQ ID NO: 23015 - RNA, 22 nt, Homo sapiens
acacugucugaugaaaguaguu

SEQ ID NO: 23016 - RNA, 22 nt, Homo sapiens
acacuguugacauuuuguagug

SEQ ID NO: 23017 - RNA, 22 nt, Homo sapiens
acacuugcuugcaauagccucc

SEQ ID NO: 23018 - RNA, 22 nt, Homo sapiens
acagauagacauauauagcuca

SEQ ID NO: 23019 - RNA, 20 nt, Homo sapiens
acagcacugguuucaagcaa

SEQ ID NO: 23020 - RNA, 19 nt, Homo sapiens
acagcugguuuugguuucu

SEQ ID NO: 23021 - RNA, 22 nt, Homo sapiens
acaggguuauuguaauaaugua

SEQ ID NO: 23022 - RNA, 20 nt, Homo sapiens
acaguagaagggauuucaaa

SEQ ID NO: 23023 - RNA, 22 nt, Homo sapiens
acagucacaauuuguaccuuuu

SEQ ID NO: 23024 - RNA, 22 nt, Homo sapiens
acagucauagcagccuuuguua

SEQ ID NO: 23025 - RNA, 23 nt, Homo sapiens
acagucuaguuugaagucaggua

SEQ ID NO: 23026 - RNA, 18 nt, Homo sapiens
acagugcugucacugcuu

SEQ ID NO: 23027 - RNA, 22 nt, Homo sapiens
acagugcuuggcacacaguaau

SEQ ID NO: 23028 - RNA, 22 nt, Homo sapiens
acagugucugacacguaggaag

SEQ ID NO: 23029 - RNA, 18 nt, Homo sapiens
acaguguguaaggguucu

SEQ ID NO: 23030 - RNA, 22 nt, Homo sapiens
acaguguguguguucaccuaga

SEQ ID NO: 23031 - RNA, 22 nt, Homo sapiens
acaguguuccuuuguugugacu

SEQ ID NO: 23032 - RNA, 22 nt, Homo sapiens
acaguuaugugagggccaccag

SEQ ID NO: 23033 - RNA, 22 nt, Homo sapiens
acauaguagacacugaaaauau

SEQ ID NO: 23034 - RNA, 22 nt, Homo sapiens
acauauaaggagacuagggcau

SEQ ID NO: 23035 - RNA, 21 nt, Homo sapiens
acaucagaguugugaagguag

SEQ ID NO: 23036 - RNA, 22 nt, Homo sapiens
acauccauuugcuuuauuugcu

SEQ ID NO: 23037 - RNA, 18 nt, Homo sapiens
acaucccaugcuggggug

SEQ ID NO: 23038 - RNA, 22 nt, Homo sapiens
acaucccuugcucggggccccu

SEQ ID NO: 23039 - RNA, 19 nt, Homo sapiens
acauggauuuugugcaaac

SEQ ID NO: 23040 - RNA, 22 nt, Homo sapiens
acauguauauaaugcauagcga

SEQ ID NO: 23041 - RNA, 19 nt, Homo sapiens
acauugcauuuguaggcuu

SEQ ID NO: 23042 - RNA, 22 nt, Homo sapiens
accacagugcuuccugcucacg

SEQ ID NO: 23043 - RNA, 22 nt, Homo sapiens
accaccauugcacugaacuuuc

SEQ ID NO: 23044 - RNA, 22 nt, Homo sapiens
accagucucagguaugucuuua

SEQ ID NO: 23045 - RNA, 22 nt, Homo sapiens
acccagaagucauucaggaaca

SEQ ID NO: 23046 - RNA, 22 nt, Homo sapiens
acccaguguucagacuaccugu

SEQ ID NO: 23047 - RNA, 23 nt, Homo sapiens
accccuacaggcuuguguccugc

SEQ ID NO: 23048 - RNA, 22 nt, Homo sapiens
accccugagaucgaaucaugcu

SEQ ID NO: 23049 - RNA, 22 nt, Homo sapiens
acccgguuagggggcaguggau

SEQ ID NO: 23050 - RNA, 22 nt, Homo sapiens
acccuacauaguagauccuaca

SEQ ID NO: 23051 - RNA, 22 nt, Homo sapiens
acccugacacgauucuucacuu

SEQ ID NO: 23052 - RNA, 22 nt, Homo sapiens
acccugcuaaacagcccccugc

SEQ ID NO: 23053 - RNA, 22 nt, Homo sapiens
acccuggaguaguaggaaucug

SEQ ID NO: 23054 - RNA, 22 nt, Homo sapiens
acccugguagcuaugaagucuu

SEQ ID NO: 23055 - RNA, 22 nt, Homo sapiens
acccuguaacauacaagugguu

SEQ ID NO: 23056 - RNA, 22 nt, Homo sapiens
acccuguaguuagaaacuuuca

SEQ ID NO: 23057 - RNA, 22 nt, Homo sapiens
acccugucaaaauggaccaauc

SEQ ID NO: 23058 - RNA, 22 nt, Homo sapiens
accucagcccggggaaguugag

SEQ ID NO: 23059 - RNA, 23 nt, Homo sapiens
accugauguuucuguggggagcc

SEQ ID NO: 23060 - RNA, 22 nt, Homo sapiens
accuggguguauguucaguuug

SEQ ID NO: 23061 - RNA, 22 nt, Homo sapiens
accuguauaacaagugggaaau

SEQ ID NO: 23062 - RNA, 23 nt, Homo sapiens
accugugguuauuuuacucuucc

SEQ ID NO: 23063 - RNA, 22 nt, Homo sapiens
accuucauuguugccaugucca

SEQ ID NO: 23064 - RNA, 19 nt, Homo sapiens
acuaggccuacaaagcuau

SEQ ID NO: 23065 - RNA, 22 nt, Homo sapiens
acucacagcaaccuccgccucc

SEQ ID NO: 23066 - RNA, 22 nt, Homo sapiens
acucagagaacauucccagucu

SEQ ID NO: 23067 - RNA, 22 nt, Homo sapiens
acugaaucaucagguguguuug

SEQ ID NO: 23068 - RNA, 19 nt, Homo sapiens
acugagcuaccugggggca

SEQ ID NO: 23069 - RNA, 22 nt, Homo sapiens
acugagucauugggugcccaga

SEQ ID NO: 23070 - RNA, 21 nt, Homo sapiens
acugcacuccaaccucaacag

SEQ ID NO: 23071 - RNA, 19 nt, Homo sapiens
acugcacuccaaccuccug

SEQ ID NO: 23072 - RNA, 18 nt, Homo sapiens
acugcacuccaccuuggg

SEQ ID NO: 23073 - RNA, 22 nt, Homo sapiens
acugcacuccagccuaggcgac

SEQ ID NO: 23074 - RNA, 22 nt, Homo sapiens
acugcacuccagccuccugggu

SEQ ID NO: 23075 - RNA, 22 nt, Homo sapiens
acugcacuccagccugcuggca

SEQ ID NO: 23076 - RNA, 22 nt, Homo sapiens
acugcacuccagccugcugggu

SEQ ID NO: 23077 - RNA, 22 nt, Homo sapiens
acugcacuccagccuggacgaa

SEQ ID NO: 23078 - RNA, 22 nt, Homo sapiens
acugcacuccagccuguugaca

SEQ ID NO: 23079 - RNA, 22 nt, Homo sapiens
acugcacuccagccuucaggac

SEQ ID NO: 23080 - RNA, 22 nt, Homo sapiens
acugcacuccagccuucggaca

SEQ ID NO: 23081 - RNA, 22 nt, Homo sapiens
acugcacuccagccuucgugac

SEQ ID NO: 23082 - RNA, 22 nt, Homo sapiens
acugcacuccagccuugauggc

SEQ ID NO: 23083 - RNA, 22 nt, Homo sapiens
acugcacuccagccuugcgaca

SEQ ID NO: 23084 - RNA, 22 nt, Homo sapiens
acugcacuccagccuugugaca

SEQ ID NO: 23085 - RNA, 22 nt, Homo sapiens
acugcacuccagccuuugcgau

SEQ ID NO: 23086 - RNA, 22 nt, Homo sapiens
acugcacuccagcuccagggug

SEQ ID NO: 23087 - RNA, 22 nt, Homo sapiens
acugcacuccagcuuuggugac

SEQ ID NO: 23088 - RNA, 20 nt, Homo sapiens
acugcacuccagucucuggg

SEQ ID NO: 23089 - RNA, 18 nt, Homo sapiens
acugcacuccauccuagg

SEQ ID NO: 23090 - RNA, 22 nt, Homo sapiens
acugcacuccaucuuagguggc

SEQ ID NO: 23091 - RNA, 20 nt, Homo sapiens
acugcauuuaguccucagga

SEQ ID NO: 23092 - RNA, 22 nt, Homo sapiens
auugagcaaggucuccuaguau

SEQ ID NO: 23093 - RNA, 18 nt, Homo sapiens
auugagcaugacagaccu

SEQ ID NO: 23094 - RNA, 22 nt, Homo sapiens
auugaggcaggaggaccaucua

SEQ ID NO: 23095 - RNA, 22 nt, Homo sapiens
auugaguaacaauuuuguucaa

SEQ ID NO: 23096 - RNA, 22 nt, Homo sapiens
auugcaaagcguagacucuaaa

SEQ ID NO: 23097 - RNA, 19 nt, Homo sapiens
auugcacuccaaccugggu

SEQ ID NO: 23098 - RNA, 22 nt, Homo sapiens
auugcacuccagccuagguaac

SEQ ID NO: 23099 - RNA, 22 nt, Homo sapiens
auugcacuccagccuagucaac

SEQ ID NO: 23100 - RNA, 22 nt, Homo sapiens
auugcacuccagccuggccaac

SEQ ID NO: 23101 - RNA, 22 nt, Homo sapiens
auugcacuccagccuggccgag

SEQ ID NO: 23102 - RNA, 22 nt, Homo sapiens
auugcacuccagccugggcuag

SEQ ID NO: 23103 - RNA, 22 nt, Homo sapiens
auugcacuccagccuggggaac

SEQ ID NO: 23104 - RNA, 22 nt, Homo sapiens
auugcacuccagccugggugag

SEQ ID NO: 23105 - RNA, 22 nt, Homo sapiens
auugcacuccagccuugacaca

SEQ ID NO: 23106 - RNA, 22 nt, Homo sapiens
auugcacuccagccuugggcaa

SEQ ID NO: 23107 - RNA, 22 nt, Homo sapiens
auugcacuccagccuugugaca

SEQ ID NO: 23108 - RNA, 22 nt, Homo sapiens
auugcacuccagucucaccagg

SEQ ID NO: 23109 - RNA, 22 nt, Homo sapiens
auugcacuccagucugggcaac

SEQ ID NO: 23110 - RNA, 22 nt, Homo sapiens
auugcacuccggccugggugac

SEQ ID NO: 23111 - RNA, 22 nt, Homo sapiens
auugcacucuagccugggugac

SEQ ID NO: 23112 - RNA, 22 nt, Homo sapiens
auugcacugcagccugggcaac

SEQ ID NO: 23113 - RNA, 22 nt, Homo sapiens
auugcagaaaugacagagcgcc

SEQ ID NO: 23114 - RNA, 22 nt, Homo sapiens
auugcagcccacccugggugau

SEQ ID NO: 23115 - RNA, 22 nt, Homo sapiens
auugcuuuuacugggagcuuug

SEQ ID NO: 23116 - RNA, 22 nt, Homo sapiens
auuggaacugaaauaauaacuu

SEQ ID NO: 23117 - RNA, 22 nt, Homo sapiens
auuggcaagauagcauaugagg

SEQ ID NO: 23118 - RNA, 22 nt, Homo sapiens
auuggcaaucgucuccauuuuu

SEQ ID NO: 23119 - RNA, 22 nt, Homo sapiens
auuggcaauggcaaagcagagu

SEQ ID NO: 23120 - RNA, 22 nt, Homo sapiens
auuggcuuuauacauaagaaua

SEQ ID NO: 23121 - RNA, 18 nt, Homo sapiens
auuguaagauguauggga

SEQ ID NO: 23122 - RNA, 22 nt, Homo sapiens
auuguaccccaauguacaauau

SEQ ID NO: 23123 - RNA, 22 nt, Homo sapiens
auuguacuccagccugggcgac

SEQ ID NO: 23124 - RNA, 22 nt, Homo sapiens
auugucacccgggcaguaagca

SEQ ID NO: 23125 - RNA, 22 nt, Homo sapiens
auugucauuuauaacuguguag

SEQ ID NO: 23126 - RNA, 22 nt, Homo sapiens
auuguguuugaaugaggcucca

SEQ ID NO: 23127 - RNA, 22 nt, Homo sapiens
auuguuccccggucauuuuugu

SEQ ID NO: 23128 - RNA, 22 nt, Homo sapiens
auuguucuuguguccuuuuccu

SEQ ID NO: 23129 - RNA, 22 nt, Homo sapiens
auuuccuguaggggcuugcgaa

SEQ ID NO: 23130 - RNA, 20 nt, Homo sapiens
auuugcauuauggagcaccc

SEQ ID NO: 23131 - RNA, 20 nt, Homo sapiens
auuuggcauaguuuaagcaa

SEQ ID NO: 23132 - RNA, 21 nt, Homo sapiens
auuugguguuagaaauaaauu

SEQ ID NO: 23133 - RNA, 22 nt, Homo sapiens
auuugguuauucaguuguucag

SEQ ID NO: 23134 - RNA, 22 nt, Homo sapiens
auuuugcauugcuguaaaggaa

SEQ ID NO: 23135 - RNA, 22 nt, Homo sapiens
auuuuuggauauagggaaggau

SEQ ID NO: 23136 - RNA, 22 nt, Homo sapiens
auuuuugguugguaggcuauua

SEQ ID NO: 23137 - RNA, 22 nt, Homo sapiens
caaagcacuuggcuuggaagau

SEQ ID NO: 23138 - RNA, 22 nt, Homo sapiens
caaagcuauagcaccagaggga

SEQ ID NO: 23139 - RNA, 22 nt, Homo sapiens
caaaggcuguuauaggccagga

SEQ ID NO: 23140 - RNA, 22 nt, Homo sapiens
caaagucuucucauuaugucuu

SEQ ID NO: 23141 - RNA, 22 nt, Homo sapiens
caaagugcuggccgggcgcagu

SEQ ID NO: 23142 - RNA, 22 nt, Homo sapiens
caaagugcugggacuggccggg

SEQ ID NO: 23143 - RNA, 19 nt, Homo sapiens
caaaguguucuucuuugcc

SEQ ID NO: 23144 - RNA, 22 nt, Homo sapiens
caacagucagcccauccacaga

SEQ ID NO: 23145 - RNA, 19 nt, Homo sapiens
caacccugcagagaaagga

SEQ ID NO: 23146 - RNA, 22 nt, Homo sapiens
caacugguuuuauacaguuuag

SEQ ID NO: 23147 - RNA, 22 nt, Homo sapiens
caagagaccugagugucauucu

SEQ ID NO: 23148 - RNA, 22 nt, Homo sapiens
caagaggcuguguauaaagcca

SEQ ID NO: 23149 - RNA, 21 nt, Homo sapiens
caaugacacuguagcugugcu

SEQ ID NO: 23150 - RNA, 22 nt, Homo sapiens
caaugguacuagauaucuucag

SEQ ID NO: 23151 - RNA, 22 nt, Homo sapiens
caauugguguuuauggggaagu

SEQ ID NO: 23152 - RNA, 22 nt, Homo sapiens
cacacugucuucauuacuguag

SEQ ID NO: 23153 - RNA, 22 nt, Homo sapiens
cacagagugagacccugucucu

SEQ ID NO: 23154 - RNA, 22 nt, Homo sapiens
cacagcgacuuccgccuaccgg

SEQ ID NO: 23155 - RNA, 22 nt, Homo sapiens
cacagcuaacaacuguuucuuc

SEQ ID NO: 23156 - RNA, 22 nt, Homo sapiens
cacaggccugucucuuucuaac

SEQ ID NO: 23157 - RNA, 22 nt, Homo sapiens
cacagucugggcuuguuuguac

SEQ ID NO: 23158 - RNA, 22 nt, Homo sapiens
cacagugaacaauauccucugu

SEQ ID NO: 23159 - RNA, 22 nt, Homo sapiens
cacagugaacugguggguuuuu

SEQ ID NO: 23160 - RNA, 22 nt, Homo sapiens
cacagugaaugucaucauugcc

SEQ ID NO: 23161 - RNA, 22 nt, Homo sapiens
cacauguuuuagcauggcuguu

SEQ ID NO: 23162 - RNA, 22 nt, Homo sapiens
cacauugaauuucugaugacaa

SEQ ID NO: 23163 - RNA, 22 nt, Homo sapiens
caccacauuccauugaucaggc

SEQ ID NO: 23164 - RNA, 22 nt, Homo sapiens
caccaggugcccagcacggcca

SEQ ID NO: 23165 - RNA, 22 nt, Homo sapiens
caccagguuggagugcaguggu

SEQ ID NO: 23166 - RNA, 23 nt, Homo sapiens
caccaguagaaugugugggaggg

SEQ ID NO: 23167 - RNA, 22 nt, Homo sapiens
cacccuuagaguuggaaguggg

SEQ ID NO: 23168 - RNA, 22 nt, Homo sapiens
caccgagguuggagugcagugg

SEQ ID NO: 23169 - RNA, 19 nt, Homo sapiens
caccgccugcccccugcug

SEQ ID NO: 23170 - RNA, 22 nt, Homo sapiens
caccuguagucccagcugaggc

SEQ ID NO: 23171 - RNA, 22 nt, Homo sapiens
caccuugugauccacccgccuu

SEQ ID NO: 23172 - RNA, 22 nt, Homo sapiens
cacugcacuccagcuuugguga

SEQ ID NO: 23173 - RNA, 22 nt, Homo sapiens
cacugcacuccaguuucgguaa

SEQ ID NO: 23174 - RNA, 22 nt, Homo sapiens
cacugcaguguaauuaagguug

SEQ ID NO: 23175 - RNA, 22 nt, Homo sapiens
cacugcauccucugccuggcgg

SEQ ID NO: 23176 - RNA, 22 nt, Homo sapiens
cacugcgaccucugccuaccgg

SEQ ID NO: 23177 - RNA, 22 nt, Homo sapiens
cacugcgacguccgccucccgg

SEQ ID NO: 23178 - RNA, 23 nt, Homo sapiens
cacugggcagcagguguucccag

SEQ ID NO: 23179 - RNA, 22 nt, Homo sapiens
cacuggguuagaacaugcuccu

SEQ ID NO: 23180 - RNA, 22 nt, Homo sapiens
cacuggucagugaaacaguauu

SEQ ID NO: 23181 - RNA, 22 nt, Homo sapiens
cacugugcaaccuccaccuccc

SEQ ID NO: 23182 - RNA, 22 nt, Homo sapiens
cagacagugucccgagucccug

SEQ ID NO: 23183 - RNA, 22 nt, Homo sapiens
cagagaaugucuuuuuuaacca

SEQ ID NO: 23184 - RNA, 22 nt, Homo sapiens
cagagcacuaaagguaaaaggc

SEQ ID NO: 23185 - RNA, 22 nt, Homo sapiens
cagagguaagcaagucagcauu

SEQ ID NO: 23186 - RNA, 22 nt, Homo sapiens
cagagguauugcaaaagccuag

SEQ ID NO: 23187 - RNA, 22 nt, Homo sapiens
cagauacuccuggucucaggag

SEQ ID NO: 23188 - RNA, 22 nt, Homo sapiens
cagauacuggaguccugaaguu

SEQ ID NO: 23189 - RNA, 22 nt, Homo sapiens
cagaucaucuugagcuuaggaa

SEQ ID NO: 23190 - RNA, 22 nt, Homo sapiens
cagaugcaugaccugggcuugg

SEQ ID NO: 23191 - RNA, 22 nt, Homo sapiens
cagauggucuuaaggcagccuu

SEQ ID NO: 23192 - RNA, 22 nt, Homo sapiens
cagauguaguauuuuagugaaa

SEQ ID NO: 23193 - RNA, 22 nt, Homo sapiens
cagcaaaucauccuauuugagc

SEQ ID NO: 23194 - RNA, 20 nt, Homo sapiens
cagcaaccugcucucuuccu

SEQ ID NO: 23195 - RNA, 22 nt, Homo sapiens
cagcacauagcaguugcucagu

SEQ ID NO: 23196 - RNA, 23 nt, Homo sapiens
cucccugaacaugacacaccaga

SEQ ID NO: 23197 - RNA, 20 nt, Homo sapiens
cucccugacaaauguggaaa

SEQ ID NO: 23198 - RNA, 20 nt, Homo sapiens
cuccuucauuccuuuggacc

SEQ ID NO: 23199 - RNA, 22 nt, Homo sapiens
cucucaguugucuaauuaguuu

SEQ ID NO: 23200 - RNA, 22 nt, Homo sapiens
cucugguuucgcaggaaauaga

SEQ ID NO: 23201 - RNA, 22 nt, Homo sapiens
cucugguuuuucuuccauuaag

SEQ ID NO: 23202 - RNA, 22 nt, Homo sapiens
cucuuagauuagccauccuaau

SEQ ID NO: 23203 - RNA, 22 nt, Homo sapiens
cucuuggguagauuuugcagag

SEQ ID NO: 23204 - RNA, 22 nt, Homo sapiens
cucuuuaguaagcaguugauga

SEQ ID NO: 23205 - RNA, 22 nt, Homo sapiens
cucuuuggaugccuuaggguua

SEQ ID NO: 23206 - RNA, 19 nt, Homo sapiens
cucuuuggugucucuucuu

SEQ ID NO: 23207 - RNA, 22 nt, Homo sapiens
cugaaaagcaucugcauagcug

SEQ ID NO: 23208 - RNA, 19 nt, Homo sapiens
cugaaacacagagagggcu

SEQ ID NO: 23209 - RNA, 22 nt, Homo sapiens
cugaaagagcauuugaaugggu

SEQ ID NO: 23210 - RNA, 22 nt, Homo sapiens
cugaaauggaaugugugcacag

SEQ ID NO: 23211 - RNA, 22 nt, Homo sapiens
cugaaauguccaucgacugaug

SEQ ID NO: 23212 - RNA, 22 nt, Homo sapiens
cugacagaugacugccacugua

SEQ ID NO: 23213 - RNA, 22 nt, Homo sapiens
cugacaugcagccacugcaccu

SEQ ID NO: 23214 - RNA, 22 nt, Homo sapiens
cugaccucugucaaagacaccc

SEQ ID NO: 23215 - RNA, 22 nt, Homo sapiens
cugacuaguuuuaaugcagauu

SEQ ID NO: 23216 - RNA, 22 nt, Homo sapiens
cugacugugcaugcccagcccc

SEQ ID NO: 23217 - RNA, 22 nt, Homo sapiens
cugagaucguggggcugcuguc

SEQ ID NO: 23218 - RNA, 22 nt, Homo sapiens
cugagauuaagauauugggagu

SEQ ID NO: 23219 - RNA, 22 nt, Homo sapiens
cugagcaaagaagugauaauga

SEQ ID NO: 23220 - RNA, 22 nt, Homo sapiens
cugagcaauauagugagaucuu

SEQ ID NO: 23221 - RNA, 18 nt, Homo sapiens
cugagcacugcuuuauga

SEQ ID NO: 23222 - RNA, 22 nt, Homo sapiens
cugagcccauucuggggagaag

SEQ ID NO: 23223 - RNA, 22 nt, Homo sapiens
cugaggauauucagccucugug

SEQ ID NO: 23224 - RNA, 22 nt, Homo sapiens
cugagguacugggggccaggau

SEQ ID NO: 23225 - RNA, 20 nt, Homo sapiens
cugagguugggguccuuccc

SEQ ID NO: 23226 - RNA, 22 nt, Homo sapiens
cugauaugaugggugauuuuca

SEQ ID NO: 23227 - RNA, 22 nt, Homo sapiens
cugauuguuugccucuaaaauc

SEQ ID NO: 23228 - RNA, 21 nt, Homo sapiens
cugcaaaugcugcugccugau

SEQ ID NO: 23229 - RNA, 22 nt, Homo sapiens
ggaucacagccagcucccagaa

SEQ ID NO: 23230 - RNA, 22 nt, Homo sapiens
ggaugugugcacgcgcacaugc

SEQ ID NO: 23231 - RNA, 22 nt, Homo sapiens
ggauuuguuggcauuagugaug

SEQ ID NO: 23232 - RNA, 22 nt, Homo sapiens
ggcaaaauggccagugggucac

SEQ ID NO: 23233 - RNA, 22 nt, Homo sapiens
ggcaaagaugaccauuacuuuu

SEQ ID NO: 23234 - RNA, 22 nt, Homo sapiens
ggcaaauucuuguaugccuacu

SEQ ID NO: 23235 - RNA, 22 nt, Homo sapiens
ggcaacauggugaaacucuguc

SEQ ID NO: 23236 - RNA, 21 nt, Homo sapiens
ggcaagaaacacaaucaagua

SEQ ID NO: 23237 - RNA, 22 nt, Homo sapiens
ggcaagaaccacaauuacuuuu

SEQ ID NO: 23238 - RNA, 22 nt, Homo sapiens
ggcaagaagagaguuuaaacau

SEQ ID NO: 23239 - RNA, 20 nt, Homo sapiens
ggcaagacccaaagugugug

SEQ ID NO: 23240 - RNA, 22 nt, Homo sapiens
ggcaagauagauaucaguguca

SEQ ID NO: 23241 - RNA, 22 nt, Homo sapiens
ggcaagaucuuggcucacugaa

SEQ ID NO: 23242 - RNA, 22 nt, Homo sapiens
ggcaagcucaggccucaggugu

SEQ ID NO: 23243 - RNA, 22 nt, Homo sapiens
ggcaaggauuagauucuccccu

SEQ ID NO: 23244 - RNA, 20 nt, Homo sapiens
ggcaagguagcauuucuucu

SEQ ID NO: 23245 - RNA, 22 nt, Homo sapiens
ggcaagugucagcagcaacacc

SEQ ID NO: 23246 - RNA, 22 nt, Homo sapiens
ggcaccacagacgccaggcgug

SEQ ID NO: 23247 - RNA, 23 nt, Homo sapiens
ggcacggaauucaaagaggcauu

SEQ ID NO: 23248 - RNA, 22 nt, Homo sapiens
ggcacugugaugugagggggua

SEQ ID NO: 23249 - RNA, 22 nt, Homo sapiens
ggcagcgugcacuuucgccacu

SEQ ID NO: 23250 - RNA, 22 nt, Homo sapiens
ggcagcucaggccccgcgcuga

SEQ ID NO: 23251 - RNA, 22 nt, Homo sapiens
ggcagcuguguccuucguaagg

SEQ ID NO: 23252 - RNA, 22 nt, Homo sapiens
ggcaguguaauaauuuauuaau

SEQ ID NO: 23253 - RNA, 22 nt, Homo sapiens
ggcaugauggcugaggcuucug

SEQ ID NO: 23254 - RNA, 22 nt, Homo sapiens
ggccagaugcaguggcucacac

SEQ ID NO: 23255 - RNA, 22 nt, Homo sapiens
ggcccugagacaggaaaaagcu

SEQ ID NO: 23256 - RNA, 22 nt, Homo sapiens
ggcccugauacaaguaaggucu

SEQ ID NO: 23257 - RNA, 22 nt, Homo sapiens
ggcgccauugcacuccagccug

SEQ ID NO: 23258 - RNA, 22 nt, Homo sapiens
ggcuauagauaugugaacacuu

SEQ ID NO: 23259 - RNA, 22 nt, Homo sapiens
ggcucagugggguccugguucu

SEQ ID NO: 23260 - RNA, 22 nt, Homo sapiens
gggaaauguaaagucauaagau

SEQ ID NO: 23261 - RNA, 22 nt, Homo sapiens
gggaacauggaaauucugcucu

SEQ ID NO: 23262 - RNA, 22 nt, Homo sapiens
gggaagaaggagugguuuacuc

SEQ ID NO: 23263 - RNA, 22 nt, Homo sapiens
gggagcaaaaaugaugcccaag

SEQ ID NO: 23264 - RNA, 19 nt, Homo sapiens
gggaggaugcgucuucagg

SEQ ID NO: 23265 - RNA, 22 nt, Homo sapiens
gggaggucauuguucaaugcug

SEQ ID NO: 23266 - RNA, 22 nt, Homo sapiens
gggaugauuaugguucacuaca

SEQ ID NO: 23267 - RNA, 22 nt, Homo sapiens
gggcaaaacuguacugccaagg

SEQ ID NO: 23268 - RNA, 19 nt, Homo sapiens
gggcaaaucuggaaauuua

SEQ ID NO: 23269 - RNA, 22 nt, Homo sapiens
gggccagaugcauuuguuauuu

SEQ ID NO: 23270 - RNA, 22 nt, Homo sapiens
ggggaauguuaaagaauuugca

SEQ ID NO: 23271 - RNA, 22 nt, Homo sapiens
gggguaggcuacacugaguucc

SEQ ID NO: 23272 - RNA, 19 nt, Homo sapiens
gggucaguuugaaugauua

SEQ ID NO: 23273 - RNA, 22 nt, Homo sapiens
gggugguuuuauuaucagugac

SEQ ID NO: 23274 - RNA, 22 nt, Homo sapiens
gguaaacauaagagagcugacu

SEQ ID NO: 23275 - RNA, 22 nt, Homo sapiens
gguaaacauacugcugucuucu

SEQ ID NO: 23276 - RNA, 22 nt, Homo sapiens
gguaaaucuucacuaagacuga

SEQ ID NO: 23277 - RNA, 22 nt, Homo sapiens
gguauuauuugccuuuuacuga

SEQ ID NO: 23278 - RNA, 22 nt, Homo sapiens
ggucaaguaauccuggguguca

SEQ ID NO: 23279 - RNA, 22 nt, Homo sapiens
ggucacauugcuagcauggguu

SEQ ID NO: 23280 - RNA, 22 nt, Homo sapiens
ggucagauggcagcugggccug

SEQ ID NO: 23281 - RNA, 19 nt, Homo sapiens
ggucauggagguuguguga

SEQ ID NO: 23282 - RNA, 22 nt, Homo sapiens
ggucauggauugucuuuucuug

SEQ ID NO: 23283 - RNA, 22 nt, Homo sapiens
ggucccccuccacucucgcaaa

SEQ ID NO: 23284 - RNA, 22 nt, Homo sapiens
gguccgccugccuuggccuccc

SEQ ID NO: 23285 - RNA, 22 nt, Homo sapiens
uauaaccauuucuucucucuuc

SEQ ID NO: 23286 - RNA, 22 nt, Homo sapiens
uauacagcaaguuacugugcug

SEQ ID NO: 23287 - RNA, 21 nt, Homo sapiens
uauagcagcacgauuuauagu

SEQ ID NO: 23288 - RNA, 22 nt, Homo sapiens
uauagcagugugagaacagacu

SEQ ID NO: 23289 - RNA, 22 nt, Homo sapiens
uauagcuuaaaguuuagauccu

SEQ ID NO: 23290 - RNA, 22 nt, Homo sapiens
uauagcuugaaggaauggucau

SEQ ID NO: 23291 - RNA, 22 nt, Homo sapiens
uauaguuuuuccugggaggaaa

SEQ ID NO: 23292 - RNA, 22 nt, Homo sapiens
uauaugcuaaacaagggguggg

SEQ ID NO: 23293 - RNA, 22 nt, Homo sapiens
uauaugcucugggauccugaaa

SEQ ID NO: 23294 - RNA, 22 nt, Homo sapiens
uaucaaacccaaggaggggguu

SEQ ID NO: 23295 - RNA, 22 nt, Homo sapiens
uaucaacaggguggccagugua

SEQ ID NO: 23296 - RNA, 22 nt, Homo sapiens
uaucaagaugacaaacuuugcu

SEQ ID NO: 23297 - RNA, 22 nt, Homo sapiens
uaucaaguguuagggagaugug

SEQ ID NO: 23298 - RNA, 22 nt, Homo sapiens
uaucacaaacuuagcaguuuaa

SEQ ID NO: 23299 - RNA, 22 nt, Homo sapiens
uaucacagauauuaugggccaa

SEQ ID NO: 23300 - RNA, 22 nt, Homo sapiens
uaucacagauucuccaggguuu

SEQ ID NO: 23301 - RNA, 22 nt, Homo sapiens
uaucacagcauugucuauaaua

SEQ ID NO: 23302 - RNA, 22 nt, Homo sapiens
uaucacagcgggguguacaccc

SEQ ID NO: 23303 - RNA, 22 nt, Homo sapiens
uaucaccacccugggaaacaua

SEQ ID NO: 23304 - RNA, 22 nt, Homo sapiens
uaucaccuugguagucuugggg

SEQ ID NO: 23305 - RNA, 22 nt, Homo sapiens
uaucacuguuguuuguuuaagg

SEQ ID NO: 23306 - RNA, 19 nt, Homo sapiens
uaucacuucccuggaaaca

SEQ ID NO: 23307 - RNA, 22 nt, Homo sapiens
uaucagagcugucagccuaccu

SEQ ID NO: 23308 - RNA, 22 nt, Homo sapiens
uaucagauugcugccaucugcu

SEQ ID NO: 23309 - RNA, 22 nt, Homo sapiens
uaucaguauggauucauggauu

SEQ ID NO: 23310 - RNA, 22 nt, Homo sapiens
uaucagugaaucuuauuuugcc

SEQ ID NO: 23311 - RNA, 22 nt, Homo sapiens
uaucauagacaaucaguuauug

SEQ ID NO: 23312 - RNA, 21 nt, Homo sapiens
uaucccagucacaucuaccca

SEQ ID NO: 23313 - RNA, 23 nt, Homo sapiens
uaucucaaugcacagagaggaaa

SEQ ID NO: 23314 - RNA, 22 nt, Homo sapiens
uaucucaguguacaggaugaua

SEQ ID NO: 23315 - RNA, 21 nt, Homo sapiens
uaucucaguuuuccuuugugg

SEQ ID NO: 23316 - RNA, 22 nt, Homo sapiens
uaucugcacauacacuuauagc

SEQ ID NO: 23317 - RNA, 22 nt, Homo sapiens
uaucuuggaguuugacaaccaa

SEQ ID NO: 23318 - RNA, 22 nt, Homo sapiens
uaugaaacucuaagauucacau

SEQ ID NO: 23319 - RNA, 22 nt, Homo sapiens
uaugaaucugagagaucuggaa

SEQ ID NO: 23320 - RNA, 22 nt, Homo sapiens
uaugacucagaaggcacacaca

SEQ ID NO: 23321 - RNA, 19 nt, Homo sapiens
uaugagcuaugacaugcau

SEQ ID NO: 23322 - RNA, 22 nt, Homo sapiens
uaugaucauuauguuauugcag

SEQ ID NO: 23323 - RNA, 22 nt, Homo sapiens
uaugcacacguguccaugugca

SEQ ID NO: 23324 - RNA, 22 nt, Homo sapiens
uaugcacaugcaugcuugaaua

SEQ ID NO: 23325 - RNA, 23 nt, Homo sapiens
uaugccuguuucaaacaaacuuu

SEQ ID NO: 23326 - RNA, 19 nt, Homo sapiens
uaugcuagagagggaagcu

SEQ ID NO: 23327 - RNA, 19 nt, Homo sapiens
uaugcuauuuauuagaagu

SEQ ID NO: 23328 - RNA, 22 nt, Homo sapiens
uaugcuguuucugauuuaggga

SEQ ID NO: 23329 - RNA, 21 nt, Homo sapiens
ugagaugugaccagggcauca

SEQ ID NO: 23330 - RNA, 22 nt, Homo sapiens
ugagauguuccaaugacuauua

SEQ ID NO: 23331 - RNA, 21 nt, Homo sapiens
ugagauuaaguuguuuagaag

SEQ ID NO: 23332 - RNA, 23 nt, Homo sapiens
ugagauuacccagaaagaguaua

SEQ ID NO: 23333 - RNA, 22 nt, Homo sapiens
ugagauuaucuugaucuugaaa

SEQ ID NO: 23334 - RNA, 19 nt, Homo sapiens
ugagauuguaugaggagau

SEQ ID NO: 23335 - RNA, 22 nt, Homo sapiens
ugagcaacauuucaaaacucca

SEQ ID NO: 23336 - RNA, 22 nt, Homo sapiens
ugagcaauaaaguuacacaguu

SEQ ID NO: 23337 - RNA, 22 nt, Homo sapiens
ugagcacauuuacaucaguucc

SEQ ID NO: 23338 - RNA, 22 nt, Homo sapiens
ugagcagugagugugcugcagg

SEQ ID NO: 23339 - RNA, 22 nt, Homo sapiens
ugagcuaggaucacaccugcau

SEQ ID NO: 23340 - RNA, 20 nt, Homo sapiens
ugagcucaauuguugcaagu

SEQ ID NO: 23341 - RNA, 22 nt, Homo sapiens
ugagcucagcuaguugaggugu

SEQ ID NO: 23342 - RNA, 22 nt, Homo sapiens
ugagcucaugcauucuugagga

SEQ ID NO: 23343 - RNA, 22 nt, Homo sapiens
ugagcugagacaauaaguuuuu

SEQ ID NO: 23344 - RNA, 22 nt, Homo sapiens
ugagcugagaucgugccauugu

SEQ ID NO: 23345 - RNA, 22 nt, Homo sapiens
ugagcugguacuaauauuauca

SEQ ID NO: 23346 - RNA, 22 nt, Homo sapiens
ugaggaaugaccccgugugguc

SEQ ID NO: 23347 - RNA, 22 nt, Homo sapiens
ugaggaguguauuucauucgcu

SEQ ID NO: 23348 - RNA, 22 nt, Homo sapiens
ugagggaugccugguuuguuuu

SEQ ID NO: 23349 - RNA, 22 nt, Homo sapiens
ugagguaacagaagcgagcauu

SEQ ID NO: 23350 - RNA, 22 nt, Homo sapiens
ugagguagaggugaacuugacc

SEQ ID NO: 23351 - RNA, 19 nt, Homo sapiens
ugagguauuuguugggaga

SEQ ID NO: 23352 - RNA, 22 nt, Homo sapiens
ugaggucauguucugucagguu

SEQ ID NO: 23353 - RNA, 22 nt, Homo sapiens
ugaggucuuuauuuagugcuca

SEQ ID NO: 23354 - RNA, 22 nt, Homo sapiens
ugagguguuaacuuuacuuuua

SEQ ID NO: 23355 - RNA, 23 nt, Homo sapiens
ugagguguuaagcagacuugucu

SEQ ID NO: 23356 - RNA, 22 nt, Homo sapiens
ugagguuauuuguucaagaagu

SEQ ID NO: 23357 - RNA, 22 nt, Homo sapiens
ugagguugucagugucauucuu

SEQ ID NO: 23358 - RNA, 22 nt, Homo sapiens
ugaguagaacaucaagucauac

SEQ ID NO: 23359 - RNA, 22 nt, Homo sapiens
ugaguagaacuagucuagagcu

SEQ ID NO: 23360 - RNA, 23 nt, Homo sapiens
ugcucgguguugacagucacauc

SEQ ID NO: 23361 - RNA, 19 nt, Homo sapiens
ugcugcauugugaccuugc

SEQ ID NO: 23362 - RNA, 22 nt, Homo sapiens
ugcuggcguuacucuccaucag

SEQ ID NO: 23363 - RNA, 22 nt, Homo sapiens
ugcugguguggucuagccgcuu

SEQ ID NO: 23364 - RNA, 22 nt, Homo sapiens
ugcugguguuuaggaauaagaa

SEQ ID NO: 23365 - RNA, 22 nt, Homo sapiens
ugcugguuuucaucaucagugg

SEQ ID NO: 23366 - RNA, 22 nt, Homo sapiens
ugcuguguugcuggcuuaaaga

SEQ ID NO: 23367 - RNA, 22 nt, Homo sapiens
ugcuuagucuugcuuuagcuau

SEQ ID NO: 23368 - RNA, 22 nt, Homo sapiens
ugcuuaguuguauguuccacau

SEQ ID NO: 23369 - RNA, 22 nt, Homo sapiens
uggaaacuuauguucuucugug

SEQ ID NO: 23370 - RNA, 22 nt, Homo sapiens
uggaaauaaaauagaguuugcc

SEQ ID NO: 23371 - RNA, 22 nt, Homo sapiens
uggaaauaaaugugccaagauc

SEQ ID NO: 23372 - RNA, 22 nt, Homo sapiens
uggaacacaucuaaggaagcag

SEQ ID NO: 23373 - RNA, 20 nt, Homo sapiens
uggaacuuaauugauggaca

SEQ ID NO: 23374 - RNA, 22 nt, Homo sapiens
uggaagacucaagguggugaau

SEQ ID NO: 23375 - RNA, 23 nt, Homo sapiens
uggaaguauggaggaggcagaau

SEQ ID NO: 23376 - RNA, 22 nt, Homo sapiens
uggaagucauugagguguguua

SEQ ID NO: 23377 - RNA, 22 nt, Homo sapiens
uggaagucuauggcauuugagu

SEQ ID NO: 23378 - RNA, 21 nt, Homo sapiens
uggaaguguacaauuauaccc

SEQ ID NO: 23379 - RNA, 22 nt, Homo sapiens
uggaauacuauucugugcugga

SEQ ID NO: 23380 - RNA, 22 nt, Homo sapiens
uggaaucuagagaaaugcaaac

SEQ ID NO: 23381 - RNA, 22 nt, Homo sapiens
uggaauggagagagggugcacg

SEQ ID NO: 23382 - RNA, 22 nt, Homo sapiens
uggaauguagcguugacacgag

SEQ ID NO: 23383 - RNA, 22 nt, Homo sapiens
uggaauguauaucguuuuuugu

SEQ ID NO: 23384 - RNA, 22 nt, Homo sapiens
uggaaugucagcuacaagaggg

SEQ ID NO: 23385 - RNA, 22 nt, Homo sapiens
uggaaugucuauguuuuugauu

SEQ ID NO: 23386 - RNA, 22 nt, Homo sapiens
uggaauguuauggcuuuaaucu

SEQ ID NO: 23387 - RNA, 21 nt, Homo sapiens
uggaauguucugacuucaggg

SEQ ID NO: 23388 - RNA, 18 nt, Homo sapiens
uggaauguuuggguuaau

SEQ ID NO: 23389 - RNA, 22 nt, Homo sapiens
uggacaagauagguucuauauu

SEQ ID NO: 23390 - RNA, 22 nt, Homo sapiens
uggacacuggagauucgucagu

SEQ ID NO: 23391 - RNA, 22 nt, Homo sapiens
uggacagaaacauguuuucagu

SEQ ID NO: 23392 - RNA, 22 nt, Homo sapiens
uggaccccugcucgggagcccu

SEQ ID NO: 23393 - RNA, 22 nt, Homo sapiens
uggaccccuucuccuauuaaaa

SEQ ID NO: 23394 - RNA, 22 nt, Homo sapiens
uggacuguaagugccuugagua

SEQ ID NO: 23395 - RNA, 22 nt, Homo sapiens
uggacuguaauuuuauaggcau

SEQ ID NO: 23396 - RNA, 22 nt, Homo sapiens
uggacuuuaauaaaagggaaau

SEQ ID NO: 23397 - RNA, 22 nt, Homo sapiens
uggagacaaagauagaaaagca

SEQ ID NO: 23398 - RNA, 22 nt, Homo sapiens
uggagagcaaaaucaauccaaa

SEQ ID NO: 23399 - RNA, 22 nt, Homo sapiens
uggagagugauaaguaaaugga

SEQ ID NO: 23400 - RNA, 22 nt, Homo sapiens
uggagauccuucauuuuggugu

SEQ ID NO: 23401 - RNA, 22 nt, Homo sapiens
uggagggcuagucauuucuuuu

SEQ ID NO: 23402 - RNA, 22 nt, Homo sapiens
uggaggucauuggaucaugggg

SEQ ID NO: 23403 - RNA, 22 nt, Homo sapiens
uggaguauuauguaauuucaau

SEQ ID NO: 23404 - RNA, 22 nt, Homo sapiens
uggaguguaaauuaguucagcc

SEQ ID NO: 23405 - RNA, 22 nt, Homo sapiens
uggaguguagaagccagccucc

SEQ ID NO: 23406 - RNA, 22 nt, Homo sapiens
uggaguuugacaugccuuuggg

SEQ ID NO: 23407 - RNA, 22 nt, Homo sapiens
uggauagauacuauccaggacu

SEQ ID NO: 23408 - RNA, 22 nt, Homo sapiens
uggauaguucuucuacuagagu

SEQ ID NO: 23409 - RNA, 22 nt, Homo sapiens
uggauauguucuuuguguaagg

SEQ ID NO: 23410 - RNA, 22 nt, Homo sapiens
uggauauguuuauauguugucu

SEQ ID NO: 23411 - RNA, 22 nt, Homo sapiens
uggaugacauccuuguaugcag

SEQ ID NO: 23412 - RNA, 21 nt, Homo sapiens
uggaugccuaggcagaaguuu

SEQ ID NO: 23413 - RNA, 21 nt, Homo sapiens
uggauuguacacccuaucauu

SEQ ID NO: 23414 - RNA, 22 nt, Homo sapiens
uggauuuuaauuauucugucau

SEQ ID NO: 23415 - RNA, 22 nt, Homo sapiens
uggcaaauauuuuguuuuguaa

SEQ ID NO: 23416 - RNA, 22 nt, Homo sapiens
uggcaaaugaaagaaagccagu

SEQ ID NO: 23417 - RNA, 22 nt, Homo sapiens
uggcaacaucuggggacauguu

SEQ ID NO: 23418 - RNA, 22 nt, Homo sapiens
uggcaagaaggauuuauuccuu

SEQ ID NO: 23419 - RNA, 22 nt, Homo sapiens
uggcaagagaacaacaucucuc

SEQ ID NO: 23420 - RNA, 22 nt, Homo sapiens
uggcaauaaggacuccuuaggu

SEQ ID NO: 23421 - RNA, 22 nt, Homo sapiens
uggcaauaauucagugugggcu

SEQ ID NO: 23422 - RNA, 18 nt, Homo sapiens
uggcaauaugguucuacc

SEQ ID NO: 23423 - RNA, 22 nt, Homo sapiens
uggcaauguggaaugguccagg

SEQ ID NO: 23424 - RNA, 22 nt, Homo sapiens
uggcacaaugacccuugugggc

SEQ ID NO: 23425 - RNA, 19 nt, Homo sapiens
uggcacauguauacauaug

SEQ ID NO: 23426 - RNA, 22 nt, Homo sapiens
uggcaccauccaggugucucua

SEQ ID NO: 23427 - RNA, 22 nt, Homo sapiens
uggcagacaaauuugagcauau

SEQ ID NO: 23428 - RNA, 22 nt, Homo sapiens
uggcagauagaaaugugguuaa

SEQ ID NO: 23429 - RNA, 22 nt, Homo sapiens
uggcagaugcucuuggugccca

SEQ ID NO: 23430 - RNA, 22 nt, Homo sapiens
uggcagaugggugagcuggaga

SEQ ID NO: 23431 - RNA, 22 nt, Homo sapiens
uggcaguuuacaaaugccauga

SEQ ID NO: 23432 - RNA, 22 nt, Homo sapiens
uggcaguuucauaugguucaac

SEQ ID NO: 23433 - RNA, 22 nt, Homo sapiens
uggcaguuuuaugugguucaac

SEQ ID NO: 23434 - RNA, 22 nt, Homo sapiens
uggcaguuuugauguggagaga

SEQ ID NO: 23435 - RNA, 22 nt, Homo sapiens
uggcauaugguauuugauaucu

SEQ ID NO: 23436 - RNA, 21 nt, Homo sapiens
ugugaaaucuaggcagagguu

SEQ ID NO: 23437 - RNA, 22 nt, Homo sapiens
ugugaacugagcauuaacuaca

SEQ ID NO: 23438 - RNA, 22 nt, Homo sapiens
ugugaagaugagaugacgcccu

SEQ ID NO: 23439 - RNA, 22 nt, Homo sapiens
ugugaagauggacuaauauagu

SEQ ID NO: 23440 - RNA, 22 nt, Homo sapiens
ugugaagauguuucuuaauuga

SEQ ID NO: 23441 - RNA, 23 nt, Homo sapiens
ugugacacuuccgucaguucauu

SEQ ID NO: 23442 - RNA, 22 nt, Homo sapiens
ugugacagcacgguucaacugc

SEQ ID NO: 23443 - RNA, 22 nt, Homo sapiens
ugugacaguguuacauuucaug

SEQ ID NO: 23444 - RNA, 22 nt, Homo sapiens
ugugacucuggcacauggugag

SEQ ID NO: 23445 - RNA, 22 nt, Homo sapiens
ugugacugguugucccgcuuuc

SEQ ID NO: 23446 - RNA, 22 nt, Homo sapiens
ugugagaaaugcagaaucucag

SEQ ID NO: 23447 - RNA, 22 nt, Homo sapiens
ugugaguguguacuaguuauca

SEQ ID NO: 23448 - RNA, 19 nt, Homo sapiens
ugugauaguugaaccugcc

SEQ ID NO: 23449 - RNA, 22 nt, Homo sapiens
ugugauuauuuauagacaguca

SEQ ID NO: 23450 - RNA, 22 nt, Homo sapiens
ugugcaaaaguaauugcgguuu

SEQ ID NO: 23451 - RNA, 18 nt, Homo sapiens
ugugcaauauuaaccacc

SEQ ID NO: 23452 - RNA, 22 nt, Homo sapiens
ugugcacaaccugcagguuugu

SEQ ID NO: 23453 - RNA, 22 nt, Homo sapiens
ugugcacaauguacagguuagu

SEQ ID NO: 23454 - RNA, 22 nt, Homo sapiens
ugugcacaaugugcagguuuga

SEQ ID NO: 23455 - RNA, 22 nt, Homo sapiens
ugugcacauaacauuuuuuuag

SEQ ID NO: 23456 - RNA, 22 nt, Homo sapiens
ugugcacuggaccuugucuucu

SEQ ID NO: 23457 - RNA, 22 nt, Homo sapiens
ugugcaguuuuagcguauuuua

SEQ ID NO: 23458 - RNA, 20 nt, Homo sapiens
acuggcacugguaggugugg

SEQ ID NO: 23459 - RNA, 22 nt, Homo sapiens
acuggcucugcuuuacaaacag

SEQ ID NO: 23460 - RNA, 22 nt, Homo sapiens
aaaacgcauccucacaggucug

SEQ ID NO: 23461 - RNA, 22 nt, Homo sapiens
aaaagcauucagagugcugggc

SEQ ID NO: 23462 - RNA, 22 nt, Homo sapiens
aaaagucuguagugaaagguga

SEQ ID NO: 23463 - RNA, 20 nt, Homo sapiens
aaacucugucuucuuuauca

SEQ ID NO: 23464 - RNA, 22 nt, Homo sapiens
aaacugaucugaaggccaggcu

SEQ ID NO: 23465 - RNA, 22 nt, Homo sapiens
aaacugcuuuccaugguggcug

SEQ ID NO: 23466 - RNA, 22 nt, Homo sapiens
aaagcacuggagucaucaucua

SEQ ID NO: 23467 - RNA, 22 nt, Homo sapiens
aaagcagcaggugguuuucaau

SEQ ID NO: 23468 - RNA, 22 nt, Homo sapiens
aaagcugucaaggcaggaggcu

SEQ ID NO: 23469 - RNA, 22 nt, Homo sapiens
aaaggauucuaauggaaaugcu

SEQ ID NO: 23470 - RNA, 22 nt, Homo sapiens
aaaggcacuagaaguuaccuuu

SEQ ID NO: 23471 - RNA, 22 nt, Homo sapiens
aaaggcuucggaucagaaggua

SEQ ID NO: 23472 - RNA, 19 nt, Homo sapiens
aaagguaguaaccucugau

SEQ ID NO: 23473 - RNA, 22 nt, Homo sapiens
aaagguaguacuucuagaaggg

SEQ ID NO: 23474 - RNA, 22 nt, Homo sapiens
aaaguaauugcaguuuuugcaa

SEQ ID NO: 23475 - RNA, 22 nt, Homo sapiens
aaagucuguuacagcuauuucu

SEQ ID NO: 23476 - RNA, 22 nt, Homo sapiens
aaagucuguuuugucagagacu

SEQ ID NO: 23477 - RNA, 22 nt, Homo sapiens
aaagugaauguaucccguaagu

SEQ ID NO: 23478 - RNA, 22 nt, Homo sapiens
aaagugcaguacuucguauauu

SEQ ID NO: 23479 - RNA, 22 nt, Homo sapiens
aaagugccuucuauuuuaguga

SEQ ID NO: 23480 - RNA, 22 nt, Homo sapiens
aaagugcuuacuaaguugccaa

SEQ ID NO: 23481 - RNA, 22 nt, Homo sapiens
aaaguggugggauuccaggcau

SEQ ID NO: 23482 - RNA, 22 nt, Homo sapiens
aaagugucuguuccuagcauga

SEQ ID NO: 23483 - RNA, 19 nt, Homo sapiens
aaaguguuuuaaagaggau

SEQ ID NO: 23484 - RNA, 22 nt, Homo sapiens
aaauaacugucagguucuggaa

SEQ ID NO: 23485 - RNA, 22 nt, Homo sapiens
uuaggcaggauaguuacauauu

SEQ ID NO: 23486 - RNA, 16 nt, Homo sapiens
uuaggcagugugauac

SEQ ID NO: 23487 - RNA, 22 nt, Homo sapiens
uuaggcaguuuauugauuuuca

SEQ ID NO: 23488 - RNA, 22 nt, Homo sapiens
uuaggcuuuauugaaaacaaua

SEQ ID NO: 23489 - RNA, 22 nt, Homo sapiens
uuaggcuuuucagacacuucau

SEQ ID NO: 23490 - RNA, 22 nt, Homo sapiens
uuagggaggcucaggacaagag

SEQ ID NO: 23491 - RNA, 22 nt, Homo sapiens
uuagggcaggcaugagagaacu

SEQ ID NO: 23492 - RNA, 22 nt, Homo sapiens
uuagguaauauauugcugcuuu

SEQ ID NO: 23493 - RNA, 22 nt, Homo sapiens
uuagguagaauugauuaaguuu

SEQ ID NO: 23494 - RNA, 22 nt, Homo sapiens
uuaguagcacagaguaucagca

SEQ ID NO: 23495 - RNA, 22 nt, Homo sapiens
uuaguaguugugauagguaccu

SEQ ID NO: 23496 - RNA, 22 nt, Homo sapiens
uuauacuacuauaaagagguag

SEQ ID NO: 23497 - RNA, 22 nt, Homo sapiens
uuauagcagugcaggaacagac

SEQ ID NO: 23498 - RNA, 22 nt, Homo sapiens
uuauagcagugcccaacuccug

SEQ ID NO: 23499 - RNA, 22 nt, Homo sapiens
uuauagcuaacaucugugaaaa

SEQ ID NO: 23500 - RNA, 18 nt, Homo sapiens
uuauaugcauguguagga

SEQ ID NO: 23501 - RNA, 22 nt, Homo sapiens
uuauauguuucuguuuggaggc

SEQ ID NO: 23502 - RNA, 22 nt, Homo sapiens
uuaucagcagcaugaaaauaga

SEQ ID NO: 23503 - RNA, 22 nt, Homo sapiens
uuaucauagugcaguuuucuga

SEQ ID NO: 23504 - RNA, 22 nt, Homo sapiens
uuaucucaguguuuguaaacaa

SEQ ID NO: 23505 - RNA, 22 nt, Homo sapiens
aaguacuguuuaaauugcagaa

SEQ ID NO: 23506 - RNA, 18 nt, Homo sapiens
aaguauagagagcccuua

SEQ ID NO: 23507 - RNA, 22 nt, Homo sapiens
aaguauagcuaugauaaacauu

SEQ ID NO: 23508 - RNA, 22 nt, Homo sapiens
aaguaucaggaauaguuauugg

SEQ ID NO: 23509 - RNA, 22 nt, Homo sapiens
aagucaaggagagaggcgucag

SEQ ID NO: 23510 - RNA, 22 nt, Homo sapiens
aagugaguaauacgucaguugu

SEQ ID NO: 23511 - RNA, 22 nt, Homo sapiens
aagugcuuccuuucagaggguu

SEQ ID NO: 23512 - RNA, 20 nt, Homo sapiens
aagugcuuccuuuuagaggg

SEQ ID NO: 23513 - RNA, 22 nt, Homo sapiens
aagugcuuuguacagggguuga

SEQ ID NO: 23514 - RNA, 23 nt, Homo sapiens
aagugguuuugaacccggacccu

SEQ ID NO: 23515 - RNA, 22 nt, Homo sapiens
aaguguaugaaacaguccaugg

SEQ ID NO: 23516 - RNA, 22 nt, Homo sapiens
aaguugguguaugagacagaag

SEQ ID NO: 23517 - RNA, 21 nt, Homo sapiens
aauaaagcaaccuuaugccau

SEQ ID NO: 23518 - RNA, 22 nt, Homo sapiens
aauaaagcagcuuuuugggacu

SEQ ID NO: 23519 - RNA, 20 nt, Homo sapiens
aauaacagccccagggaggu

SEQ ID NO: 23520 - RNA, 22 nt, Homo sapiens
aauaagcauaguaccugauagg

SEQ ID NO: 23521 - RNA, 22 nt, Homo sapiens
aauaauggcaccaaagcacaag

SEQ ID NO: 23522 - RNA, 22 nt, Homo sapiens
aauacagcacacagaugggucu

SEQ ID NO: 23523 - RNA, 22 nt, Homo sapiens
aauacucaguccuggugaggcu

SEQ ID NO: 23524 - RNA, 22 nt, Homo sapiens
aauacuuccaaaucuagucauu

SEQ ID NO: 23525 - RNA, 22 nt, Homo sapiens
aauagcuguccuuagaagugug

SEQ ID NO: 23526 - RNA, 22 nt, Homo sapiens
aauagugcugugcagugagugg

SEQ ID NO: 23527 - RNA, 22 nt, Homo sapiens
aauauagcuauguacaugucca

SEQ ID NO: 23528 - RNA, 22 nt, Homo sapiens
aauaugguuuuaugaagcaauu

SEQ ID NO: 23529 - RNA, 22 nt, Homo sapiens
aaucacagccagcuuccgcuau

SEQ ID NO: 23530 - RNA, 22 nt, Homo sapiens
aaucacuaugccaugaaguaca

SEQ ID NO: 23531 - RNA, 22 nt, Homo sapiens
aaucacuuuggcaccaaccuaa

SEQ ID NO: 23532 - RNA, 22 nt, Homo sapiens
aaucauauugucugccaagagg

SEQ ID NO: 23533 - RNA, 22 nt, Homo sapiens
aauccaugugcuuuaccauuuu

SEQ ID NO: 23534 - RNA, 22 nt, Homo sapiens
aaucccugagcuagacacaaag

SEQ ID NO: 23535 - RNA, 22 nt, Homo sapiens
aaucccuggacuuucggaggcu

SEQ ID NO: 23536 - RNA, 22 nt, Homo sapiens
aaucucaacacuuugggaggcu

SEQ ID NO: 23537 - RNA, 22 nt, Homo sapiens
aaucugauguuaucagcuuaag

SEQ ID NO: 23538 - RNA, 22 nt, Homo sapiens
aaucugguguguggccgggcac

SEQ ID NO: 23539 - RNA, 22 nt, Homo sapiens
aaucuguagaaggugcacauuc

SEQ ID NO: 23540 - RNA, 22 nt, Homo sapiens
aaugacacugagcaucuuucau

SEQ ID NO: 23541 - RNA, 22 nt, Homo sapiens
aaugacugugauauuuuucuuc

SEQ ID NO: 23542 - RNA, 22 nt, Homo sapiens
aaugauacuguguacaagggca

SEQ ID NO: 23543 - RNA, 22 nt, Homo sapiens
aaugcaagauguuaauuauagg

SEQ ID NO: 23544 - RNA, 22 nt, Homo sapiens
aaugccacugugccugccaagg

SEQ ID NO: 23545 - RNA, 22 nt, Homo sapiens
aauggcaagagccacagaggcg

SEQ ID NO: 23546 - RNA, 22 nt, Homo sapiens
aauggcagaugaaauugucauu

SEQ ID NO: 23547 - RNA, 20 nt, Homo sapiens
aauggcauguuggacaacug

SEQ ID NO: 23548 - RNA, 22 nt, Homo sapiens
aauggcauugguccuuuuggau

SEQ ID NO: 23549 - RNA, 22 nt, Homo sapiens
aauggcuauuucaugugguagg

SEQ ID NO: 23550 - RNA, 18 nt, Homo sapiens
aauggcucuggguucuaa

SEQ ID NO: 23551 - RNA, 22 nt, Homo sapiens
aauggcucuuuaggcaauagau

SEQ ID NO: 23552 - RNA, 22 nt, Homo sapiens
aauggcuucuuauugugguuca

SEQ ID NO: 23553 - RNA, 19 nt, Homo sapiens
aauggcuuuuccuguuccc

SEQ ID NO: 23554 - RNA, 22 nt, Homo sapiens
aaugguuuuaucagcguccaaa

SEQ ID NO: 23555 - RNA, 22 nt, Homo sapiens
aaugucacugugguccuccagu

SEQ ID NO: 23556 - RNA, 22 nt, Homo sapiens
aauuacuucuacaccaaccuaa

SEQ ID NO: 23557 - RNA, 22 nt, Homo sapiens
aauuaguugaaagucugcuuuu

SEQ ID NO: 23558 - RNA, 22 nt, Homo sapiens
aauugcacuaagcauaguccag

SEQ ID NO: 23559 - RNA, 23 nt, Homo sapiens
aauugcuuuugaggacuuaguug

SEQ ID NO: 23560 - RNA, 22 nt, Homo sapiens
aauuguacucccauaauucccu

SEQ ID NO: 23561 - RNA, 22 nt, Homo sapiens
aauugugcuuguaggccaggca

SEQ ID NO: 23562 - RNA, 20 nt, Homo sapiens
acaaaugcauucugugacau

SEQ ID NO: 23563 - RNA, 22 nt, Homo sapiens
acaacaguuuuaucaccccaga

SEQ ID NO: 23564 - RNA, 22 nt, Homo sapiens
acaagcacaaaugcauagaugg

SEQ ID NO: 23565 - RNA, 22 nt, Homo sapiens
acaagugcuuuuccuggagaca

SEQ ID NO: 23566 - RNA, 22 nt, Homo sapiens
acacacgugcauguaugcguau

SEQ ID NO: 23567 - RNA, 22 nt, Homo sapiens
acacaguaaauauugucuccuc

SEQ ID NO: 23568 - RNA, 22 nt, Homo sapiens
acacaguguuuauugugguuag

SEQ ID NO: 23569 - RNA, 22 nt, Homo sapiens
acacauuggcaauucuggagca

SEQ ID NO: 23570 - RNA, 22 nt, Homo sapiens
ugacagucaccaggacccacag

SEQ ID NO: 23571 - RNA, 23 nt, Homo sapiens
ugacagucucccgauggcuaggc

SEQ ID NO: 23572 - RNA, 22 nt, Homo sapiens
ugacagugugagacuuugucuc

SEQ ID NO: 23573 - RNA, 20 nt, Homo sapiens
ugacaguuaagggauagaag

SEQ ID NO: 23574 - RNA, 19 nt, Homo sapiens
ugacaugaaacccaagauc

SEQ ID NO: 23575 - RNA, 22 nt, Homo sapiens
ugacaugauguuccuacacugu

SEQ ID NO: 23576 - RNA, 22 nt, Homo sapiens
ugacauggugcucuuucaggca

SEQ ID NO: 23577 - RNA, 22 nt, Homo sapiens
ugacauguagagaacuucucau

SEQ ID NO: 23578 - RNA, 22 nt, Homo sapiens
ugacauuacagucacuugcugu

SEQ ID NO: 23579 - RNA, 22 nt, Homo sapiens
ugaccacugucuaagauaggug

SEQ ID NO: 23580 - RNA, 22 nt, Homo sapiens
ugacccauagaaauguggauaa

SEQ ID NO: 23581 - RNA, 22 nt, Homo sapiens
ugacccuguggcagcgucuaag

SEQ ID NO: 23582 - RNA, 22 nt, Homo sapiens
ugacuaaaacugaguuucauua

SEQ ID NO: 23583 - RNA, 22 nt, Homo sapiens
ugacuacacacaauuugucaag

SEQ ID NO: 23584 - RNA, 22 nt, Homo sapiens
ugacuacauaaguaaucucaaa

SEQ ID NO: 23585 - RNA, 22 nt, Homo sapiens
ugacuagggacauucuuccacg

SEQ ID NO: 23586 - RNA, 22 nt, Homo sapiens
ugacuggaacuuuagugagucu

SEQ ID NO: 23587 - RNA, 22 nt, Homo sapiens
ugacuggagaccucaguagggu

SEQ ID NO: 23588 - RNA, 23 nt, Homo sapiens
ugacuggagacuguugauccuuu

SEQ ID NO: 23589 - RNA, 20 nt, Homo sapiens
ugacuggauacccuuuggcu

SEQ ID NO: 23590 - RNA, 22 nt, Homo sapiens
ugacuucauuugguaauugggu

SEQ ID NO: 23591 - RNA, 22 nt, Homo sapiens
ugacuugagcuggagccugccu

SEQ ID NO: 23592 - RNA, 22 nt, Homo sapiens
ugacuugauccauggggcucca

SEQ ID NO: 23593 - RNA, 21 nt, Homo sapiens
ugagaacaacaggucaagcag

SEQ ID NO: 23594 - RNA, 22 nt, Homo sapiens
ugagaacauggagaacccccca

SEQ ID NO: 23595 - RNA, 20 nt, Homo sapiens
ugagaacauguggcauuugg

SEQ ID NO: 23596 - RNA, 22 nt, Homo sapiens
ugagaacauuccucuuccuggc

SEQ ID NO: 23597 - RNA, 22 nt, Homo sapiens
ugagaagcauaccagugucugu

SEQ ID NO: 23598 - RNA, 22 nt, Homo sapiens
ugagaaugaugauuuccaguuu

SEQ ID NO: 23599 - RNA, 21 nt, Homo sapiens
ugagacaauccuggucaauau

SEQ ID NO: 23600 - RNA, 22 nt, Homo sapiens
ugagacacugaauccggccuga

SEQ ID NO: 23601 - RNA, 22 nt, Homo sapiens
ugagacauauuauacugcuuuu

SEQ ID NO: 23602 - RNA, 22 nt, Homo sapiens
ugagacggagucucacucuguu

SEQ ID NO: 23603 - RNA, 22 nt, Homo sapiens
ugagacggagucucgcuguguc

SEQ ID NO: 23604 - RNA, 22 nt, Homo sapiens
ugagacggagucuggcacuguc

SEQ ID NO: 23605 - RNA, 22 nt, Homo sapiens
ugagacugagucuugcucuugu

SEQ ID NO: 23606 - RNA, 22 nt, Homo sapiens
ugagagacaguuucgucggagg

SEQ ID NO: 23607 - RNA, 22 nt, Homo sapiens
ugagagucacugaccugguaua

SEQ ID NO: 23608 - RNA, 22 nt, Homo sapiens
ugagauaaugcaugugaagauc

SEQ ID NO: 23609 - RNA, 18 nt, Homo sapiens
ugagauacuagaauaggu

SEQ ID NO: 23610 - RNA, 22 nt, Homo sapiens
ugagauaggaucuugcucuguu

SEQ ID NO: 23611 - RNA, 22 nt, Homo sapiens
ugagaucaagauguuagggacu

SEQ ID NO: 23612 - RNA, 18 nt, Homo sapiens
ugagaucagcaucaaggg

SEQ ID NO: 23613 - RNA, 20 nt, Homo sapiens
ugagaucaggauuaaggcua

SEQ ID NO: 23614 - RNA, 22 nt, Homo sapiens
ugagaucaguuguuauaauucu

SEQ ID NO: 23615 - RNA, 22 nt, Homo sapiens
ugagaucaugccacugcacuuc

SEQ ID NO: 23616 - RNA, 22 nt, Homo sapiens
ugagaucugauaggccuggguu

SEQ ID NO: 23617 - RNA, 22 nt, Homo sapiens
ugagaucuuaccuuccugccuu

SEQ ID NO: 23618 - RNA, 19 nt, Homo sapiens
ugagaucuuuacuggguuu

SEQ ID NO: 23619 - RNA, 22 nt, Homo sapiens
ugagaugaagucucacucuguc

SEQ ID NO: 23620 - RNA, 22 nt, Homo sapiens
ugagaugagggcugcacucaaa

SEQ ID NO: 23621 - RNA, 22 nt, Homo sapiens
ugagaugaggucucacucuguu

SEQ ID NO: 23622 - RNA, 22 nt, Homo sapiens
ugagaugaucaaaguauaggcu

SEQ ID NO: 23623 - RNA, 21 nt, Homo sapiens
ugagaugauccugcaugcaug

SEQ ID NO: 23624 - RNA, 22 nt, Homo sapiens
ugagaugcaaaaugagaauugu

SEQ ID NO: 23625 - RNA, 22 nt, Homo sapiens
ugagaugcucgccggccagcau

SEQ ID NO: 23626 - RNA, 22 nt, Homo sapiens
ugagauggaguuucgcuuuugu

SEQ ID NO: 23627 - RNA, 22 nt, Homo sapiens
ugagauguagauauggauuaga

SEQ ID NO: 23628 - RNA, 22 nt, Homo sapiens
ugagauguggcuagagagguug

SEQ ID NO: 23629 - RNA, 22 nt, Homo sapiens
ugagaugugugcauucaacuca

SEQ ID NO: 23630 - RNA, 22 nt, Homo sapiens
ugagauguuuagauuguugucu

SEQ ID NO: 23631 - RNA, 22 nt, Homo sapiens
ugagauuaaucuuuaaguaaga

SEQ ID NO: 23632 - RNA, 22 nt, Homo sapiens
ugagauuauauuucuuaacaga

SEQ ID NO: 23633 - RNA, 22 nt, Homo sapiens
ugagcaagaucuuuauaauuag

SEQ ID NO: 23634 - RNA, 22 nt, Homo sapiens
ugagcagaguuguuucuccuga

SEQ ID NO: 23635 - RNA, 22 nt, Homo sapiens
ugagcagugaguguggugcagg

SEQ ID NO: 23636 - RNA, 22 nt, Homo sapiens
ugagcauauugugauaccuaaa

SEQ ID NO: 23637 - RNA, 22 nt, Homo sapiens
ugagcauuguuuggacuuggau

SEQ ID NO: 23638 - RNA, 22 nt, Homo sapiens
ugagccaaguucacaccauugc

SEQ ID NO: 23639 - RNA, 22 nt, Homo sapiens
ugagccaugggguaaaugugau

SEQ ID NO: 23640 - RNA, 22 nt, Homo sapiens
ugagccaugguuagcuucucau

SEQ ID NO: 23641 - RNA, 20 nt, Homo sapiens
ugagcuauauauguccuuga

SEQ ID NO: 23642 - RNA, 17 nt, Homo sapiens
ugagcuaugauccuguc

SEQ ID NO: 23643 - RNA, 20 nt, Homo sapiens
ugagcucaugacauuuuucu

SEQ ID NO: 23644 - RNA, 22 nt, Homo sapiens
ugagcuccuucauaaaaaggca

SEQ ID NO: 23645 - RNA, 22 nt, Homo sapiens
ugagcugagaucaugcuauugu

SEQ ID NO: 23646 - RNA, 22 nt, Homo sapiens
ugaggaauguguguuaaagaua

SEQ ID NO: 23647 - RNA, 22 nt, Homo sapiens
ugaggagugaacuauuucugau

SEQ ID NO: 23648 - RNA, 22 nt, Homo sapiens
ugaggagugagaaauugguuuc

SEQ ID NO: 23649 - RNA, 17 nt, Homo sapiens
ugaggcacuaguaucac

SEQ ID NO: 23650 - RNA, 22 nt, Homo sapiens
ugagggaugcguacccuaugcc

SEQ ID NO: 23651 - RNA, 22 nt, Homo sapiens
ugagguaacaaacuaugaguua

SEQ ID NO: 23652 - RNA, 22 nt, Homo sapiens
ugagguaggugaagaaugcacg

SEQ ID NO: 23653 - RNA, 22 nt, Homo sapiens
ugagguauuuuguuaugcagcc

SEQ ID NO: 23654 - RNA, 22 nt, Homo sapiens
ugaggucauucaugugggcgca

SEQ ID NO: 23655 - RNA, 22 nt, Homo sapiens
ugaggugagggguuaggugcua

SEQ ID NO: 23656 - RNA, 22 nt, Homo sapiens
ugaguagaagugaagauagugg

SEQ ID NO: 23657 - RNA, 22 nt, Homo sapiens
ugaguagcuaauguuuacugag

SEQ ID NO: 23658 - RNA, 21 nt, Homo sapiens
ugaguagcuagaacuaggggc

SEQ ID NO: 23659 - RNA, 22 nt, Homo sapiens
ugaguagucagugggcaggaag

SEQ ID NO: 23660 - RNA, 22 nt, Homo sapiens
ugaguauguaggaugugucuua

SEQ ID NO: 23661 - RNA, 22 nt, Homo sapiens
ugagucaauucuaacaauggca

SEQ ID NO: 23662 - RNA, 22 nt, Homo sapiens
ugagucaugcuggagucauggc

SEQ ID NO: 23663 - RNA, 22 nt, Homo sapiens
ugagugaaugugaaggcuaggg

SEQ ID NO: 23664 - RNA, 22 nt, Homo sapiens
ugagugccuggagggcagggac

SEQ ID NO: 23665 - RNA, 22 nt, Homo sapiens
uguccaaaucagagguaccaaa

SEQ ID NO: 23666 - RNA, 19 nt, Homo sapiens
ugucccagccauagaggca

SEQ ID NO: 23667 - RNA, 18 nt, Homo sapiens
ugucccuuugcuguucau

SEQ ID NO: 23668 - RNA, 22 nt, Homo sapiens
uguccuagagggaugucacccc

SEQ ID NO: 23669 - RNA, 22 nt, Homo sapiens
ugucucagugauuggcuuucug

SEQ ID NO: 23670 - RNA, 22 nt, Homo sapiens
ugucucaguuacggcaauucca

SEQ ID NO: 23671 - RNA, 22 nt, Homo sapiens
uuuaaagcacggaguuuguggc

SEQ ID NO: 23672 - RNA, 22 nt, Homo sapiens
uuuaacauuggaugagaucguc

SEQ ID NO: 23673 - RNA, 22 nt, Homo sapiens
uuuaagguauguggugaaaauu

SEQ ID NO: 23674 - RNA, 22 nt, Homo sapiens
uuuaauagcagggacuuccggg

SEQ ID NO: 23675 - RNA, 22 nt, Homo sapiens
uuuaaugcaucccaaaauguag

SEQ ID NO: 23676 - RNA, 22 nt, Homo sapiens
uuuacagucucauagguggaag

SEQ ID NO: 23677 - RNA, 22 nt, Homo sapiens
uuuacagucuuuugugugaguc

SEQ ID NO: 23678 - RNA, 22 nt, Homo sapiens
uuuacccugaggaaucuauuuu

SEQ ID NO: 23679 - RNA, 22 nt, Homo sapiens
uuuagcaaagcaauuuacacca

SEQ ID NO: 23680 - RNA, 22 nt, Homo sapiens
uuuagcagcaaagagcuguguu

SEQ ID NO: 23681 - RNA, 22 nt, Homo sapiens
uuuagguagucaaagguuaguc

SEQ ID NO: 23682 - RNA, 22 nt, Homo sapiens
uuuagguauuugguauagcagu

SEQ ID NO: 23683 - RNA, 18 nt, Homo sapiens
uuucaagucuuaggugac

SEQ ID NO: 23684 - RNA, 19 nt, Homo sapiens
uuucacacucgccuacuuc

SEQ ID NO: 23685 - RNA, 22 nt, Homo sapiens
uuucacagcaauugccuauugu

SEQ ID NO: 23686 - RNA, 22 nt, Homo sapiens
uuucacagcugucuuccgucuc

SEQ ID NO: 23687 - RNA, 22 nt, Homo sapiens
uuucacguuggggaguugagug

SEQ ID NO: 23688 - RNA, 22 nt, Homo sapiens
uuucaggcaagggugacccuga

SEQ ID NO: 23689 - RNA, 22 nt, Homo sapiens
uuucagguauuuaagggccguu

SEQ ID NO: 23690 - RNA, 22 nt, Homo sapiens
uuucauccggcuguguauuaug

SEQ ID NO: 23691 - RNA, 22 nt, Homo sapiens
uuucauggcgaggcuucauggg

SEQ ID NO: 23692 - RNA, 22 nt, Homo sapiens
uuucauguuuuucugugaggca

SEQ ID NO: 23693 - RNA, 22 nt, Homo sapiens
uuuccaguuguucuagaaagcu

SEQ ID NO: 23694 - RNA, 22 nt, Homo sapiens
uuucccagugguacaguuuaua

SEQ ID NO: 23695 - RNA, 22 nt, Homo sapiens
uuucuacagggcuugccaggua

SEQ ID NO: 23696 - RNA, 17 nt, Homo sapiens
uuucucagcccucuucu

SEQ ID NO: 23697 - RNA, 22 nt, Homo sapiens
uuucucaguguuucaggguagg

SEQ ID NO: 23698 - RNA, 22 nt, Homo sapiens
uuucugaggccucaccagaagc

SEQ ID NO: 23699 - RNA, 22 nt, Homo sapiens
uuucugcuugagagaauugcug

SEQ ID NO: 23700 - RNA, 21 nt, Homo sapiens
uuucugggggagcauggcagg

SEQ ID NO: 23701 - RNA, 22 nt, Homo sapiens
uuucugugguccucuugaaggu

SEQ ID NO: 23702 - RNA, 22 nt, Homo sapiens
uuugaagugugaugccuugaug

SEQ ID NO: 23703 - RNA, 19 nt, Homo sapiens
uuugaauauaaugcagcua

SEQ ID NO: 23704 - RNA, 22 nt, Homo sapiens
uuugaauggaaguuuugugaaa

SEQ ID NO: 23705 - RNA, 22 nt, Homo sapiens
uuugaauguaaugagcaggaag

SEQ ID NO: 23706 - RNA, 22 nt, Homo sapiens
uuugacaaugugugcuuguauu

SEQ ID NO: 23707 - RNA, 22 nt, Homo sapiens
uuugagcaagaggugacauuau

SEQ ID NO: 23708 - RNA, 23 nt, Homo sapiens
uuugagugugauaaacacuguca

SEQ ID NO: 23709 - RNA, 22 nt, Homo sapiens
uuugaguuugaggugcugauga

SEQ ID NO: 23710 - RNA, 22 nt, Homo sapiens
uuugaugcaucucuacuuuguu

SEQ ID NO: 23711 - RNA, 16 nt, Homo sapiens
uuugcaagaucagaag

SEQ ID NO: 23712 - RNA, 22 nt, Homo sapiens
uuugcaccuuccuaguggcuga

SEQ ID NO: 23713 - RNA, 22 nt, Homo sapiens
uuugcacuucugagugugacau

SEQ ID NO: 23714 - RNA, 23 nt, Homo sapiens
uuugcacuugcuccuucuauggc

SEQ ID NO: 23715 - RNA, 22 nt, Homo sapiens
uuugcacuuuaauauaauguga

SEQ ID NO: 23716 - RNA, 22 nt, Homo sapiens
uuugcagagucuuucgcugggc

SEQ ID NO: 23717 - RNA, 19 nt, Homo sapiens
uuugcauagugagaauaua

SEQ ID NO: 23718 - RNA, 22 nt, Homo sapiens
uuugcaucuuuugcuuccugga

SEQ ID NO: 23719 - RNA, 22 nt, Homo sapiens
uuugccaauauuuuacugagga

SEQ ID NO: 23720 - RNA, 22 nt, Homo sapiens
uuugccacugcaggcuguuuaa

SEQ ID NO: 23721 - RNA, 22 nt, Homo sapiens
uuugcuauagugaauagugcug

SEQ ID NO: 23722 - RNA, 22 nt, Homo sapiens
uuugcuuaaaucuuaaucagau

SEQ ID NO: 23723 - RNA, 22 nt, Homo sapiens
uuuggcaaagaucaacauguua

SEQ ID NO: 23724 - RNA, 22 nt, Homo sapiens
uuuggcaauuugacuguauagg

SEQ ID NO: 23725 - RNA, 22 nt, Homo sapiens
uuuggcauauuuuaagcugguu

SEQ ID NO: 23726 - RNA, 22 nt, Homo sapiens
uuuggcauuagagagacuugca

SEQ ID NO: 23727 - RNA, 21 nt, Homo sapiens
uuuggcauuaugucaccagag

SEQ ID NO: 23728 - RNA, 23 nt, Homo sapiens
uuuggcauuccagaaauuuucau

SEQ ID NO: 23729 - RNA, 22 nt, Homo sapiens
uuuggcauuuaaauaugcaugg

SEQ ID NO: 23730 - RNA, 22 nt, Homo sapiens
uuuggcuuaagauugacugcaa

SEQ ID NO: 23731 - RNA, 22 nt, Homo sapiens
uuuggcuuugagaagcagugga

SEQ ID NO: 23732 - RNA, 22 nt, Homo sapiens
uuuggucagcugcgggucagcu

SEQ ID NO: 23733 - RNA, 22 nt, Homo sapiens
uuugguccuccuacagggcagg

SEQ ID NO: 23734 - RNA, 22 nt, Homo sapiens
uuuguacugagccaagauggua

SEQ ID NO: 23735 - RNA, 18 nt, Homo sapiens
uuuguacuuuuucuaaug

SEQ ID NO: 23736 - RNA, 19 nt, Homo sapiens
uuuguauguuuccaguaau

SEQ ID NO: 23737 - RNA, 22 nt, Homo sapiens
uuugucacccugaauguaagau

SEQ ID NO: 23738 - RNA, 22 nt, Homo sapiens
uuugucacucuuggagguuguu

SEQ ID NO: 23739 - RNA, 22 nt, Homo sapiens
uuugucauagcagcaggaaugg

SEQ ID NO: 23740 - RNA, 22 nt, Homo sapiens
uuugucccccguaguucauaua

SEQ ID NO: 23741 - RNA, 22 nt, Homo sapiens
uuuguccugccaugguuuauuu

SEQ ID NO: 23742 - RNA, 23 nt, Homo sapiens
uuugugacacucuccaucuccag

SEQ ID NO: 23743 - RNA, 22 nt, Homo sapiens
uuugugacucauggucuagugc

SEQ ID NO: 23744 - RNA, 22 nt, Homo sapiens
uuugugagguggauagauugca

SEQ ID NO: 23745 - RNA, 22 nt, Homo sapiens
uuugugcaugaagagggggugc

SEQ ID NO: 23746 - RNA, 22 nt, Homo sapiens
uuugugcuaacuuuaacucuua

SEQ ID NO: 23747 - RNA, 22 nt, Homo sapiens
uuugugcuaaugcuagauuacu

SEQ ID NO: 23748 - RNA, 22 nt, Homo sapiens
uugaggugaauuugcaggaugc

SEQ ID NO: 23749 - RNA, 20 nt, Homo sapiens
uugaggugugaggggcagag

SEQ ID NO: 23750 - RNA, 22 nt, Homo sapiens
uugaguaguaagugguucaccg

SEQ ID NO: 23751 - RNA, 22 nt, Homo sapiens
uugaguuugaguauucuaaagc

SEQ ID NO: 23752 - RNA, 22 nt, Homo sapiens
uugauaagaaaaauauaccaga

SEQ ID NO: 23753 - RNA, 22 nt, Homo sapiens
uugauaauguuaacuuugguca

SEQ ID NO: 23754 - RNA, 22 nt, Homo sapiens
uugauagacacauauccaugug

SEQ ID NO: 23755 - RNA, 22 nt, Homo sapiens
uugauauguggaauauuuaucu

SEQ ID NO: 23756 - RNA, 22 nt, Homo sapiens
uugauauuacucaguaacagau

SEQ ID NO: 23757 - RNA, 22 nt, Homo sapiens
uugauauucugagaagcugaag

SEQ ID NO: 23758 - RNA, 22 nt, Homo sapiens
uugauccucugagaaucuaucg

SEQ ID NO: 23759 - RNA, 22 nt, Homo sapiens
uugcaaacaucuuguuucacau

SEQ ID NO: 23760 - RNA, 22 nt, Homo sapiens
uugcaaagaccucuucacuucc

SEQ ID NO: 23761 - RNA, 22 nt, Homo sapiens
uugcaaaguugccaaggaagga

SEQ ID NO: 23762 - RNA, 22 nt, Homo sapiens
uugcaaaucucuuguguuuggu

SEQ ID NO: 23763 - RNA, 18 nt, Homo sapiens
uugcaaauucuucccugu

SEQ ID NO: 23764 - RNA, 22 nt, Homo sapiens
uugcaacauuguaaguuuauau

SEQ ID NO: 23765 - RNA, 22 nt, Homo sapiens
uugcaagaaaucagagccuucc

SEQ ID NO: 23766 - RNA, 20 nt, Homo sapiens
uugcacagagaaggaggcag

SEQ ID NO: 23767 - RNA, 22 nt, Homo sapiens
uugcacagucuagcuccaccuu

SEQ ID NO: 23768 - RNA, 22 nt, Homo sapiens
uugcacauggcaggugcucaau

SEQ ID NO: 23769 - RNA, 22 nt, Homo sapiens
uugcaccuugaagccaauagca

SEQ ID NO: 23770 - RNA, 22 nt, Homo sapiens
uugcacuccagccugggugaca

SEQ ID NO: 23771 - RNA, 22 nt, Homo sapiens
uugcacuccagccuuggggaga

SEQ ID NO: 23772 - RNA, 22 nt, Homo sapiens
uugcacuugcugaggagugauu

SEQ ID NO: 23773 - RNA, 22 nt, Homo sapiens
uugcagcaacauggaugaaacu

SEQ ID NO: 23774 - RNA, 22 nt, Homo sapiens
uugcagcauucugguuccuggu

SEQ ID NO: 23775 - RNA, 22 nt, Homo sapiens
uugcaggugguuuaugcaagac

SEQ ID NO: 23776 - RNA, 22 nt, Homo sapiens
uugcagugugacgacuauauuu

SEQ ID NO: 23777 - RNA, 22 nt, Homo sapiens
uugcauauucucugaggcagga

SEQ ID NO: 23778 - RNA, 22 nt, Homo sapiens
uugcaugcuccuuaugagaauc

SEQ ID NO: 23779 - RNA, 22 nt, Homo sapiens
uugcaugggagcugggugaagc

SEQ ID NO: 23780 - RNA, 22 nt, Homo sapiens
uugcauguacguacagagagag

SEQ ID NO: 23781 - RNA, 22 nt, Homo sapiens
uugcauuuucuaggagggcaaa

SEQ ID NO: 23782 - RNA, 22 nt, Homo sapiens
uugccuaggcuggaguguggug

SEQ ID NO: 23783 - RNA, 22 nt, Homo sapiens
uugccuuuguuggaaacaagug

SEQ ID NO: 23784 - RNA, 22 nt, Homo sapiens
uugcuagaugaaaaugguaccu

SEQ ID NO: 23785 - RNA, 22 nt, Homo sapiens
uugcuuagucaugaaucacuga

SEQ ID NO: 23786 - RNA, 22 nt, Homo sapiens
uuggaaacaccuggugagguua

SEQ ID NO: 23787 - RNA, 22 nt, Homo sapiens
uuggaaagagguguuuaugacu

SEQ ID NO: 23788 - RNA, 22 nt, Homo sapiens
uuggaaaugguaaaggguuaau

SEQ ID NO: 23789 - RNA, 22 nt, Homo sapiens
uuggaagacauucugucugcua

SEQ ID NO: 23790 - RNA, 22 nt, Homo sapiens
uuggaauauaaccuguuucuaa

SEQ ID NO: 23791 - RNA, 23 nt, Homo sapiens
uuggaaugagaccuaagaguuuu

SEQ ID NO: 23792 - RNA, 22 nt, Homo sapiens
uuggaccacuugauuucugguc

SEQ ID NO: 23793 - RNA, 22 nt, Homo sapiens
uuggacuaagaacuuaaaauaa

SEQ ID NO: 23794 - RNA, 22 nt, Homo sapiens
uuggacugggauggccgaggcu

SEQ ID NO: 23795 - RNA, 22 nt, Homo sapiens
uuggacuucuaacugacaugga

SEQ ID NO: 23796 - RNA, 22 nt, Homo sapiens
uuggacuucucaaggcaauaaa

SEQ ID NO: 23797 - RNA, 22 nt, Homo sapiens
uuggagagugauauucagaugc

SEQ ID NO: 23798 - RNA, 22 nt, Homo sapiens
uuggaguguucugguccgggcu

SEQ ID NO: 23799 - RNA, 22 nt, Homo sapiens
uuggauuauaaacugagauuug

SEQ ID NO: 23800 - RNA, 22 nt, Homo sapiens
uuggauuuuaacaaacuaggug

SEQ ID NO: 23801 - RNA, 22 nt, Homo sapiens
uuggcaaagugucuggcauuua

SEQ ID NO: 23802 - RNA, 22 nt, Homo sapiens
uuggcaaaugucacaaaucagg

SEQ ID NO: 23803 - RNA, 22 nt, Homo sapiens
uuggcaaucaauucugacgucu

SEQ ID NO: 23804 - RNA, 22 nt, Homo sapiens
uuggcacuugauaauauucugg

SEQ ID NO: 23805 - RNA, 22 nt, Homo sapiens
uuggcagcacgcaguccagagg

SEQ ID NO: 23806 - RNA, 22 nt, Homo sapiens
uuggcaguaucuacuacagcua

SEQ ID NO: 23807 - RNA, 22 nt, Homo sapiens
uuggcauagaggcucucaagcu

SEQ ID NO: 23808 - RNA, 22 nt, Homo sapiens
uuggcauugaguuucaaaucau

SEQ ID NO: 23809 - RNA, 22 nt, Homo sapiens
uuggcauuuauucuaaggucaa

SEQ ID NO: 23810 - RNA, 22 nt, Homo sapiens
uuggccauaugacuugcuuugg

SEQ ID NO: 23811 - RNA, 22 nt, Homo sapiens
uuggccuccuggucauauccag

SEQ ID NO: 23812 - RNA, 21 nt, Homo sapiens
uuggccuggaggccugaaugu

SEQ ID NO: 23813 - RNA, 22 nt, Homo sapiens
uuggccuuucucuaaauacuuu

SEQ ID NO: 23814 - RNA, 22 nt, Homo sapiens
uuggcuguguuccucaaggagu

SEQ ID NO: 23815 - RNA, 22 nt, Homo sapiens
uuggcuguguuuauaugcugga

SEQ ID NO: 23816 - RNA, 22 nt, Homo sapiens
uugggauggaaauuuguacccc

SEQ ID NO: 23817 - RNA, 22 nt, Homo sapiens
uugggauggaacuuuucaguga

SEQ ID NO: 23818 - RNA, 23 nt, Homo sapiens
uugggcaaaucacuaacgucucc

SEQ ID NO: 23819 - RNA, 23 nt, Homo sapiens
uugggcaaaucacugagggcaga

SEQ ID NO: 23820 - RNA, 22 nt, Homo sapiens
uugggcuugagggugcccaguc

SEQ ID NO: 23821 - RNA, 22 nt, Homo sapiens
uugggguagaauugcaacauau

SEQ ID NO: 23822 - RNA, 22 nt, Homo sapiens
uuggguaguauagaagcaacaa

SEQ ID NO: 23823 - RNA, 22 nt, Homo sapiens
auuguguagucuuacugcuugc

SEQ ID NO: 23824 - RNA, 22 nt, Homo sapiens
auuuggcagugaagggaucaca

SEQ ID NO: 23825 - RNA, 22 nt, Homo sapiens
auuuggcauagaguaucauucu

SEQ ID NO: 23826 - RNA, 22 nt, Homo sapiens
auuugggaaugugcauuauacu

SEQ ID NO: 23827 - RNA, 22 nt, Homo sapiens
auuugguguuguuuggagccua

SEQ ID NO: 23828 - RNA, 22 nt, Homo sapiens
auuugguuauggucauggacac

SEQ ID NO: 23829 - RNA, 22 nt, Homo sapiens
auuugucaauacacuucuucca

SEQ ID NO: 23830 - RNA, 22 nt, Homo sapiens
caaaagugguucuuauccuuuu

SEQ ID NO: 23831 - RNA, 22 nt, Homo sapiens
caaaguaauugugguuuugcca

SEQ ID NO: 23832 - RNA, 22 nt, Homo sapiens
caaagucuucaguugauucuga

SEQ ID NO: 23833 - RNA, 22 nt, Homo sapiens
caaagugcugggaugggccagg

SEQ ID NO: 23834 - RNA, 22 nt, Homo sapiens
caaauacuuucauguugucuug

SEQ ID NO: 23835 - RNA, 22 nt, Homo sapiens
caaaugaucugcuggccucagc

SEQ ID NO: 23836 - RNA, 22 nt, Homo sapiens
caaauugcuugucuguagugga

SEQ ID NO: 23837 - RNA, 22 nt, Homo sapiens
caacauccaccuccuggguuca

SEQ ID NO: 23838 - RNA, 22 nt, Homo sapiens
caacugcucacuccuggguuca

SEQ ID NO: 23839 - RNA, 22 nt, Homo sapiens
caaggugcugagacaggagccc

SEQ ID NO: 23840 - RNA, 22 nt, Homo sapiens
caagugaauaguugcucucaga

SEQ ID NO: 23841 - RNA, 21 nt, Homo sapiens
caagugaugcuucugcuuuaa

SEQ ID NO: 23842 - RNA, 22 nt, Homo sapiens
caauggcaaugaaauagugaga

SEQ ID NO: 23843 - RNA, 22 nt, Homo sapiens
caauggcacgaucucgucucac

SEQ ID NO: 23844 - RNA, 21 nt, Homo sapiens
caauggcacgaucuuggcuca

SEQ ID NO: 23845 - RNA, 22 nt, Homo sapiens
caauggcacuauuggaaaaggu

SEQ ID NO: 23846 - RNA, 22 nt, Homo sapiens
caauugcacucuuagguguaca

SEQ ID NO: 23847 - RNA, 22 nt, Homo sapiens
cacacugucuuucagaaugguu

SEQ ID NO: 23848 - RNA, 22 nt, Homo sapiens
cacacuguuuuccauggggguu

SEQ ID NO: 23849 - RNA, 22 nt, Homo sapiens
cacagcuagucaaugguagaca

SEQ ID NO: 23850 - RNA, 22 nt, Homo sapiens
cacaggaagaggcacggucccu

SEQ ID NO: 23851 - RNA, 22 nt, Homo sapiens
cacaguguuccagcuauuugaa

SEQ ID NO: 23852 - RNA, 22 nt, Homo sapiens
cacaguugccuaucuccugaag

SEQ ID NO: 23853 - RNA, 22 nt, Homo sapiens
caccacagccauuauugucccc

SEQ ID NO: 23854 - RNA, 19 nt, Homo sapiens
caccagugcaugcuacuau

SEQ ID NO: 23855 - RNA, 22 nt, Homo sapiens
caccuagacuggagugcagugg

SEQ ID NO: 23856 - RNA, 22 nt, Homo sapiens
caccuguacauggcaguguccu

SEQ ID NO: 23857 - RNA, 22 nt, Homo sapiens
cacuaccucuacaggcagcugg

SEQ ID NO: 23858 - RNA, 22 nt, Homo sapiens
cacugaaugugagguuggggag

SEQ ID NO: 23859 - RNA, 18 nt, Homo sapiens
cacugagcccuucacucu

SEQ ID NO: 23860 - RNA, 22 nt, Homo sapiens
cacugcaauuacuuuugcacca

SEQ ID NO: 23861 - RNA, 22 nt, Homo sapiens
cacugcacuccagccuaagagg

SEQ ID NO: 23862 - RNA, 22 nt, Homo sapiens
cacugcacuccagucuggcgac

SEQ ID NO: 23863 - RNA, 21 nt, Homo sapiens
cacugcacuugccuucugggu

SEQ ID NO: 23864 - RNA, 22 nt, Homo sapiens
cacugcauccuccaccugccag

SEQ ID NO: 23865 - RNA, 22 nt, Homo sapiens
cacugcauccuugaccuucugg

SEQ ID NO: 23866 - RNA, 22 nt, Homo sapiens
cacugggccaucacuuaauauu

SEQ ID NO: 23867 - RNA, 17 nt, Homo sapiens
cacugggugcaagagga

SEQ ID NO: 23868 - RNA, 22 nt, Homo sapiens
cacugggugccauauguuugcu

SEQ ID NO: 23869 - RNA, 22 nt, Homo sapiens
cacuguggauggaacuauguga

SEQ ID NO: 23870 - RNA, 22 nt, Homo sapiens
cacuuugguucaccugaguuuc

SEQ ID NO: 23871 - RNA, 22 nt, Homo sapiens
cagaaguauugguaugcucugu

SEQ ID NO: 23872 - RNA, 22 nt, Homo sapiens
cagcaguuguuucggauuggga

SEQ ID NO: 23873 - RNA, 22 nt, Homo sapiens
cagcaucauucaucugggguaa

SEQ ID NO: 23874 - RNA, 22 nt, Homo sapiens
cagcuaguuuuugguuuacagu

SEQ ID NO: 23875 - RNA, 22 nt, Homo sapiens
cagcucuuguuaaaacuaacua

SEQ ID NO: 23876 - RNA, 22 nt, Homo sapiens
cagcugguggcaagaagacaga

SEQ ID NO: 23877 - RNA, 22 nt, Homo sapiens
cagcugguguuacaaaccagag

SEQ ID NO: 23878 - RNA, 22 nt, Homo sapiens
caggaccucuugccuggaagcc

SEQ ID NO: 23879 - RNA, 22 nt, Homo sapiens
caggcagucuggggguguaucc

SEQ ID NO: 23880 - RNA, 22 nt, Homo sapiens
caggcagugggagacaaaacug

SEQ ID NO: 23881 - RNA, 22 nt, Homo sapiens
caggcauagucuugaguuuuau

SEQ ID NO: 23882 - RNA, 22 nt, Homo sapiens
caggcauuguauuguaaucccc

SEQ ID NO: 23883 - RNA, 22 nt, Homo sapiens
cagguacuucugggcugagcag

SEQ ID NO: 23884 - RNA, 22 nt, Homo sapiens
cagguaguauuugguuacauaa

SEQ ID NO: 23885 - RNA, 22 nt, Homo sapiens
caggugguauuugguuuucugu

SEQ ID NO: 23886 - RNA, 22 nt, Homo sapiens
caguagcaugccucagaaugag

SEQ ID NO: 23887 - RNA, 20 nt, Homo sapiens
cagugcacuuucccacuggu

SEQ ID NO: 23888 - RNA, 22 nt, Homo sapiens
cagugcauccauguucagcagu

SEQ ID NO: 23889 - RNA, 23 nt, Homo sapiens
cagugguguuagagaaaucuuuu

SEQ ID NO: 23890 - RNA, 22 nt, Homo sapiens
cagugguuuucucaguucagca

SEQ ID NO: 23891 - RNA, 22 nt, Homo sapiens
caguuacuugacacaaccaauu

SEQ ID NO: 23892 - RNA, 22 nt, Homo sapiens
caguuguuuuaugacauaagau

SEQ ID NO: 23893 - RNA, 22 nt, Homo sapiens
gagaaccauuuggagaaaaagu

SEQ ID NO: 23894 - RNA, 22 nt, Homo sapiens
gagaacuaaugauguacuaggc

SEQ ID NO: 23895 - RNA, 22 nt, Homo sapiens
gagaacuggcugauucaaggac

SEQ ID NO: 23896 - RNA, 21 nt, Homo sapiens
gagaaucuuuucagggcaaac

SEQ ID NO: 23897 - RNA, 22 nt, Homo sapiens
gagaaugagaggggaaggccac

SEQ ID NO: 23898 - RNA, 22 nt, Homo sapiens
gagacagugucagccauugaaa

SEQ ID NO: 23899 - RNA, 22 nt, Homo sapiens
gagacggagucacgcccuguca

SEQ ID NO: 23900 - RNA, 22 nt, Homo sapiens
gagacggagucucgcucuguca

SEQ ID NO: 23901 - RNA, 22 nt, Homo sapiens
gagacugagucuugcccuguca

SEQ ID NO: 23902 - RNA, 22 nt, Homo sapiens
gagagugaaguuugcuaccugu

SEQ ID NO: 23903 - RNA, 22 nt, Homo sapiens
gagagugugucagaggcugcga

SEQ ID NO: 23904 - RNA, 21 nt, Homo sapiens
gagauagguaccgaagcuuag

SEQ ID NO: 23905 - RNA, 22 nt, Homo sapiens
gagaucaaguauucuccacuaa

SEQ ID NO: 23906 - RNA, 22 nt, Homo sapiens
gagaucaaugccuauggcuuuc

SEQ ID NO: 23907 - RNA, 22 nt, Homo sapiens
gagaucaaugggauggaauuga

SEQ ID NO: 23908 - RNA, 22 nt, Homo sapiens
gagaucaauucauggcauaguu

SEQ ID NO: 23909 - RNA, 22 nt, Homo sapiens
gagaucauguacuagaacaccu

SEQ ID NO: 23910 - RNA, 22 nt, Homo sapiens
gagaucauuaugucagggguca

SEQ ID NO: 23911 - RNA, 23 nt, Homo sapiens
gagaucauucuggaauuagagug

SEQ ID NO: 23912 - RNA, 22 nt, Homo sapiens
gagaugcaccuugucacguuuc

SEQ ID NO: 23913 - RNA, 22 nt, Homo sapiens
gaugaaacaucuuuggaaacug

SEQ ID NO: 23914 - RNA, 22 nt, Homo sapiens
gaugaggcuagagacaugugua

SEQ ID NO: 23915 - RNA, 22 nt, Homo sapiens
gaugauauuugagucauuagaa

SEQ ID NO: 23916 - RNA, 22 nt, Homo sapiens
gaugauguuacucuuuuuccuu

SEQ ID NO: 23917 - RNA, 22 nt, Homo sapiens
gaugauguuugauaaauaauaa

SEQ ID NO: 23918 - RNA, 22 nt, Homo sapiens
gaugcagcuaggauuugugaca

SEQ ID NO: 23919 - RNA, 22 nt, Homo sapiens
gaugccuuuuuguccucaguua

SEQ ID NO: 23920 - RNA, 22 nt, Homo sapiens
gauggaguaauguaaucuugag

SEQ ID NO: 23921 - RNA, 22 nt, Homo sapiens
gauggugucccaggcucaggcu

SEQ ID NO: 23922 - RNA, 22 nt, Homo sapiens
gauguguuuaucacccaguccu

SEQ ID NO: 23923 - RNA, 22 nt, Homo sapiens
gauguguuuccaggauuuguuu

SEQ ID NO: 23924 - RNA, 22 nt, Homo sapiens
gauguguuuguuucuggaggag

SEQ ID NO: 23925 - RNA, 22 nt, Homo sapiens
gauuccauugcgaauuuucaga

SEQ ID NO: 23926 - RNA, 22 nt, Homo sapiens
gauuggcauugcugcaccugag

SEQ ID NO: 23927 - RNA, 22 nt, Homo sapiens
gauuucaucuuuagaggaagga

SEQ ID NO: 23928 - RNA, 22 nt, Homo sapiens
gauuuguauuaaaagugugacg

SEQ ID NO: 23929 - RNA, 22 nt, Homo sapiens
gcaaaguaauuguuguuuuugc

SEQ ID NO: 23930 - RNA, 22 nt, Homo sapiens
gcaaggacucccugggucauuc

SEQ ID NO: 23931 - RNA, 22 nt, Homo sapiens
gcaagugucugagguuuuguau

SEQ ID NO: 23932 - RNA, 22 nt, Homo sapiens
gcaauacugacagcauuaguuu

SEQ ID NO: 23933 - RNA, 22 nt, Homo sapiens
gcacacguagaagcaugcauca

SEQ ID NO: 23934 - RNA, 22 nt, Homo sapiens
gcacaguaggugguaggacuuu

SEQ ID NO: 23935 - RNA, 22 nt, Homo sapiens
gcacagucaacacuuauucacc

SEQ ID NO: 23936 - RNA, 22 nt, Homo sapiens
gcacaguggcucccgucuauaa

SEQ ID NO: 23937 - RNA, 22 nt, Homo sapiens
gcacaguuaaagggucauguga

SEQ ID NO: 23938 - RNA, 22 nt, Homo sapiens
gcacauauguaaauagcugccu

SEQ ID NO: 23939 - RNA, 22 nt, Homo sapiens
gcacauggccacuaggaauaaa

SEQ ID NO: 23940 - RNA, 22 nt, Homo sapiens
gcaccccuuaccgggcuggguu

SEQ ID NO: 23941 - RNA, 22 nt, Homo sapiens
gcacccguagugcuuucaauua

SEQ ID NO: 23942 - RNA, 22 nt, Homo sapiens
gcacccugucaaaauggaccaa

SEQ ID NO: 23943 - RNA, 22 nt, Homo sapiens
gcacgugcacccacaugcacgu

SEQ ID NO: 23944 - RNA, 22 nt, Homo sapiens
gcagaguauagagggcugggcc

SEQ ID NO: 23945 - RNA, 22 nt, Homo sapiens
gcaggaaucuugagaaggauuc

SEQ ID NO: 23946 - RNA, 22 nt, Homo sapiens
gcaggaauuucucugcagaccc

SEQ ID NO: 23947 - RNA, 17 nt, Homo sapiens
gcaguacuuaguaagga

SEQ ID NO: 23948 - RNA, 22 nt, Homo sapiens
gcaguacuuuauguccuaauua

SEQ ID NO: 23949 - RNA, 22 nt, Homo sapiens
gcaguauuguugaaauguccau

SEQ ID NO: 23950 - RNA, 23 nt, Homo sapiens
gcagucauuuggaaaagguugaa

SEQ ID NO: 23951 - RNA, 22 nt, Homo sapiens
gcagugaugugaucauagcuca

SEQ ID NO: 23952 - RNA, 20 nt, Homo sapiens
gcaguguucacuguauuccu

SEQ ID NO: 23953 - RNA, 22 nt, Homo sapiens
gcauaaagcuaauaagacgaag

SEQ ID NO: 23954 - RNA, 20 nt, Homo sapiens
gcauaugucuuuauagcaga

SEQ ID NO: 23955 - RNA, 22 nt, Homo sapiens
gcaucaaugucuauaguguuug

SEQ ID NO: 23956 - RNA, 20 nt, Homo sapiens
gcaugagucuuuauaguaga

SEQ ID NO: 23957 - RNA, 22 nt, Homo sapiens
gcaugaugaauaauaucacaag

SEQ ID NO: 23958 - RNA, 22 nt, Homo sapiens
gcauggaaggcgcuuugugacu

SEQ ID NO: 23959 - RNA, 22 nt, Homo sapiens
gcauggaguggaaauucuuggg

SEQ ID NO: 23960 - RNA, 22 nt, Homo sapiens
gcauugcacuuggcauagacug

SEQ ID NO: 23961 - RNA, 22 nt, Homo sapiens
gccaagaagugucuaagcagga

SEQ ID NO: 23962 - RNA, 19 nt, Homo sapiens
gccaccuggugcguguucu

SEQ ID NO: 23963 - RNA, 22 nt, Homo sapiens
gccaguauuuuauugagaauuu

SEQ ID NO: 23964 - RNA, 22 nt, Homo sapiens
gccaguauuuuguugagaauuu

SEQ ID NO: 23965 - RNA, 22 nt, Homo sapiens
gccagugugaugugaucauggc

SEQ ID NO: 23966 - RNA, 22 nt, Homo sapiens
gccauggugucuuauuuuugug

SEQ ID NO: 23967 - RNA, 22 nt, Homo sapiens
gccauugcacuccagccugagc

SEQ ID NO: 23968 - RNA, 22 nt, Homo sapiens
gcccacuguuaaauuuguuuua

SEQ ID NO: 23969 - RNA, 22 nt, Homo sapiens
gcccauuguuccuaggcuacaa

SEQ ID NO: 23970 - RNA, 22 nt, Homo sapiens
gccccgggugaugcagccguca

SEQ ID NO: 23971 - RNA, 22 nt, Homo sapiens
gccgagagauuuggaaugggga

SEQ ID NO: 23972 - RNA, 22 nt, Homo sapiens
gccuagauccaaauauggugca

SEQ ID NO: 23973 - RNA, 22 nt, Homo sapiens
gccucaguuguggccagggauu

SEQ ID NO: 23974 - RNA, 22 nt, Homo sapiens
gccuguagaagaguagaugacc

SEQ ID NO: 23975 - RNA, 22 nt, Homo sapiens
gcgagcauuguaggaaguucag

SEQ ID NO: 23976 - RNA, 22 nt, Homo sapiens
gcuaaaucuguaaaaugaggag

SEQ ID NO: 23977 - RNA, 20 nt, Homo sapiens
gcuaaggcacgggaauuacu

SEQ ID NO: 23978 - RNA, 22 nt, Homo sapiens
gcuaaggcaggagcauugcuug

SEQ ID NO: 23979 - RNA, 22 nt, Homo sapiens
gcuagcacauugucaccucuca

SEQ ID NO: 23980 - RNA, 22 nt, Homo sapiens
gcuaugguuuuuagcuccauca

SEQ ID NO: 23981 - RNA, 22 nt, Homo sapiens
gcucaugagacaagcaggagua

SEQ ID NO: 23982 - RNA, 22 nt, Homo sapiens
gcuccauuuuccauuucucuaa

SEQ ID NO: 23983 - RNA, 22 nt, Homo sapiens
gcugacacugggcuauagaucu

SEQ ID NO: 23984 - RNA, 22 nt, Homo sapiens
gcugauggugcaguucuagccu

SEQ ID NO: 23985 - RNA, 17 nt, Homo sapiens
gcugauguuugcauuuu

SEQ ID NO: 23986 - RNA, 17 nt, Homo sapiens
gcugcauucauguagaa

SEQ ID NO: 23987 - RNA, 22 nt, Homo sapiens
gcugcuguuauucaucagaacu

SEQ ID NO: 23988 - RNA, 21 nt, Homo sapiens
gcugguaaucacuuugccaaa

SEQ ID NO: 23989 - RNA, 22 nt, Homo sapiens
gcuggugacuuuaaguugaagc

SEQ ID NO: 23990 - RNA, 22 nt, Homo sapiens
gcugucaugagcaacacaugaa

SEQ ID NO: 23991 - RNA, 22 nt, Homo sapiens
gcuguugcuauuauuccgagaa

SEQ ID NO: 23992 - RNA, 22 nt, Homo sapiens
gcuguuugccgccaucgcagac

SEQ ID NO: 23993 - RNA, 22 nt, Homo sapiens
gcuugguccccacccaaaucgc

SEQ ID NO: 23994 - RNA, 22 nt, Homo sapiens
guagaagcacagggccuguauu

SEQ ID NO: 23995 - RNA, 22 nt, Homo sapiens
guagaugcauggauuuacuucu

SEQ ID NO: 23996 - RNA, 22 nt, Homo sapiens
guagcagccacacuugauaacu

SEQ ID NO: 23997 - RNA, 22 nt, Homo sapiens
guaggcacuggcucagcuuauc

SEQ ID NO: 23998 - RNA, 22 nt, Homo sapiens
guauacacccugugauauuauu

SEQ ID NO: 23999 - RNA, 22 nt, Homo sapiens
guauacaguugacccuugaacc

SEQ ID NO: 24000 - RNA, 22 nt, Homo sapiens
guauacuucugaaaauagcuau

SEQ ID NO: 24001 - RNA, 22 nt, Homo sapiens
guauagcacauaauacuugaug

SEQ ID NO: 24002 - RNA, 22 nt, Homo sapiens
guauaggcuuucaccacgccau

SEQ ID NO: 24003 - RNA, 22 nt, Homo sapiens
guaucaugaaguuucuucauuu

SEQ ID NO: 24004 - RNA, 22 nt, Homo sapiens
guaucccuugcuaucugaaucu

SEQ ID NO: 24005 - RNA, 22 nt, Homo sapiens
guaugcacauauguguauguau

SEQ ID NO: 24006 - RNA, 22 nt, Homo sapiens
guauggaagucaguuuguuggc

SEQ ID NO: 24007 - RNA, 22 nt, Homo sapiens
guauggcacuauccucucugau

SEQ ID NO: 24008 - RNA, 21 nt, Homo sapiens
guaugguugaagugacaagcc

SEQ ID NO: 24009 - RNA, 22 nt, Homo sapiens
guaugguugaagugacaagcca

SEQ ID NO: 24010 - RNA, 22 nt, Homo sapiens
uagacuguaagauccaggagag

SEQ ID NO: 24011 - RNA, 22 nt, Homo sapiens
uagagagcuguuugaaagcagg

SEQ ID NO: 24012 - RNA, 22 nt, Homo sapiens
uagagauaucaauuucauggug

SEQ ID NO: 24013 - RNA, 21 nt, Homo sapiens
uagagcaacacacgcccucuc

SEQ ID NO: 24014 - RNA, 22 nt, Homo sapiens
uagagcuaguuuuuaaucuaac

SEQ ID NO: 24015 - RNA, 22 nt, Homo sapiens
uagaggaaugaauuuggccaga

SEQ ID NO: 24016 - RNA, 22 nt, Homo sapiens
uagagguagagugacuucccca

SEQ ID NO: 24017 - RNA, 22 nt, Homo sapiens
uagagguauaccaaaaaggcau

SEQ ID NO: 24018 - RNA, 22 nt, Homo sapiens
uagagguauuaacaguagaaga

SEQ ID NO: 24019 - RNA, 21 nt, Homo sapiens
uagauacuguauuaaaccuag

SEQ ID NO: 24020 - RNA, 22 nt, Homo sapiens
uagauaguaaagccauuagcuu

SEQ ID NO: 24021 - RNA, 22 nt, Homo sapiens
uagaucaauuaauuguuacuug

SEQ ID NO: 24022 - RNA, 22 nt, Homo sapiens
uagaucauauucagugcuuacu

SEQ ID NO: 24023 - RNA, 22 nt, Homo sapiens
uagauuaucccugauuugucca

SEQ ID NO: 24024 - RNA, 22 nt, Homo sapiens
uagauuaucuuaaggagcauca

SEQ ID NO: 24025 - RNA, 22 nt, Homo sapiens
uagcacagggaauugguucucu

SEQ ID NO: 24026 - RNA, 17 nt, Homo sapiens
uagcacagugccuggua

SEQ ID NO: 24027 - RNA, 22 nt, Homo sapiens
uagcacagugucauucuaggua

SEQ ID NO: 24028 - RNA, 20 nt, Homo sapiens
uagcacaucuggcuguagag

SEQ ID NO: 24029 - RNA, 22 nt, Homo sapiens
uagcacaucuucuuggccugca

SEQ ID NO: 24030 - RNA, 22 nt, Homo sapiens
uagcacaugucagguaauuugc

SEQ ID NO: 24031 - RNA, 22 nt, Homo sapiens
uagcaccucuuuggccuuucgu

SEQ ID NO: 24032 - RNA, 22 nt, Homo sapiens
uagcacuauguuaucacauacu

SEQ ID NO: 24033 - RNA, 22 nt, Homo sapiens
uagcagacuauuuugugauaau

SEQ ID NO: 24034 - RNA, 22 nt, Homo sapiens
uagcagcaaagcaggaucugcu

SEQ ID NO: 24035 - RNA, 20 nt, Homo sapiens
uagcagcagacagagggagg

SEQ ID NO: 24036 - RNA, 22 nt, Homo sapiens
uagcaguauggagcgaggccca

SEQ ID NO: 24037 - RNA, 22 nt, Homo sapiens
uagcagugugaaaacggacuaa

SEQ ID NO: 24038 - RNA, 22 nt, Homo sapiens
uagcaguuguuguuacuuguau

SEQ ID NO: 24039 - RNA, 22 nt, Homo sapiens
uagcauaauuuguagaaaauca

SEQ ID NO: 24040 - RNA, 22 nt, Homo sapiens
uagcauggagucaugcacggcu

SEQ ID NO: 24041 - RNA, 20 nt, Homo sapiens
uagccggguguugugucaug

SEQ ID NO: 24042 - RNA, 22 nt, Homo sapiens
uagccuguggugaauguuucug

SEQ ID NO: 24043 - RNA, 22 nt, Homo sapiens
uagcuaaauucagcucuaggua

SEQ ID NO: 24044 - RNA, 22 nt, Homo sapiens
uagcucagcccagcuaagcuca

SEQ ID NO: 24045 - RNA, 21 nt, Homo sapiens
uagcucagugguguugccaua

SEQ ID NO: 24046 - RNA, 22 nt, Homo sapiens
uagcuccacagcuauauauaau

SEQ ID NO: 24047 - RNA, 18 nt, Homo sapiens
uagcucuuguugguccau

SEQ ID NO: 24048 - RNA, 22 nt, Homo sapiens
uagcugcaaaauauagacuucu

SEQ ID NO: 24049 - RNA, 22 nt, Homo sapiens
uagcugcccagcacgaaguugg

SEQ ID NO: 24050 - RNA, 22 nt, Homo sapiens
uagcugcuguauguacacggau

SEQ ID NO: 24051 - RNA, 22 nt, Homo sapiens
uagcuggaauuacuugcaccug

SEQ ID NO: 24052 - RNA, 22 nt, Homo sapiens
uagcuguuggugggaagucaga

SEQ ID NO: 24053 - RNA, 23 nt, Homo sapiens
uagcuucucccagaccugcuccc

SEQ ID NO: 24054 - RNA, 22 nt, Homo sapiens
uaggacauugcccuuguggaga

SEQ ID NO: 24055 - RNA, 22 nt, Homo sapiens
uaggagcacagcagcauguggg

SEQ ID NO: 24056 - RNA, 22 nt, Homo sapiens
uaggagugugaacccuaugaac

SEQ ID NO: 24057 - RNA, 22 nt, Homo sapiens
uaggagugugaacccuguuuug

SEQ ID NO: 24058 - RNA, 22 nt, Homo sapiens
uaggcaauggagauagaggaug

SEQ ID NO: 24059 - RNA, 22 nt, Homo sapiens
uaggcaguggagaaauaaacag

SEQ ID NO: 24060 - RNA, 22 nt, Homo sapiens
uaggcaguuuuccuuucacagu

SEQ ID NO: 24061 - RNA, 22 nt, Homo sapiens
uaggccuuuuucagauggguag

SEQ ID NO: 24062 - RNA, 22 nt, Homo sapiens
uagggaguuuuggggugcagaa

SEQ ID NO: 24063 - RNA, 22 nt, Homo sapiens
uagggcaugugggaaguuauaa

SEQ ID NO: 24064 - RNA, 22 nt, Homo sapiens
uagguaaguaugugugaugggg

SEQ ID NO: 24065 - RNA, 22 nt, Homo sapiens
uagguuaucucaaguguaauuu

SEQ ID NO: 24066 - RNA, 22 nt, Homo sapiens
uagguuguccaucucuagaagc

SEQ ID NO: 24067 - RNA, 22 nt, Homo sapiens
uagguugucucuucacucugau

SEQ ID NO: 24068 - RNA, 20 nt, Homo sapiens
uagguuuucacagaauugcc

SEQ ID NO: 24069 - RNA, 22 nt, Homo sapiens
uaguagugucccugacuaucac

SEQ ID NO: 24070 - RNA, 22 nt, Homo sapiens
uaguaucacaagguguacaccc

SEQ ID NO: 24071 - RNA, 22 nt, Homo sapiens
uaguauguuuauagcauugagu

SEQ ID NO: 24072 - RNA, 22 nt, Homo sapiens
uagucacacacucaacuuuuca

SEQ ID NO: 24073 - RNA, 22 nt, Homo sapiens
uaguccauuuucaugcugcuau

SEQ ID NO: 24074 - RNA, 22 nt, Homo sapiens
uagucccauaugauuuagugaa

SEQ ID NO: 24075 - RNA, 22 nt, Homo sapiens
uagucccuuucuauuaaugaga

SEQ ID NO: 24076 - RNA, 22 nt, Homo sapiens
uagugcaguggcuccaucucag

SEQ ID NO: 24077 - RNA, 21 nt, Homo sapiens
uagugcagugggguaugacuu

SEQ ID NO: 24078 - RNA, 22 nt, Homo sapiens
uagugcuguaauucuaaugaaa

SEQ ID NO: 24079 - RNA, 22 nt, Homo sapiens
uauaacacccacauauagucuu

SEQ ID NO: 24080 - RNA, 22 nt, Homo sapiens
uauacaguaggcacucaguggc

SEQ ID NO: 24081 - RNA, 22 nt, Homo sapiens
uauacugucuuuguaugccuag

SEQ ID NO: 24082 - RNA, 22 nt, Homo sapiens
uauagcaaugugccacucucug

SEQ ID NO: 24083 - RNA, 22 nt, Homo sapiens
uauagcagccugaacaaaguaa

SEQ ID NO: 24084 - RNA, 22 nt, Homo sapiens
uauagcuauuguuaauggaacu

SEQ ID NO: 24085 - RNA, 21 nt, Homo sapiens
uauaguaguaugauuuacaau

SEQ ID NO: 24086 - RNA, 22 nt, Homo sapiens
uauaugcacucagguguaugug

SEQ ID NO: 24087 - RNA, 22 nt, Homo sapiens
uauauguucugugucccuuucg

SEQ ID NO: 24088 - RNA, 22 nt, Homo sapiens
uauauguuuucauaaggcuaga

SEQ ID NO: 24089 - RNA, 22 nt, Homo sapiens
uaucaaggccacucauuuuaug

SEQ ID NO: 24090 - RNA, 22 nt, Homo sapiens
uaucaaguuggaagagaaguaa

SEQ ID NO: 24091 - RNA, 22 nt, Homo sapiens
uaucacacgccuugcuucauuu

SEQ ID NO: 24092 - RNA, 22 nt, Homo sapiens
uaucacacuggaagaaguuaag

SEQ ID NO: 24093 - RNA, 22 nt, Homo sapiens
uaucacacuguuggauuugauu

SEQ ID NO: 24094 - RNA, 22 nt, Homo sapiens
uaucacaggucaggaaucuugc

SEQ ID NO: 24095 - RNA, 22 nt, Homo sapiens
ucuaugguuuaagucaccaaga

SEQ ID NO: 24096 - RNA, 22 nt, Homo sapiens
ucuaugguuuauuuccaagugu

SEQ ID NO: 24097 - RNA, 22 nt, Homo sapiens
ucuauguuuuugcuaguagugu

SEQ ID NO: 24098 - RNA, 22 nt, Homo sapiens
ucucaaccucccaaguagcugg

SEQ ID NO: 24099 - RNA, 22 nt, Homo sapiens
ucucaauggguuguagacaaag

SEQ ID NO: 24100 - RNA, 22 nt, Homo sapiens
ucucacagaguugaauguuucu

SEQ ID NO: 24101 - RNA, 18 nt, Homo sapiens
ucucacagcaaucuguca

SEQ ID NO: 24102 - RNA, 22 nt, Homo sapiens
ucucagugaaauaaauuauuuu

SEQ ID NO: 24103 - RNA, 22 nt, Homo sapiens
ucucaguggcuuccucacuuuu

SEQ ID NO: 24104 - RNA, 22 nt, Homo sapiens
ucucagugugguaaaaguuuuu

SEQ ID NO: 24105 - RNA, 22 nt, Homo sapiens
ucucaguuuucuggggaagaaa

SEQ ID NO: 24106 - RNA, 20 nt, Homo sapiens
ucucauagagguagagaaua

SEQ ID NO: 24107 - RNA, 21 nt, Homo sapiens
ucucauagaguuucacuuucu

SEQ ID NO: 24108 - RNA, 22 nt, Homo sapiens
ucucauggagguagagaguaaa

SEQ ID NO: 24109 - RNA, 21 nt, Homo sapiens
ucucauuacugaugagccaga

SEQ ID NO: 24110 - RNA, 22 nt, Homo sapiens
ucucccuaccugagccgagcca

SEQ ID NO: 24111 - RNA, 22 nt, Homo sapiens
ucuccggguggcggcgaaggga

SEQ ID NO: 24112 - RNA, 22 nt, Homo sapiens
ucucugacacugaccccaaaaa

SEQ ID NO: 24113 - RNA, 22 nt, Homo sapiens
ucucugagaccacuccaaacuc

SEQ ID NO: 24114 - RNA, 22 nt, Homo sapiens
ucucugauuaaacaagauagug

SEQ ID NO: 24115 - RNA, 22 nt, Homo sapiens
ucucuggauaucuacuuauguu

SEQ ID NO: 24116 - RNA, 22 nt, Homo sapiens
ucucugguuuucaaagcaguau

SEQ ID NO: 24117 - RNA, 22 nt, Homo sapiens
ucucuuggugacuuaaaauguu

SEQ ID NO: 24118 - RNA, 22 nt, Homo sapiens
ucucuugguugaacaguuugga

SEQ ID NO: 24119 - RNA, 22 nt, Homo sapiens
ucugacaaugaacaaucuauag

SEQ ID NO: 24120 - RNA, 22 nt, Homo sapiens
ucugacuagacaagcaguguac

SEQ ID NO: 24121 - RNA, 22 nt, Homo sapiens
ucugagcaauaaacaacauauu

SEQ ID NO: 24122 - RNA, 22 nt, Homo sapiens
ucugagguuacugcuuuguaga

SEQ ID NO: 24123 - RNA, 22 nt, Homo sapiens
ucugaguggcagaaugagcuga

SEQ ID NO: 24124 - RNA, 22 nt, Homo sapiens
ucugccuacugagcacacagug

SEQ ID NO: 24125 - RNA, 22 nt, Homo sapiens
ucuggcacucagaggccuugcu

SEQ ID NO: 24126 - RNA, 22 nt, Homo sapiens
ucuggcauuuucucugcuugca

SEQ ID NO: 24127 - RNA, 22 nt, Homo sapiens
ucuggccccucccaaaucucau

SEQ ID NO: 24128 - RNA, 22 nt, Homo sapiens
ucuggccuacaaguaauuuuau

SEQ ID NO: 24129 - RNA, 22 nt, Homo sapiens
ucuggccuagaacaauuaauua

SEQ ID NO: 24130 - RNA, 18 nt, Homo sapiens
ucuggcuucuuuguucca

SEQ ID NO: 24131 - RNA, 23 nt, Homo sapiens
ucuggcuuugggaugcucaaggg

SEQ ID NO: 24132 - RNA, 22 nt, Homo sapiens
ucuggcuuuuaacaucuauaaa

SEQ ID NO: 24133 - RNA, 22 nt, Homo sapiens
ucugggguuuccacuuuuacuu

SEQ ID NO: 24134 - RNA, 22 nt, Homo sapiens
ucuguaacauccaccuucuggg

SEQ ID NO: 24135 - RNA, 19 nt, Homo sapiens
ucuguaguuagggcuacag

SEQ ID NO: 24136 - RNA, 22 nt, Homo sapiens
ucugugcauuacacuuuucuca

SEQ ID NO: 24137 - RNA, 19 nt, Homo sapiens
ucugugcuugucccccugu

SEQ ID NO: 24138 - RNA, 22 nt, Homo sapiens
ucuguggucagcauccgccacu

SEQ ID NO: 24139 - RNA, 22 nt, Homo sapiens
ucugugguucaaaccagcaacu

SEQ ID NO: 24140 - RNA, 22 nt, Homo sapiens
ucuguguugaucacacugggag

SEQ ID NO: 24141 - RNA, 22 nt, Homo sapiens
ucuguguugaugcucauuaauu

SEQ ID NO: 24142 - RNA, 22 nt, Homo sapiens
ucuguugguucuuugaggagga

SEQ ID NO: 24143 - RNA, 22 nt, Homo sapiens
ucuguuguuaucauaauauuga

SEQ ID NO: 24144 - RNA, 22 nt, Homo sapiens
ucuuaggugaugauugauguga

SEQ ID NO: 24145 - RNA, 22 nt, Homo sapiens
ucuugcaauuuccuuaguggug

SEQ ID NO: 24146 - RNA, 22 nt, Homo sapiens
ucuugcuuguuguucccuucau

SEQ ID NO: 24147 - RNA, 22 nt, Homo sapiens
ucuugcuuuugcagagcuucuc

SEQ ID NO: 24148 - RNA, 22 nt, Homo sapiens
ucuugguuaggggaaauaggca

SEQ ID NO: 24149 - RNA, 23 nt, Homo sapiens
ucuugguuauagaaaaauaguug

SEQ ID NO: 24150 - RNA, 22 nt, Homo sapiens
ucuugguuuauugauggagagg

SEQ ID NO: 24151 - RNA, 22 nt, Homo sapiens
ucuuuagugacaguugugcaag

SEQ ID NO: 24152 - RNA, 22 nt, Homo sapiens
ucuuugauguucugaaagaugg

SEQ ID NO: 24153 - RNA, 22 nt, Homo sapiens
ucuuugccuaacccaaggucau

SEQ ID NO: 24154 - RNA, 22 nt, Homo sapiens
ucuuuggauggaaauuggaguc

SEQ ID NO: 24155 - RNA, 18 nt, Homo sapiens
ucuuuggcugaacuguag

SEQ ID NO: 24156 - RNA, 19 nt, Homo sapiens
ucuuugguacgugcuuuga

SEQ ID NO: 24157 - RNA, 22 nt, Homo sapiens
ucuuuggucagaaagauuacac

SEQ ID NO: 24158 - RNA, 22 nt, Homo sapiens
ucuuugguucugugcagccuau

SEQ ID NO: 24159 - RNA, 22 nt, Homo sapiens
ugaaacacacagagaagggaga

SEQ ID NO: 24160 - RNA, 22 nt, Homo sapiens
ugaaacacacauugcccuuuau

SEQ ID NO: 24161 - RNA, 22 nt, Homo sapiens
ugaaacacaccuccucuccauc

SEQ ID NO: 24162 - RNA, 22 nt, Homo sapiens
ugaaagcuacaggaaaguauuu

SEQ ID NO: 24163 - RNA, 22 nt, Homo sapiens
ugaaaguaauugcaguuuuuac

SEQ ID NO: 24164 - RNA, 22 nt, Homo sapiens
ugaaaguuauauugugaaauuc

SEQ ID NO: 24165 - RNA, 22 nt, Homo sapiens
ugaaaucuuugaugguggcauu

SEQ ID NO: 24166 - RNA, 22 nt, Homo sapiens
ugaaaugauuauaugguguuug

SEQ ID NO: 24167 - RNA, 22 nt, Homo sapiens
ugaaaugcagaacuuuaggucu

SEQ ID NO: 24168 - RNA, 22 nt, Homo sapiens
ugaaaugccuugagauuuugac

SEQ ID NO: 24169 - RNA, 22 nt, Homo sapiens
ugaaaugcugucuaggggaaau

SEQ ID NO: 24170 - RNA, 22 nt, Homo sapiens
ugaacucagcauccagggccaa

SEQ ID NO: 24171 - RNA, 22 nt, Homo sapiens
ugaacuguaagguauaggugau

SEQ ID NO: 24172 - RNA, 22 nt, Homo sapiens
ugaagacucaguuugagggaca

SEQ ID NO: 24173 - RNA, 19 nt, Homo sapiens
ugaaguauagggcuucuga

SEQ ID NO: 24174 - RNA, 18 nt, Homo sapiens
ugaauacagcguugggaa

SEQ ID NO: 24175 - RNA, 21 nt, Homo sapiens
ugaauacugcugcucccuuug

SEQ ID NO: 24176 - RNA, 22 nt, Homo sapiens
ugaauacuucaaaaaaauagcu

SEQ ID NO: 24177 - RNA, 22 nt, Homo sapiens
ugaauagaaguggcaggaguag

SEQ ID NO: 24178 - RNA, 22 nt, Homo sapiens
ugaauagaaguuuacuccuuuu

SEQ ID NO: 24179 - RNA, 21 nt, Homo sapiens
ugaauauuuggguugugucca

SEQ ID NO: 24180 - RNA, 22 nt, Homo sapiens
ugaaucaugcugcuauaaagac

SEQ ID NO: 24181 - RNA, 22 nt, Homo sapiens
ugaaugauuuuaaaagccucuc

SEQ ID NO: 24182 - RNA, 22 nt, Homo sapiens
ugaaugcaucauguagggcuca

SEQ ID NO: 24183 - RNA, 22 nt, Homo sapiens
ugaaugguuuuuagagaacaau

SEQ ID NO: 24184 - RNA, 22 nt, Homo sapiens
ugaauguaacuaaaccugugaa

SEQ ID NO: 24185 - RNA, 22 nt, Homo sapiens
ugaauguaagaugucugcuggu

SEQ ID NO: 24186 - RNA, 23 nt, Homo sapiens
ugaauguaucgaaugugggaaag

SEQ ID NO: 24187 - RNA, 22 nt, Homo sapiens
ugaauguuguugguugagauau

SEQ ID NO: 24188 - RNA, 23 nt, Homo sapiens
ugaauguuuauucucggugcaga

SEQ ID NO: 24189 - RNA, 22 nt, Homo sapiens
ugaauuguuucauucuuuacau

SEQ ID NO: 24190 - RNA, 23 nt, Homo sapiens
ugacaagagcgagacuuggucuc

SEQ ID NO: 24191 - RNA, 22 nt, Homo sapiens
ugacaagcucccucugcaccuu

SEQ ID NO: 24192 - RNA, 22 nt, Homo sapiens
agaucacagucuuugguuuuag

SEQ ID NO: 24193 - RNA, 22 nt, Homo sapiens
agaugauguuuacugagcauca

SEQ ID NO: 24194 - RNA, 23 nt, Homo sapiens
agaugcaucuggcugcgaggcaa

SEQ ID NO: 24195 - RNA, 22 nt, Homo sapiens
agauggguuuucacauguuggc

SEQ ID NO: 24196 - RNA, 22 nt, Homo sapiens
agcaagauccagucgcacagga

SEQ ID NO: 24197 - RNA, 22 nt, Homo sapiens
agcacagugaaugguuuacuca

SEQ ID NO: 24198 - RNA, 22 nt, Homo sapiens
agcacagugguuaaguuucuua

SEQ ID NO: 24199 - RNA, 22 nt, Homo sapiens
agcaccaugggcugaguaagug

SEQ ID NO: 24200 - RNA, 22 nt, Homo sapiens
agcaccauugcacuccagccug

SEQ ID NO: 24201 - RNA, 22 nt, Homo sapiens
agcagagcauauucauucgggg

SEQ ID NO: 24202 - RNA, 21 nt, Homo sapiens
agcagaguggcagcucuuuug

SEQ ID NO: 24203 - RNA, 17 nt, Homo sapiens
agcagcccauaucccca

SEQ ID NO: 24204 - RNA, 22 nt, Homo sapiens
agcagcucaagacuuaaauuug

SEQ ID NO: 24205 - RNA, 22 nt, Homo sapiens
agcagcucaugccuuugggagg

SEQ ID NO: 24206 - RNA, 22 nt, Homo sapiens
agcagcuuugcauggccugugg

SEQ ID NO: 24207 - RNA, 22 nt, Homo sapiens
agcagugugaaaauggacuaau

SEQ ID NO: 24208 - RNA, 22 nt, Homo sapiens
agcagugugagaauggacuaau

SEQ ID NO: 24209 - RNA, 22 nt, Homo sapiens
agcaucacacacuacagggaaa

SEQ ID NO: 24210 - RNA, 22 nt, Homo sapiens
agcaucagugauuuuguugaag

SEQ ID NO: 24211 - RNA, 22 nt, Homo sapiens
agcaucauaccaaucugguccu

SEQ ID NO: 24212 - RNA, 22 nt, Homo sapiens
agcaucaugcaguugcuauuca

SEQ ID NO: 24213 - RNA, 22 nt, Homo sapiens
agcaucauuugauguucccgag

SEQ ID NO: 24214 - RNA, 22 nt, Homo sapiens
agcauuacaugguacagagaag

SEQ ID NO: 24215 - RNA, 19 nt, Homo sapiens
agccaguuuucccagcacc

SEQ ID NO: 24216 - RNA, 22 nt, Homo sapiens
agcccagagacuguguaaauuu

SEQ ID NO: 24217 - RNA, 17 nt, Homo sapiens
agccccauuagcuaguu

SEQ ID NO: 24218 - RNA, 23 nt, Homo sapiens
agcccugugacucgaacgaggag

SEQ ID NO: 24219 - RNA, 22 nt, Homo sapiens
agccgguguccacgaagaagag

SEQ ID NO: 24220 - RNA, 22 nt, Homo sapiens
agccucauucuacauguuaaug

SEQ ID NO: 24221 - RNA, 22 nt, Homo sapiens
agccuguagugagcugugauug

SEQ ID NO: 24222 - RNA, 21 nt, Homo sapiens
agccugugggucauaguugcc

SEQ ID NO: 24223 - RNA, 23 nt, Homo sapiens
agccuguugccuaggcagcucau

SEQ ID NO: 24224 - RNA, 22 nt, Homo sapiens
agcgccacugcacuccagccug

SEQ ID NO: 24225 - RNA, 22 nt, Homo sapiens
agcggcuguuccccuggucuau

SEQ ID NO: 24226 - RNA, 21 nt, Homo sapiens
agcuaaauuggaaauuucugu

SEQ ID NO: 24227 - RNA, 22 nt, Homo sapiens
agcucauugcuguccuggagga

SEQ ID NO: 24228 - RNA, 21 nt, Homo sapiens
agcuccacucguucccaaagc

SEQ ID NO: 24229 - RNA, 20 nt, Homo sapiens
agcuccauuccugaaggcug

SEQ ID NO: 24230 - RNA, 22 nt, Homo sapiens
agcucuuguuaguauuagcagu

SEQ ID NO: 24231 - RNA, 22 nt, Homo sapiens
agcugaguguuccaagagcgag

SEQ ID NO: 24232 - RNA, 22 nt, Homo sapiens
agcugauuuuaaguccuugucc

SEQ ID NO: 24233 - RNA, 22 nt, Homo sapiens
agcugcaaagggagagaugauu

SEQ ID NO: 24234 - RNA, 22 nt, Homo sapiens
agcugcaauguuuaguauaaua

SEQ ID NO: 24235 - RNA, 22 nt, Homo sapiens
agcugccagucuuguaaggccu

SEQ ID NO: 24236 - RNA, 17 nt, Homo sapiens
agcuggaauuacgggag

SEQ ID NO: 24237 - RNA, 22 nt, Homo sapiens
agcuggauguggaugacccugu

SEQ ID NO: 24238 - RNA, 22 nt, Homo sapiens
agcugguaguuuucuaguguuu

SEQ ID NO: 24239 - RNA, 22 nt, Homo sapiens
agcuggucuacguguguaugag

SEQ ID NO: 24240 - RNA, 22 nt, Homo sapiens
agcugguuuauuucucacaaca

SEQ ID NO: 24241 - RNA, 22 nt, Homo sapiens
agcuguaguuuauucauguuaa

SEQ ID NO: 24242 - RNA, 22 nt, Homo sapiens
agcugugucuucuuaaagauuu

SEQ ID NO: 24243 - RNA, 20 nt, Homo sapiens
agcuguuguuaaaaaggagg

SEQ ID NO: 24244 - RNA, 22 nt, Homo sapiens
agugccacugcacucuagccug

SEQ ID NO: 24245 - RNA, 22 nt, Homo sapiens
aguggauguuguggccugggag

SEQ ID NO: 24246 - RNA, 22 nt, Homo sapiens
agugguuuuaaguagagcauac

SEQ ID NO: 24247 - RNA, 22 nt, Homo sapiens
agugguuuuggaauggaauuca

SEQ ID NO: 24248 - RNA, 22 nt, Homo sapiens
agugucaggagacagguagcug

SEQ ID NO: 24249 - RNA, 19 nt, Homo sapiens
agugucauggucauuauuu

SEQ ID NO: 24250 - RNA, 22 nt, Homo sapiens
aguguuuuuacaagcacucugg

SEQ ID NO: 24251 - RNA, 22 nt, Homo sapiens
aguucaaaucgagccuggccau

SEQ ID NO: 24252 - RNA, 21 nt, Homo sapiens
aguucacauggcuccuguguu

SEQ ID NO: 24253 - RNA, 22 nt, Homo sapiens
auaaaccuacauuuucacuucu

SEQ ID NO: 24254 - RNA, 19 nt, Homo sapiens
auaaacuagaacugucccc

SEQ ID NO: 24255 - RNA, 23 nt, Homo sapiens
auaaacugucaaaagccagcccu

SEQ ID NO: 24256 - RNA, 22 nt, Homo sapiens
auaaagacacuuggcaugauuu

SEQ ID NO: 24257 - RNA, 22 nt, Homo sapiens
auaaagcaaauaggacuauugc

SEQ ID NO: 24258 - RNA, 22 nt, Homo sapiens
auaaagccaugagcuugagaug

SEQ ID NO: 24259 - RNA, 22 nt, Homo sapiens
auaaaguucugcuggcauauau

SEQ ID NO: 24260 - RNA, 22 nt, Homo sapiens
auaacucuguuuuuuucaugca

SEQ ID NO: 24261 - RNA, 22 nt, Homo sapiens
auaagaagugaaccagacgucu

SEQ ID NO: 24262 - RNA, 22 nt, Homo sapiens
auaagguuagcucugagaaagu

SEQ ID NO: 24263 - RNA, 22 nt, Homo sapiens
auaauacugggaagaugagcau

SEQ ID NO: 24264 - RNA, 22 nt, Homo sapiens
auaauacuuuuauuuugaggaa

SEQ ID NO: 24265 - RNA, 22 nt, Homo sapiens
auaauagguaguaauggauuga

SEQ ID NO: 24266 - RNA, 22 nt, Homo sapiens
auaauaguguuuagauuuggga

SEQ ID NO: 24267 - RNA, 22 nt, Homo sapiens
auaaugacuuccaguuccacuc

SEQ ID NO: 24268 - RNA, 23 nt, Homo sapiens
auaaugcaaguggugguaaucug

SEQ ID NO: 24269 - RNA, 22 nt, Homo sapiens
auacacgugccuuguuggugua

SEQ ID NO: 24270 - RNA, 19 nt, Homo sapiens
auacacguguauacauaca

SEQ ID NO: 24271 - RNA, 22 nt, Homo sapiens
auacagguauacaaugcauaau

SEQ ID NO: 24272 - RNA, 22 nt, Homo sapiens
auacaguauggagggcccagcu

SEQ ID NO: 24273 - RNA, 22 nt, Homo sapiens
auacaucugccauguuggugug

SEQ ID NO: 24274 - RNA, 22 nt, Homo sapiens
auacauguucaagggcauauau

SEQ ID NO: 24275 - RNA, 22 nt, Homo sapiens
auagacacugaaaucccugcca

SEQ ID NO: 24276 - RNA, 23 nt, Homo sapiens
auagagcuaggaugcagacagau

SEQ ID NO: 24277 - RNA, 22 nt, Homo sapiens
auagaggacugaggugaucuuu

SEQ ID NO: 24278 - RNA, 22 nt, Homo sapiens
auagagguagacagaggggaaa

SEQ ID NO: 24279 - RNA, 22 nt, Homo sapiens
auagcaaugcaagaauggcuua

SEQ ID NO: 24280 - RNA, 20 nt, Homo sapiens
auagcaccagacagcccuag

SEQ ID NO: 24281 - RNA, 21 nt, Homo sapiens
auagcacuucacuugguuaga

SEQ ID NO: 24282 - RNA, 22 nt, Homo sapiens
auagcagaauuuggucaagucu

SEQ ID NO: 24283 - RNA, 22 nt, Homo sapiens
auagcagcaccccacuaccuca

SEQ ID NO: 24284 - RNA, 22 nt, Homo sapiens
auagcagcaccucacucuacug

SEQ ID NO: 24285 - RNA, 22 nt, Homo sapiens
auagcaggagaauggucauggg

SEQ ID NO: 24286 - RNA, 22 nt, Homo sapiens
auagcagugccccaaacuccug

SEQ ID NO: 24287 - RNA, 22 nt, Homo sapiens
auagcagugugaaaauggacua

SEQ ID NO: 24288 - RNA, 22 nt, Homo sapiens
auagcaucauuucuugaaaaga

SEQ ID NO: 24289 - RNA, 22 nt, Homo sapiens
auagcuguccuuacuagcuagg

SEQ ID NO: 24290 - RNA, 22 nt, Homo sapiens
auagcuguugaauggaauauuc

SEQ ID NO: 24291 - RNA, 22 nt, Homo sapiens
auaggagcagaaaccguauuuu

SEQ ID NO: 24292 - RNA, 22 nt, Homo sapiens
auagguauguaauacaaaugaa

SEQ ID NO: 24293 - RNA, 22 nt, Homo sapiens
aguauuaggugaguguauuuca

SEQ ID NO: 24294 - RNA, 20 nt, Homo sapiens
aguauucacuuuuuucaugg

SEQ ID NO: 24295 - RNA, 22 nt, Homo sapiens
agucaacaucaugaaguggaaa

SEQ ID NO: 24296 - RNA, 22 nt, Homo sapiens
agucaagauggcaagguaaggc

SEQ ID NO: 24297 - RNA, 22 nt, Homo sapiens
agucacagccuuuuacuuuaga

SEQ ID NO: 24298 - RNA, 22 nt, Homo sapiens
agucacagguucuugggauuag

SEQ ID NO: 24299 - RNA, 23 nt, Homo sapiens
agucaguaugcuccuuggauccc

SEQ ID NO: 24300 - RNA, 22 nt, Homo sapiens
agucagugcauaagaaugaagu

SEQ ID NO: 24301 - RNA, 22 nt, Homo sapiens
agucaguggaguaaauguaauu

SEQ ID NO: 24302 - RNA, 22 nt, Homo sapiens
agucaugggagagaugugaucg

SEQ ID NO: 24303 - RNA, 22 nt, Homo sapiens
agugaaaugucaccuuuuagga

SEQ ID NO: 24304 - RNA, 17 nt, Homo sapiens
agugagaucauggcuua

SEQ ID NO: 24305 - RNA, 22 nt, Homo sapiens
agugagcuggagaaaagaaacu

SEQ ID NO: 24306 - RNA, 22 nt, Homo sapiens
agugagcuguuuuuacuuucug

SEQ ID NO: 24307 - RNA, 22 nt, Homo sapiens
agugauggagccaggauuuaau

SEQ ID NO: 24308 - RNA, 22 nt, Homo sapiens
agugauuuuaacuuccagcaau

SEQ ID NO: 24309 - RNA, 22 nt, Homo sapiens
agugcaauggugccaucauagc

SEQ ID NO: 24310 - RNA, 19 nt, Homo sapiens
agugcaauugccuuugugc

SEQ ID NO: 24311 - RNA, 22 nt, Homo sapiens
agugcacucuuuccucucuuac

SEQ ID NO: 24312 - RNA, 22 nt, Homo sapiens
agugcaguggcucaaaaugccu

SEQ ID NO: 24313 - RNA, 22 nt, Homo sapiens
agugcaguugucacgugccuuc

SEQ ID NO: 24314 - RNA, 22 nt, Homo sapiens
agugcauuuguucugugucagg

SEQ ID NO: 24315 - RNA, 22 nt, Homo sapiens
agugccuauugauggaaagaua

SEQ ID NO: 24316 - RNA, 22 nt, Homo sapiens
agugcuuaauagauguccagca

SEQ ID NO: 24317 - RNA, 22 nt, Homo sapiens
aguggcaaugugauguccugaa

SEQ ID NO: 24318 - RNA, 22 nt, Homo sapiens
aguggcuuuuuaguggcagaug

SEQ ID NO: 24319 - RNA, 22 nt, Homo sapiens
aguggguguuccauuggauaaa

SEQ ID NO: 24320 - RNA, 22 nt, Homo sapiens
aguggugucugaguggccaggg

SEQ ID NO: 24321 - RNA, 20 nt, Homo sapiens
agugguuuucaaauaugucu

SEQ ID NO: 24322 - RNA, 22 nt, Homo sapiens
aguuaguguugugauaaaucca

SEQ ID NO: 24323 - RNA, 22 nt, Homo sapiens
aguucaauggguuuucacucau

SEQ ID NO: 24324 - RNA, 22 nt, Homo sapiens
aguuccauuuauucucgucucu

SEQ ID NO: 24325 - RNA, 18 nt, Homo sapiens
aguuguuuuauccugccc

SEQ ID NO: 24326 - RNA, 22 nt, Homo sapiens
auaaaagcaggucuaggucagg

SEQ ID NO: 24327 - RNA, 18 nt, Homo sapiens
auaaacucaucauuuuua

SEQ ID NO: 24328 - RNA, 22 nt, Homo sapiens
auaaaguagaggugaggugcau

SEQ ID NO: 24329 - RNA, 22 nt, Homo sapiens
auaaaugcauugagaacugcug

SEQ ID NO: 24330 - RNA, 22 nt, Homo sapiens
auaaaugccuguuguuuuaagc

SEQ ID NO: 24331 - RNA, 22 nt, Homo sapiens
auaaaugcuuccagucauuaaa

SEQ ID NO: 24332 - RNA, 20 nt, Homo sapiens
auaaauguauagguguacau

SEQ ID NO: 24333 - RNA, 22 nt, Homo sapiens
auaagagugggguguuagggau

SEQ ID NO: 24334 - RNA, 22 nt, Homo sapiens
auaagaugaaggaagccauauc

SEQ ID NO: 24335 - RNA, 22 nt, Homo sapiens
auaaggcuaguguaggagccag

SEQ ID NO: 24336 - RNA, 22 nt, Homo sapiens
auaaguagaaugauggucaaaa

SEQ ID NO: 24337 - RNA, 22 nt, Homo sapiens
auaaguauuuggacuuuacugu

SEQ ID NO: 24338 - RNA, 22 nt, Homo sapiens
auaagucaauggaacagauuaa

SEQ ID NO: 24339 - RNA, 19 nt, Homo sapiens
auaagugaaucacgggggc

SEQ ID NO: 24340 - RNA, 22 nt, Homo sapiens
auaagugagugauucaguguua

SEQ ID NO: 24341 - RNA, 22 nt, Homo sapiens
auaagugcuuguugaauaauag

SEQ ID NO: 24342 - RNA, 22 nt, Homo sapiens
aucccuguaacuagcagccccu

SEQ ID NO: 24343 - RNA, 22 nt, Homo sapiens
aucccugugacgagcaucccua

SEQ ID NO: 24344 - RNA, 22 nt, Homo sapiens
aucccuguguccagcaccugug

SEQ ID NO: 24345 - RNA, 22 nt, Homo sapiens
aucccuuccuagcacuuggugu

SEQ ID NO: 24346 - RNA, 22 nt, Homo sapiens
aucccuuucucuggcuaggggg

SEQ ID NO: 24347 - RNA, 22 nt, Homo sapiens
aucccuuucugauacuuucccu

SEQ ID NO: 24348 - RNA, 22 nt, Homo sapiens
auccucugagagaguuucauaa

SEQ ID NO: 24349 - RNA, 22 nt, Homo sapiens
auccucugagaucuaggcagag

SEQ ID NO: 24350 - RNA, 22 nt, Homo sapiens
auccugagacuuugcugaaguu

SEQ ID NO: 24351 - RNA, 22 nt, Homo sapiens
auccugagacuuuucugaaguu

SEQ ID NO: 24352 - RNA, 22 nt, Homo sapiens
auccuguagagaugagggugga

SEQ ID NO: 24353 - RNA, 22 nt, Homo sapiens
auccuguaggcuaguagacagu

SEQ ID NO: 24354 - RNA, 22 nt, Homo sapiens
aucuagagacauaguaaagaau

SEQ ID NO: 24355 - RNA, 22 nt, Homo sapiens
aucucaguuaauuccaucuuuc

SEQ ID NO: 24356 - RNA, 22 nt, Homo sapiens
aucucaguucaggcuggccaca

SEQ ID NO: 24357 - RNA, 22 nt, Homo sapiens
aucucauggagguagagaguaa

SEQ ID NO: 24358 - RNA, 20 nt, Homo sapiens
aucucugggcaaaggaaaau

SEQ ID NO: 24359 - RNA, 22 nt, Homo sapiens
aucucuugccagucagaauggu

SEQ ID NO: 24360 - RNA, 22 nt, Homo sapiens
aucugcaaauaaugaagauugg

SEQ ID NO: 24361 - RNA, 22 nt, Homo sapiens
aucugguguauuggugcugggu

SEQ ID NO: 24362 - RNA, 22 nt, Homo sapiens
aucugguguggcugugauccuc

SEQ ID NO: 24363 - RNA, 22 nt, Homo sapiens
aucuuguccugagguuuuauug

SEQ ID NO: 24364 - RNA, 22 nt, Homo sapiens
aucuuuaguggcuguuuucaga

SEQ ID NO: 24365 - RNA, 22 nt, Homo sapiens
aucuuugauuguagguacaaug

SEQ ID NO: 24366 - RNA, 22 nt, Homo sapiens
augaaaacaugauuugccuguu

SEQ ID NO: 24367 - RNA, 23 nt, Homo sapiens
augaaagcccuugcaaaugcugg

SEQ ID NO: 24368 - RNA, 22 nt, Homo sapiens
augaaaugcauguuaaguccgu

SEQ ID NO: 24369 - RNA, 22 nt, Homo sapiens
augaaauugcuaucgcaguacu

SEQ ID NO: 24370 - RNA, 18 nt, Homo sapiens
augaacucaucaguucuu

SEQ ID NO: 24371 - RNA, 22 nt, Homo sapiens
augaacucaucaucuagguuuu

SEQ ID NO: 24372 - RNA, 18 nt, Homo sapiens
augaacucaucauuuuuu

SEQ ID NO: 24373 - RNA, 23 nt, Homo sapiens
augaacucaucauuuuuuauggc

SEQ ID NO: 24374 - RNA, 22 nt, Homo sapiens
augaagaucaugaagacggcuu

SEQ ID NO: 24375 - RNA, 22 nt, Homo sapiens
augaagaucucugccuuguguc

SEQ ID NO: 24376 - RNA, 20 nt, Homo sapiens
augaagugaaguuagggaac

SEQ ID NO: 24377 - RNA, 22 nt, Homo sapiens
augaauagaguuaauugaguac

SEQ ID NO: 24378 - RNA, 22 nt, Homo sapiens
augaaugcuuuuggauguaucu

SEQ ID NO: 24379 - RNA, 22 nt, Homo sapiens
augaauguaaagaaugugggaa

SEQ ID NO: 24380 - RNA, 22 nt, Homo sapiens
augaaugucuuauuuugagaaa

SEQ ID NO: 24381 - RNA, 22 nt, Homo sapiens
augaauucaucugguuuuggga

SEQ ID NO: 24382 - RNA, 22 nt, Homo sapiens
augaauuuucugauguugggua

SEQ ID NO: 24383 - RNA, 22 nt, Homo sapiens
augacaagagccuucuuuccuu

SEQ ID NO: 24384 - RNA, 22 nt, Homo sapiens
augacacugcagagauguccca

SEQ ID NO: 24385 - RNA, 22 nt, Homo sapiens
augacagcaucugugaaguugu

SEQ ID NO: 24386 - RNA, 22 nt, Homo sapiens
augacauugaaaagcaagugga

SEQ ID NO: 24387 - RNA, 22 nt, Homo sapiens
augacguugugggcucucaagc

SEQ ID NO: 24388 - RNA, 20 nt, Homo sapiens
augacuagaggacaugguaa

SEQ ID NO: 24389 - RNA, 22 nt, Homo sapiens
augacugucuugcagaggcuau

SEQ ID NO: 24390 - RNA, 22 nt, Homo sapiens
augagaacauaucaagugauug

SEQ ID NO: 24391 - RNA, 22 nt, Homo sapiens
augagaacugucaaugagagcu

SEQ ID NO: 24392 - RNA, 22 nt, Homo sapiens
augagaaugaagccuggcgugu

SEQ ID NO: 24393 - RNA, 22 nt, Homo sapiens
augagaaugauucuguuauggu

SEQ ID NO: 24394 - RNA, 22 nt, Homo sapiens
augagacaguucccuuuaucuu

SEQ ID NO: 24395 - RNA, 22 nt, Homo sapiens
augagacuagaagagaauaaua

SEQ ID NO: 24396 - RNA, 22 nt, Homo sapiens
aaggauuguaacaccaagguua

SEQ ID NO: 24397 - RNA, 22 nt, Homo sapiens
aaggcaagaagagaaccaucgg

SEQ ID NO: 24398 - RNA, 22 nt, Homo sapiens
aaggcaagagaaaauuucgagu

SEQ ID NO: 24399 - RNA, 22 nt, Homo sapiens
aaggcaagauacugguugcuga

SEQ ID NO: 24400 - RNA, 22 nt, Homo sapiens
aaggcacugaacuuaaauucug

SEQ ID NO: 24401 - RNA, 22 nt, Homo sapiens
aaggcaugcaaagaacauuuua

SEQ ID NO: 24402 - RNA, 22 nt, Homo sapiens
aaggcaugcaguacguuucuau

SEQ ID NO: 24403 - RNA, 22 nt, Homo sapiens
aaggcaugcugaguccuaaaag

SEQ ID NO: 24404 - RNA, 22 nt, Homo sapiens
aaggcgguguggauccuacagc

SEQ ID NO: 24405 - RNA, 22 nt, Homo sapiens
aaggcuguucauuuagcacagu

SEQ ID NO: 24406 - RNA, 22 nt, Homo sapiens
aaggcuuuuugcugacguccuu

SEQ ID NO: 24407 - RNA, 22 nt, Homo sapiens
aagggaauguuguggcugguug

SEQ ID NO: 24408 - RNA, 22 nt, Homo sapiens
aagguacuggaaagaggaaugg

SEQ ID NO: 24409 - RNA, 22 nt, Homo sapiens
aagguagguuccaaaauaccua

SEQ ID NO: 24410 - RNA, 22 nt, Homo sapiens
aagguaguuuucuuuaaugcug

SEQ ID NO: 24411 - RNA, 22 nt, Homo sapiens
aaggugcucucuuauguagaaa

SEQ ID NO: 24412 - RNA, 17 nt, Homo sapiens
aaggugcuucgaccucc

SEQ ID NO: 24413 - RNA, 22 nt, Homo sapiens
aagguggaguugacaauuuuca

SEQ ID NO: 24414 - RNA, 22 nt, Homo sapiens
aagguggugucagagagcuuau

SEQ ID NO: 24415 - RNA, 22 nt, Homo sapiens
aaguaaacauuuuguacaauaa

SEQ ID NO: 24416 - RNA, 22 nt, Homo sapiens
aaguaaauauccgguaguccca

SEQ ID NO: 24417 - RNA, 22 nt, Homo sapiens
aaguaaaucuuaugucagggag

SEQ ID NO: 24418 - RNA, 22 nt, Homo sapiens
aaguagcuggaugcaguggcac

SEQ ID NO: 24419 - RNA, 22 nt, Homo sapiens
aaguaguuaggaacauucucuc

SEQ ID NO: 24420 - RNA, 19 nt, Homo sapiens
aaguaguugugacagaugc

SEQ ID NO: 24421 - RNA, 22 nt, Homo sapiens
aagucaaggagagaagcuucag

SEQ ID NO: 24422 - RNA, 22 nt, Homo sapiens
aaguccccugacagaggggagg

SEQ ID NO: 24423 - RNA, 22 nt, Homo sapiens
aagugaaugugcuggaauagcu

SEQ ID NO: 24424 - RNA, 22 nt, Homo sapiens
aagugaccuaacaaugaaggcc

SEQ ID NO: 24425 - RNA, 22 nt, Homo sapiens
aagugacuagacuaugaaaccu

SEQ ID NO: 24426 - RNA, 22 nt, Homo sapiens
aagugcauguauuaguguaguc

SEQ ID NO: 24427 - RNA, 22 nt, Homo sapiens
aagugccauguggaugggcccu

SEQ ID NO: 24428 - RNA, 22 nt, Homo sapiens
aagugcucuugugggaagagag

SEQ ID NO: 24429 - RNA, 22 nt, Homo sapiens
aagugcuguccuaccuuuggga

SEQ ID NO: 24430 - RNA, 22 nt, Homo sapiens
aagugcuuacagggaacaugau

SEQ ID NO: 24431 - RNA, 22 nt, Homo sapiens
aagugcuuuuuagauaugguuu

SEQ ID NO: 24432 - RNA, 22 nt, Homo sapiens
aagugguagggucaggauugga

SEQ ID NO: 24433 - RNA, 22 nt, Homo sapiens
aagugguguuugggagcuggac

SEQ ID NO: 24434 - RNA, 22 nt, Homo sapiens
aagugucuuaccgggagggagu

SEQ ID NO: 24435 - RNA, 23 nt, Homo sapiens
aaguucaugcucaucuguuacac

SEQ ID NO: 24436 - RNA, 22 nt, Homo sapiens
aaguuguuggaguuccauuguu

SEQ ID NO: 24437 - RNA, 22 nt, Homo sapiens
aauaaagcaggguccuugcacu

SEQ ID NO: 24438 - RNA, 22 nt, Homo sapiens
aauaaagcuuugagcuuugcug

SEQ ID NO: 24439 - RNA, 22 nt, Homo sapiens
aauaagcugagagaauucuaca

SEQ ID NO: 24440 - RNA, 19 nt, Homo sapiens
aauaaugccagaugucugu

SEQ ID NO: 24441 - RNA, 22 nt, Homo sapiens
aauacugagaugugagguacua

SEQ ID NO: 24442 - RNA, 22 nt, Homo sapiens
aauacugugauaucgagcgauu

SEQ ID NO: 24443 - RNA, 22 nt, Homo sapiens
aauagagucaggguuucaccau

SEQ ID NO: 24444 - RNA, 22 nt, Homo sapiens
aauaguggcuuggacuaaauau

SEQ ID NO: 24445 - RNA, 22 nt, Homo sapiens
aauaucacaguggguguacacc

SEQ ID NO: 24446 - RNA, 22 nt, Homo sapiens
aauaucuguguauagauggggg

SEQ ID NO: 24447 - RNA, 22 nt, Homo sapiens
aauauguccaguguuuugggag

SEQ ID NO: 24448 - RNA, 22 nt, Homo sapiens
aaucacacuugauguugagcaa

SEQ ID NO: 24449 - RNA, 22 nt, Homo sapiens
aaucacauuaaugcucccucag

SEQ ID NO: 24450 - RNA, 22 nt, Homo sapiens
aaucagagcccucugagcuuca

SEQ ID NO: 24451 - RNA, 20 nt, Homo sapiens
aaucuacuugcccauuuagc

SEQ ID NO: 24452 - RNA, 22 nt, Homo sapiens
aaucucagagauaucugugucc

SEQ ID NO: 24453 - RNA, 22 nt, Homo sapiens
aaucugucaguuuuguguuaau

SEQ ID NO: 24454 - RNA, 22 nt, Homo sapiens
aaugacagccagauucuucucu

SEQ ID NO: 24455 - RNA, 22 nt, Homo sapiens
aaugacagugcuaaagaacccu

SEQ ID NO: 24456 - RNA, 22 nt, Homo sapiens
aaugaucaauguuugaggugau

SEQ ID NO: 24457 - RNA, 21 nt, Homo sapiens
accugauguuucaguuggagu

SEQ ID NO: 24458 - RNA, 22 nt, Homo sapiens
accuggcacuuagcaaaucuga

SEQ ID NO: 24459 - RNA, 22 nt, Homo sapiens
accugugguuacagucugucuc

SEQ ID NO: 24460 - RNA, 22 nt, Homo sapiens
accuugcacugagccgagauug

SEQ ID NO: 24461 - RNA, 22 nt, Homo sapiens
accuuguaucuguuaggauugc

SEQ ID NO: 24462 - RNA, 22 nt, Homo sapiens
acgugguaguacaguauuuuaa

SEQ ID NO: 24463 - RNA, 22 nt, Homo sapiens
acuagagaugcauuuguaguuu

SEQ ID NO: 24464 - RNA, 22 nt, Homo sapiens
acucagagagaacugucauuug

SEQ ID NO: 24465 - RNA, 22 nt, Homo sapiens
acucagagugggccccuagaua

SEQ ID NO: 24466 - RNA, 22 nt, Homo sapiens
acuccauuuggacucugggagg

SEQ ID NO: 24467 - RNA, 22 nt, Homo sapiens
acucuguaagcaagcuggggaa

SEQ ID NO: 24468 - RNA, 22 nt, Homo sapiens
acugaauguaaacacggagugu

SEQ ID NO: 24469 - RNA, 22 nt, Homo sapiens
acugagccuuuaaaugacuuca

SEQ ID NO: 24470 - RNA, 20 nt, Homo sapiens
acugauauguuccuguucuc

SEQ ID NO: 24471 - RNA, 23 nt, Homo sapiens
acugcaauuacguuugcaccaac

SEQ ID NO: 24472 - RNA, 22 nt, Homo sapiens
acugcacuccagcccaggugac

SEQ ID NO: 24473 - RNA, 22 nt, Homo sapiens
acugcacuccagccuccugaca

SEQ ID NO: 24474 - RNA, 22 nt, Homo sapiens
acugcacuccagccucggcaau

SEQ ID NO: 24475 - RNA, 22 nt, Homo sapiens
acugcacuccagccucguggac

SEQ ID NO: 24476 - RNA, 22 nt, Homo sapiens
acugcacuccagccugagccug

SEQ ID NO: 24477 - RNA, 22 nt, Homo sapiens
acugcacuccagccugaugaaa

SEQ ID NO: 24478 - RNA, 22 nt, Homo sapiens
acugcacuccagccugccgaca

SEQ ID NO: 24479 - RNA, 22 nt, Homo sapiens
acugcacuccagccugcugaca

SEQ ID NO: 24480 - RNA, 22 nt, Homo sapiens
acugcacuccagccuggcggac

SEQ ID NO: 24481 - RNA, 22 nt, Homo sapiens
acugcacuccagccugugcgua

SEQ ID NO: 24482 - RNA, 22 nt, Homo sapiens
acugcacuccagccuugagagc

SEQ ID NO: 24483 - RNA, 22 nt, Homo sapiens
acugcacuccagccuuggagac

SEQ ID NO: 24484 - RNA, 22 nt, Homo sapiens
acugcacuccagccuuggcggc

SEQ ID NO: 24485 - RNA, 22 nt, Homo sapiens
acugcacuccagcuugggugac

SEQ ID NO: 24486 - RNA, 22 nt, Homo sapiens
acugcacuccagcuuuggguga

SEQ ID NO: 24487 - RNA, 22 nt, Homo sapiens
acugcacuccaguuugggcagc

SEQ ID NO: 24488 - RNA, 22 nt, Homo sapiens
acugcacucccgcccgggugac

SEQ ID NO: 24489 - RNA, 19 nt, Homo sapiens
acugcacuccuccuugggu

SEQ ID NO: 24490 - RNA, 22 nt, Homo sapiens
acugcacuccuccuugggugac

SEQ ID NO: 24491 - RNA, 22 nt, Homo sapiens
acugcacuguccuagaguccuc

SEQ ID NO: 24492 - RNA, 22 nt, Homo sapiens
acugcacuuauccuccaauguu

SEQ ID NO: 24493 - RNA, 20 nt, Homo sapiens
acugcacuucagccugcugg

SEQ ID NO: 24494 - RNA, 22 nt, Homo sapiens
acugcacuucagccuguugaca

SEQ ID NO: 24495 - RNA, 22 nt, Homo sapiens
acugcacuucagccuuggcuac

SEQ ID NO: 24496 - RNA, 22 nt, Homo sapiens
acugcacuucagccuugggaaa

SEQ ID NO: 24497 - RNA, 22 nt, Homo sapiens
augcauggcagagucaggguac

SEQ ID NO: 24498 - RNA, 19 nt, Homo sapiens
augccacagugaggucaga

SEQ ID NO: 24499 - RNA, 22 nt, Homo sapiens
augccauugcacuccagccuag

SEQ ID NO: 24500 - RNA, 19 nt, Homo sapiens
augccucaguuuuguacuu

SEQ ID NO: 24501 - RNA, 22 nt, Homo sapiens
augcuacugauaagcaaucauu

SEQ ID NO: 24502 - RNA, 22 nt, Homo sapiens
auggaaaugaagggcuggcccu

SEQ ID NO: 24503 - RNA, 22 nt, Homo sapiens
auggaacauaacuauuugggga

SEQ ID NO: 24504 - RNA, 22 nt, Homo sapiens
auggaacauuauagauguaaaa

SEQ ID NO: 24505 - RNA, 22 nt, Homo sapiens
auggaagaauugucggggaugu

SEQ ID NO: 24506 - RNA, 22 nt, Homo sapiens
auggaagcugauuagauaguac

SEQ ID NO: 24507 - RNA, 22 nt, Homo sapiens
auggaaucauccuccugggagc

SEQ ID NO: 24508 - RNA, 22 nt, Homo sapiens
auggaauguaaguuauguuugc

SEQ ID NO: 24509 - RNA, 22 nt, Homo sapiens
auggaauguggaaugguaagua

SEQ ID NO: 24510 - RNA, 21 nt, Homo sapiens
auggacaugguuaggcuuugu

SEQ ID NO: 24511 - RNA, 22 nt, Homo sapiens
auggacguagauucucaaggau

SEQ ID NO: 24512 - RNA, 22 nt, Homo sapiens
auggacucauugaauuaagucc

SEQ ID NO: 24513 - RNA, 22 nt, Homo sapiens
auggacuuuuuguucagugucu

SEQ ID NO: 24514 - RNA, 22 nt, Homo sapiens
auggagcaaaacagauuuggga

SEQ ID NO: 24515 - RNA, 22 nt, Homo sapiens
auggaggccuacagaauuuugg

SEQ ID NO: 24516 - RNA, 22 nt, Homo sapiens
auggaguguucugaauccuuug

SEQ ID NO: 24517 - RNA, 19 nt, Homo sapiens
auggauacauuuucugcua

SEQ ID NO: 24518 - RNA, 22 nt, Homo sapiens
auggauaugcuuccaacugccu

SEQ ID NO: 24519 - RNA, 22 nt, Homo sapiens
auggauugucuccuugugccau

SEQ ID NO: 24520 - RNA, 22 nt, Homo sapiens
auggcaaaaaaugcaauuacuu

SEQ ID NO: 24521 - RNA, 22 nt, Homo sapiens
auggcacucaaucaaguugaga

SEQ ID NO: 24522 - RNA, 22 nt, Homo sapiens
auggcacuccagccugggcaac

SEQ ID NO: 24523 - RNA, 22 nt, Homo sapiens
auggcacugauggaaguaccuu

SEQ ID NO: 24524 - RNA, 22 nt, Homo sapiens
auggcagaaucaagccgacagc

SEQ ID NO: 24525 - RNA, 22 nt, Homo sapiens
auggcagcccucuuuauccaug

SEQ ID NO: 24526 - RNA, 22 nt, Homo sapiens
auggcagcugacacuuccgucu

SEQ ID NO: 24527 - RNA, 22 nt, Homo sapiens
auggcaguuuggucucugugcu

SEQ ID NO: 24528 - RNA, 22 nt, Homo sapiens
auggcccugggaaaggaggcau

SEQ ID NO: 24529 - RNA, 22 nt, Homo sapiens
auggcccuguguggagcugcug

SEQ ID NO: 24530 - RNA, 22 nt, Homo sapiens
auggccuaugaccguuauguug

SEQ ID NO: 24531 - RNA, 22 nt, Homo sapiens
auggccuuuuuaucucaccaag

SEQ ID NO: 24532 - RNA, 22 nt, Homo sapiens
auggcucuggauagaaugcagg

SEQ ID NO: 24533 - RNA, 22 nt, Homo sapiens
auggcugugaaaugguaggugg

SEQ ID NO: 24534 - RNA, 22 nt, Homo sapiens
auggcuguuccugggaguucua

SEQ ID NO: 24535 - RNA, 22 nt, Homo sapiens
auggcuguuuaagaguuucauu

SEQ ID NO: 24536 - RNA, 22 nt, Homo sapiens
auggcuucuuacucuucugcau

SEQ ID NO: 24537 - RNA, 22 nt, Homo sapiens
auggcuugugacccaugcuuca

SEQ ID NO: 24538 - RNA, 22 nt, Homo sapiens
auggcuuuuauuguguugaggu

SEQ ID NO: 24539 - RNA, 22 nt, Homo sapiens
auggcuuuugcccuaaauggau

SEQ ID NO: 24540 - RNA, 22 nt, Homo sapiens
augggacugggugccguggagc

SEQ ID NO: 24541 - RNA, 22 nt, Homo sapiens
augggguagguagcucggggaa

SEQ ID NO: 24542 - RNA, 18 nt, Homo sapiens
auggguguuggaaaauga

SEQ ID NO: 24543 - RNA, 22 nt, Homo sapiens
augguacuagaguaagaauugu

SEQ ID NO: 24544 - RNA, 21 nt, Homo sapiens
augguacugucucuggagaua

SEQ ID NO: 24545 - RNA, 22 nt, Homo sapiens
augguauuuugugauaccuugu

SEQ ID NO: 24546 - RNA, 22 nt, Homo sapiens
auggucccauucauucacguau

SEQ ID NO: 24547 - RNA, 22 nt, Homo sapiens
auggucuuuauuguguugagug

SEQ ID NO: 24548 - RNA, 22 nt, Homo sapiens
auggucuuuguuucuaauucug

SEQ ID NO: 24549 - RNA, 22 nt, Homo sapiens
augguguccuguuuccccagga

SEQ ID NO: 24550 - RNA, 22 nt, Homo sapiens
augguugguuaaaucuguguau

SEQ ID NO: 24551 - RNA, 22 nt, Homo sapiens
auguaaacagaugugcagcuug

SEQ ID NO: 24552 - RNA, 22 nt, Homo sapiens
auguaaacauuuggucuaaauu

SEQ ID NO: 24553 - RNA, 22 nt, Homo sapiens
cuagaguguaguuuucuuagga

SEQ ID NO: 24554 - RNA, 22 nt, Homo sapiens
cuagauuauccaacuuauuagc

SEQ ID NO: 24555 - RNA, 22 nt, Homo sapiens
cuagauuguuuccauaaugaca

SEQ ID NO: 24556 - RNA, 22 nt, Homo sapiens
cuagcagaacaauacaauucgg

SEQ ID NO: 24557 - RNA, 22 nt, Homo sapiens
cuagcagacacuuccagagagu

SEQ ID NO: 24558 - RNA, 22 nt, Homo sapiens
cuagcaggcaagauaagauuca

SEQ ID NO: 24559 - RNA, 21 nt, Homo sapiens
cuaggaccaguucuguaauuc

SEQ ID NO: 24560 - RNA, 22 nt, Homo sapiens
cuaggcacugauaguuguauuu

SEQ ID NO: 24561 - RNA, 22 nt, Homo sapiens
cuagucacauuuucaucaaaua

SEQ ID NO: 24562 - RNA, 22 nt, Homo sapiens
cuagugcaauccuuugauggua

SEQ ID NO: 24563 - RNA, 18 nt, Homo sapiens
cuaguguuucuugaauca

SEQ ID NO: 24564 - RNA, 22 nt, Homo sapiens
cuaugcuucuuaaauuaguuau

SEQ ID NO: 24565 - RNA, 22 nt, Homo sapiens
cuauuagguuggugcaaaagua

SEQ ID NO: 24566 - RNA, 22 nt, Homo sapiens
cucaaagucaagggaaagcagg

SEQ ID NO: 24567 - RNA, 18 nt, Homo sapiens
cucaaccucaugcagggc

SEQ ID NO: 24568 - RNA, 18 nt, Homo sapiens
cucacaguaacuuuuaag

SEQ ID NO: 24569 - RNA, 22 nt, Homo sapiens
cucacagucucucccuaauuuu

SEQ ID NO: 24570 - RNA, 22 nt, Homo sapiens
cucacaugcucaccugguguuc

SEQ ID NO: 24571 - RNA, 22 nt, Homo sapiens
cucacuggguguaaaacaugua

SEQ ID NO: 24572 - RNA, 22 nt, Homo sapiens
cucacugugguguccuuaggua

SEQ ID NO: 24573 - RNA, 22 nt, Homo sapiens
cucaggguacuucuccuuugcu

SEQ ID NO: 24574 - RNA, 22 nt, Homo sapiens
cucagguaguuccuuauagcaa

SEQ ID NO: 24575 - RNA, 22 nt, Homo sapiens
cucaguagaaaauacauggacu

SEQ ID NO: 24576 - RNA, 22 nt, Homo sapiens
cucagugucuggcacacagaaa

SEQ ID NO: 24577 - RNA, 22 nt, Homo sapiens
cucaguuuugccuuguuuaagg

SEQ ID NO: 24578 - RNA, 21 nt, Homo sapiens
cucauauugcuuuuccauggu

SEQ ID NO: 24579 - RNA, 19 nt, Homo sapiens
cucauggagaaggagaaua

SEQ ID NO: 24580 - RNA, 22 nt, Homo sapiens
gccaagaugcugcccacagaca

SEQ ID NO: 24581 - RNA, 22 nt, Homo sapiens
gccaagauuuaauucaucaguu

SEQ ID NO: 24582 - RNA, 22 nt, Homo sapiens
gccauugcacuccagcuugggc

SEQ ID NO: 24583 - RNA, 22 nt, Homo sapiens
gcccagauguuuggggucaugg

SEQ ID NO: 24584 - RNA, 22 nt, Homo sapiens
gcccagcguucagggaggggcu

SEQ ID NO: 24585 - RNA, 22 nt, Homo sapiens
gcccuguugcccaggcuggagu

SEQ ID NO: 24586 - RNA, 19 nt, Homo sapiens
gcggcacuggagacacagc

SEQ ID NO: 24587 - RNA, 22 nt, Homo sapiens
gcgguagcauagacugcaggac

SEQ ID NO: 24588 - RNA, 22 nt, Homo sapiens
gcuagcauucaaaugugcagcc

SEQ ID NO: 24589 - RNA, 23 nt, Homo sapiens
gcuaggagagaugaaacacaggu

SEQ ID NO: 24590 - RNA, 22 nt, Homo sapiens
gcugagaucucuugccugaacu

SEQ ID NO: 24591 - RNA, 19 nt, Homo sapiens
gcugauguuacauucuugc

SEQ ID NO: 24592 - RNA, 22 nt, Homo sapiens
gcugcguguagaguucucacug

SEQ ID NO: 24593 - RNA, 22 nt, Homo sapiens
gcugcuuuugaugacaaaaaca

SEQ ID NO: 24594 - RNA, 22 nt, Homo sapiens
gcuggcuuucuccugaucucag

SEQ ID NO: 24595 - RNA, 22 nt, Homo sapiens
gcuggguugccagguuacuuaa

SEQ ID NO: 24596 - RNA, 22 nt, Homo sapiens
gcugugguuuaguagaaagaag

SEQ ID NO: 24597 - RNA, 22 nt, Homo sapiens
gcuguguguuaucagaaauugc

SEQ ID NO: 24598 - RNA, 22 nt, Homo sapiens
gcuguguucucgaggcggggga

SEQ ID NO: 24599 - RNA, 22 nt, Homo sapiens
gcuguugguaaaaaggacauga

SEQ ID NO: 24600 - RNA, 18 nt, Homo sapiens
gcuguugucagagcacau

SEQ ID NO: 24601 - RNA, 22 nt, Homo sapiens
gcuucauggaggcugggcgcag

SEQ ID NO: 24602 - RNA, 22 nt, Homo sapiens
gcuuggugugcaagugguacua

SEQ ID NO: 24603 - RNA, 19 nt, Homo sapiens
gcuuguccacgugagauaa

SEQ ID NO: 24604 - RNA, 22 nt, Homo sapiens
gcuuguguucaagucacccuua

SEQ ID NO: 24605 - RNA, 22 nt, Homo sapiens
gcuuugcaauggcauugaccau

SEQ ID NO: 24606 - RNA, 22 nt, Homo sapiens
gcuuuguuguugaugggaaauc

SEQ ID NO: 24607 - RNA, 18 nt, Homo sapiens
ggaaaacuuuucuaagua

SEQ ID NO: 24608 - RNA, 22 nt, Homo sapiens
ggaaauguuuagcauccacuuu

SEQ ID NO: 24609 - RNA, 18 nt, Homo sapiens
ggaagccuauuuaguaac

SEQ ID NO: 24610 - RNA, 22 nt, Homo sapiens
ggaagguaauuggcuaaugaga

SEQ ID NO: 24611 - RNA, 22 nt, Homo sapiens
ggaagguaauugucagcucaua

SEQ ID NO: 24612 - RNA, 22 nt, Homo sapiens
ggaaggucaaagggaaagcaga

SEQ ID NO: 24613 - RNA, 22 nt, Homo sapiens
ggaauauaaaacuuuugacagg

SEQ ID NO: 24614 - RNA, 19 nt, Homo sapiens
ggaaugcaccaguccuugc

SEQ ID NO: 24615 - RNA, 22 nt, Homo sapiens
ggaauguauuaaggcauugggc

SEQ ID NO: 24616 - RNA, 22 nt, Homo sapiens
ggaauuaaggcaauugaaagcu

SEQ ID NO: 24617 - RNA, 22 nt, Homo sapiens
ggacaagaucuuccaccauuca

SEQ ID NO: 24618 - RNA, 22 nt, Homo sapiens
ggacacaucaugugaccaaggu

SEQ ID NO: 24619 - RNA, 22 nt, Homo sapiens
ggacagaugggcucccgggucu

SEQ ID NO: 24620 - RNA, 22 nt, Homo sapiens
ggacauguauauauaugugugu

SEQ ID NO: 24621 - RNA, 22 nt, Homo sapiens
ggacuagaggugaaaagaagac

SEQ ID NO: 24622 - RNA, 22 nt, Homo sapiens
ggacuggaagcauauuuauuuu

SEQ ID NO: 24623 - RNA, 22 nt, Homo sapiens
ggagagugacauauuucuaggc

SEQ ID NO: 24624 - RNA, 22 nt, Homo sapiens
ggaggcuaguaaaaagguagaa

SEQ ID NO: 24625 - RNA, 22 nt, Homo sapiens
ggagguaauaaguuccagugua

SEQ ID NO: 24626 - RNA, 22 nt, Homo sapiens
ggaguaggcuguccggcaccca

SEQ ID NO: 24627 - RNA, 22 nt, Homo sapiens
ggaguuuaagucuugugcaucu

SEQ ID NO: 24628 - RNA, 22 nt, Homo sapiens
ggauaacagccaggucaaacaa

SEQ ID NO: 24629 - RNA, 22 nt, Homo sapiens
ggauacauuuuuccuccucuuc

SEQ ID NO: 24630 - RNA, 22 nt, Homo sapiens
ggaucacagagcuugggaaagg

SEQ ID NO: 24631 - RNA, 23 nt, Homo sapiens
ggauggaaaguuuugagggccac

SEQ ID NO: 24632 - RNA, 22 nt, Homo sapiens
ggcaaaauauugucugguauag

SEQ ID NO: 24633 - RNA, 22 nt, Homo sapiens
ggcaaaucugcaauuacuuuug

SEQ ID NO: 24634 - RNA, 22 nt, Homo sapiens
ggcaaaugaagauggagaggcu

SEQ ID NO: 24635 - RNA, 22 nt, Homo sapiens
ggcaacaaagacauuucaacau

SEQ ID NO: 24636 - RNA, 22 nt, Homo sapiens
ggcaacaugccgaaaccacguc

SEQ ID NO: 24637 - RNA, 22 nt, Homo sapiens
ggcaagaaagaaaucaucuguc

SEQ ID NO: 24638 - RNA, 22 nt, Homo sapiens
ggcaagaaccagggauuugcgu

SEQ ID NO: 24639 - RNA, 22 nt, Homo sapiens
ggcaagaagaacuauaacuuuu

SEQ ID NO: 24640 - RNA, 22 nt, Homo sapiens
ggcaagaggagauucugcuccc

SEQ ID NO: 24641 - RNA, 19 nt, Homo sapiens
ggcaagaguuguucugugu

SEQ ID NO: 24642 - RNA, 22 nt, Homo sapiens
ggcaaggugaugaaugucuaca

SEQ ID NO: 24643 - RNA, 19 nt, Homo sapiens
ggcaauacuuucuuguugg

SEQ ID NO: 24644 - RNA, 22 nt, Homo sapiens
ggcaaugucagcuaaugaugga

SEQ ID NO: 24645 - RNA, 22 nt, Homo sapiens
ggcacaauugcagcaauaaaca

SEQ ID NO: 24646 - RNA, 22 nt, Homo sapiens
ggcacaguuaagugcuaccuaa

SEQ ID NO: 24647 - RNA, 19 nt, Homo sapiens
ggcaccuuuuccaaaaaug

SEQ ID NO: 24648 - RNA, 22 nt, Homo sapiens
ggcacgguggcucacgccugua

SEQ ID NO: 24649 - RNA, 19 nt, Homo sapiens
ggcacugugugagugagga

SEQ ID NO: 24650 - RNA, 22 nt, Homo sapiens
ggcagagucuugcaucuuuaga

SEQ ID NO: 24651 - RNA, 22 nt, Homo sapiens
ggcagaucauuggccucaguuu

SEQ ID NO: 24652 - RNA, 22 nt, Homo sapiens
ggcagcacaauuuucugaugga

SEQ ID NO: 24653 - RNA, 17 nt, Homo sapiens
ggcaggaauuaauguca

SEQ ID NO: 24654 - RNA, 21 nt, Homo sapiens
uagcaaauugcuauuaaggca

SEQ ID NO: 24655 - RNA, 22 nt, Homo sapiens
uagcaccacaaucaagauacag

SEQ ID NO: 24656 - RNA, 22 nt, Homo sapiens
uagcaccugugcacaccaggca

SEQ ID NO: 24657 - RNA, 22 nt, Homo sapiens
uagcacuauuuuucacuauccu

SEQ ID NO: 24658 - RNA, 22 nt, Homo sapiens
uagcagcagugguguauuuaga

SEQ ID NO: 24659 - RNA, 22 nt, Homo sapiens
uagcagcauaaauggacuaaga

SEQ ID NO: 24660 - RNA, 19 nt, Homo sapiens
uagcagcaugauuuauaau

SEQ ID NO: 24661 - RNA, 22 nt, Homo sapiens
uagcagccaggaagggcuggcu

SEQ ID NO: 24662 - RNA, 22 nt, Homo sapiens
ucucaauuugauuacauucaua

SEQ ID NO: 24663 - RNA, 22 nt, Homo sapiens
ucucacaccccucucauauacc

SEQ ID NO: 24664 - RNA, 22 nt, Homo sapiens
ucucacagccauuucucccucu

SEQ ID NO: 24665 - RNA, 19 nt, Homo sapiens
ucucacagcucuacuaugu

SEQ ID NO: 24666 - RNA, 22 nt, Homo sapiens
ucucagagccuaggguuuuuca

SEQ ID NO: 24667 - RNA, 22 nt, Homo sapiens
ucucagcggacaggccggccag

SEQ ID NO: 24668 - RNA, 22 nt, Homo sapiens
ucucagugaauguggaaaaagc

SEQ ID NO: 24669 - RNA, 22 nt, Homo sapiens
ucucagugacugcugggucccc

SEQ ID NO: 24670 - RNA, 22 nt, Homo sapiens
ucucauagaggcagagaguaaa

SEQ ID NO: 24671 - RNA, 20 nt, Homo sapiens
ucucauggagggaaagagca

SEQ ID NO: 24672 - RNA, 20 nt, Homo sapiens
ucucauggagguagagaaua

SEQ ID NO: 24673 - RNA, 22 nt, Homo sapiens
ucuccaguuuccuucgucuauc

SEQ ID NO: 24674 - RNA, 22 nt, Homo sapiens
ucuccauuguccagaugaggaa

SEQ ID NO: 24675 - RNA, 20 nt, Homo sapiens
ucucccaaacagcaggcccu

SEQ ID NO: 24676 - RNA, 17 nt, Homo sapiens
ucucccaucccuuucuc

SEQ ID NO: 24677 - RNA, 22 nt, Homo sapiens
ucucccauccguacacggauug

SEQ ID NO: 24678 - RNA, 22 nt, Homo sapiens
ucucugauuauugcauuucauu

SEQ ID NO: 24679 - RNA, 22 nt, Homo sapiens
ucucugguuaugucauuaagca

SEQ ID NO: 24680 - RNA, 22 nt, Homo sapiens
ucucugguuuguggaaucuuag

SEQ ID NO: 24681 - RNA, 22 nt, Homo sapiens
ucucuguuuauuuuugguguau

SEQ ID NO: 24682 - RNA, 22 nt, Homo sapiens
ucugaaucguucccaugcagga

SEQ ID NO: 24683 - RNA, 22 nt, Homo sapiens
ucugacagugagagaaaucuga

SEQ ID NO: 24684 - RNA, 22 nt, Homo sapiens
ucugacagugugaauauugacu

SEQ ID NO: 24685 - RNA, 22 nt, Homo sapiens
ucugacucugugaugggcccaa

SEQ ID NO: 24686 - RNA, 22 nt, Homo sapiens
ucugagaugagacuuugaauuu

SEQ ID NO: 24687 - RNA, 22 nt, Homo sapiens
ucugcauaucaugcagaacuau

SEQ ID NO: 24688 - RNA, 22 nt, Homo sapiens
ucugccuuuucaugugggaugg

SEQ ID NO: 24689 - RNA, 23 nt, Homo sapiens
ucugcggguguggacccuagugc

SEQ ID NO: 24690 - RNA, 22 nt, Homo sapiens
ucuggaauguaaaguuuauggg

SEQ ID NO: 24691 - RNA, 22 nt, Homo sapiens
ucuggcaagauauccauugcuu

SEQ ID NO: 24692 - RNA, 20 nt, Homo sapiens
ucuggccccucuaaaucuca

SEQ ID NO: 24693 - RNA, 22 nt, Homo sapiens
ucuggccuccuaugagaaucga

SEQ ID NO: 24694 - RNA, 22 nt, Homo sapiens
ucuggcuucugacuuaggggac

SEQ ID NO: 24695 - RNA, 22 nt, Homo sapiens
ucugggguuagucaaagguaug

SEQ ID NO: 24696 - RNA, 22 nt, Homo sapiens
ucuggugugcucuggacuugca

SEQ ID NO: 24697 - RNA, 22 nt, Homo sapiens
ucugguuccuuggcuucggguc

SEQ ID NO: 24698 - RNA, 22 nt, Homo sapiens
ucuguacugccaaguuucuuua

SEQ ID NO: 24699 - RNA, 22 nt, Homo sapiens
ucugucacugaaucccugucac

SEQ ID NO: 24700 - RNA, 22 nt, Homo sapiens
ucugucuuguccucacccuaga

SEQ ID NO: 24701 - RNA, 22 nt, Homo sapiens
ucugucuuugccuaaguuuguc

SEQ ID NO: 24702 - RNA, 22 nt, Homo sapiens
ucugucuuugucaggaccagag

SEQ ID NO: 24703 - RNA, 22 nt, Homo sapiens
ucugugguaagaaacgcauguc

SEQ ID NO: 24704 - RNA, 22 nt, Homo sapiens
ucuguggugggcuccacccagu

SEQ ID NO: 24705 - RNA, 18 nt, Homo sapiens
ucugugguguaaauacgu

SEQ ID NO: 24706 - RNA, 22 nt, Homo sapiens
ucugugguucuagcuacuuugg

SEQ ID NO: 24707 - RNA, 22 nt, Homo sapiens
ucugugguuguugcauggaaug

SEQ ID NO: 24708 - RNA, 21 nt, Homo sapiens
ucuguguugaucucacuggga

SEQ ID NO: 24709 - RNA, 22 nt, Homo sapiens
ucuguguuugaucaagauugua

SEQ ID NO: 24710 - RNA, 22 nt, Homo sapiens
ucuguuguuguuuuaagagaca

SEQ ID NO: 24711 - RNA, 22 nt, Homo sapiens
ucuuauuuggggaaaggguccu

SEQ ID NO: 24712 - RNA, 22 nt, Homo sapiens
ucuugcauuuuuaaauagugcu

SEQ ID NO: 24713 - RNA, 22 nt, Homo sapiens
ucuuggcaaagaauuuuuggcu

SEQ ID NO: 24714 - RNA, 22 nt, Homo sapiens
ucuuggccaugaauggcaaggc

SEQ ID NO: 24715 - RNA, 20 nt, Homo sapiens
ucuugggaauguagccuagg

SEQ ID NO: 24716 - RNA, 22 nt, Homo sapiens
ucuuggguggauucauucuuuc

SEQ ID NO: 24717 - RNA, 21 nt, Homo sapiens
ucuugguauguauuuaggagg

SEQ ID NO: 24718 - RNA, 22 nt, Homo sapiens
ucuugguugaaaauucauaaua

SEQ ID NO: 24719 - RNA, 23 nt, Homo sapiens
ucuuguacuuugagugagcaugg

SEQ ID NO: 24720 - RNA, 22 nt, Homo sapiens
ucuuugauuaugcagauggguu

SEQ ID NO: 24721 - RNA, 23 nt, Homo sapiens
ucuuuggcucuaauauaccuugu

SEQ ID NO: 24722 - RNA, 22 nt, Homo sapiens
ucuuugguaauggaugucugau

SEQ ID NO: 24723 - RNA, 22 nt, Homo sapiens
ucuuugguaugugcaugugcuu

SEQ ID NO: 24724 - RNA, 22 nt, Homo sapiens
ucuuugguuucugucucuguaa

SEQ ID NO: 24725 - RNA, 22 nt, Homo sapiens
ucuuuguuggaguccaaggaua

SEQ ID NO: 24726 - RNA, 22 nt, Homo sapiens
ucuuuuguaaaaugaggaggug

SEQ ID NO: 24727 - RNA, 22 nt, Homo sapiens
ucuuuugugagucagccucucc

SEQ ID NO: 24728 - RNA, 20 nt, Homo sapiens
ucuuuuuguggccccagagu

SEQ ID NO: 24729 - RNA, 22 nt, Homo sapiens
ugaaaaguuguugaaggcuuca

SEQ ID NO: 24730 - RNA, 22 nt, Homo sapiens
ugaaacugcagugggcuuggca

SEQ ID NO: 24731 - RNA, 22 nt, Homo sapiens
ugaaauaguuaaguugccuagu

SEQ ID NO: 24732 - RNA, 22 nt, Homo sapiens
ugaaaugaucaguuugguuacu

SEQ ID NO: 24733 - RNA, 21 nt, Homo sapiens
ugaaaugcaugugcacauuaa

SEQ ID NO: 24734 - RNA, 22 nt, Homo sapiens
ugaaauggaaagaguguagacu

SEQ ID NO: 24735 - RNA, 22 nt, Homo sapiens
ugaaauggaagaagucccuuuu

SEQ ID NO: 24736 - RNA, 22 nt, Homo sapiens
ugaaauggugcggucugcagca

SEQ ID NO: 24737 - RNA, 22 nt, Homo sapiens
ugaaaugguuaugugaggagau

SEQ ID NO: 24738 - RNA, 22 nt, Homo sapiens
ugaaauguaaguugucuagucu

SEQ ID NO: 24739 - RNA, 22 nt, Homo sapiens
ugaaauguugggugauggaauc

SEQ ID NO: 24740 - RNA, 22 nt, Homo sapiens
ugaaauuauucuuaccaaggug

SEQ ID NO: 24741 - RNA, 22 nt, Homo sapiens
ugaaauuguuugcaaggauagg

SEQ ID NO: 24742 - RNA, 21 nt, Homo sapiens
ugaacacuggacugagugucc

SEQ ID NO: 24743 - RNA, 22 nt, Homo sapiens
ugaacagcacguuuauucagaa

SEQ ID NO: 24744 - RNA, 22 nt, Homo sapiens
ugaacagcuaucuugucagugu

SEQ ID NO: 24745 - RNA, 22 nt, Homo sapiens
ugaacucauccuuucuuauggc

SEQ ID NO: 24746 - RNA, 22 nt, Homo sapiens
ugaacugagacuagacuuguuc

SEQ ID NO: 24747 - RNA, 22 nt, Homo sapiens
ugaagacauuuuugggugugua

SEQ ID NO: 24748 - RNA, 22 nt, Homo sapiens
ugaagacucauacuugaaucag

SEQ ID NO: 24749 - RNA, 22 nt, Homo sapiens
ugaagagucuaaaucugucuuc

SEQ ID NO: 24750 - RNA, 22 nt, Homo sapiens
ugaagcuaggauuaauuuucau

SEQ ID NO: 24751 - RNA, 20 nt, Homo sapiens
ugaaggaggucauuuauacc

SEQ ID NO: 24752 - RNA, 22 nt, Homo sapiens
ugaaggaguauggauaagucgu

SEQ ID NO: 24753 - RNA, 22 nt, Homo sapiens
ugaaggccgggcaugguggcuc

SEQ ID NO: 24754 - RNA, 21 nt, Homo sapiens
ugaaguagcauaggaugucaa

SEQ ID NO: 24755 - RNA, 22 nt, Homo sapiens
uauggcauuguuggugaugaua

SEQ ID NO: 24756 - RNA, 22 nt, Homo sapiens
uauggcauuuuguaagggcuug

SEQ ID NO: 24757 - RNA, 22 nt, Homo sapiens
uauggccccuacaugugcaaaa

SEQ ID NO: 24758 - RNA, 22 nt, Homo sapiens
uauggcuucuuauucuuucccg

SEQ ID NO: 24759 - RNA, 22 nt, Homo sapiens
uauggcuucuuuaaauugaggu

SEQ ID NO: 24760 - RNA, 21 nt, Homo sapiens
ugaaugcuuuaaauauuagaa

SEQ ID NO: 24761 - RNA, 22 nt, Homo sapiens
ugaaugguaaagaaaagcacug

SEQ ID NO: 24762 - RNA, 22 nt, Homo sapiens
ugaaugguaauuuaguaggcac

SEQ ID NO: 24763 - RNA, 21 nt, Homo sapiens
ugaaugucuaggcagaaguuu

SEQ ID NO: 24764 - RNA, 23 nt, Homo sapiens
ugacaaccucaugcuuugucaug

SEQ ID NO: 24765 - RNA, 22 nt, Homo sapiens
ugacaagacuacauaucccauu

SEQ ID NO: 24766 - RNA, 22 nt, Homo sapiens
ugacaagauauggucuuaucaa

SEQ ID NO: 24767 - RNA, 22 nt, Homo sapiens
ugacacauguagacaucuggug

SEQ ID NO: 24768 - RNA, 19 nt, Homo sapiens
ugacacuguuggugggagg

SEQ ID NO: 24769 - RNA, 17 nt, Homo sapiens
ugacagaaacuuguugu

SEQ ID NO: 24770 - RNA, 22 nt, Homo sapiens
ugacagcuguugaggcauuuau

SEQ ID NO: 24771 - RNA, 22 nt, Homo sapiens
ugacagguuggaauuaugggag

SEQ ID NO: 24772 - RNA, 22 nt, Homo sapiens
ugacaguaaacagucuugauua

SEQ ID NO: 24773 - RNA, 22 nt, Homo sapiens
ugacaguguccucauucccaac

SEQ ID NO: 24774 - RNA, 22 nt, Homo sapiens
ugacauagcuauuaagugaugc

SEQ ID NO: 24775 - RNA, 18 nt, Homo sapiens
ugacaucauuuagaaagg

SEQ ID NO: 24776 - RNA, 22 nt, Homo sapiens
ugacaugagauuugggaggggc

SEQ ID NO: 24777 - RNA, 22 nt, Homo sapiens
ugacaugaugagcaauaauggc

SEQ ID NO: 24778 - RNA, 22 nt, Homo sapiens
ugacaugauuguauauuuagaa

SEQ ID NO: 24779 - RNA, 22 nt, Homo sapiens
ugacauggagggugcggcugca

SEQ ID NO: 24780 - RNA, 22 nt, Homo sapiens
ugacauguccaggugguccugu

SEQ ID NO: 24781 - RNA, 21 nt, Homo sapiens
ugacauuauuucaugucagua

SEQ ID NO: 24782 - RNA, 22 nt, Homo sapiens
ugaccacagaaagugagggagc

SEQ ID NO: 24783 - RNA, 17 nt, Homo sapiens
ugaccacugauucuacu

SEQ ID NO: 24784 - RNA, 19 nt, Homo sapiens
ugaccagggacagaaacca

SEQ ID NO: 24785 - RNA, 22 nt, Homo sapiens
ugaccuguuugaaauugccaau

SEQ ID NO: 24786 - RNA, 22 nt, Homo sapiens
ugacggaggcauuggaagcuug

SEQ ID NO: 24787 - RNA, 22 nt, Homo sapiens
ugacuaaggaaggauuaugugc

SEQ ID NO: 24788 - RNA, 22 nt, Homo sapiens
ugacuagagacagaaacuaaaa

SEQ ID NO: 24789 - RNA, 22 nt, Homo sapiens
ugacuaggaggcuggaggauga

SEQ ID NO: 24790 - RNA, 22 nt, Homo sapiens
ugacuauaggauaacaugcauu

SEQ ID NO: 24791 - RNA, 22 nt, Homo sapiens
ugacucaagagccugacucauc

SEQ ID NO: 24792 - RNA, 22 nt, Homo sapiens
ugacucaguuucucagguagua

SEQ ID NO: 24793 - RNA, 22 nt, Homo sapiens
ugacugaguaguauuccacuau

SEQ ID NO: 24794 - RNA, 22 nt, Homo sapiens
ugacugucuagauagagcuugg

SEQ ID NO: 24795 - RNA, 22 nt, Homo sapiens
ugacugugcagcuccaucaggg

SEQ ID NO: 24796 - RNA, 23 nt, Homo sapiens
ugacuuaggccucaacuaugacu

SEQ ID NO: 24797 - RNA, 22 nt, Homo sapiens
ugacuugaggcucgcacaaguu

SEQ ID NO: 24798 - RNA, 22 nt, Homo sapiens
ugacuugaucauuacacauucu

SEQ ID NO: 24799 - RNA, 23 nt, Homo sapiens
ugacuuguccagugauaguucgu

SEQ ID NO: 24800 - RNA, 22 nt, Homo sapiens
ugacuuuagaauuuuauccaga

SEQ ID NO: 24801 - RNA, 22 nt, Homo sapiens
ugagaacagcagcuugggacac

SEQ ID NO: 24802 - RNA, 22 nt, Homo sapiens
ugagaacaugcacuugagguug

SEQ ID NO: 24803 - RNA, 16 nt, Homo sapiens
ugagaacaugugauau

SEQ ID NO: 24804 - RNA, 19 nt, Homo sapiens
ugagaacaugugguauuug

SEQ ID NO: 24805 - RNA, 18 nt, Homo sapiens
ugagaacauguguacaca

SEQ ID NO: 24806 - RNA, 22 nt, Homo sapiens
ugagaaccucugugugcccacu

SEQ ID NO: 24807 - RNA, 22 nt, Homo sapiens
ugagaacuaaugaagaauuuau

SEQ ID NO: 24808 - RNA, 22 nt, Homo sapiens
ugagaacuuugucuuuuacucu

SEQ ID NO: 24809 - RNA, 22 nt, Homo sapiens
ugagaauauuugaagauguuag

SEQ ID NO: 24810 - RNA, 22 nt, Homo sapiens
ugagaauauuuuccaugucuca

SEQ ID NO: 24811 - RNA, 19 nt, Homo sapiens
ugagaauguuaccaggucc

SEQ ID NO: 24812 - RNA, 22 nt, Homo sapiens
ugagacauacuuacaggggaug

SEQ ID NO: 24813 - RNA, 22 nt, Homo sapiens
ugagacaucucuccugagacag

SEQ ID NO: 24814 - RNA, 22 nt, Homo sapiens
ugagaccaacagauuccaguuc

SEQ ID NO: 24815 - RNA, 22 nt, Homo sapiens
ugagacgaagucuugcucuguu

SEQ ID NO: 24816 - RNA, 22 nt, Homo sapiens
ugagacggagucucgcucuguc

SEQ ID NO: 24817 - RNA, 22 nt, Homo sapiens
ugagacggagucuugcccuguc

SEQ ID NO: 24818 - RNA, 22 nt, Homo sapiens
ugagacggaguuauuuauaaua

SEQ ID NO: 24819 - RNA, 22 nt, Homo sapiens
ugagacggaguuucgcucuugu

SEQ ID NO: 24820 - RNA, 22 nt, Homo sapiens
ugagacugagucucccucuguc

SEQ ID NO: 24821 - RNA, 22 nt, Homo sapiens
ugagacugagucuugcucuauu

SEQ ID NO: 24822 - RNA, 22 nt, Homo sapiens
ugagacugaguuucgcucuugu

SEQ ID NO: 24823 - RNA, 22 nt, Homo sapiens
ugagacugaguuucucucuugu

SEQ ID NO: 24824 - RNA, 22 nt, Homo sapiens
ugagacugauaggacauuuucu

SEQ ID NO: 24825 - RNA, 22 nt, Homo sapiens
ugagacugguaauguguagggc

SEQ ID NO: 24826 - RNA, 22 nt, Homo sapiens
ugagacugguuaauugauaaag

SEQ ID NO: 24827 - RNA, 22 nt, Homo sapiens
ugagacuguuuuggggaacuuc

SEQ ID NO: 24828 - RNA, 22 nt, Homo sapiens
ugagagacagacauuaucuuau

SEQ ID NO: 24829 - RNA, 22 nt, Homo sapiens
ugagagaugaacucugauaugu

SEQ ID NO: 24830 - RNA, 22 nt, Homo sapiens
ugagagcugcauucuugaaagc

SEQ ID NO: 24831 - RNA, 22 nt, Homo sapiens
ugagagcuuugaugcacuguuu

SEQ ID NO: 24832 - RNA, 22 nt, Homo sapiens
ugagagcuuuuuugccugguga

SEQ ID NO: 24833 - RNA, 22 nt, Homo sapiens
ugagaggugaauggcaggcuca

SEQ ID NO: 24834 - RNA, 22 nt, Homo sapiens
ugagaggugauaaagcaagggu

SEQ ID NO: 24835 - RNA, 22 nt, Homo sapiens
ugagauaaagcauguacugugu

SEQ ID NO: 24836 - RNA, 22 nt, Homo sapiens
ugagauaguacuuuuuuaaagg

SEQ ID NO: 24837 - RNA, 22 nt, Homo sapiens
ugagaucaacugagucagagca

SEQ ID NO: 24838 - RNA, 22 nt, Homo sapiens
ugagaucacgccacugcacucc

SEQ ID NO: 24839 - RNA, 22 nt, Homo sapiens
ugagaucacuaagagguaaugg

SEQ ID NO: 24840 - RNA, 22 nt, Homo sapiens
ugagaucagugaagaaguguuu

SEQ ID NO: 24841 - RNA, 19 nt, Homo sapiens
ugagauccacugaagauuc

SEQ ID NO: 24842 - RNA, 23 nt, Homo sapiens
ugagaucuacagaucucagaucu

SEQ ID NO: 24843 - RNA, 22 nt, Homo sapiens
ugagaucugucuuuauaguauu

SEQ ID NO: 24844 - RNA, 19 nt, Homo sapiens
ugagaugaagacagggguu

SEQ ID NO: 24845 - RNA, 22 nt, Homo sapiens
ugagaugagaaucaguucuaau

SEQ ID NO: 24846 - RNA, 22 nt, Homo sapiens
ugagaugagagaaugcuugccu

SEQ ID NO: 24847 - RNA, 22 nt, Homo sapiens
ugagaugagucucgcucuguca

SEQ ID NO: 24848 - RNA, 20 nt, Homo sapiens
ugagaugcauugggauguuu

SEQ ID NO: 24849 - RNA, 22 nt, Homo sapiens
ugagauggaguuucacuuuugu

SEQ ID NO: 24850 - RNA, 22 nt, Homo sapiens
ugagauggaguuucgcccuugu

SEQ ID NO: 24851 - RNA, 22 nt, Homo sapiens
ugagauggaucuuggauuugaa

SEQ ID NO: 24852 - RNA, 22 nt, Homo sapiens
ugagauggcugaauucagaaua

SEQ ID NO: 24853 - RNA, 22 nt, Homo sapiens
ugagauggguaauuaaauggug

SEQ ID NO: 24854 - RNA, 22 nt, Homo sapiens
ugagauguuuguuucagugccu

SEQ ID NO: 24855 - RNA, 22 nt, Homo sapiens
ugagauucucugauuguagguc

SEQ ID NO: 24856 - RNA, 23 nt, Homo sapiens
uauugcacuaugguaacccuuuu

SEQ ID NO: 24857 - RNA, 20 nt, Homo sapiens
ugccagugugucaauuuaua

SEQ ID NO: 24858 - RNA, 22 nt, Homo sapiens
ugccauagagauuuguggaacu

SEQ ID NO: 24859 - RNA, 19 nt, Homo sapiens
ugccauguaacaggaaaau

SEQ ID NO: 24860 - RNA, 22 nt, Homo sapiens
ugcccaguggacagaaagucau

SEQ ID NO: 24861 - RNA, 21 nt, Homo sapiens
ugcccaguggcuuggggucag

SEQ ID NO: 24862 - RNA, 22 nt, Homo sapiens
ugccuacagaaggggcucagca

SEQ ID NO: 24863 - RNA, 22 nt, Homo sapiens
ugccuaggcuggaaugcagugg

SEQ ID NO: 24864 - RNA, 22 nt, Homo sapiens
ugccuaguagaaggugaacaug

SEQ ID NO: 24865 - RNA, 22 nt, Homo sapiens
ugccuaguggaaggagagcaaa

SEQ ID NO: 24866 - RNA, 22 nt, Homo sapiens
ugccugagccagguuuuaggag

SEQ ID NO: 24867 - RNA, 22 nt, Homo sapiens
ugccugagcccagcccuguagu

SEQ ID NO: 24868 - RNA, 22 nt, Homo sapiens
ugccugauacccucugucucuc

SEQ ID NO: 24869 - RNA, 22 nt, Homo sapiens
ugccuggagagcuccuacauau

SEQ ID NO: 24870 - RNA, 22 nt, Homo sapiens
ugccuucuguuaaacgaggaug

SEQ ID NO: 24871 - RNA, 16 nt, Homo sapiens
ugccuucuucuguauu

SEQ ID NO: 24872 - RNA, 22 nt, Homo sapiens
ugcuacccuucgucucucuggu

SEQ ID NO: 24873 - RNA, 22 nt, Homo sapiens
ugcuagagaaauauauuugggg

SEQ ID NO: 24874 - RNA, 23 nt, Homo sapiens
ugcugagaccuagauccuaaaga

SEQ ID NO: 24875 - RNA, 22 nt, Homo sapiens
ugcugcaaacaggcaucugugg

SEQ ID NO: 24876 - RNA, 22 nt, Homo sapiens
ugcugcaaacaugagaggaagu

SEQ ID NO: 24877 - RNA, 22 nt, Homo sapiens
ugcugcaaucucggcacuuugg

SEQ ID NO: 24878 - RNA, 22 nt, Homo sapiens
ugcugcacaguucuuaagauua

SEQ ID NO: 24879 - RNA, 22 nt, Homo sapiens
ugcugcacuuauggcucugagg

SEQ ID NO: 24880 - RNA, 22 nt, Homo sapiens
ugcugcuguuguuguuacuagc

SEQ ID NO: 24881 - RNA, 22 nt, Homo sapiens
ugcugguauuauguuauccaga

SEQ ID NO: 24882 - RNA, 22 nt, Homo sapiens
ugcugguuuaaaaugcaaauuc

SEQ ID NO: 24883 - RNA, 22 nt, Homo sapiens
ugcuguuguuugaugaaguaau

SEQ ID NO: 24884 - RNA, 22 nt, Homo sapiens
ugcuuaggcuaacaaaaauagc

SEQ ID NO: 24885 - RNA, 18 nt, Homo sapiens
ugcuuagucauuuucaau

SEQ ID NO: 24886 - RNA, 22 nt, Homo sapiens
ugcuucauuggccaccaggaag

SEQ ID NO: 24887 - RNA, 21 nt, Homo sapiens
ugcuuuggucauacuucuucc

SEQ ID NO: 24888 - RNA, 22 nt, Homo sapiens
ugcuuuguuauauggggauucu

SEQ ID NO: 24889 - RNA, 22 nt, Homo sapiens
ugcuuuguugaaaaucauuugg

SEQ ID NO: 24890 - RNA, 22 nt, Homo sapiens
uggaaaguacugagguccaccu

SEQ ID NO: 24891 - RNA, 22 nt, Homo sapiens
uggaaaguacuugaguuuguau

SEQ ID NO: 24892 - RNA, 22 nt, Homo sapiens
uggaaaguaguucuaaucuaag

SEQ ID NO: 24893 - RNA, 22 nt, Homo sapiens
uggaacaccaggcuggcguggc

SEQ ID NO: 24894 - RNA, 19 nt, Homo sapiens
uggaacauaaaaguugguu

SEQ ID NO: 24895 - RNA, 22 nt, Homo sapiens
uggaacugauauugauggaaaa

SEQ ID NO: 24896 - RNA, 22 nt, Homo sapiens
uggaagacaggcuguauuuuaa

SEQ ID NO: 24897 - RNA, 22 nt, Homo sapiens
uggaagacauugggugaagggu

SEQ ID NO: 24898 - RNA, 22 nt, Homo sapiens
uggaagacauuuuggaccuugg

SEQ ID NO: 24899 - RNA, 23 nt, Homo sapiens
uggaagacuccucucuuggcugc

SEQ ID NO: 24900 - RNA, 22 nt, Homo sapiens
uggaagacucuagucucuugag

SEQ ID NO: 24901 - RNA, 22 nt, Homo sapiens
uggaagauggaguuuuaucauu

SEQ ID NO: 24902 - RNA, 22 nt, Homo sapiens
uggaagauucuagaagauucca

SEQ ID NO: 24903 - RNA, 22 nt, Homo sapiens
uggaaggcuucauauguaaaga

SEQ ID NO: 24904 - RNA, 20 nt, Homo sapiens
uggaaguaagaauauaggug

SEQ ID NO: 24905 - RNA, 22 nt, Homo sapiens
uggaaguagauagauuguguca

SEQ ID NO: 24906 - RNA, 22 nt, Homo sapiens
uggaagucaugcugcaagaaca

SEQ ID NO: 24907 - RNA, 22 nt, Homo sapiens
uggaagucuucauuauguauag

SEQ ID NO: 24908 - RNA, 22 nt, Homo sapiens
uggaagugucugugcccagcuc

SEQ ID NO: 24909 - RNA, 22 nt, Homo sapiens
uggaaguuaaaugacucuuucu

SEQ ID NO: 24910 - RNA, 22 nt, Homo sapiens
uggaaguuaaauuaguugauga

SEQ ID NO: 24911 - RNA, 22 nt, Homo sapiens
uggaaucuacuaaagcaaaauc

SEQ ID NO: 24912 - RNA, 21 nt, Homo sapiens
uggaaucuauagaggcaguag

SEQ ID NO: 24913 - RNA, 20 nt, Homo sapiens
uggaaucugaagaucucagu

SEQ ID NO: 24914 - RNA, 21 nt, Homo sapiens
uggaaugaauggccaacaugg

SEQ ID NO: 24915 - RNA, 22 nt, Homo sapiens
uggaaugcuaagcaugugggag

SEQ ID NO: 24916 - RNA, 19 nt, Homo sapiens
uggaauggauuuaaaugug

SEQ ID NO: 24917 - RNA, 22 nt, Homo sapiens
uggaaugugaauaacuuccuuc

SEQ ID NO: 24918 - RNA, 22 nt, Homo sapiens
uggaauguggacucuuaugggg

SEQ ID NO: 24919 - RNA, 21 nt, Homo sapiens
uggaauuaauggagagguguu

SEQ ID NO: 24920 - RNA, 22 nt, Homo sapiens
uggaauuuacuuauuuaggggc

SEQ ID NO: 24921 - RNA, 22 nt, Homo sapiens
uggaauuuagguugauaguaua

SEQ ID NO: 24922 - RNA, 22 nt, Homo sapiens
uggacagagagaccggcauuuu

SEQ ID NO: 24923 - RNA, 18 nt, Homo sapiens
uggacagugauuauccau

SEQ ID NO: 24924 - RNA, 22 nt, Homo sapiens
uggacaugaagggcacaggagg

SEQ ID NO: 24925 - RNA, 21 nt, Homo sapiens
uggaccccuacuucucaccau

SEQ ID NO: 24926 - RNA, 21 nt, Homo sapiens
uggaccccuuccagucaucau

SEQ ID NO: 24927 - RNA, 22 nt, Homo sapiens
uggacuaaagaaacauuccgug

SEQ ID NO: 24928 - RNA, 22 nt, Homo sapiens
uggacugagauuucagcugcca

SEQ ID NO: 24929 - RNA, 22 nt, Homo sapiens
uggagcccuaaacuucuaauau

SEQ ID NO: 24930 - RNA, 22 nt, Homo sapiens
uggagcccuaguuccucauaac

SEQ ID NO: 24931 - RNA, 22 nt, Homo sapiens
uggagguaggacgaagaacucu

SEQ ID NO: 24932 - RNA, 21 nt, Homo sapiens
uggagugaagaguuuauugac

SEQ ID NO: 24933 - RNA, 22 nt, Homo sapiens
uggagugauaugguuauauggg

SEQ ID NO: 24934 - RNA, 21 nt, Homo sapiens
uggagugcaacacuagguaua

SEQ ID NO: 24935 - RNA, 22 nt, Homo sapiens
uggagugcaauggcaccaucuu

SEQ ID NO: 24936 - RNA, 22 nt, Homo sapiens
uggagugcaauggugagaucuu

SEQ ID NO: 24937 - RNA, 22 nt, Homo sapiens
uggaguguaauuagccaucagu

SEQ ID NO: 24938 - RNA, 22 nt, Homo sapiens
uggauagugauaagguagauga

SEQ ID NO: 24939 - RNA, 22 nt, Homo sapiens
uggauccaucacgccucuuccc

SEQ ID NO: 24940 - RNA, 22 nt, Homo sapiens
uggauugcaaaaucuuuuugag

SEQ ID NO: 24941 - RNA, 22 nt, Homo sapiens
uggcaaaauauuuugguuucug

SEQ ID NO: 24942 - RNA, 22 nt, Homo sapiens
uggcaaaauggaauauguuggg

SEQ ID NO: 24943 - RNA, 22 nt, Homo sapiens
uggcaaauagcaauaggagggu

SEQ ID NO: 24944 - RNA, 22 nt, Homo sapiens
uggcaaauguaguacccaauag

SEQ ID NO: 24945 - RNA, 22 nt, Homo sapiens
uggcaaauuccaaaguuaauuc

SEQ ID NO: 24946 - RNA, 21 nt, Homo sapiens
uggcaacauggauggauucug

SEQ ID NO: 24947 - RNA, 22 nt, Homo sapiens
uggcaacuugcaaccucauucu

SEQ ID NO: 24948 - RNA, 22 nt, Homo sapiens
uggcaagaacaacaauuacuuu

SEQ ID NO: 24949 - RNA, 22 nt, Homo sapiens
uggcaagaaccacaguuacuuu

SEQ ID NO: 24950 - RNA, 22 nt, Homo sapiens
uggcaagaagagcaugagacca

SEQ ID NO: 24951 - RNA, 23 nt, Homo sapiens
uggcaagaauucuuaccgugugg

SEQ ID NO: 24952 - RNA, 22 nt, Homo sapiens
uggcaagagcaaaauguacagu

SEQ ID NO: 24953 - RNA, 22 nt, Homo sapiens
uggcaagagggaugcaagguuu

SEQ ID NO: 24954 - RNA, 22 nt, Homo sapiens
uggcaagaucacaauuacuuuu

SEQ ID NO: 24955 - RNA, 19 nt, Homo sapiens
uggcaaugucagcagagau

SEQ ID NO: 24956 - RNA, 19 nt, Homo sapiens
uggcacauguauacuuaug

SEQ ID NO: 24957 - RNA, 22 nt, Homo sapiens
ugaguugagauaagguuacauu

SEQ ID NO: 24958 - RNA, 22 nt, Homo sapiens
ugaguuguagcuauaguuucuu

SEQ ID NO: 24959 - RNA, 22 nt, Homo sapiens
ugaguuuaucuaaagaccuggg

SEQ ID NO: 24960 - RNA, 22 nt, Homo sapiens
ugauaacugaucuggauuugua

SEQ ID NO: 24961 - RNA, 22 nt, Homo sapiens
ugauaagaaauuguucauguag

SEQ ID NO: 24962 - RNA, 22 nt, Homo sapiens
ugauaagugagauagcaaguga

SEQ ID NO: 24963 - RNA, 20 nt, Homo sapiens
ugauaaguugcacuuuccuu

SEQ ID NO: 24964 - RNA, 22 nt, Homo sapiens
ugauaauguuaggcuuuauuca

SEQ ID NO: 24965 - RNA, 18 nt, Homo sapiens
ugauaucaaugauagcca

SEQ ID NO: 24966 - RNA, 22 nt, Homo sapiens
ugauaucucuugccuccaaaug

SEQ ID NO: 24967 - RNA, 22 nt, Homo sapiens
ugauaugaaagggaaauaagug

SEQ ID NO: 24968 - RNA, 22 nt, Homo sapiens
ugauauggcuuggcuaugucac

SEQ ID NO: 24969 - RNA, 21 nt, Homo sapiens
ugauaugguagaagagagaca

SEQ ID NO: 24970 - RNA, 22 nt, Homo sapiens
ugauaugucacuugaucauggu

SEQ ID NO: 24971 - RNA, 21 nt, Homo sapiens
ugaucacaugaaaaccaugca

SEQ ID NO: 24972 - RNA, 22 nt, Homo sapiens
ugauccagugcucaguuggagu

SEQ ID NO: 24973 - RNA, 22 nt, Homo sapiens
ugauccccucacauuauuauau

SEQ ID NO: 24974 - RNA, 22 nt, Homo sapiens
ugaugaaguauaggaagggcuu

SEQ ID NO: 24975 - RNA, 22 nt, Homo sapiens
ugaugacacugauuucuucaau

SEQ ID NO: 24976 - RNA, 22 nt, Homo sapiens
ugauggcauuuggaguugggac

SEQ ID NO: 24977 - RNA, 22 nt, Homo sapiens
ugauguguuuuguaguucaacu

SEQ ID NO: 24978 - RNA, 22 nt, Homo sapiens
ugauguugacuguaggcagaga

SEQ ID NO: 24979 - RNA, 22 nt, Homo sapiens
ugauuggagaacaaacugcaua

SEQ ID NO: 24980 - RNA, 18 nt, Homo sapiens
ugcaaacauguguguguu

SEQ ID NO: 24981 - RNA, 22 nt, Homo sapiens
ugcaaaucuuguguaguuguga

SEQ ID NO: 24982 - RNA, 22 nt, Homo sapiens
ugcaaauguuauuuugguuucu

SEQ ID NO: 24983 - RNA, 19 nt, Homo sapiens
ugcaaauucuaaaaacuga

SEQ ID NO: 24984 - RNA, 22 nt, Homo sapiens
ugcaacacauugccccugcucu

SEQ ID NO: 24985 - RNA, 22 nt, Homo sapiens
ugcaagaaucagccuaucauua

SEQ ID NO: 24986 - RNA, 21 nt, Homo sapiens
ugcaagaaucaggaagcugcc

SEQ ID NO: 24987 - RNA, 22 nt, Homo sapiens
ugcaagaaucuuucaggcuagc

SEQ ID NO: 24988 - RNA, 22 nt, Homo sapiens
ugcaagaggagacuguacucag

SEQ ID NO: 24989 - RNA, 22 nt, Homo sapiens
ugcaagauaggcaguuugcacu

SEQ ID NO: 24990 - RNA, 22 nt, Homo sapiens
ugcaauauccucuacuauaggu

SEQ ID NO: 24991 - RNA, 22 nt, Homo sapiens
ugcaccacugcacugccugggu

SEQ ID NO: 24992 - RNA, 22 nt, Homo sapiens
ugcaccacuguacuccagucug

SEQ ID NO: 24993 - RNA, 22 nt, Homo sapiens
ugcaccauugcacuccagccug

SEQ ID NO: 24994 - RNA, 22 nt, Homo sapiens
ugcaccauugcauacuuaauua

SEQ ID NO: 24995 - RNA, 16 nt, Homo sapiens
ugcagaguaggugaau

SEQ ID NO: 24996 - RNA, 22 nt, Homo sapiens
ugcagagucuguccugccugcc

SEQ ID NO: 24997 - RNA, 17 nt, Homo sapiens
ugcagcacacugauggg

SEQ ID NO: 24998 - RNA, 23 nt, Homo sapiens
ugcagcacacugaugggucuuga

SEQ ID NO: 24999 - RNA, 18 nt, Homo sapiens
ugcagcaucaguacccag

SEQ ID NO: 25000 - RNA, 22 nt, Homo sapiens
ugcagguaggcaguaucauuua

SEQ ID NO: 25001 - RNA, 22 nt, Homo sapiens
ugcaguaggcccagcgggaggc

SEQ ID NO: 25002 - RNA, 22 nt, Homo sapiens
ugcagugugauuuucuggcuga

SEQ ID NO: 25003 - RNA, 22 nt, Homo sapiens
ugcaguguggcucacgccugua

SEQ ID NO: 25004 - RNA, 22 nt, Homo sapiens
ugcauaugcagcauuuaugauu

SEQ ID NO: 25005 - RNA, 22 nt, Homo sapiens
ugcauauguugagaugcauauu

SEQ ID NO: 25006 - RNA, 22 nt, Homo sapiens
ugcauauucaaggcaggccauu

SEQ ID NO: 25007 - RNA, 22 nt, Homo sapiens
ugcauauuuuauaaagauggaa

SEQ ID NO: 25008 - RNA, 22 nt, Homo sapiens
ugcaucaggcugcuuauuacaa

SEQ ID NO: 25009 - RNA, 22 nt, Homo sapiens
ugcaugaugcugagauuuggga

SEQ ID NO: 25010 - RNA, 22 nt, Homo sapiens
ugcauggagauauacaguuuuu

SEQ ID NO: 25011 - RNA, 22 nt, Homo sapiens
ugcauggaggagcuccccgcag

SEQ ID NO: 25012 - RNA, 20 nt, Homo sapiens
ugcauguccucacuuacuug

SEQ ID NO: 25013 - RNA, 22 nt, Homo sapiens
ugcauuaucagauguuugcuuu

SEQ ID NO: 25014 - RNA, 22 nt, Homo sapiens
ugcauuguaggauguuuagcag

SEQ ID NO: 25015 - RNA, 21 nt, Homo sapiens
ugcauuguugcugagagcagg

SEQ ID NO: 25016 - RNA, 22 nt, Homo sapiens
ugccaagaacauuuucuguuuu

SEQ ID NO: 25017 - RNA, 22 nt, Homo sapiens
ugccaguauuuuacugaggauu

SEQ ID NO: 25018 - RNA, 22 nt, Homo sapiens
ugccaguauuuuauugagcauu

SEQ ID NO: 25019 - RNA, 22 nt, Homo sapiens
ugccaguguugccuuucacuag

SEQ ID NO: 25020 - RNA, 22 nt, Homo sapiens
ugccaucauuaauauuaggcau

SEQ ID NO: 25021 - RNA, 22 nt, Homo sapiens
ugccaugaagagaggaagcagu

SEQ ID NO: 25022 - RNA, 22 nt, Homo sapiens
ugccaugaagaucccugaaaug

SEQ ID NO: 25023 - RNA, 19 nt, Homo sapiens
ugccauguagcacaugguc

SEQ ID NO: 25024 - RNA, 22 nt, Homo sapiens
ugccuaggcccaguccucagaa

SEQ ID NO: 25025 - RNA, 22 nt, Homo sapiens
ugccuagucuauugagagucuu

SEQ ID NO: 25026 - RNA, 22 nt, Homo sapiens
ugcgccauugcacucuagccug

SEQ ID NO: 25027 - RNA, 22 nt, Homo sapiens
ugcuagaugcuguagggauuua

SEQ ID NO: 25028 - RNA, 22 nt, Homo sapiens
ugcuaucauugauuagugaugu

SEQ ID NO: 25029 - RNA, 21 nt, Homo sapiens
ugcucaugaguaaugcaguga

SEQ ID NO: 25030 - RNA, 21 nt, Homo sapiens
ugcugcacuucuuuugcugug

SEQ ID NO: 25031 - RNA, 22 nt, Homo sapiens
ugcugcuguuaucauuuuacca

SEQ ID NO: 25032 - RNA, 22 nt, Homo sapiens
ugcugguaguuuaugacuaauu

SEQ ID NO: 25033 - RNA, 22 nt, Homo sapiens
ugcugguauuuggaccagccug

SEQ ID NO: 25034 - RNA, 19 nt, Homo sapiens
ugcuuaguuuuauguguaa

SEQ ID NO: 25035 - RNA, 19 nt, Homo sapiens
ugcuuauccagagaaacuu

SEQ ID NO: 25036 - RNA, 22 nt, Homo sapiens
ugcuugagacacauaugaauuu

SEQ ID NO: 25037 - RNA, 22 nt, Homo sapiens
ugcuuugguagaaaucuuuggu

SEQ ID NO: 25038 - RNA, 22 nt, Homo sapiens
uggaaaauuaggggagguuaua

SEQ ID NO: 25039 - RNA, 21 nt, Homo sapiens
uggaaacuucuagcuuacgua

SEQ ID NO: 25040 - RNA, 20 nt, Homo sapiens
uggaaaguaagucaugauau

SEQ ID NO: 25041 - RNA, 22 nt, Homo sapiens
uggaaaguccaagccaaccggg

SEQ ID NO: 25042 - RNA, 22 nt, Homo sapiens
uggaagacaaguguuagcaugg

SEQ ID NO: 25043 - RNA, 22 nt, Homo sapiens
uggaagacuuuagaggcuuaua

SEQ ID NO: 25044 - RNA, 22 nt, Homo sapiens
uggaagaugggaccucaguuuu

SEQ ID NO: 25045 - RNA, 22 nt, Homo sapiens
uggaagcauagcagcgugugug

SEQ ID NO: 25046 - RNA, 22 nt, Homo sapiens
uggaagccuagauucuuuucuu

SEQ ID NO: 25047 - RNA, 20 nt, Homo sapiens
uggaagccuggugcuaucuu

SEQ ID NO: 25048 - RNA, 22 nt, Homo sapiens
uggaagguaaguuuugagcauu

SEQ ID NO: 25049 - RNA, 22 nt, Homo sapiens
uggaaguaaccaugaauggaau

SEQ ID NO: 25050 - RNA, 22 nt, Homo sapiens
ugacucuagagcugccuguggc

SEQ ID NO: 25051 - RNA, 22 nt, Homo sapiens
ugacuggagucuugcucugucg

SEQ ID NO: 25052 - RNA, 22 nt, Homo sapiens
ugacuuaugcaacucugaugug

SEQ ID NO: 25053 - RNA, 22 nt, Homo sapiens
ugacuugaaacgugaacagauc

SEQ ID NO: 25054 - RNA, 22 nt, Homo sapiens
ugacuugaacuucuaugucacc

SEQ ID NO: 25055 - RNA, 20 nt, Homo sapiens
ugacuuguccgagguccccc

SEQ ID NO: 25056 - RNA, 22 nt, Homo sapiens
ugagaacagauggcuuuauuau

SEQ ID NO: 25057 - RNA, 16 nt, Homo sapiens
ugagaacaugcagcau

SEQ ID NO: 25058 - RNA, 22 nt, Homo sapiens
ugaguucaauuguauuuuauua

SEQ ID NO: 25059 - RNA, 18 nt, Homo sapiens
ugaguucauuagacuucc

SEQ ID NO: 25060 - RNA, 22 nt, Homo sapiens
ugaguucuuccuaucucugccu

SEQ ID NO: 25061 - RNA, 22 nt, Homo sapiens
ugauagucuuugcuggugaccu

SEQ ID NO: 25062 - RNA, 18 nt, Homo sapiens
ugauaucaucacaauuga

SEQ ID NO: 25063 - RNA, 22 nt, Homo sapiens
ugauaugacagcucugcugcca

SEQ ID NO: 25064 - RNA, 22 nt, Homo sapiens
ugauaugaucgcccuagcuuga

SEQ ID NO: 25065 - RNA, 23 nt, Homo sapiens
ugauaugccuaggaguauauuuu

SEQ ID NO: 25066 - RNA, 18 nt, Homo sapiens
ugauaugguuuggcucug

SEQ ID NO: 25067 - RNA, 20 nt, Homo sapiens
ugauaugguuuggcuguguu

SEQ ID NO: 25068 - RNA, 22 nt, Homo sapiens
ugauauguaacuacuccuuaua

SEQ ID NO: 25069 - RNA, 22 nt, Homo sapiens
ugauaugucccucgacaucagg

SEQ ID NO: 25070 - RNA, 22 nt, Homo sapiens
ugauauguguaaacaauguaua

SEQ ID NO: 25071 - RNA, 20 nt, Homo sapiens
ugauauuuucugagcaggaa

SEQ ID NO: 25072 - RNA, 22 nt, Homo sapiens
ugaucuguguauauugaaccag

SEQ ID NO: 25073 - RNA, 22 nt, Homo sapiens
ugaugacucuguggccccaggc

SEQ ID NO: 25074 - RNA, 22 nt, Homo sapiens
ugaugaugaaugaucuuuuaca

SEQ ID NO: 25075 - RNA, 20 nt, Homo sapiens
ugaugcaaaucuuuaaaagu

SEQ ID NO: 25076 - RNA, 22 nt, Homo sapiens
ugaugcugaguggcuauuugaa

SEQ ID NO: 25077 - RNA, 22 nt, Homo sapiens
ugauggcauuucauguuuguaa

SEQ ID NO: 25078 - RNA, 22 nt, Homo sapiens
ugauggccuguucuccauaugu

SEQ ID NO: 25079 - RNA, 20 nt, Homo sapiens
ugauguccaggcagagguuu

SEQ ID NO: 25080 - RNA, 22 nt, Homo sapiens
ugauuuccaugagaacaugccu

SEQ ID NO: 25081 - RNA, 22 nt, Homo sapiens
ugauuugucucucagcccuacu

SEQ ID NO: 25082 - RNA, 22 nt, Homo sapiens
ugauuugucugcaggaauagug

SEQ ID NO: 25083 - RNA, 22 nt, Homo sapiens
ugauuuguuucaggaguuuucu

SEQ ID NO: 25084 - RNA, 22 nt, Homo sapiens
ugcaaagaaauuuuggugacca

SEQ ID NO: 25085 - RNA, 22 nt, Homo sapiens
ugcaaaguccucauucuuaccc

SEQ ID NO: 25086 - RNA, 22 nt, Homo sapiens
ugcaaugugaaauaagcacauc

SEQ ID NO: 25087 - RNA, 22 nt, Homo sapiens
ugcacaguccagugcccacuga

SEQ ID NO: 25088 - RNA, 22 nt, Homo sapiens
ugcaccaauucuaaacaguucu

SEQ ID NO: 25089 - RNA, 23 nt, Homo sapiens
ugcaccacuacacacucuugggu

SEQ ID NO: 25090 - RNA, 22 nt, Homo sapiens
ugcaccacugcaccccagucug

SEQ ID NO: 25091 - RNA, 22 nt, Homo sapiens
ugcaccacugcacuccacccug

SEQ ID NO: 25092 - RNA, 22 nt, Homo sapiens
ugcaccacugcacuccagcuug

SEQ ID NO: 25093 - RNA, 22 nt, Homo sapiens
ugcaccacugcacuccaggcug

SEQ ID NO: 25094 - RNA, 22 nt, Homo sapiens
ugcaccacugcuagccugggua

SEQ ID NO: 25095 - RNA, 22 nt, Homo sapiens
ugcacuguggucugagagacag

SEQ ID NO: 25096 - RNA, 22 nt, Homo sapiens
ugcagcacaguagguuugcaau

SEQ ID NO: 25097 - RNA, 20 nt, Homo sapiens
ugcagcacugggaaugcagu

SEQ ID NO: 25098 - RNA, 22 nt, Homo sapiens
ugcagcucagcugcggaguuuu

SEQ ID NO: 25099 - RNA, 18 nt, Homo sapiens
ugcagcuuugugauuggc

SEQ ID NO: 25100 - RNA, 22 nt, Homo sapiens
ugcagguacuugacaacuuggg

SEQ ID NO: 25101 - RNA, 22 nt, Homo sapiens
ugcaguagugugaucuuggcuc

SEQ ID NO: 25102 - RNA, 22 nt, Homo sapiens
ugcagugugaaagagccugaca

SEQ ID NO: 25103 - RNA, 22 nt, Homo sapiens
ugcaguguucuuuagaggaaau

SEQ ID NO: 25104 - RNA, 22 nt, Homo sapiens
ugcauacugggagguugggugu

SEQ ID NO: 25105 - RNA, 19 nt, Homo sapiens
ugcauaggguuacauacuc

SEQ ID NO: 25106 - RNA, 22 nt, Homo sapiens
ugcauauguauacaugugccau

SEQ ID NO: 25107 - RNA, 22 nt, Homo sapiens
ugcauauguugaaccagccuug

SEQ ID NO: 25108 - RNA, 22 nt, Homo sapiens
ugcauauucgaguuauuuuggg

SEQ ID NO: 25109 - RNA, 21 nt, Homo sapiens
ugcaugguagucacaugauuc

SEQ ID NO: 25110 - RNA, 22 nt, Homo sapiens
ugccaaaaugggcuuuauaccg

SEQ ID NO: 25111 - RNA, 22 nt, Homo sapiens
ugccaagauuucaggaauuaag

SEQ ID NO: 25112 - RNA, 22 nt, Homo sapiens
ugccaaggagucagucccuaga

SEQ ID NO: 25113 - RNA, 22 nt, Homo sapiens
ugccagagacguagggaauauu

SEQ ID NO: 25114 - RNA, 22 nt, Homo sapiens
ugccagaugcaguguucaacaa

SEQ ID NO: 25115 - RNA, 22 nt, Homo sapiens
ugccagaugcuggugugagggg

SEQ ID NO: 25116 - RNA, 22 nt, Homo sapiens
ugccaggaugaggucaauguuu

SEQ ID NO: 25117 - RNA, 22 nt, Homo sapiens
ugccaguauuuuguugaagauu

SEQ ID NO: 25118 - RNA, 22 nt, Homo sapiens
ugccaguguuuuguugaagauu

SEQ ID NO: 25119 - RNA, 22 nt, Homo sapiens
ugccauagcaaugguaagcuga

SEQ ID NO: 25120 - RNA, 22 nt, Homo sapiens
ugccaugaaguaauggcaaaaa

SEQ ID NO: 25121 - RNA, 22 nt, Homo sapiens
ugccaugucauagguuaagccu

SEQ ID NO: 25122 - RNA, 22 nt, Homo sapiens
ugccauugcacuccagccuggg

SEQ ID NO: 25123 - RNA, 22 nt, Homo sapiens
ugcccuuugucagaugaguagg

SEQ ID NO: 25124 - RNA, 18 nt, Homo sapiens
ugccuacugggcucaagc

SEQ ID NO: 25125 - RNA, 22 nt, Homo sapiens
ugccuagaaacacuauuucucc

SEQ ID NO: 25126 - RNA, 23 nt, Homo sapiens
ugccuagaugcugcccugggaca

SEQ ID NO: 25127 - RNA, 20 nt, Homo sapiens
ugccugacacucuuugcuuc

SEQ ID NO: 25128 - RNA, 21 nt, Homo sapiens
ugccuuuguaguaggugucuu

SEQ ID NO: 25129 - RNA, 22 nt, Homo sapiens
ugcgccauugcacuccagucuu

SEQ ID NO: 25130 - RNA, 22 nt, Homo sapiens
ugcuagaagaucacacacauca

SEQ ID NO: 25131 - RNA, 22 nt, Homo sapiens
ugcuaugucagccaggcugguc

SEQ ID NO: 25132 - RNA, 22 nt, Homo sapiens
ugcucaccugcugcucaccucc

SEQ ID NO: 25133 - RNA, 22 nt, Homo sapiens
ugcucaguuuaaaacuuuugag

SEQ ID NO: 25134 - RNA, 21 nt, Homo sapiens
ugcuccauuuucuagccugaa

SEQ ID NO: 25135 - RNA, 23 nt, Homo sapiens
ugcuccccucauggaugaauaaa

SEQ ID NO: 25136 - RNA, 18 nt, Homo sapiens
ugcuccccugggugagca

SEQ ID NO: 25137 - RNA, 20 nt, Homo sapiens
ugcugcacuuaagcaugggc

SEQ ID NO: 25138 - RNA, 22 nt, Homo sapiens
ugcuggugauuaaauccugaag

SEQ ID NO: 25139 - RNA, 22 nt, Homo sapiens
ugcuggugucaucaaggcuuug

SEQ ID NO: 25140 - RNA, 22 nt, Homo sapiens
ugcuuaggcuuccuuacaguau

SEQ ID NO: 25141 - RNA, 22 nt, Homo sapiens
ugcuuaguguugacccucugcc

SEQ ID NO: 25142 - RNA, 22 nt, Homo sapiens
uggaaaacaugcacauuggauu

SEQ ID NO: 25143 - RNA, 22 nt, Homo sapiens
uggaaauuaacagggauugucc

SEQ ID NO: 25144 - RNA, 20 nt, Homo sapiens
uggaaauuaaccuuucaggu

SEQ ID NO: 25145 - RNA, 22 nt, Homo sapiens
uggaaauuaagucuuuccugag

SEQ ID NO: 25146 - RNA, 22 nt, Homo sapiens
uggaacacauaaauagcauagu

SEQ ID NO: 25147 - RNA, 22 nt, Homo sapiens
uugccacuucucuugccccauu

SEQ ID NO: 25148 - RNA, 22 nt, Homo sapiens
uugccauggaguagaauugaag

SEQ ID NO: 25149 - RNA, 22 nt, Homo sapiens
uugcccuuuagguaacuauaua

SEQ ID NO: 25150 - RNA, 22 nt, Homo sapiens
uugccgggugcaguggcucaug

SEQ ID NO: 25151 - RNA, 22 nt, Homo sapiens
uugccuaggcuggagugcagug

SEQ ID NO: 25152 - RNA, 22 nt, Homo sapiens
uugccugagaagccaagaauaa

SEQ ID NO: 25153 - RNA, 22 nt, Homo sapiens
uugcuaagucaagagaaaugau

SEQ ID NO: 25154 - RNA, 22 nt, Homo sapiens
uugcuagagaugagggaugugu

SEQ ID NO: 25155 - RNA, 22 nt, Homo sapiens
uugcucaggcuagaguucagcu

SEQ ID NO: 25156 - RNA, 22 nt, Homo sapiens
uugcuuuguuacugcaguuucc

SEQ ID NO: 25157 - RNA, 22 nt, Homo sapiens
uuggaaaaauccaccuugaucu

SEQ ID NO: 25158 - RNA, 22 nt, Homo sapiens
uuggaaacauuuaugguaacag

SEQ ID NO: 25159 - RNA, 22 nt, Homo sapiens
aggaccaugguauugcuuuggg

SEQ ID NO: 25160 - RNA, 22 nt, Homo sapiens
aggagcacaggacuuugauuau

SEQ ID NO: 25161 - RNA, 22 nt, Homo sapiens
aggagcacuggccuuggaguca

SEQ ID NO: 25162 - RNA, 22 nt, Homo sapiens
aggaggauugcuuucaucuuuu

SEQ ID NO: 25163 - RNA, 22 nt, Homo sapiens
aggagguagggugugaaacagc

SEQ ID NO: 25164 - RNA, 22 nt, Homo sapiens
aggagguagucugucccuuagc

SEQ ID NO: 25165 - RNA, 22 nt, Homo sapiens
aggaguguguauuaaugaaauu

SEQ ID NO: 25166 - RNA, 22 nt, Homo sapiens
aggaucauugacuauuauaagg

SEQ ID NO: 25167 - RNA, 22 nt, Homo sapiens
aggcaaaugccagcaaucacac

SEQ ID NO: 25168 - RNA, 22 nt, Homo sapiens
aggcaacaugguaaaacccugu

SEQ ID NO: 25169 - RNA, 22 nt, Homo sapiens
aggcacggugucucaugccugu

SEQ ID NO: 25170 - RNA, 22 nt, Homo sapiens
aggcaugugugcagacugucug

SEQ ID NO: 25171 - RNA, 22 nt, Homo sapiens
agggagcaaaguggucuuucuc

SEQ ID NO: 25172 - RNA, 22 nt, Homo sapiens
agggcaguguuaggacugucug

SEQ ID NO: 25173 - RNA, 22 nt, Homo sapiens
aggguaguaggcuugggauugg

SEQ ID NO: 25174 - RNA, 20 nt, Homo sapiens
agguacacugacaugccuuc

SEQ ID NO: 25175 - RNA, 22 nt, Homo sapiens
agguacuuucccaaccauacug

SEQ ID NO: 25176 - RNA, 22 nt, Homo sapiens
agguaguguuauuugcagcuga

SEQ ID NO: 25177 - RNA, 22 nt, Homo sapiens
agguauguaugucuguacagcg

SEQ ID NO: 25178 - RNA, 22 nt, Homo sapiens
agguauuuucaacuuagaaugg

SEQ ID NO: 25179 - RNA, 21 nt, Homo sapiens
aggucaguaagaaugcagcac

SEQ ID NO: 25180 - RNA, 22 nt, Homo sapiens
agguccacuuacuacuccuguu

SEQ ID NO: 25181 - RNA, 22 nt, Homo sapiens
agguccauuauuuucauucaug

SEQ ID NO: 25182 - RNA, 22 nt, Homo sapiens
aggugcaauggugguuuugugg

SEQ ID NO: 25183 - RNA, 22 nt, Homo sapiens
aggugcugagcagagaauccug

SEQ ID NO: 25184 - RNA, 22 nt, Homo sapiens
aggugguauuucaaaguggcag

SEQ ID NO: 25185 - RNA, 22 nt, Homo sapiens
agguuaucccgcauuauuuggu

SEQ ID NO: 25186 - RNA, 20 nt, Homo sapiens
agguuauuauaauuagaaga

SEQ ID NO: 25187 - RNA, 18 nt, Homo sapiens
agguuauuucccaagacu

SEQ ID NO: 25188 - RNA, 20 nt, Homo sapiens
agguucaaaucccaaucaug

SEQ ID NO: 25189 - RNA, 22 nt, Homo sapiens
aguaaagcuacucacugugggc

SEQ ID NO: 25190 - RNA, 22 nt, Homo sapiens
aguaacacaccugcauggugug

SEQ ID NO: 25191 - RNA, 22 nt, Homo sapiens
aguacacuguuaaaaagaagug

SEQ ID NO: 25192 - RNA, 21 nt, Homo sapiens
aguagcacugugucuuacaaa

SEQ ID NO: 25193 - RNA, 22 nt, Homo sapiens
aguaucacaggcaaaacagaau

SEQ ID NO: 25194 - RNA, 20 nt, Homo sapiens
agucaguuuauuuucucucu

SEQ ID NO: 25195 - RNA, 21 nt, Homo sapiens
agucauaggaguacauaaugc

SEQ ID NO: 25196 - RNA, 22 nt, Homo sapiens
agucgguguuacugacagaaug

SEQ ID NO: 25197 - RNA, 23 nt, Homo sapiens
agucuguguuuacaggcucucug

SEQ ID NO: 25198 - RNA, 22 nt, Homo sapiens
agugaauuguucaacaggagga

SEQ ID NO: 25199 - RNA, 22 nt, Homo sapiens
agugagcugcagucuggggucc

SEQ ID NO: 25200 - RNA, 22 nt, Homo sapiens
agugaucauuugaauugaugau

SEQ ID NO: 25201 - RNA, 22 nt, Homo sapiens
agugcaaggacauuuagguugu

SEQ ID NO: 25202 - RNA, 22 nt, Homo sapiens
agugcaaugauccggugcuggg

SEQ ID NO: 25203 - RNA, 22 nt, Homo sapiens
agugcacuccagccugggcaac

SEQ ID NO: 25204 - RNA, 22 nt, Homo sapiens
agugcaguggugccaucauaac

SEQ ID NO: 25205 - RNA, 22 nt, Homo sapiens
agugcagugguuaggagccagg

SEQ ID NO: 25206 - RNA, 22 nt, Homo sapiens
agugcauaugucuuuuuggaag

SEQ ID NO: 25207 - RNA, 22 nt, Homo sapiens
aguggaaucuguuauacuaacu

SEQ ID NO: 25208 - RNA, 22 nt, Homo sapiens
aguggaauuaagaaacugaauu

SEQ ID NO: 25209 - RNA, 22 nt, Homo sapiens
aguggaguguaaagcgucuuuu

SEQ ID NO: 25210 - RNA, 22 nt, Homo sapiens
aguggcacaauuuugacucccc

SEQ ID NO: 25211 - RNA, 22 nt, Homo sapiens
aguggcacuauucucagaguca

SEQ ID NO: 25212 - RNA, 22 nt, Homo sapiens
agugggccccuagaggugaggu

SEQ ID NO: 25213 - RNA, 22 nt, Homo sapiens
agugguuugaucacagcucacu

SEQ ID NO: 25214 - RNA, 22 nt, Homo sapiens
aguguuuuuaucaugaaagggu

SEQ ID NO: 25215 - RNA, 22 nt, Homo sapiens
aguucaaugcucuuucuacuau

SEQ ID NO: 25216 - RNA, 22 nt, Homo sapiens
aguugcaagucuugaguaaaga

SEQ ID NO: 25217 - RNA, 22 nt, Homo sapiens
aguuggcacugagcugugauug

SEQ ID NO: 25218 - RNA, 22 nt, Homo sapiens
auaaacugucaguggagaguaa

SEQ ID NO: 25219 - RNA, 22 nt, Homo sapiens
auaaagcuauuccucucuuuuu

SEQ ID NO: 25220 - RNA, 22 nt, Homo sapiens
auaaagguaagcacuauccuga

SEQ ID NO: 25221 - RNA, 22 nt, Homo sapiens
auaaaguguuuaguauaggcaa

SEQ ID NO: 25222 - RNA, 22 nt, Homo sapiens
auaaaugcaaugguauuuuuga

SEQ ID NO: 25223 - RNA, 19 nt, Homo sapiens
auaaaugccuacaagggug

SEQ ID NO: 25224 - RNA, 22 nt, Homo sapiens
auaaaugcuuagaucuguauau

SEQ ID NO: 25225 - RNA, 22 nt, Homo sapiens
auaaauucauuuaagcuccuua

SEQ ID NO: 25226 - RNA, 22 nt, Homo sapiens
auaacaggaaauacagggcuuu

SEQ ID NO: 25227 - RNA, 22 nt, Homo sapiens
auaacauggaguuugucauuua

SEQ ID NO: 25228 - RNA, 22 nt, Homo sapiens
auaagagcaggcuucuggccag

SEQ ID NO: 25229 - RNA, 22 nt, Homo sapiens
auaagaucauuugcuaagaggg

SEQ ID NO: 25230 - RNA, 22 nt, Homo sapiens
auaaggcagcugcuaaaaggca

SEQ ID NO: 25231 - RNA, 22 nt, Homo sapiens
auaauaucagguugugaugaug

SEQ ID NO: 25232 - RNA, 22 nt, Homo sapiens
auaaugcuuuucuagguugcau

SEQ ID NO: 25233 - RNA, 22 nt, Homo sapiens
auacaagcaguccaacuccaua

SEQ ID NO: 25234 - RNA, 22 nt, Homo sapiens
auacaaggaaugaagagauuug

SEQ ID NO: 25235 - RNA, 22 nt, Homo sapiens
auacaaguuauuugaacugcgg

SEQ ID NO: 25236 - RNA, 22 nt, Homo sapiens
auacacgugcagaacaugcagg

SEQ ID NO: 25237 - RNA, 22 nt, Homo sapiens
auacacgugccauguuggugug

SEQ ID NO: 25238 - RNA, 22 nt, Homo sapiens
auacagacacagucagaggggu

SEQ ID NO: 25239 - RNA, 22 nt, Homo sapiens
auacaguaaugucuuaggcugu

SEQ ID NO: 25240 - RNA, 22 nt, Homo sapiens
auacagucuguuagauuuccuc

SEQ ID NO: 25241 - RNA, 22 nt, Homo sapiens
auacaguguucugggaagaagu

SEQ ID NO: 25242 - RNA, 22 nt, Homo sapiens
auacaugugccauguucgugug

SEQ ID NO: 25243 - RNA, 19 nt, Homo sapiens
auacccacuagguuacuua

SEQ ID NO: 25244 - RNA, 22 nt, Homo sapiens
auacccaguaguggaauugcua

SEQ ID NO: 25245 - RNA, 22 nt, Homo sapiens
auacguacauaugcacauaugg

SEQ ID NO: 25246 - RNA, 22 nt, Homo sapiens
auacuagucaagaauguaugag

SEQ ID NO: 25247 - RNA, 22 nt, Homo sapiens
auacugccuuuagcaaaacagu

SEQ ID NO: 25248 - RNA, 22 nt, Homo sapiens
auacuggcuuuccaauugugau

SEQ ID NO: 25249 - RNA, 22 nt, Homo sapiens
auagaaucaucugugcacuagu

SEQ ID NO: 25250 - RNA, 22 nt, Homo sapiens
auagaccuggagaguagauaua

SEQ ID NO: 25251 - RNA, 22 nt, Homo sapiens
auagcaaugccccacuccuugg

SEQ ID NO: 25252 - RNA, 22 nt, Homo sapiens
auagcacaguguguguacacca

SEQ ID NO: 25253 - RNA, 22 nt, Homo sapiens
auagcacugguuuuucuugguu

SEQ ID NO: 25254 - RNA, 22 nt, Homo sapiens
auagcacuuauagauuuggucu

SEQ ID NO: 25255 - RNA, 22 nt, Homo sapiens
auagcagaacagugucucacug

SEQ ID NO: 25256 - RNA, 22 nt, Homo sapiens
auagcagaagaagggacaauuc

SEQ ID NO: 25257 - RNA, 22 nt, Homo sapiens
auagcagacauuucaaggcagg

SEQ ID NO: 25258 - RNA, 22 nt, Homo sapiens
auagcauagucagcuucgcuga

SEQ ID NO: 25259 - RNA, 21 nt, Homo sapiens
auagggcuuguugauaguuaa

SEQ ID NO: 25260 - RNA, 22 nt, Homo sapiens
auagguagcauagcaggaauau

SEQ ID NO: 25261 - RNA, 22 nt, Homo sapiens
auaggucaucaugggaguggga

SEQ ID NO: 25262 - RNA, 22 nt, Homo sapiens
auaguacuauugcaguguuaua

SEQ ID NO: 25263 - RNA, 22 nt, Homo sapiens
auaguagcaugcacuggugcug

SEQ ID NO: 25264 - RNA, 22 nt, Homo sapiens
auagucaguagucucauaauga

SEQ ID NO: 25265 - RNA, 20 nt, Homo sapiens
ccuaguguucuuaggcugca

SEQ ID NO: 25266 - RNA, 22 nt, Homo sapiens
ccucaguguuuaucauuauuuu

SEQ ID NO: 25267 - RNA, 22 nt, Homo sapiens
ccucauggagaacaucugcuag

SEQ ID NO: 25268 - RNA, 22 nt, Homo sapiens
ccucauggagaaccucugcuag

SEQ ID NO: 25269 - RNA, 22 nt, Homo sapiens
ccucccuuuguugcaagggaaa

SEQ ID NO: 25270 - RNA, 22 nt, Homo sapiens
ccugagacgaauggagugaaca

SEQ ID NO: 25271 - RNA, 22 nt, Homo sapiens
ccuggaaugaagcuuauauugc

SEQ ID NO: 25272 - RNA, 22 nt, Homo sapiens
ccuggcaagagacugaagauag

SEQ ID NO: 25273 - RNA, 22 nt, Homo sapiens
ccuggcacugggccccguggcu

SEQ ID NO: 25274 - RNA, 22 nt, Homo sapiens
ccuguagcauccaagaagcugc

SEQ ID NO: 25275 - RNA, 21 nt, Homo sapiens
ccuugagaacaucaauuugcu

SEQ ID NO: 25276 - RNA, 22 nt, Homo sapiens
ccuugcacuucccaagugaggc

SEQ ID NO: 25277 - RNA, 22 nt, Homo sapiens
ccuuggcaauggcuggggcuga

SEQ ID NO: 25278 - RNA, 22 nt, Homo sapiens
ccuuggcacuacugacauugua

SEQ ID NO: 25279 - RNA, 22 nt, Homo sapiens
ccuuuguuaguuugcugagaau

SEQ ID NO: 25280 - RNA, 22 nt, Homo sapiens
ccuuuuugaguugccagaguuc

SEQ ID NO: 25281 - RNA, 21 nt, Homo sapiens
cgauaacagcccuuucccaaa

SEQ ID NO: 25282 - RNA, 22 nt, Homo sapiens
cgugaauguuuuggucuuucac

SEQ ID NO: 25283 - RNA, 22 nt, Homo sapiens
cgugaggaaaacagaggguguu

SEQ ID NO: 25284 - RNA, 22 nt, Homo sapiens
cgugaggaguauuuuuaggugc

SEQ ID NO: 25285 - RNA, 20 nt, Homo sapiens
cguugcacuccagccugggc

SEQ ID NO: 25286 - RNA, 22 nt, Homo sapiens
cuaaagauagugacaugauuug

SEQ ID NO: 25287 - RNA, 22 nt, Homo sapiens
cuaaagugcugagauuauaggu

SEQ ID NO: 25288 - RNA, 22 nt, Homo sapiens
cuaacacagggcaagucaggcu

SEQ ID NO: 25289 - RNA, 22 nt, Homo sapiens
cuaagauugucuuaguguguug

SEQ ID NO: 25290 - RNA, 21 nt, Homo sapiens
cuaaggaaagcuaugaacccu

SEQ ID NO: 25291 - RNA, 22 nt, Homo sapiens
cuaauacaguuguccaagcugg

SEQ ID NO: 25292 - RNA, 18 nt, Homo sapiens
cuaauacuauucaacaag

SEQ ID NO: 25293 - RNA, 20 nt, Homo sapiens
cuaaucaucccagaagaaau

SEQ ID NO: 25294 - RNA, 22 nt, Homo sapiens
cuaaucugugcauagaagaggc

SEQ ID NO: 25295 - RNA, 22 nt, Homo sapiens
cuacacaugcaggcucccugcc

SEQ ID NO: 25296 - RNA, 22 nt, Homo sapiens
cuacagcacugagcugugugca

SEQ ID NO: 25297 - RNA, 22 nt, Homo sapiens
cuacaguagagaggauguagaa

SEQ ID NO: 25298 - RNA, 22 nt, Homo sapiens
cuacaguaugaaaccuuuacuc

SEQ ID NO: 25299 - RNA, 22 nt, Homo sapiens
cuacauuguagguauucaaacu

SEQ ID NO: 25300 - RNA, 22 nt, Homo sapiens
cuacucuggagagugacaauca

SEQ ID NO: 25301 - RNA, 22 nt, Homo sapiens
cuacugacacuacugcaaucau

SEQ ID NO: 25302 - RNA, 22 nt, Homo sapiens
cuacugcacaucaucugaguua

SEQ ID NO: 25303 - RNA, 22 nt, Homo sapiens
cuagaagcauauucagaacaga

SEQ ID NO: 25304 - RNA, 22 nt, Homo sapiens
cuagacuagacccaaauugaag

SEQ ID NO: 25305 - RNA, 22 nt, Homo sapiens
cuagagagaagcugugugaccu

SEQ ID NO: 25306 - RNA, 22 nt, Homo sapiens
cuagcacauaguuauucacuca

SEQ ID NO: 25307 - RNA, 22 nt, Homo sapiens
cuagcagacaugggcugaacca

SEQ ID NO: 25308 - RNA, 22 nt, Homo sapiens
cuagcuuuuuaugacaaucuug

SEQ ID NO: 25309 - RNA, 22 nt, Homo sapiens
cuagguagcuuuucugucaugu

SEQ ID NO: 25310 - RNA, 22 nt, Homo sapiens
cuagguuauacucugaaauggu

SEQ ID NO: 25311 - RNA, 22 nt, Homo sapiens
cuaguaaugucugucuuaugga

SEQ ID NO: 25312 - RNA, 22 nt, Homo sapiens
cuagugcaguuccccugucuua

SEQ ID NO: 25313 - RNA, 22 nt, Homo sapiens
cuauaacagugugguuuggaga

SEQ ID NO: 25314 - RNA, 18 nt, Homo sapiens
cuaugccacuuuauauca

SEQ ID NO: 25315 - RNA, 19 nt, Homo sapiens
cuauugcacauagcugaag

SEQ ID NO: 25316 - RNA, 22 nt, Homo sapiens
cuauuugcauucagaggcaugu

SEQ ID NO: 25317 - RNA, 22 nt, Homo sapiens
cucaaagugcuaagauuaggcu

SEQ ID NO: 25318 - RNA, 19 nt, Homo sapiens
cucaaagugguauuuggag

SEQ ID NO: 25319 - RNA, 22 nt, Homo sapiens
cucaaguacaugggauuacagg

SEQ ID NO: 25320 - RNA, 22 nt, Homo sapiens
cucaaguagugguuuucauuga

SEQ ID NO: 25321 - RNA, 22 nt, Homo sapiens
cucaauuuggaauugucaguaa

SEQ ID NO: 25322 - RNA, 20 nt, Homo sapiens
cucacagacagcuucuuucu

SEQ ID NO: 25323 - RNA, 20 nt, Homo sapiens
cucaccagguguaggcugag

SEQ ID NO: 25324 - RNA, 22 nt, Homo sapiens
cucaccuugugauccaccggcc

SEQ ID NO: 25325 - RNA, 22 nt, Homo sapiens
cucacggugcaggcuucuggga

SEQ ID NO: 25326 - RNA, 22 nt, Homo sapiens
cucacugcauuucaguuuuguu

SEQ ID NO: 25327 - RNA, 20 nt, Homo sapiens
cucagauuauucugaagcaa

SEQ ID NO: 25328 - RNA, 22 nt, Homo sapiens
cucagggugguggacucuaaua

SEQ ID NO: 25329 - RNA, 22 nt, Homo sapiens
cucagucuaugauacuuugcua

SEQ ID NO: 25330 - RNA, 22 nt, Homo sapiens
cucagugaagggcaagaggcaa

SEQ ID NO: 25331 - RNA, 22 nt, Homo sapiens
cucagugucuggggccccaggg

SEQ ID NO: 25332 - RNA, 22 nt, Homo sapiens
cucauggaauacuucacagcca

SEQ ID NO: 25333 - RNA, 22 nt, Homo sapiens
cucauggauggucuggcagcca

SEQ ID NO: 25334 - RNA, 22 nt, Homo sapiens
cucauuggcuacugaggcuugu

SEQ ID NO: 25335 - RNA, 22 nt, Homo sapiens
cuccauuuaguccuuuuagaag

SEQ ID NO: 25336 - RNA, 22 nt, Homo sapiens
cucccagagccaguuauaggcu

SEQ ID NO: 25337 - RNA, 22 nt, Homo sapiens
cugcaagaaucguaguauuuga

SEQ ID NO: 25338 - RNA, 22 nt, Homo sapiens
cugcaauguuugaaauggcaaa

SEQ ID NO: 25339 - RNA, 22 nt, Homo sapiens
cugcagaucuuggggcuugcca

SEQ ID NO: 25340 - RNA, 22 nt, Homo sapiens
cugcauaaucaucucucugcau

SEQ ID NO: 25341 - RNA, 19 nt, Homo sapiens
cugcaugagacaguugguu

SEQ ID NO: 25342 - RNA, 22 nt, Homo sapiens
cugcauuagucuguuuaguguu

SEQ ID NO: 25343 - RNA, 18 nt, Homo sapiens
cugccagugugcucuccg

SEQ ID NO: 25344 - RNA, 22 nt, Homo sapiens
cugcccuuucuauaugauguaa

SEQ ID NO: 25345 - RNA, 22 nt, Homo sapiens
cugccuagauguuguagggggu

SEQ ID NO: 25346 - RNA, 22 nt, Homo sapiens
cuggaauguuccuaaagauuca

SEQ ID NO: 25347 - RNA, 22 nt, Homo sapiens
cuggaauuacaggguugagcua

SEQ ID NO: 25348 - RNA, 22 nt, Homo sapiens
cuggagaucuugacauugaagu

SEQ ID NO: 25349 - RNA, 22 nt, Homo sapiens
cuggagcauugguggauuuguu

SEQ ID NO: 25350 - RNA, 22 nt, Homo sapiens
cuggaguaugaaccauguauca

SEQ ID NO: 25351 - RNA, 22 nt, Homo sapiens
cuggagucugacugacacaagg

SEQ ID NO: 25352 - RNA, 22 nt, Homo sapiens
cuggauagagauugaugaugcu

SEQ ID NO: 25353 - RNA, 22 nt, Homo sapiens
cuggcaagagugaaccagcugu

SEQ ID NO: 25354 - RNA, 22 nt, Homo sapiens
cuggcaauaaauuuuuguguug

SEQ ID NO: 25355 - RNA, 22 nt, Homo sapiens
cuggcacagugucagaaacaca

SEQ ID NO: 25356 - RNA, 22 nt, Homo sapiens
cuggcagucugccucuucacug

SEQ ID NO: 25357 - RNA, 22 nt, Homo sapiens
cuggcuaagugcuugagugugc

SEQ ID NO: 25358 - RNA, 22 nt, Homo sapiens
cugggaugugacuguugccccc

SEQ ID NO: 25359 - RNA, 22 nt, Homo sapiens
cugggcaaugcggcuggauaga

SEQ ID NO: 25360 - RNA, 22 nt, Homo sapiens
cugggguaggacuggcuuuuga

SEQ ID NO: 25361 - RNA, 22 nt, Homo sapiens
cugguaagaaggucuaagucaa

SEQ ID NO: 25362 - RNA, 22 nt, Homo sapiens
cuggucaugggggcacccucug

SEQ ID NO: 25363 - RNA, 22 nt, Homo sapiens
cuggugauugguuucauucagu

SEQ ID NO: 25364 - RNA, 22 nt, Homo sapiens
cuggugugugacuuuucauuau

SEQ ID NO: 25365 - RNA, 22 nt, Homo sapiens
cuguaaaguaagagguaaguua

SEQ ID NO: 25366 - RNA, 22 nt, Homo sapiens
cuguaaaguucucauuguagcc

SEQ ID NO: 25367 - RNA, 22 nt, Homo sapiens
cuguaaggcacuaagcauaugu

SEQ ID NO: 25368 - RNA, 22 nt, Homo sapiens
cuguacucaucccauaugcacu

SEQ ID NO: 25369 - RNA, 22 nt, Homo sapiens
cuguaguuagcagaugaugaau

SEQ ID NO: 25370 - RNA, 22 nt, Homo sapiens
cugucacuggggcacauguccc

SEQ ID NO: 25371 - RNA, 22 nt, Homo sapiens
cugucucagccucuccaguagc

SEQ ID NO: 25372 - RNA, 22 nt, Homo sapiens
cugucuggaggccugcaaauaa

SEQ ID NO: 25373 - RNA, 22 nt, Homo sapiens
cugugcauaugacuuuauugga

SEQ ID NO: 25374 - RNA, 22 nt, Homo sapiens
cugugcaugcgcggagcugaaa

SEQ ID NO: 25375 - RNA, 22 nt, Homo sapiens
cugugccaagcuugcgaugugc

SEQ ID NO: 25376 - RNA, 22 nt, Homo sapiens
cugugcuaggcaaugugguaga

SEQ ID NO: 25377 - RNA, 22 nt, Homo sapiens
cugugcuuggagucccccuagg

SEQ ID NO: 25378 - RNA, 19 nt, Homo sapiens
cuguggucauuauuuugcu

SEQ ID NO: 25379 - RNA, 22 nt, Homo sapiens
cuguucaggaggcauuuggugg

SEQ ID NO: 25380 - RNA, 19 nt, Homo sapiens
cuguuguacuccaggcauu

SEQ ID NO: 25381 - RNA, 22 nt, Homo sapiens
cuguuuguuuaggguacucaga

SEQ ID NO: 25382 - RNA, 22 nt, Homo sapiens
cuucaaguguggccaccugacc

SEQ ID NO: 25383 - RNA, 22 nt, Homo sapiens
cuucaaguuggaagggaccuaa

SEQ ID NO: 25384 - RNA, 22 nt, Homo sapiens
cuucaccaguuuggcagucuca

SEQ ID NO: 25385 - RNA, 22 nt, Homo sapiens
cuuccagcuggguucagucagu

SEQ ID NO: 25386 - RNA, 22 nt, Homo sapiens
cuuccaguggcagccgggcaug

SEQ ID NO: 25387 - RNA, 22 nt, Homo sapiens
cuuccauauucuaggacaggcu

SEQ ID NO: 25388 - RNA, 22 nt, Homo sapiens
cuucccguuauugcccuugggu

SEQ ID NO: 25389 - RNA, 22 nt, Homo sapiens
cuucuugagggccugcugggaa

SEQ ID NO: 25390 - RNA, 22 nt, Homo sapiens
cuucuugcuguguccucacaug

SEQ ID NO: 25391 - RNA, 22 nt, Homo sapiens
cuugaccuauggaucuguuuuu

SEQ ID NO: 25392 - RNA, 23 nt, Homo sapiens
cuugagacaaaugcgugugugca

SEQ ID NO: 25393 - RNA, 22 nt, Homo sapiens
cuugagcaaacaaaggugguag

SEQ ID NO: 25394 - RNA, 22 nt, Homo sapiens
cuugauagugguaaucauuuuu

SEQ ID NO: 25395 - RNA, 22 nt, Homo sapiens
cuugcagagucauucuaauuuc

SEQ ID NO: 25396 - RNA, 22 nt, Homo sapiens
cuugccuacucacugguuuacu

SEQ ID NO: 25397 - RNA, 22 nt, Homo sapiens
cuuggauuauaauggaauauuu

SEQ ID NO: 25398 - RNA, 22 nt, Homo sapiens
cuuggcacgugauagguguuga

SEQ ID NO: 25399 - RNA, 22 nt, Homo sapiens
cuugguacucugugucccagcu

SEQ ID NO: 25400 - RNA, 22 nt, Homo sapiens
cuuucucagugagacccgagau

SEQ ID NO: 25401 - RNA, 22 nt, Homo sapiens
cuuucugaggagaauagagaac

SEQ ID NO: 25402 - RNA, 22 nt, Homo sapiens
cuuugaugagaaaauacuuugu

SEQ ID NO: 25403 - RNA, 22 nt, Homo sapiens
cuuugcaaaacauugagaccuc

SEQ ID NO: 25404 - RNA, 22 nt, Homo sapiens
ggugaauuguaccccauaggau

SEQ ID NO: 25405 - RNA, 19 nt, Homo sapiens
ggugagaaauuaugggucu

SEQ ID NO: 25406 - RNA, 22 nt, Homo sapiens
ggugagguaguaagguacaaua

SEQ ID NO: 25407 - RNA, 19 nt, Homo sapiens
ggugcuugaauauuccucc

SEQ ID NO: 25408 - RNA, 22 nt, Homo sapiens
ggugcuugaggaacggaggcug

SEQ ID NO: 25409 - RNA, 22 nt, Homo sapiens
gguggugguauuucagaaaaug

SEQ ID NO: 25410 - RNA, 22 nt, Homo sapiens
ggugucaguuggccccuacugg

SEQ ID NO: 25411 - RNA, 22 nt, Homo sapiens
guaaaucucuguuuucauggac

SEQ ID NO: 25412 - RNA, 22 nt, Homo sapiens
guaaauguccccugugauauug

SEQ ID NO: 25413 - RNA, 22 nt, Homo sapiens
guaacagucucaacaguggucu

SEQ ID NO: 25414 - RNA, 22 nt, Homo sapiens
guaacguaaugucaaaaucuau

SEQ ID NO: 25415 - RNA, 22 nt, Homo sapiens
guaagacuuauuuucuuuauca

SEQ ID NO: 25416 - RNA, 22 nt, Homo sapiens
guaaggcuguuaucuucacguc

SEQ ID NO: 25417 - RNA, 22 nt, Homo sapiens
guaagguuguauuucaagaaac

SEQ ID NO: 25418 - RNA, 22 nt, Homo sapiens
guaaguagcuuuagauauaaau

SEQ ID NO: 25419 - RNA, 23 nt, Homo sapiens
guaauacuagucauaguagcagg

SEQ ID NO: 25420 - RNA, 22 nt, Homo sapiens
guaaucucagcuacucgggaga

SEQ ID NO: 25421 - RNA, 22 nt, Homo sapiens
guaaucucagcuacuugggagc

SEQ ID NO: 25422 - RNA, 22 nt, Homo sapiens
guaaugaacuugaaagccuguu

SEQ ID NO: 25423 - RNA, 22 nt, Homo sapiens
guacauagucacacauauacau

SEQ ID NO: 25424 - RNA, 22 nt, Homo sapiens
guacccuauggauauagaugaa

SEQ ID NO: 25425 - RNA, 17 nt, Homo sapiens
guacucagugaccaugg

SEQ ID NO: 25426 - RNA, 22 nt, Homo sapiens
guacucuggaguaggccuaauu

SEQ ID NO: 25427 - RNA, 22 nt, Homo sapiens
guagcagaauaucagauaauuu

SEQ ID NO: 25428 - RNA, 22 nt, Homo sapiens
guagcagcuacuaaguugcugu

SEQ ID NO: 25429 - RNA, 18 nt, Homo sapiens
guaggucaguaccaagca

SEQ ID NO: 25430 - RNA, 22 nt, Homo sapiens
guauagcaaugccccacaccug

SEQ ID NO: 25431 - RNA, 22 nt, Homo sapiens
guauaguaguacaaaaguuuuu

SEQ ID NO: 25432 - RNA, 22 nt, Homo sapiens
guaucauugccuaaugcucuca

SEQ ID NO: 25433 - RNA, 22 nt, Homo sapiens
guaucauuggcauguaaccaga

SEQ ID NO: 25434 - RNA, 18 nt, Homo sapiens
guaugcacaugccccugc

SEQ ID NO: 25435 - RNA, 22 nt, Homo sapiens
guauggaauuugugaccuuaua

SEQ ID NO: 25436 - RNA, 22 nt, Homo sapiens
guaugugacuggaacaguagga

SEQ ID NO: 25437 - RNA, 22 nt, Homo sapiens
guauuagguuggggcaaaagua

SEQ ID NO: 25438 - RNA, 18 nt, Homo sapiens
guauuccagccugaguga

SEQ ID NO: 25439 - RNA, 22 nt, Homo sapiens
guauuuuguuagggugugguau

SEQ ID NO: 25440 - RNA, 22 nt, Homo sapiens
gucaacauauuaauuauguucu

SEQ ID NO: 25441 - RNA, 22 nt, Homo sapiens
gucaagagaacuuucuaucacu

SEQ ID NO: 25442 - RNA, 22 nt, Homo sapiens
gucaauguaucuagcuguauua

SEQ ID NO: 25443 - RNA, 22 nt, Homo sapiens
gucacuguggagaagaaagugg

SEQ ID NO: 25444 - RNA, 22 nt, Homo sapiens
gucagaaucucagaugacaacg

SEQ ID NO: 25445 - RNA, 22 nt, Homo sapiens
gucagaugcagauuccaguucu

SEQ ID NO: 25446 - RNA, 22 nt, Homo sapiens
gucagcaaaguucuccugcaga

SEQ ID NO: 25447 - RNA, 22 nt, Homo sapiens
gucagcaucaccaugucuauga

SEQ ID NO: 25448 - RNA, 22 nt, Homo sapiens
gucagcuuuuccuuacuuuagg

SEQ ID NO: 25449 - RNA, 22 nt, Homo sapiens
gucagugauugauuuaaagacg

SEQ ID NO: 25450 - RNA, 22 nt, Homo sapiens
gucagugucuuaacagagauua

SEQ ID NO: 25451 - RNA, 22 nt, Homo sapiens
gucagugucuuugcagcucaga

SEQ ID NO: 25452 - RNA, 22 nt, Homo sapiens
gucaguucuugugguugcauuc

SEQ ID NO: 25453 - RNA, 22 nt, Homo sapiens
gucaguuucacucagcuggaac

SEQ ID NO: 25454 - RNA, 22 nt, Homo sapiens
gucaguuugguuaaucauucca

SEQ ID NO: 25455 - RNA, 22 nt, Homo sapiens
gucaucaggacgggucaucugc

SEQ ID NO: 25456 - RNA, 22 nt, Homo sapiens
gucauggaggaugaauggccaa

SEQ ID NO: 25457 - RNA, 22 nt, Homo sapiens
gucauggagggacauaacuaac

SEQ ID NO: 25458 - RNA, 22 nt, Homo sapiens
gucauguuuaacuucuugagga

SEQ ID NO: 25459 - RNA, 22 nt, Homo sapiens
gucauugcuuaucugcugacgu

SEQ ID NO: 25460 - RNA, 18 nt, Homo sapiens
guccauuuguugguacac

SEQ ID NO: 25461 - RNA, 22 nt, Homo sapiens
gucccaguggaaccuccaagcu

SEQ ID NO: 25462 - RNA, 22 nt, Homo sapiens
gucguggagucucuggcuugua

SEQ ID NO: 25463 - RNA, 22 nt, Homo sapiens
gucucagugcgaaucucaaaga

SEQ ID NO: 25464 - RNA, 22 nt, Homo sapiens
gucucccaaccccugugcccag

SEQ ID NO: 25465 - RNA, 22 nt, Homo sapiens
gucuccggcuguccuuugaggu

SEQ ID NO: 25466 - RNA, 22 nt, Homo sapiens
gucucuuguuaucauuucugag

SEQ ID NO: 25467 - RNA, 22 nt, Homo sapiens
gucuggcuccugucuaaucacu

SEQ ID NO: 25468 - RNA, 22 nt, Homo sapiens
gucugguuccugggagauuucu

SEQ ID NO: 25469 - RNA, 22 nt, Homo sapiens
gucugugcauuaauacgugcug

SEQ ID NO: 25470 - RNA, 22 nt, Homo sapiens
gucuuggagaacucagcuuggc

SEQ ID NO: 25471 - RNA, 22 nt, Homo sapiens
gucuuggcaugugcagcuggga

SEQ ID NO: 25472 - RNA, 20 nt, Homo sapiens
gucuuguagcucaaguuauu

SEQ ID NO: 25473 - RNA, 22 nt, Homo sapiens
gugaaagcaucugacugugcca

SEQ ID NO: 25474 - RNA, 22 nt, Homo sapiens
gugaaauacauaaucccaagug

SEQ ID NO: 25475 - RNA, 22 nt, Homo sapiens
gugaaauguguagaggaucugg

SEQ ID NO: 25476 - RNA, 22 nt, Homo sapiens
gugaacaagcaaaggcaggagg

SEQ ID NO: 25477 - RNA, 22 nt, Homo sapiens
gugaacagcagaugagugagug

SEQ ID NO: 25478 - RNA, 22 nt, Homo sapiens
gugaacuguuugaggaagagaa

SEQ ID NO: 25479 - RNA, 22 nt, Homo sapiens
gugaagaugugcaucagaucca

SEQ ID NO: 25480 - RNA, 22 nt, Homo sapiens
gugaaguuuuugugaggccuaa

SEQ ID NO: 25481 - RNA, 20 nt, Homo sapiens
gugaauacauuugguuucau

SEQ ID NO: 25482 - RNA, 22 nt, Homo sapiens
gugaauagggaauaaugggauc

SEQ ID NO: 25483 - RNA, 22 nt, Homo sapiens
gugaauguaaagucaugugacu

SEQ ID NO: 25484 - RNA, 22 nt, Homo sapiens
gugaauguuuucuuacauggua

SEQ ID NO: 25485 - RNA, 22 nt, Homo sapiens
gugacagucaaagacaugacuu

SEQ ID NO: 25486 - RNA, 22 nt, Homo sapiens
gugacauuauuucagcuacaug

SEQ ID NO: 25487 - RNA, 22 nt, Homo sapiens
gugacugcauauaaguguaugu

SEQ ID NO: 25488 - RNA, 18 nt, Homo sapiens
gugagaaugacuguucug

SEQ ID NO: 25489 - RNA, 22 nt, Homo sapiens
gugagaugaggucucacucugu

SEQ ID NO: 25490 - RNA, 22 nt, Homo sapiens
gugagauggagucuugcuuugu

SEQ ID NO: 25491 - RNA, 22 nt, Homo sapiens
gugagauggaguuggugucuuu

SEQ ID NO: 25492 - RNA, 22 nt, Homo sapiens
gugagaugugacuucugccucu

SEQ ID NO: 25493 - RNA, 22 nt, Homo sapiens
gugagauuuucuccagguucag

SEQ ID NO: 25494 - RNA, 19 nt, Homo sapiens
gugagcacagacaauacaa

SEQ ID NO: 25495 - RNA, 22 nt, Homo sapiens
gugagcacugaaagaaggcaag

SEQ ID NO: 25496 - RNA, 22 nt, Homo sapiens
gugagcaguguccuugggggca

SEQ ID NO: 25497 - RNA, 22 nt, Homo sapiens
gugagcuaagcaaauaugagcc

SEQ ID NO: 25498 - RNA, 22 nt, Homo sapiens
gugagcuaguuucuuugcugug

SEQ ID NO: 25499 - RNA, 22 nt, Homo sapiens
gugagcuauguccugguuuggg

SEQ ID NO: 25500 - RNA, 22 nt, Homo sapiens
gugagggagcuggaauauuuau

SEQ ID NO: 25501 - RNA, 22 nt, Homo sapiens
gugagguagagcaugugaaaga

SEQ ID NO: 25502 - RNA, 22 nt, Homo sapiens
gugaggucagggcuguggacag

SEQ ID NO: 25503 - RNA, 22 nt, Homo sapiens
gugaggucguagucauaggcaa

SEQ ID NO: 25504 - RNA, 22 nt, Homo sapiens
uacaguccaugcauuauccucc

SEQ ID NO: 25505 - RNA, 22 nt, Homo sapiens
uacagucuagaggagaaucagg

SEQ ID NO: 25506 - RNA, 22 nt, Homo sapiens
uacaguggaaguuaaccccauu

SEQ ID NO: 25507 - RNA, 22 nt, Homo sapiens
uacaguggugugaucucagcuc

SEQ ID NO: 25508 - RNA, 22 nt, Homo sapiens
uacauacuucacagacuuuaaa

SEQ ID NO: 25509 - RNA, 22 nt, Homo sapiens
uacauccauccugcugggcagu

SEQ ID NO: 25510 - RNA, 22 nt, Homo sapiens
uacauguauccauuguuuuugg

SEQ ID NO: 25511 - RNA, 22 nt, Homo sapiens
uacaugugcacaacgugcaggu

SEQ ID NO: 25512 - RNA, 22 nt, Homo sapiens
uaccaaaguuucggccucuguu

SEQ ID NO: 25513 - RNA, 23 nt, Homo sapiens
uaccacauuccuucuuuccuguu

SEQ ID NO: 25514 - RNA, 22 nt, Homo sapiens
uaccagcauuucucuuuaagua

SEQ ID NO: 25515 - RNA, 22 nt, Homo sapiens
uaccaguaaugguucuagagga

SEQ ID NO: 25516 - RNA, 22 nt, Homo sapiens
uaccagugaauuccaggggcua

SEQ ID NO: 25517 - RNA, 22 nt, Homo sapiens
uaccaugcagguguauguuugu

SEQ ID NO: 25518 - RNA, 22 nt, Homo sapiens
uacccgucuacuuugaacaaaa

SEQ ID NO: 25519 - RNA, 22 nt, Homo sapiens
uaccuuugucaguuacucaccu

SEQ ID NO: 25520 - RNA, 22 nt, Homo sapiens
uacguaucagucguuucuguga

SEQ ID NO: 25521 - RNA, 22 nt, Homo sapiens
uacuagaggaaaacuugaagac

SEQ ID NO: 25522 - RNA, 23 nt, Homo sapiens
uacuaguaagcguguucuuugca

SEQ ID NO: 25523 - RNA, 22 nt, Homo sapiens
uacuauugcaucggugauuagg

SEQ ID NO: 25524 - RNA, 22 nt, Homo sapiens
uacucugcagccauaaaacaga

SEQ ID NO: 25525 - RNA, 19 nt, Homo sapiens
uacugcacuccagucuggg

SEQ ID NO: 25526 - RNA, 18 nt, Homo sapiens
uacugcacucuccagccu

SEQ ID NO: 25527 - RNA, 22 nt, Homo sapiens
uacugcacuugaccuccugggc

SEQ ID NO: 25528 - RNA, 22 nt, Homo sapiens
uacugcaguugcagcuugagga

SEQ ID NO: 25529 - RNA, 22 nt, Homo sapiens
uacugcauuucacuguuaaaga

SEQ ID NO: 25530 - RNA, 22 nt, Homo sapiens
uacuggccccaaaguagguagu

SEQ ID NO: 25531 - RNA, 22 nt, Homo sapiens
uacuguacugcaguucugcaaa

SEQ ID NO: 25532 - RNA, 22 nt, Homo sapiens
uacuuuguagagugugagaauu

SEQ ID NO: 25533 - RNA, 22 nt, Homo sapiens
uagaaagcaugaccuucagaua

SEQ ID NO: 25534 - RNA, 20 nt, Homo sapiens
uagaaaguagaguggugguu

SEQ ID NO: 25535 - RNA, 22 nt, Homo sapiens
uagacccauuguucagagagug

SEQ ID NO: 25536 - RNA, 22 nt, Homo sapiens
uagagcaaugacucuggaaacc

SEQ ID NO: 25537 - RNA, 21 nt, Homo sapiens
uagagcuuggcacagaguaga

SEQ ID NO: 25538 - RNA, 22 nt, Homo sapiens
uagaggaaggauuggaaacgca

SEQ ID NO: 25539 - RNA, 22 nt, Homo sapiens
uagaguacucugguaaguucuu

SEQ ID NO: 25540 - RNA, 22 nt, Homo sapiens
uagaucaacuuugguaagagaa

SEQ ID NO: 25541 - RNA, 22 nt, Homo sapiens
uagaucacucaggcaauaaaag

SEQ ID NO: 25542 - RNA, 19 nt, Homo sapiens
uagaugucuuugcauagau

SEQ ID NO: 25543 - RNA, 22 nt, Homo sapiens
uagauuaucauucauacaggga

SEQ ID NO: 25544 - RNA, 22 nt, Homo sapiens
uagauuauccggcugggacaau

SEQ ID NO: 25545 - RNA, 22 nt, Homo sapiens
uagauuguaauaugcagaaugg

SEQ ID NO: 25546 - RNA, 23 nt, Homo sapiens
uagcaacaguuggaggugaggua

SEQ ID NO: 25547 - RNA, 22 nt, Homo sapiens
uagcaacauucagcucagguac

SEQ ID NO: 25548 - RNA, 22 nt, Homo sapiens
uagcaagaugaauuugugcaaa

SEQ ID NO: 25549 - RNA, 22 nt, Homo sapiens
uagcaaguguuuaagcacuuuu

SEQ ID NO: 25550 - RNA, 20 nt, Homo sapiens
uagcacacauguagaauagu

SEQ ID NO: 25551 - RNA, 19 nt, Homo sapiens
uagcacagggucccagacu

SEQ ID NO: 25552 - RNA, 22 nt, Homo sapiens
ucucacaggguuauugaggggg

SEQ ID NO: 25553 - RNA, 22 nt, Homo sapiens
ucucacauuucacagggauggg

SEQ ID NO: 25554 - RNA, 22 nt, Homo sapiens
ucucagcacaaacaaaauugcu

SEQ ID NO: 25555 - RNA, 22 nt, Homo sapiens
ucucaguggugcuggcagggga

SEQ ID NO: 25556 - RNA, 22 nt, Homo sapiens
ucucauggagucaggagcagaa

SEQ ID NO: 25557 - RNA, 22 nt, Homo sapiens
ucucauggcucacccugcauag

SEQ ID NO: 25558 - RNA, 22 nt, Homo sapiens
ucuccauugaaauggacauaau

SEQ ID NO: 25559 - RNA, 22 nt, Homo sapiens
ucuccauuuguaaggguuucuc

SEQ ID NO: 25560 - RNA, 22 nt, Homo sapiens
ucucccauccaugaacuucugu

SEQ ID NO: 25561 - RNA, 22 nt, Homo sapiens
ucucugaaacucuugacauccu

SEQ ID NO: 25562 - RNA, 22 nt, Homo sapiens
ucugacacagugauuaguaaau

SEQ ID NO: 25563 - RNA, 22 nt, Homo sapiens
ucugacacuucugcagaauuga

SEQ ID NO: 25564 - RNA, 22 nt, Homo sapiens
ucugagacuguuucuaacaagc

SEQ ID NO: 25565 - RNA, 22 nt, Homo sapiens
ucugagguuaaauuuuauaguu

SEQ ID NO: 25566 - RNA, 22 nt, Homo sapiens
ucugagucaucacaaaugaugc

SEQ ID NO: 25567 - RNA, 22 nt, Homo sapiens
ucugauggaguugccagggaga

SEQ ID NO: 25568 - RNA, 22 nt, Homo sapiens
ucugcaagucuaaacuagccau

SEQ ID NO: 25569 - RNA, 22 nt, Homo sapiens
ucugccuacugguuggaggaac

SEQ ID NO: 25570 - RNA, 23 nt, Homo sapiens
ucuggaucauucguagugccagc

SEQ ID NO: 25571 - RNA, 22 nt, Homo sapiens
ucuggauuuuugaggcaauaua

SEQ ID NO: 25572 - RNA, 22 nt, Homo sapiens
ucuggcacugaugugggaugcu

SEQ ID NO: 25573 - RNA, 21 nt, Homo sapiens
ucuggcccccucaaaucucau

SEQ ID NO: 25574 - RNA, 20 nt, Homo sapiens
ucuggccccuccaaaucuca

SEQ ID NO: 25575 - RNA, 17 nt, Homo sapiens
ucuggcuuucacaccug

SEQ ID NO: 25576 - RNA, 20 nt, Homo sapiens
ucuggguuuuggccacgccc

SEQ ID NO: 25577 - RNA, 22 nt, Homo sapiens
ucuggguuuuuacaauguuuac

SEQ ID NO: 25578 - RNA, 22 nt, Homo sapiens
ucugucaaaucuuauguuguag

SEQ ID NO: 25579 - RNA, 22 nt, Homo sapiens
ucugugaaugaacacuugaaaa

SEQ ID NO: 25580 - RNA, 22 nt, Homo sapiens
ucugugaaugugaccuuauuug

SEQ ID NO: 25581 - RNA, 22 nt, Homo sapiens
ucugugcauggcagaggaauga

SEQ ID NO: 25582 - RNA, 22 nt, Homo sapiens
ucugugcauuguaggauguuua

SEQ ID NO: 25583 - RNA, 22 nt, Homo sapiens
ucugugcauuuucuuuuagacu

SEQ ID NO: 25584 - RNA, 22 nt, Homo sapiens
ucugugguucaggcuggagugc

SEQ ID NO: 25585 - RNA, 22 nt, Homo sapiens
ucuguguuugguuggcaauuuc

SEQ ID NO: 25586 - RNA, 22 nt, Homo sapiens
ucuuaggugggccaucacccca

SEQ ID NO: 25587 - RNA, 22 nt, Homo sapiens
ucuuauggagaaaggugguugg

SEQ ID NO: 25588 - RNA, 22 nt, Homo sapiens
ucuucaugcuugaaauaauagc

SEQ ID NO: 25589 - RNA, 22 nt, Homo sapiens
ucuugcacaaauuauuuuaacu

SEQ ID NO: 25590 - RNA, 19 nt, Homo sapiens
ucuugcacaugugaacuca

SEQ ID NO: 25591 - RNA, 22 nt, Homo sapiens
ucuugcaccuacaugcuuuguc

SEQ ID NO: 25592 - RNA, 22 nt, Homo sapiens
ucuugcaguucccaaauucaca

SEQ ID NO: 25593 - RNA, 22 nt, Homo sapiens
ucuugccacuucauccccuuuc

SEQ ID NO: 25594 - RNA, 22 nt, Homo sapiens
ucuuggguuguuggcuucuccu

SEQ ID NO: 25595 - RNA, 22 nt, Homo sapiens
ucuuggguuugccuugcugcug

SEQ ID NO: 25596 - RNA, 22 nt, Homo sapiens
ucuugguaaugucacauuuccu

SEQ ID NO: 25597 - RNA, 22 nt, Homo sapiens
ucuugucacugcauccccagcu

SEQ ID NO: 25598 - RNA, 20 nt, Homo sapiens
ucuuucgguuaccaggcagu

SEQ ID NO: 25599 - RNA, 19 nt, Homo sapiens
ucuuugaggcaucgcccuc

SEQ ID NO: 25600 - RNA, 22 nt, Homo sapiens
ucuuugaguggagcgaggcaga

SEQ ID NO: 25601 - RNA, 22 nt, Homo sapiens
ucuuugaguguauacuuagauu

SEQ ID NO: 25602 - RNA, 22 nt, Homo sapiens
ucuuugaguuauugugcagacu

SEQ ID NO: 25603 - RNA, 22 nt, Homo sapiens
ucuuugauaagauccagaagaa

SEQ ID NO: 25604 - RNA, 19 nt, Homo sapiens
ucuuugcuuuucuaagagg

SEQ ID NO: 25605 - RNA, 22 nt, Homo sapiens
ucuuuggguagauauguagcug

SEQ ID NO: 25606 - RNA, 22 nt, Homo sapiens
ucuuugguaggaguaggaggcc

SEQ ID NO: 25607 - RNA, 22 nt, Homo sapiens
ucuuuggucuacuuucauaugu

SEQ ID NO: 25608 - RNA, 22 nt, Homo sapiens
ucuuugguuagguuuaguugau

SEQ ID NO: 25609 - RNA, 22 nt, Homo sapiens
ucuuugguucuguuuauguaau

SEQ ID NO: 25610 - RNA, 22 nt, Homo sapiens
ucuuugguugcacugcaggugu

SEQ ID NO: 25611 - RNA, 22 nt, Homo sapiens
ucuuugguuguuuagggugcau

SEQ ID NO: 25612 - RNA, 22 nt, Homo sapiens
ucuuuguguaggucaaucuggc

SEQ ID NO: 25613 - RNA, 22 nt, Homo sapiens
ucuuuguguucaggagccacgu

SEQ ID NO: 25614 - RNA, 22 nt, Homo sapiens
ucuuuugggccucuugucagac

SEQ ID NO: 25615 - RNA, 22 nt, Homo sapiens
ucuuuuugagucaguuucggua

SEQ ID NO: 25616 - RNA, 22 nt, Homo sapiens
ugaaacauacacucugaugggg

SEQ ID NO: 25617 - RNA, 22 nt, Homo sapiens
ugaaagacugaagaauaggcau

SEQ ID NO: 25618 - RNA, 22 nt, Homo sapiens
ugaaagguauagguucuggagg

SEQ ID NO: 25619 - RNA, 22 nt, Homo sapiens
ugaaaucauguaguuauugcaa

SEQ ID NO: 25620 - RNA, 22 nt, Homo sapiens
ugaaaucuaaaauguuccaaga

SEQ ID NO: 25621 - RNA, 22 nt, Homo sapiens
ugaaaugccuuuaaugaauuua

SEQ ID NO: 25622 - RNA, 22 nt, Homo sapiens
ugaaaugcuaauucguagcuaa

SEQ ID NO: 25623 - RNA, 22 nt, Homo sapiens
ugaacacagccugccucugcca

SEQ ID NO: 25624 - RNA, 16 nt, Homo sapiens
ugaacagagaggauuc

SEQ ID NO: 25625 - RNA, 21 nt, Homo sapiens
ugaaccccugcucucaagaaa

SEQ ID NO: 25626 - RNA, 22 nt, Homo sapiens
ugaacuguugggggaaauucag

SEQ ID NO: 25627 - RNA, 22 nt, Homo sapiens
ugaagugaagacucacagaagg

SEQ ID NO: 25628 - RNA, 22 nt, Homo sapiens
ugaagugaaugguaaguaugcc

SEQ ID NO: 25629 - RNA, 22 nt, Homo sapiens
ugaagugcugugggccaggcgu

SEQ ID NO: 25630 - RNA, 22 nt, Homo sapiens
ugaagugggaaaugaguauuaa

SEQ ID NO: 25631 - RNA, 21 nt, Homo sapiens
ugaaguguaaccgugcagggc

SEQ ID NO: 25632 - RNA, 22 nt, Homo sapiens
ugaaguguuuuuucaggcaugu

SEQ ID NO: 25633 - RNA, 22 nt, Homo sapiens
ugaauacuucguucaaagauaa

SEQ ID NO: 25634 - RNA, 22 nt, Homo sapiens
ugaauaguaauguguuuggucu

SEQ ID NO: 25635 - RNA, 22 nt, Homo sapiens
ugaauaguuugacagaacucuu

SEQ ID NO: 25636 - RNA, 22 nt, Homo sapiens
ugaauauguuaauuagcaucau

SEQ ID NO: 25637 - RNA, 22 nt, Homo sapiens
ugaauauuugcuacucacucuu

SEQ ID NO: 25638 - RNA, 22 nt, Homo sapiens
ugaaugcaucuagaaauuuauu

SEQ ID NO: 25639 - RNA, 22 nt, Homo sapiens
ugaauguccauugauguuuuga

SEQ ID NO: 25640 - RNA, 22 nt, Homo sapiens
ugaauucaucucacagaguuaa

SEQ ID NO: 25641 - RNA, 22 nt, Homo sapiens
ugacaacugauuaacuccuuua

SEQ ID NO: 25642 - RNA, 22 nt, Homo sapiens
ugacaagaacuuuccauaguaa

SEQ ID NO: 25643 - RNA, 22 nt, Homo sapiens
ugacaagagaccccuccgcagg

SEQ ID NO: 25644 - RNA, 22 nt, Homo sapiens
ugacaagaguagagagggugcc

SEQ ID NO: 25645 - RNA, 22 nt, Homo sapiens
ugacaagggaaaugcaaaaugu

SEQ ID NO: 25646 - RNA, 20 nt, Homo sapiens
ugacaagugagaauuauggg

SEQ ID NO: 25647 - RNA, 22 nt, Homo sapiens
ugacacagcaagauggaaccau

SEQ ID NO: 25648 - RNA, 22 nt, Homo sapiens
ugacacuugcccuuagaaacau

SEQ ID NO: 25649 - RNA, 23 nt, Homo sapiens
ugacagaccuucuggaagaaguc

SEQ ID NO: 25650 - RNA, 18 nt, Homo sapiens
ugacagcacaugugggga

SEQ ID NO: 25651 - RNA, 22 nt, Homo sapiens
ugacagcaucaggauuggagag

SEQ ID NO: 25652 - RNA, 18 nt, Homo sapiens
ugacaguuucuuuauauu

SEQ ID NO: 25653 - RNA, 22 nt, Homo sapiens
ugacaucugcuugugcccagga

SEQ ID NO: 25654 - RNA, 22 nt, Homo sapiens
ugacauguauuagcucagugcu

SEQ ID NO: 25655 - RNA, 22 nt, Homo sapiens
ugacauugggagugaagugaag

SEQ ID NO: 25656 - RNA, 22 nt, Homo sapiens
ugaccagaaaacaaauuaguuu

SEQ ID NO: 25657 - RNA, 22 nt, Homo sapiens
ugaccucugauagcaguaggug

SEQ ID NO: 25658 - RNA, 22 nt, Homo sapiens
ugacggaggacaccugcggaau

SEQ ID NO: 25659 - RNA, 22 nt, Homo sapiens
ugacuacaccacacgguuaagg

SEQ ID NO: 25660 - RNA, 22 nt, Homo sapiens
ugacuaguuuugcuguuguuau

SEQ ID NO: 25661 - RNA, 19 nt, Homo sapiens
ugacuauagccugaucagu

SEQ ID NO: 25662 - RNA, 22 nt, Homo sapiens
ugacuauaucucuguauaaacu

SEQ ID NO: 25663 - RNA, 22 nt, Homo sapiens
ugacuauugauuuagacgugcu

SEQ ID NO: 25664 - RNA, 22 nt, Homo sapiens
ugacuccagagacugugcuguc

SEQ ID NO: 25665 - RNA, 22 nt, Homo sapiens
ugacucgaggcgccuccagucc

SEQ ID NO: 25666 - RNA, 22 nt, Homo sapiens
ugacuggaaacaguguuauuug

SEQ ID NO: 25667 - RNA, 22 nt, Homo sapiens
ugacuucagacugaaaugauuc

SEQ ID NO: 25668 - RNA, 22 nt, Homo sapiens
ugacuucauuuuuggccaugag

SEQ ID NO: 25669 - RNA, 22 nt, Homo sapiens
ugacuugaguaacuggcucagg

SEQ ID NO: 25670 - RNA, 22 nt, Homo sapiens
ugacuugaucacccccuaaggg

SEQ ID NO: 25671 - RNA, 16 nt, Homo sapiens
ugagaacaugggguau

SEQ ID NO: 25672 - RNA, 22 nt, Homo sapiens
ugagaacaugugauauuuggug

SEQ ID NO: 25673 - RNA, 20 nt, Homo sapiens
ugagaacaugugguauuugg

SEQ ID NO: 25674 - RNA, 22 nt, Homo sapiens
ugagaacuaaaaugugguauau

SEQ ID NO: 25675 - RNA, 22 nt, Homo sapiens
ugagaacugcagggagcugcau

SEQ ID NO: 25676 - RNA, 22 nt, Homo sapiens
ugagaacugccuguauuuaucu

SEQ ID NO: 25677 - RNA, 22 nt, Homo sapiens
ugagaagacaucagcuuucgga

SEQ ID NO: 25678 - RNA, 22 nt, Homo sapiens
ugagaagacaucuuugcuuugu

SEQ ID NO: 25679 - RNA, 22 nt, Homo sapiens
ugagaagaugaacuccuugguc

SEQ ID NO: 25680 - RNA, 22 nt, Homo sapiens
ugagaaugcagaaucucgugca

SEQ ID NO: 25681 - RNA, 22 nt, Homo sapiens
ugagacaaucucaucucaguga

SEQ ID NO: 25682 - RNA, 22 nt, Homo sapiens
ugagacaucugagauuuuaagc

SEQ ID NO: 25683 - RNA, 22 nt, Homo sapiens
ugagacaugugaacuguaguuc

SEQ ID NO: 25684 - RNA, 22 nt, Homo sapiens
ugagaccuuucauuucucagug

SEQ ID NO: 25685 - RNA, 22 nt, Homo sapiens
ugagacgaagucucguucugua

SEQ ID NO: 25686 - RNA, 22 nt, Homo sapiens
ugagacggagucucgcucuguu

SEQ ID NO: 25687 - RNA, 22 nt, Homo sapiens
ugagacggagucuugcuaaguu

SEQ ID NO: 25688 - RNA, 22 nt, Homo sapiens
ugagacggagucuugcucuguc

SEQ ID NO: 25689 - RNA, 22 nt, Homo sapiens
ugagacggaguuuugcucuugu

SEQ ID NO: 25690 - RNA, 22 nt, Homo sapiens
ugagacugagucucgcucuauu

SEQ ID NO: 25691 - RNA, 22 nt, Homo sapiens
ugagacugagucucgcucuugu

SEQ ID NO: 25692 - RNA, 22 nt, Homo sapiens
ugagacugaguuucacuuuugu

SEQ ID NO: 25693 - RNA, 22 nt, Homo sapiens
ugagacugaguuuccaucuugu

SEQ ID NO: 25694 - RNA, 22 nt, Homo sapiens
ugagacugaguuuugcucuugu

SEQ ID NO: 25695 - RNA, 22 nt, Homo sapiens
ugagagacauuuguuguagagu

SEQ ID NO: 25696 - RNA, 22 nt, Homo sapiens
ugagagaugaacuauucuugaa

SEQ ID NO: 25697 - RNA, 22 nt, Homo sapiens
ugagauaacuaaaaacauuuug

SEQ ID NO: 25698 - RNA, 22 nt, Homo sapiens
ugagauaaggaaauugaggcuc

SEQ ID NO: 25699 - RNA, 22 nt, Homo sapiens
ugagaucaaggugggcccuggg

SEQ ID NO: 25700 - RNA, 22 nt, Homo sapiens
ugagaucaagguuaauauaauc

SEQ ID NO: 25701 - RNA, 22 nt, Homo sapiens
ugagaucagaaggauuucucug

SEQ ID NO: 25702 - RNA, 22 nt, Homo sapiens
ugagaucauguguggaccccag

SEQ ID NO: 25703 - RNA, 20 nt, Homo sapiens
ugagauccacgugaaguaug

SEQ ID NO: 25704 - RNA, 22 nt, Homo sapiens
ugagauccaugcuauuugggcu

SEQ ID NO: 25705 - RNA, 22 nt, Homo sapiens
ugagaucuucgcucuucacaga

SEQ ID NO: 25706 - RNA, 22 nt, Homo sapiens
ugagaucuuggaggcuuuguga

SEQ ID NO: 25707 - RNA, 22 nt, Homo sapiens
ugagaucuuuuguggcugagaa

SEQ ID NO: 25708 - RNA, 22 nt, Homo sapiens
ugagaugaagucuugcucuguu

SEQ ID NO: 25709 - RNA, 22 nt, Homo sapiens
ugagaugacgacacaccucagu

SEQ ID NO: 25710 - RNA, 22 nt, Homo sapiens
ugagaugaggucucgcucuguc

SEQ ID NO: 25711 - RNA, 22 nt, Homo sapiens
ugagaugaguugcuggcucuga

SEQ ID NO: 25712 - RNA, 22 nt, Homo sapiens
ugagaugauagauauguuaauu

SEQ ID NO: 25713 - RNA, 22 nt, Homo sapiens
ugagaugauaucuuauuguaau

SEQ ID NO: 25714 - RNA, 21 nt, Homo sapiens
ugagaugcaaucaccagggag

SEQ ID NO: 25715 - RNA, 22 nt, Homo sapiens
ugagauggagucuugucgccua

SEQ ID NO: 25716 - RNA, 22 nt, Homo sapiens
ugagauggaguuucgcucuugu

SEQ ID NO: 25717 - RNA, 22 nt, Homo sapiens
ugagauggcuuuauugcugaau

SEQ ID NO: 25718 - RNA, 22 nt, Homo sapiens
ugagaugguaaauuuuuguugu

SEQ ID NO: 25719 - RNA, 23 nt, Homo sapiens
ugagaugucugauugcgaggguc

SEQ ID NO: 25720 - RNA, 22 nt, Homo sapiens
ugagaugugaagaucacaugaa

SEQ ID NO: 25721 - RNA, 22 nt, Homo sapiens
ugggccgcugcaggaugguccc

SEQ ID NO: 25722 - RNA, 22 nt, Homo sapiens
uggggugugagggagaaagaaa

SEQ ID NO: 25723 - RNA, 22 nt, Homo sapiens
uggguaggaccagaaaugcacu

SEQ ID NO: 25724 - RNA, 22 nt, Homo sapiens
ugggucaguagcauguaugucu

SEQ ID NO: 25725 - RNA, 22 nt, Homo sapiens
ugggugaguaucuauuauucag

SEQ ID NO: 25726 - RNA, 22 nt, Homo sapiens
ugggugugaccgcucaaggggg

SEQ ID NO: 25727 - RNA, 23 nt, Homo sapiens
uggguucauucuugaagucagug

SEQ ID NO: 25728 - RNA, 22 nt, Homo sapiens
ugguaagaggcccugaguuugu

SEQ ID NO: 25729 - RNA, 22 nt, Homo sapiens
ugguaauguaauuuggagaagg

SEQ ID NO: 25730 - RNA, 22 nt, Homo sapiens
ugguauguauacuagcgacacu

SEQ ID NO: 25731 - RNA, 22 nt, Homo sapiens
ugguaugucuagauggggaagu

SEQ ID NO: 25732 - RNA, 22 nt, Homo sapiens
ugguauguugucucuuuguucu

SEQ ID NO: 25733 - RNA, 22 nt, Homo sapiens
uggucaccugaauuaugcaugu

SEQ ID NO: 25734 - RNA, 22 nt, Homo sapiens
uggucaguugaguccuugccaa

SEQ ID NO: 25735 - RNA, 21 nt, Homo sapiens
uggucaguuuucucacuagga

SEQ ID NO: 25736 - RNA, 22 nt, Homo sapiens
uggucaugaggugaggcuucuc

SEQ ID NO: 25737 - RNA, 22 nt, Homo sapiens
ugguccacuaacccucaguauc

SEQ ID NO: 25738 - RNA, 22 nt, Homo sapiens
ugguccccaauacuucuauaga

SEQ ID NO: 25739 - RNA, 20 nt, Homo sapiens
ugguccccugagucuggcuu

SEQ ID NO: 25740 - RNA, 22 nt, Homo sapiens
ugguccucugcuuccagaauuc

SEQ ID NO: 25741 - RNA, 22 nt, Homo sapiens
uggucuuuucaacaaaugguau

SEQ ID NO: 25742 - RNA, 22 nt, Homo sapiens
uggugagaaacuagauauuuuu

SEQ ID NO: 25743 - RNA, 22 nt, Homo sapiens
uggugcaaugaagugaucucaa

SEQ ID NO: 25744 - RNA, 22 nt, Homo sapiens
uggugcccuguccuucuguggc

SEQ ID NO: 25745 - RNA, 20 nt, Homo sapiens
uggugucuuggaaagagcuc

SEQ ID NO: 25746 - RNA, 23 nt, Homo sapiens
uguaaaagcauuugucagccugg

SEQ ID NO: 25747 - RNA, 18 nt, Homo sapiens
uguaaacuaccucaaccu

SEQ ID NO: 25748 - RNA, 22 nt, Homo sapiens
uguaaacucaguauguuuuacu

SEQ ID NO: 25749 - RNA, 23 nt, Homo sapiens
uguaaagcuaugaauuauucuuu

SEQ ID NO: 25750 - RNA, 20 nt, Homo sapiens
uguaaaggagauugcagcug

SEQ ID NO: 25751 - RNA, 20 nt, Homo sapiens
uguaacaaucuggauguugc

SEQ ID NO: 25752 - RNA, 22 nt, Homo sapiens
uguaagcagcagagacuauccu

SEQ ID NO: 25753 - RNA, 22 nt, Homo sapiens
uguaagcauugggcaugcaguc

SEQ ID NO: 25754 - RNA, 22 nt, Homo sapiens
uguaaggcaguuagagcaaauu

SEQ ID NO: 25755 - RNA, 22 nt, Homo sapiens
uguaagugugcaauucagugau

SEQ ID NO: 25756 - RNA, 22 nt, Homo sapiens
uguaauaguaggcucacauuug

SEQ ID NO: 25757 - RNA, 22 nt, Homo sapiens
uguaauguuucaucauuauuaa

SEQ ID NO: 25758 - RNA, 22 nt, Homo sapiens
uguaauguuugguagguuaggu

SEQ ID NO: 25759 - RNA, 22 nt, Homo sapiens
uguacaaauuucugugguggug

SEQ ID NO: 25760 - RNA, 19 nt, Homo sapiens
uguacacuguaaaccugug

SEQ ID NO: 25761 - RNA, 22 nt, Homo sapiens
uguacccuuagagagugaucga

SEQ ID NO: 25762 - RNA, 22 nt, Homo sapiens
uguagcagccauaaacacagug

SEQ ID NO: 25763 - RNA, 20 nt, Homo sapiens
uguagguguacaguaaggag

SEQ ID NO: 25764 - RNA, 22 nt, Homo sapiens
uguaguuugaaagcucccucug

SEQ ID NO: 25765 - RNA, 22 nt, Homo sapiens
uguauauguuuguacauauguc

SEQ ID NO: 25766 - RNA, 22 nt, Homo sapiens
uguauguugggucaaaguacau

SEQ ID NO: 25767 - RNA, 22 nt, Homo sapiens
uguauguuguaagacuuagacc

SEQ ID NO: 25768 - RNA, 22 nt, Homo sapiens
uguauguuuaaggccaguggaa

SEQ ID NO: 25769 - RNA, 16 nt, Homo sapiens
uguauugcuaaaaaga

SEQ ID NO: 25770 - RNA, 22 nt, Homo sapiens
ugucaacauuuaucaaguuauu

SEQ ID NO: 25771 - RNA, 22 nt, Homo sapiens
ugucaagaugguuugauguugu

SEQ ID NO: 25772 - RNA, 22 nt, Homo sapiens
ugucaaggaaugucauugguuu

SEQ ID NO: 25773 - RNA, 22 nt, Homo sapiens
ugucaaguugugguucaauuuu

SEQ ID NO: 25774 - RNA, 22 nt, Homo sapiens
ugucaaugggaauuuguuuuag

SEQ ID NO: 25775 - RNA, 22 nt, Homo sapiens
ugucacagagauuuugguaugu

SEQ ID NO: 25776 - RNA, 22 nt, Homo sapiens
ugucacaguuuguacuuuauag

SEQ ID NO: 25777 - RNA, 18 nt, Homo sapiens
ugucacuggauaaugguc

SEQ ID NO: 25778 - RNA, 22 nt, Homo sapiens
ugucacuuugccuucuggacuu

SEQ ID NO: 25779 - RNA, 22 nt, Homo sapiens
ugucagaaucugagacgacaac

SEQ ID NO: 25780 - RNA, 22 nt, Homo sapiens
ugucaggaggguccagagaaaa

SEQ ID NO: 25781 - RNA, 22 nt, Homo sapiens
ugucaguguacuguaagaauua

SEQ ID NO: 25782 - RNA, 22 nt, Homo sapiens
ugucauagaugauuuuuuucgg

SEQ ID NO: 25783 - RNA, 19 nt, Homo sapiens
ugucaucaucuuuucuugc

SEQ ID NO: 25784 - RNA, 22 nt, Homo sapiens
ugucaucauuggaaucugccuc

SEQ ID NO: 25785 - RNA, 22 nt, Homo sapiens
ugucaugagucuccuccaucuu

SEQ ID NO: 25786 - RNA, 22 nt, Homo sapiens
ugucauggugcucugggcccug

SEQ ID NO: 25787 - RNA, 22 nt, Homo sapiens
uguccaaauugaaucaucuggu

SEQ ID NO: 25788 - RNA, 22 nt, Homo sapiens
ugucccaguuggguauugaauu

SEQ ID NO: 25789 - RNA, 22 nt, Homo sapiens
uguccugaagcuuuguuaugua

SEQ ID NO: 25790 - RNA, 22 nt, Homo sapiens
uguccugcagagguguuugccu

SEQ ID NO: 25791 - RNA, 22 nt, Homo sapiens
uguccuguaggaggcagaacaa

SEQ ID NO: 25792 - RNA, 22 nt, Homo sapiens
ugucuagaaaagccugccuucu

SEQ ID NO: 25793 - RNA, 22 nt, Homo sapiens
ugucuagaucugaauguaauug

SEQ ID NO: 25794 - RNA, 20 nt, Homo sapiens
ugucuauggggguucucugc

SEQ ID NO: 25795 - RNA, 22 nt, Homo sapiens
ugucucccuucccauuaggaag

SEQ ID NO: 25796 - RNA, 22 nt, Homo sapiens
ugucuggaguccauagaagugu

SEQ ID NO: 25797 - RNA, 16 nt, Homo sapiens
ugucuguuugggcaca

SEQ ID NO: 25798 - RNA, 22 nt, Homo sapiens
ugucuuuguuaguuguccuagu

SEQ ID NO: 25799 - RNA, 23 nt, Homo sapiens
ugcaguagugagaucuaggcuca

SEQ ID NO: 25800 - RNA, 22 nt, Homo sapiens
ugcagugcaugacuguguuaug

SEQ ID NO: 25801 - RNA, 20 nt, Homo sapiens
ugcaguguccucacuuguca

SEQ ID NO: 25802 - RNA, 22 nt, Homo sapiens
ugcauaauuccuugcaccagaa

SEQ ID NO: 25803 - RNA, 21 nt, Homo sapiens
ugcauacuucucagaugauua

SEQ ID NO: 25804 - RNA, 22 nt, Homo sapiens
ugcauauguucaaaguauucug

SEQ ID NO: 25805 - RNA, 21 nt, Homo sapiens
ugcauauuggaacuuucucuc

SEQ ID NO: 25806 - RNA, 21 nt, Homo sapiens
ugcauggagaacacugagggu

SEQ ID NO: 25807 - RNA, 22 nt, Homo sapiens
ugcauggauguuugaacacacu

SEQ ID NO: 25808 - RNA, 22 nt, Homo sapiens
ugcauuagucuguucucacacu

SEQ ID NO: 25809 - RNA, 20 nt, Homo sapiens
ugccaagaugacuauagcuc

SEQ ID NO: 25810 - RNA, 22 nt, Homo sapiens
ugccaguauuuuauugaagauu

SEQ ID NO: 25811 - RNA, 22 nt, Homo sapiens
ugcccuguaucccacuguuuca

SEQ ID NO: 25812 - RNA, 22 nt, Homo sapiens
ugccuacuuugcaucugucagg

SEQ ID NO: 25813 - RNA, 23 nt, Homo sapiens
ugccuagaccaucagccugaggu

SEQ ID NO: 25814 - RNA, 22 nt, Homo sapiens
ugccuaggcuggaaugcaaugg

SEQ ID NO: 25815 - RNA, 22 nt, Homo sapiens
ugccuaggcuggagugcagugg

SEQ ID NO: 25816 - RNA, 22 nt, Homo sapiens
ugccuaggcuggaguguagugg

SEQ ID NO: 25817 - RNA, 22 nt, Homo sapiens
ugccugcugucuaauauauucu

SEQ ID NO: 25818 - RNA, 22 nt, Homo sapiens
ugcgauuauuaugucacuuccu

SEQ ID NO: 25819 - RNA, 22 nt, Homo sapiens
ugcgccauugaacuccuccugg

SEQ ID NO: 25820 - RNA, 22 nt, Homo sapiens
ugcgguagugcaaucauggcuc

SEQ ID NO: 25821 - RNA, 22 nt, Homo sapiens
ugcuagaugaaguuugaguuuu

SEQ ID NO: 25822 - RNA, 18 nt, Homo sapiens
ugcuaugagauuauuuua

SEQ ID NO: 25823 - RNA, 22 nt, Homo sapiens
ugcuaugucuucucucacagag

SEQ ID NO: 25824 - RNA, 21 nt, Homo sapiens
ugcuauguuguccaggcuggc

SEQ ID NO: 25825 - RNA, 22 nt, Homo sapiens
ugcuauguuuucccuccuuauc

SEQ ID NO: 25826 - RNA, 22 nt, Homo sapiens
uuaugacaggcucaggagcccc

SEQ ID NO: 25827 - RNA, 17 nt, Homo sapiens
uuaugagacuucuuagc

SEQ ID NO: 25828 - RNA, 22 nt, Homo sapiens
uuaugcagcaaagugcuugaaa

SEQ ID NO: 25829 - RNA, 22 nt, Homo sapiens
uuauggcuauugaugacaauug

SEQ ID NO: 25830 - RNA, 23 nt, Homo sapiens
uuauggcuuuuauuauguugagg

SEQ ID NO: 25831 - RNA, 22 nt, Homo sapiens
uuaugggucuuggaaugcaaua

SEQ ID NO: 25832 - RNA, 22 nt, Homo sapiens
uuauguaaaucaaucuggaauc

SEQ ID NO: 25833 - RNA, 22 nt, Homo sapiens
uuauguccuuuaacuucaucac

SEQ ID NO: 25834 - RNA, 22 nt, Homo sapiens
uuaugugccuuuuugccauuca

SEQ ID NO: 25835 - RNA, 22 nt, Homo sapiens
uuauuagguuagugcaaaaguu

SEQ ID NO: 25836 - RNA, 22 nt, Homo sapiens
uuauucauuaacagggaccaaa

SEQ ID NO: 25837 - RNA, 22 nt, Homo sapiens
uuauugcacuccagccugggua

SEQ ID NO: 25838 - RNA, 22 nt, Homo sapiens
uuauugcuaaaucaugaccaca

SEQ ID NO: 25839 - RNA, 22 nt, Homo sapiens
uuauugcuuuugugcaggugag

SEQ ID NO: 25840 - RNA, 22 nt, Homo sapiens
uucaaaggauagauuaagauca

SEQ ID NO: 25841 - RNA, 22 nt, Homo sapiens
uucaaaucuucguuuugccaua

SEQ ID NO: 25842 - RNA, 23 nt, Homo sapiens
uucaaauguucucugguugucag

SEQ ID NO: 25843 - RNA, 22 nt, Homo sapiens
uucaagaauuaaaguggcuuuu

SEQ ID NO: 25844 - RNA, 22 nt, Homo sapiens
uucaaggacuaaggauuuuugg

SEQ ID NO: 25845 - RNA, 22 nt, Homo sapiens
uucaagucuuggcuuugccacc

SEQ ID NO: 25846 - RNA, 22 nt, Homo sapiens
uucacacugggccuacucugug

SEQ ID NO: 25847 - RNA, 22 nt, Homo sapiens
uucacagcuuaauaaggcucag

SEQ ID NO: 25848 - RNA, 22 nt, Homo sapiens
uucaccagggaagucucaacuc

SEQ ID NO: 25849 - RNA, 21 nt, Homo sapiens
uucaccauggcuccacacucu

SEQ ID NO: 25850 - RNA, 22 nt, Homo sapiens
uucaccuugcccacagcagucu

SEQ ID NO: 25851 - RNA, 22 nt, Homo sapiens
uucacugagccagacuaagaca

SEQ ID NO: 25852 - RNA, 22 nt, Homo sapiens
uucacugcacuccagccugagc

SEQ ID NO: 25853 - RNA, 22 nt, Homo sapiens
uucacugcacuccagccugggu

SEQ ID NO: 25854 - RNA, 22 nt, Homo sapiens
uucacuguuaagcaguuaaacu

SEQ ID NO: 25855 - RNA, 22 nt, Homo sapiens
uucagagagggagggauaccua

SEQ ID NO: 25856 - RNA, 22 nt, Homo sapiens
uucagaucaucccagcuccacu

SEQ ID NO: 25857 - RNA, 22 nt, Homo sapiens
uucagaugcacacuguagucua

SEQ ID NO: 25858 - RNA, 20 nt, Homo sapiens
uucagcaaaggaaugggagu

SEQ ID NO: 25859 - RNA, 22 nt, Homo sapiens
uucagcaaugacagccuauaua

SEQ ID NO: 25860 - RNA, 22 nt, Homo sapiens
uucaggcaccauugucauugau

SEQ ID NO: 25861 - RNA, 22 nt, Homo sapiens
uucaggguggagaguaugaggu

SEQ ID NO: 25862 - RNA, 22 nt, Homo sapiens
uucagguaauuaugguuugucu

SEQ ID NO: 25863 - RNA, 22 nt, Homo sapiens
uucagguacugggggaguaugg

SEQ ID NO: 25864 - RNA, 22 nt, Homo sapiens
uucaguagucaaaagauaaggg

SEQ ID NO: 25865 - RNA, 22 nt, Homo sapiens
uucaguauugcaccuggagucc

SEQ ID NO: 25866 - RNA, 22 nt, Homo sapiens
uucaguucugcucugaucuuag

SEQ ID NO: 25867 - RNA, 19 nt, Homo sapiens
uucauacagugagagcagc

SEQ ID NO: 25868 - RNA, 22 nt, Homo sapiens
uucauaguaacaguaacuaugg

SEQ ID NO: 25869 - RNA, 22 nt, Homo sapiens
uucauaguauuuuucuccaaau

SEQ ID NO: 25870 - RNA, 22 nt, Homo sapiens
uucauagucuaauuuuuuccac

SEQ ID NO: 25871 - RNA, 22 nt, Homo sapiens
uucauagugaaaaauucaaagu

SEQ ID NO: 25872 - RNA, 22 nt, Homo sapiens
uucauaguucuuuuagucauua

SEQ ID NO: 25873 - RNA, 22 nt, Homo sapiens
uucaucaggaauauugaccugu

SEQ ID NO: 25874 - RNA, 22 nt, Homo sapiens
uucauggaauauugaccauuuu

SEQ ID NO: 25875 - RNA, 22 nt, Homo sapiens
uucauguaauauauuucaggcc

SEQ ID NO: 25876 - RNA, 22 nt, Homo sapiens
uucauguaauauuucacagcuu

SEQ ID NO: 25877 - RNA, 22 nt, Homo sapiens
uucauugcugcuuaucuccaga

SEQ ID NO: 25878 - RNA, 22 nt, Homo sapiens
uuccacaauggcugaacuaguu

SEQ ID NO: 25879 - RNA, 22 nt, Homo sapiens
uuccacaaugguugaacuaguu

SEQ ID NO: 25880 - RNA, 23 nt, Homo sapiens
uuccaccauugacuaguuacaua

SEQ ID NO: 25881 - RNA, 20 nt, Homo sapiens
uuccagcacauuagggaagc

SEQ ID NO: 25882 - RNA, 22 nt, Homo sapiens
uuccauguugauacgugaaguu

SEQ ID NO: 25883 - RNA, 22 nt, Homo sapiens
uucccagagagggacuucuaau

SEQ ID NO: 25884 - RNA, 22 nt, Homo sapiens
uucccagugccaggcacuggga

SEQ ID NO: 25885 - RNA, 22 nt, Homo sapiens
uucccuguaucuucugccaugu

SEQ ID NO: 25886 - RNA, 22 nt, Homo sapiens
uucccugugggaguaggaaagu

SEQ ID NO: 25887 - RNA, 22 nt, Homo sapiens
uucccugugggcuggugcucca

SEQ ID NO: 25888 - RNA, 22 nt, Homo sapiens
uucccuuucugaaaaucucauu

SEQ ID NO: 25889 - RNA, 22 nt, Homo sapiens
uuccugagagggcugggugcag

SEQ ID NO: 25890 - RNA, 22 nt, Homo sapiens
uuccugagccuuguaucuagua

SEQ ID NO: 25891 - RNA, 22 nt, Homo sapiens
uuccuggaggggaaguguccaa

SEQ ID NO: 25892 - RNA, 22 nt, Homo sapiens
uuccuguagcgauuuuaguaau

SEQ ID NO: 25893 - RNA, 22 nt, Homo sapiens
uuccugugacccccaagcccac

SEQ ID NO: 25894 - RNA, 22 nt, Homo sapiens
uuccuucaugcuugaaggguau

SEQ ID NO: 25895 - RNA, 22 nt, Homo sapiens
uuccuuguagcaaaugcgauga

SEQ ID NO: 25896 - RNA, 22 nt, Homo sapiens
uuccuugugacuaguagugacc

SEQ ID NO: 25897 - RNA, 22 nt, Homo sapiens
uucuaaguaagucuguggggaa

SEQ ID NO: 25898 - RNA, 22 nt, Homo sapiens
uucuacagugacugcagccaua

SEQ ID NO: 25899 - RNA, 20 nt, Homo sapiens
uucuauggugaugaguccug

SEQ ID NO: 25900 - RNA, 22 nt, Homo sapiens
uucuaugguuaccaggcuaguc

SEQ ID NO: 25901 - RNA, 22 nt, Homo sapiens
uucuauguuugaaaaugccaaa

SEQ ID NO: 25902 - RNA, 22 nt, Homo sapiens
uucuauugguaauauuuucugu

SEQ ID NO: 25903 - RNA, 22 nt, Homo sapiens
uucucacaguacagggagcucu

SEQ ID NO: 25904 - RNA, 21 nt, Homo sapiens
uucucagaggcaggggauaaa

SEQ ID NO: 25905 - RNA, 22 nt, Homo sapiens
uucucaguaauuccagauuuuu

SEQ ID NO: 25906 - RNA, 22 nt, Homo sapiens
uucucaguucgguggcagugcu

SEQ ID NO: 25907 - RNA, 22 nt, Homo sapiens
uucuggcucaggucaacacuuc

SEQ ID NO: 25908 - RNA, 22 nt, Homo sapiens
uucuggcucgauucucugaccg

SEQ ID NO: 25909 - RNA, 22 nt, Homo sapiens
uugcauagaccgaugucuugga

SEQ ID NO: 25910 - RNA, 22 nt, Homo sapiens
uugcauauguugaaccaagcgu

SEQ ID NO: 25911 - RNA, 22 nt, Homo sapiens
uugcaucagcaggcauaauugg

SEQ ID NO: 25912 - RNA, 18 nt, Homo sapiens
uugcaucauuuuguuguu

SEQ ID NO: 25913 - RNA, 22 nt, Homo sapiens
uugcaugcacaguucucaauag

SEQ ID NO: 25914 - RNA, 22 nt, Homo sapiens
uugcaugggagcugggugaggc

SEQ ID NO: 25915 - RNA, 22 nt, Homo sapiens
uugcaugucugcuucuccuccu

SEQ ID NO: 25916 - RNA, 22 nt, Homo sapiens
uugcauuagugugguacauuug

SEQ ID NO: 25917 - RNA, 22 nt, Homo sapiens
uugccaucaucucuuacucagu

SEQ ID NO: 25918 - RNA, 22 nt, Homo sapiens
uugccuaggcuggagugcagua

SEQ ID NO: 25919 - RNA, 22 nt, Homo sapiens
uugccuaggcuggauugcagug

SEQ ID NO: 25920 - RNA, 18 nt, Homo sapiens
uugccuauucacucugau

SEQ ID NO: 25921 - RNA, 22 nt, Homo sapiens
uugcgcuuuuccuauguugccc

SEQ ID NO: 25922 - RNA, 22 nt, Homo sapiens
uugcggcaguacagcccaggua

SEQ ID NO: 25923 - RNA, 22 nt, Homo sapiens
uugcuacauugauugccucuuu

SEQ ID NO: 25924 - RNA, 22 nt, Homo sapiens
uugcucaccugagaagaauaga

SEQ ID NO: 25925 - RNA, 22 nt, Homo sapiens
uugcuccccaggaaaggaagca

SEQ ID NO: 25926 - RNA, 22 nt, Homo sapiens
uugcuccucugccaggaccugu

SEQ ID NO: 25927 - RNA, 22 nt, Homo sapiens
uugcuggugguucgagcaacac

SEQ ID NO: 25928 - RNA, 22 nt, Homo sapiens
uugcugguuuucauaugagcag

SEQ ID NO: 25929 - RNA, 22 nt, Homo sapiens
uuggaaacgucaccuuuuccuu

SEQ ID NO: 25930 - RNA, 22 nt, Homo sapiens
uuggaacacauguuuuucuacc

SEQ ID NO: 25931 - RNA, 22 nt, Homo sapiens
uuggaagcacauuguuuaauua

SEQ ID NO: 25932 - RNA, 22 nt, Homo sapiens
uuggaaggcugaauggccucuc

SEQ ID NO: 25933 - RNA, 22 nt, Homo sapiens
uuggaagguaaucaaaaguucu

SEQ ID NO: 25934 - RNA, 22 nt, Homo sapiens
uuggaauacucaaaagguuggg

SEQ ID NO: 25935 - RNA, 22 nt, Homo sapiens
uuggaaugcaacagaaggauaa

SEQ ID NO: 25936 - RNA, 22 nt, Homo sapiens
uuggaauguauggcaucuugcg

SEQ ID NO: 25937 - RNA, 22 nt, Homo sapiens
uuggaauuaaccuggugcugga

SEQ ID NO: 25938 - RNA, 22 nt, Homo sapiens
uuggaauuuuacuucuguaaga

SEQ ID NO: 25939 - RNA, 22 nt, Homo sapiens
uuggacugagaguuccaccauu

SEQ ID NO: 25940 - RNA, 22 nt, Homo sapiens
uuggacuggaacuauaccauug

SEQ ID NO: 25941 - RNA, 22 nt, Homo sapiens
uuggacugugagguuucguggg

SEQ ID NO: 25942 - RNA, 22 nt, Homo sapiens
uuggagagaaaggcaguuccug

SEQ ID NO: 25943 - RNA, 22 nt, Homo sapiens
uuggagagucacuaguuagugc

SEQ ID NO: 25944 - RNA, 22 nt, Homo sapiens
uuggcaaagaggaaugccacuu

SEQ ID NO: 25945 - RNA, 22 nt, Homo sapiens
uuggcaaauagguuuuauugca

SEQ ID NO: 25946 - RNA, 22 nt, Homo sapiens
uuggcaacauagugagaccccc

SEQ ID NO: 25947 - RNA, 22 nt, Homo sapiens
uuggcaagaauguaugccgauc

SEQ ID NO: 25948 - RNA, 22 nt, Homo sapiens
uuggcaagcuguuaauuauaaa

SEQ ID NO: 25949 - RNA, 22 nt, Homo sapiens
uuggcaauucagauucuuuuau

SEQ ID NO: 25950 - RNA, 22 nt, Homo sapiens
uuggcagaaaaggucggggguu

SEQ ID NO: 25951 - RNA, 19 nt, Homo sapiens
uuggcagaguugcccccua

SEQ ID NO: 25952 - RNA, 22 nt, Homo sapiens
uuggcagugcccgaugcugggg

SEQ ID NO: 25953 - RNA, 22 nt, Homo sapiens
uuggcauaguugcacuuacuag

SEQ ID NO: 25954 - RNA, 22 nt, Homo sapiens
uuggccagugucuuuuuuuccu

SEQ ID NO: 25955 - RNA, 22 nt, Homo sapiens
uuggccauggagcacuuuucua

SEQ ID NO: 25956 - RNA, 22 nt, Homo sapiens
uuggccccuuucauccacagcu

SEQ ID NO: 25957 - RNA, 22 nt, Homo sapiens
uuggccuuuucaaugccucuuu

SEQ ID NO: 25958 - RNA, 22 nt, Homo sapiens
uuggcuacagauuaugaauuuc

SEQ ID NO: 25959 - RNA, 22 nt, Homo sapiens
uuggcuauagauacauggauua

SEQ ID NO: 25960 - RNA, 22 nt, Homo sapiens
uuggcuguguuucccuacaaau

SEQ ID NO: 25961 - RNA, 22 nt, Homo sapiens
uuggcuuguaaaaugaaaagcu

SEQ ID NO: 25962 - RNA, 22 nt, Homo sapiens
uugggauaaucacaaaguaaaa

SEQ ID NO: 25963 - RNA, 21 nt, Homo sapiens
uuggggaauggagagguuuuc

SEQ ID NO: 25964 - RNA, 22 nt, Homo sapiens
uuggggcacggccucuguugcc

SEQ ID NO: 25965 - RNA, 22 nt, Homo sapiens
uugguaagguggaugaugaaua

SEQ ID NO: 25966 - RNA, 22 nt, Homo sapiens
uugguacuagcugaucgcagag

SEQ ID NO: 25967 - RNA, 22 nt, Homo sapiens
uugguccacugugaaauuggga

SEQ ID NO: 25968 - RNA, 22 nt, Homo sapiens
uuggucucuuaaucacacuuuu

SEQ ID NO: 25969 - RNA, 22 nt, Homo sapiens
uugguuccauuuuaccagcucu

SEQ ID NO: 25970 - RNA, 22 nt, Homo sapiens
uuguaacaugcuuucacuucag

SEQ ID NO: 25971 - RNA, 23 nt, Homo sapiens
uuguaacuggagaguaacauucc

SEQ ID NO: 25972 - RNA, 22 nt, Homo sapiens
uuguacuagucauauuuugaaa

SEQ ID NO: 25973 - RNA, 22 nt, Homo sapiens
uuguaguagucucguucuuuua

SEQ ID NO: 25974 - RNA, 22 nt, Homo sapiens
uuguaguguuuauucugucaac

SEQ ID NO: 25975 - RNA, 22 nt, Homo sapiens
uuguauacucuauuuuagcagu

SEQ ID NO: 25976 - RNA, 22 nt, Homo sapiens
uuguauccaucuuucaggcaac

SEQ ID NO: 25977 - RNA, 22 nt, Homo sapiens
uuguaugucuucauuugaaaaa

SEQ ID NO: 25978 - RNA, 22 nt, Homo sapiens
uugucaccucuaaaucucauau

SEQ ID NO: 25979 - RNA, 22 nt, Homo sapiens
uugucacuauaaauaagcauuu

SEQ ID NO: 25980 - RNA, 22 nt, Homo sapiens
uuguccacugcuagccucugca

SEQ ID NO: 25981 - RNA, 22 nt, Homo sapiens
uuguccccuuccaaaucucaug

SEQ ID NO: 25982 - RNA, 21 nt, Homo sapiens
uugucuagagaaauauaucuc

SEQ ID NO: 25983 - RNA, 22 nt, Homo sapiens
uugugaaaaaccucucguggaa

SEQ ID NO: 25984 - RNA, 22 nt, Homo sapiens
uugugaagaaaccagaaaaguu

SEQ ID NO: 25985 - RNA, 22 nt, Homo sapiens
uugugaauggugcugcaguaaa

SEQ ID NO: 25986 - RNA, 22 nt, Homo sapiens
uugugcaaaaguaauugcgguu

SEQ ID NO: 25987 - RNA, 22 nt, Homo sapiens
uugugccacugaagcccuccag

SEQ ID NO: 25988 - RNA, 22 nt, Homo sapiens
uugugccauucuucugccucag

SEQ ID NO: 25989 - RNA, 19 nt, Homo sapiens
uugugggaggacagagggg

SEQ ID NO: 25990 - RNA, 22 nt, Homo sapiens
uugugguaggaguugccauguu

SEQ ID NO: 25991 - RNA, 22 nt, Homo sapiens
uugugguaggaugaagagauga

SEQ ID NO: 25992 - RNA, 22 nt, Homo sapiens
uugugguugauacacguaggaa

SEQ ID NO: 25993 - RNA, 22 nt, Homo sapiens
uugugguugaugaagacugucu

SEQ ID NO: 25994 - RNA, 22 nt, Homo sapiens
uugugucaaauggcaauuagca

SEQ ID NO: 25995 - RNA, 22 nt, Homo sapiens
uuguguccccacccaaaucuca

SEQ ID NO: 25996 - RNA, 22 nt, Homo sapiens
uugugucccugcggcugaggag

SEQ ID NO: 25997 - RNA, 22 nt, Homo sapiens
uuguguuugaugcugacacgca

SEQ ID NO: 25998 - RNA, 22 nt, Homo sapiens
uuguuauguuaaacuacugaaa

SEQ ID NO: 25999 - RNA, 23 nt, Homo sapiens
uuguucccuuccacucagucucc

SEQ ID NO: 26000 - RNA, 22 nt, Homo sapiens
uuuaaagcuaaaauauguuuau

SEQ ID NO: 26001 - RNA, 22 nt, Homo sapiens
uuuaauacugcaucuuuacucu

SEQ ID NO: 26002 - RNA, 22 nt, Homo sapiens
uuuacugugggguuucuuagag

SEQ ID NO: 26003 - RNA, 22 nt, Homo sapiens
uuuagcaaugcuguggggaagu

SEQ ID NO: 26004 - RNA, 22 nt, Homo sapiens
uuuagcucauucaauuucaguc

SEQ ID NO: 26005 - RNA, 22 nt, Homo sapiens
uuuaucuguuuaaaacuguuca

SEQ ID NO: 26006 - RNA, 22 nt, Homo sapiens
uuuaugucuguacaucgggcgg

SEQ ID NO: 26007 - RNA, 22 nt, Homo sapiens
uuuauucggcuaggagcuucgg

SEQ ID NO: 26008 - RNA, 22 nt, Homo sapiens
uuuauugcucuaaaguugccau

SEQ ID NO: 26009 - RNA, 22 nt, Homo sapiens
uuucaacaggucuggggugguc

SEQ ID NO: 26010 - RNA, 22 nt, Homo sapiens
ugugcaguuuugagugaauuuc

SEQ ID NO: 26011 - RNA, 22 nt, Homo sapiens
ugugcauaugucuuuauaguag

SEQ ID NO: 26012 - RNA, 22 nt, Homo sapiens
ugugccacugcacucugggcaa

SEQ ID NO: 26013 - RNA, 22 nt, Homo sapiens
ugugccuucuaagaaggagucu

SEQ ID NO: 26014 - RNA, 22 nt, Homo sapiens
ugugcgugugccuguaagaauu

SEQ ID NO: 26015 - RNA, 22 nt, Homo sapiens
ugugcucaucucagucaacugu

SEQ ID NO: 26016 - RNA, 22 nt, Homo sapiens
ugugcuuguaaaggccagagca

SEQ ID NO: 26017 - RNA, 22 nt, Homo sapiens
uguggaaauggugcuacgaaca

SEQ ID NO: 26018 - RNA, 22 nt, Homo sapiens
uguggaguguaugugacagaga

SEQ ID NO: 26019 - RNA, 17 nt, Homo sapiens
uguggcucuuaugcuga

SEQ ID NO: 26020 - RNA, 22 nt, Homo sapiens
uguggcugguggcaccuuuucc

SEQ ID NO: 26021 - RNA, 22 nt, Homo sapiens
uguggcuuuacagcaugguuca

SEQ ID NO: 26022 - RNA, 22 nt, Homo sapiens
ugugggaggugcuaauguaaau

SEQ ID NO: 26023 - RNA, 22 nt, Homo sapiens
uguggucaucacuugaagguaa

SEQ ID NO: 26024 - RNA, 22 nt, Homo sapiens
ugugguuuuaguaaaacuaugu

SEQ ID NO: 26025 - RNA, 22 nt, Homo sapiens
ugugguuuuauaaacgugaccu

SEQ ID NO: 26026 - RNA, 22 nt, Homo sapiens
ugugguuuuucacauuuagaga

SEQ ID NO: 26027 - RNA, 22 nt, Homo sapiens
uguguaaagcuuguuccagaaa

SEQ ID NO: 26028 - RNA, 22 nt, Homo sapiens
uguguaaauaugauagaggaau

SEQ ID NO: 26029 - RNA, 22 nt, Homo sapiens
uguguauaucacugcaugagug

SEQ ID NO: 26030 - RNA, 22 nt, Homo sapiens
ugugucacugcacuccagccug

SEQ ID NO: 26031 - RNA, 22 nt, Homo sapiens
ugugucuacugagaugaucaug

SEQ ID NO: 26032 - RNA, 16 nt, Homo sapiens
ugugucuugggcccug

SEQ ID NO: 26033 - RNA, 22 nt, Homo sapiens
ugugucuuuuaucacacaaugu

SEQ ID NO: 26034 - RNA, 21 nt, Homo sapiens
uguuaacaugcagauuacugg

SEQ ID NO: 26035 - RNA, 22 nt, Homo sapiens
uguucacaguguuucuuugaga

SEQ ID NO: 26036 - RNA, 22 nt, Homo sapiens
uguucauggauccaguggcuuc

SEQ ID NO: 26037 - RNA, 22 nt, Homo sapiens
uguucuugagccuuuagaccua

SEQ ID NO: 26038 - RNA, 22 nt, Homo sapiens
uguugcacuccagccugggcaa

SEQ ID NO: 26039 - RNA, 19 nt, Homo sapiens
uguugcacuccagcuuggg

SEQ ID NO: 26040 - RNA, 22 nt, Homo sapiens
uguugcacugguaauguacuga

SEQ ID NO: 26041 - RNA, 22 nt, Homo sapiens
uguuggcauugcugcugacccu

SEQ ID NO: 26042 - RNA, 22 nt, Homo sapiens
uguuugcuuaacguggagccag

SEQ ID NO: 26043 - RNA, 22 nt, Homo sapiens
uuaaaccugucuucucacuaau

SEQ ID NO: 26044 - RNA, 22 nt, Homo sapiens
uuaaaguaauugaaauggccuu

SEQ ID NO: 26045 - RNA, 22 nt, Homo sapiens
uuaaagugaucauaaggauagu

SEQ ID NO: 26046 - RNA, 22 nt, Homo sapiens
uuaaauacagcaugguguuucu

SEQ ID NO: 26047 - RNA, 22 nt, Homo sapiens
uuaacacugccauugauacugu

SEQ ID NO: 26048 - RNA, 22 nt, Homo sapiens
uuaagcaguaguuaaggagagg

SEQ ID NO: 26049 - RNA, 22 nt, Homo sapiens
uuaaggaaggagucuuaaaugg

SEQ ID NO: 26050 - RNA, 18 nt, Homo sapiens
uuaaggcaggacuuuaag

SEQ ID NO: 26051 - RNA, 22 nt, Homo sapiens
uuaaggcagugcaucuggaguu

SEQ ID NO: 26052 - RNA, 22 nt, Homo sapiens
uuaaggcagugucuaugccagu

SEQ ID NO: 26053 - RNA, 22 nt, Homo sapiens
uuaaggcuccuguuggcuuuua

SEQ ID NO: 26054 - RNA, 22 nt, Homo sapiens
uuaaggcuuguacuuguuuucu

SEQ ID NO: 26055 - RNA, 19 nt, Homo sapiens
uuaagguacuuagaugugu

SEQ ID NO: 26056 - RNA, 23 nt, Homo sapiens
uuaaggugaugucuuugugccuc

SEQ ID NO: 26057 - RNA, 22 nt, Homo sapiens
uuaagguuuuuguagcaaggau

SEQ ID NO: 26058 - RNA, 22 nt, Homo sapiens
uuaagugaauuaucuaacaugu

SEQ ID NO: 26059 - RNA, 22 nt, Homo sapiens
uuaaguguaaguggugugggac

SEQ ID NO: 26060 - RNA, 22 nt, Homo sapiens
uuaaguuguagcuacaaauaca

SEQ ID NO: 26061 - RNA, 22 nt, Homo sapiens
uuaaucacagcugaacucaaac

SEQ ID NO: 26062 - RNA, 22 nt, Homo sapiens
uuaaucacagugucuuccuuca

SEQ ID NO: 26063 - RNA, 22 nt, Homo sapiens
uuaaucaggccguuuccuaaga

SEQ ID NO: 26064 - RNA, 22 nt, Homo sapiens
uuaaugcuuuugggauauuucu

SEQ ID NO: 26065 - RNA, 22 nt, Homo sapiens
uuaauguaauugauugauugac

SEQ ID NO: 26066 - RNA, 22 nt, Homo sapiens
uuaauuguccauuauucuguuc

SEQ ID NO: 26067 - RNA, 22 nt, Homo sapiens
uuacaagaugucuguccaacac

SEQ ID NO: 26068 - RNA, 21 nt, Homo sapiens
uuacaauggcuccuugaaggu

SEQ ID NO: 26069 - RNA, 22 nt, Homo sapiens
uuacaguugugagccaccaugc

SEQ ID NO: 26070 - RNA, 22 nt, Homo sapiens
uuacaucaucacauuaguuugc

SEQ ID NO: 26071 - RNA, 22 nt, Homo sapiens
uuacauugcuucaaauucagug

SEQ ID NO: 26072 - RNA, 22 nt, Homo sapiens
uuaccacagugccugucuaaug

SEQ ID NO: 26073 - RNA, 22 nt, Homo sapiens
uuacuacucucuaugaccaguu

SEQ ID NO: 26074 - RNA, 22 nt, Homo sapiens
uuacuagaaacagggcuucgcc

SEQ ID NO: 26075 - RNA, 22 nt, Homo sapiens
uuacuauguuucaaagugucuc

SEQ ID NO: 26076 - RNA, 22 nt, Homo sapiens
uuacugcauaauuccugggaag

SEQ ID NO: 26077 - RNA, 22 nt, Homo sapiens
uuacuugagaugaguuggacaa

SEQ ID NO: 26078 - RNA, 22 nt, Homo sapiens
uuagacacacauacauuuaucu

SEQ ID NO: 26079 - RNA, 22 nt, Homo sapiens
uuagaucaacauggaacucuau

SEQ ID NO: 26080 - RNA, 22 nt, Homo sapiens
uuagauuauugguguuuugcaa

SEQ ID NO: 26081 - RNA, 22 nt, Homo sapiens
uuagcacaguucauucauguua

SEQ ID NO: 26082 - RNA, 22 nt, Homo sapiens
uuagcacuaauucguuggggca

SEQ ID NO: 26083 - RNA, 22 nt, Homo sapiens
uuagcagcacaaaagcagacua

SEQ ID NO: 26084 - RNA, 22 nt, Homo sapiens
uuagcagcucuaauaacugcua

SEQ ID NO: 26085 - RNA, 22 nt, Homo sapiens
uuagcagugucccacuccuugg

SEQ ID NO: 26086 - RNA, 22 nt, Homo sapiens
uuagcagugugaaaaaagacua

SEQ ID NO: 26087 - RNA, 22 nt, Homo sapiens
uuagcauccauaggagauuggu

SEQ ID NO: 26088 - RNA, 21 nt, Homo sapiens
uuagcauccauguucaucaac

SEQ ID NO: 26089 - RNA, 22 nt, Homo sapiens
uuagccccuuugagccucaacu

SEQ ID NO: 26090 - RNA, 22 nt, Homo sapiens
uaugcuuauugucucauccacu

SEQ ID NO: 26091 - RNA, 22 nt, Homo sapiens
uauggauguuaagguucacagc

SEQ ID NO: 26092 - RNA, 22 nt, Homo sapiens
uauggauucuagcucaguaggu

SEQ ID NO: 26093 - RNA, 21 nt, Homo sapiens
uauggauuugccuauucugga

SEQ ID NO: 26094 - RNA, 22 nt, Homo sapiens
uauggauuuuuuugacaagagc

SEQ ID NO: 26095 - RNA, 22 nt, Homo sapiens
uauggcaaugcauaggaaggaa

SEQ ID NO: 26096 - RNA, 22 nt, Homo sapiens
uauggcacuaguacuggaaagc

SEQ ID NO: 26097 - RNA, 22 nt, Homo sapiens
uauggccacugucuuugaguca

SEQ ID NO: 26098 - RNA, 22 nt, Homo sapiens
uauggcuacuacgaauaaugcu

SEQ ID NO: 26099 - RNA, 22 nt, Homo sapiens
uauggcugugacuuaucuuguu

SEQ ID NO: 26100 - RNA, 22 nt, Homo sapiens
uauggcuuuguuaacauuuucu

SEQ ID NO: 26101 - RNA, 22 nt, Homo sapiens
uauggcuuuucacuuaaguccu

SEQ ID NO: 26102 - RNA, 22 nt, Homo sapiens
uaugguuuuaagguuaaggacu

SEQ ID NO: 26103 - RNA, 20 nt, Homo sapiens
uaugguuuuagguauagcau

SEQ ID NO: 26104 - RNA, 23 nt, Homo sapiens
uaugucuauucuaaugccagcac

SEQ ID NO: 26105 - RNA, 20 nt, Homo sapiens
uauuacagaguaauggugga

SEQ ID NO: 26106 - RNA, 22 nt, Homo sapiens
uauuagguuggugcaacaguaa

SEQ ID NO: 26107 - RNA, 22 nt, Homo sapiens
uauuauuguccuucuauaccca

SEQ ID NO: 26108 - RNA, 22 nt, Homo sapiens
uauucaagccaaauucaagcca

SEQ ID NO: 26109 - RNA, 20 nt, Homo sapiens
uauucacucuccagucuugc

SEQ ID NO: 26110 - RNA, 22 nt, Homo sapiens
uauucacuguaucauugauggg

SEQ ID NO: 26111 - RNA, 22 nt, Homo sapiens
uauuccagcccuggugagccag

SEQ ID NO: 26112 - RNA, 22 nt, Homo sapiens
uauuccauuugggucaggauga

SEQ ID NO: 26113 - RNA, 22 nt, Homo sapiens
uauuccauuugugaaaggaagu

SEQ ID NO: 26114 - RNA, 22 nt, Homo sapiens
uauugaauuuuuaagcccuuug

SEQ ID NO: 26115 - RNA, 17 nt, Homo sapiens
uauugaccuuuguaugu

SEQ ID NO: 26116 - RNA, 22 nt, Homo sapiens
uauugacuugaugagggagggu

SEQ ID NO: 26117 - RNA, 22 nt, Homo sapiens
uauugauuaauugugauuaggc

SEQ ID NO: 26118 - RNA, 22 nt, Homo sapiens
uauugcaauuggcagagugcua

SEQ ID NO: 26119 - RNA, 22 nt, Homo sapiens
uauugcagaaugugaguuggca

SEQ ID NO: 26120 - RNA, 20 nt, Homo sapiens
uauugccuaaauaccagaau

SEQ ID NO: 26121 - RNA, 22 nt, Homo sapiens
uauugcuaaaacucaugguugc

SEQ ID NO: 26122 - RNA, 22 nt, Homo sapiens
uauugcuaaauucuuuuccuag

SEQ ID NO: 26123 - RNA, 22 nt, Homo sapiens
uauugcugaugcugaagggaag

SEQ ID NO: 26124 - RNA, 22 nt, Homo sapiens
uauugcuggauguauuacaugu

SEQ ID NO: 26125 - RNA, 22 nt, Homo sapiens
uauugcuuaugaugcugaauua

SEQ ID NO: 26126 - RNA, 22 nt, Homo sapiens
uauugcuuuuaacccaaucucu

SEQ ID NO: 26127 - RNA, 22 nt, Homo sapiens
uauugggcuucucagaauagag

SEQ ID NO: 26128 - RNA, 22 nt, Homo sapiens
uauuguuuuucccaggagucua

SEQ ID NO: 26129 - RNA, 22 nt, Homo sapiens
uauuugguagcuauuuugcagu

SEQ ID NO: 26130 - RNA, 22 nt, Homo sapiens
uauuugguuauaugaguaaguu

SEQ ID NO: 26131 - RNA, 20 nt, Homo sapiens
uauuugguuauuuccauggu

SEQ ID NO: 26132 - RNA, 22 nt, Homo sapiens
uauuuguccccuccaaaaguca

SEQ ID NO: 26133 - RNA, 22 nt, Homo sapiens
ucaaagacacacaaggagaagg

SEQ ID NO: 26134 - RNA, 20 nt, Homo sapiens
ucaaagacauggcugucaga

SEQ ID NO: 26135 - RNA, 22 nt, Homo sapiens
ucaaaguagaaaaggggcaauu

SEQ ID NO: 26136 - RNA, 22 nt, Homo sapiens
ucaaagucuucucaaguaacau

SEQ ID NO: 26137 - RNA, 22 nt, Homo sapiens
ucaaagugagcuccuucucacu

SEQ ID NO: 26138 - RNA, 22 nt, Homo sapiens
ucaaaugaucugcccgccuugg

SEQ ID NO: 26139 - RNA, 22 nt, Homo sapiens
ucaaaugauucacccaccuuug

SEQ ID NO: 26140 - RNA, 22 nt, Homo sapiens
ucaaaugauucuccugccucag

SEQ ID NO: 26141 - RNA, 17 nt, Homo sapiens
ucaaaugcucccaguga

SEQ ID NO: 26142 - RNA, 22 nt, Homo sapiens
ucaaaugcuguauuguaguaau

SEQ ID NO: 26143 - RNA, 22 nt, Homo sapiens
ucaaauguucccuguacuggcc

SEQ ID NO: 26144 - RNA, 22 nt, Homo sapiens
ucaaauuccaagucuagguagg

SEQ ID NO: 26145 - RNA, 22 nt, Homo sapiens
ucaacagugauggaaaguuaua

SEQ ID NO: 26146 - RNA, 22 nt, Homo sapiens
ucaacauugcugucaggcaucu

SEQ ID NO: 26147 - RNA, 22 nt, Homo sapiens
ucaagaccucacauagaggaga

SEQ ID NO: 26148 - RNA, 22 nt, Homo sapiens
ucaagcaauucuccugccucag

SEQ ID NO: 26149 - RNA, 22 nt, Homo sapiens
gaaucacugugguaucccaugc

SEQ ID NO: 26150 - RNA, 22 nt, Homo sapiens
gaaugaauguuuauccuuagau

SEQ ID NO: 26151 - RNA, 22 nt, Homo sapiens
gaaugguuuacaaguguaaucu

SEQ ID NO: 26152 - RNA, 22 nt, Homo sapiens
gaaugucuuauugcucguugua

SEQ ID NO: 26153 - RNA, 22 nt, Homo sapiens
gaauugcacaaaaacugcuugu

SEQ ID NO: 26154 - RNA, 20 nt, Homo sapiens
gacaaaccuagaugguacag

SEQ ID NO: 26155 - RNA, 22 nt, Homo sapiens
gacacagugaagucucuacuug

SEQ ID NO: 26156 - RNA, 22 nt, Homo sapiens
gacacuggguguuuguuggcgu

SEQ ID NO: 26157 - RNA, 22 nt, Homo sapiens
gacagagcaagacccuauuuaa

SEQ ID NO: 26158 - RNA, 22 nt, Homo sapiens
gacagugagaugucaugugaaa

SEQ ID NO: 26159 - RNA, 22 nt, Homo sapiens
gacauagagccuugacuucauu

SEQ ID NO: 26160 - RNA, 16 nt, Homo sapiens
gacaugaucuuguuua

SEQ ID NO: 26161 - RNA, 22 nt, Homo sapiens
gacauguaaggcucucucuguu

SEQ ID NO: 26162 - RNA, 20 nt, Homo sapiens
gacauguugguuugcugcac

SEQ ID NO: 26163 - RNA, 22 nt, Homo sapiens
gacauguuuucaagauuuauaa

SEQ ID NO: 26164 - RNA, 22 nt, Homo sapiens
gacauguuuuuuaagguuuaug

SEQ ID NO: 26165 - RNA, 22 nt, Homo sapiens
gacccucuagagggaagcgcuu

SEQ ID NO: 26166 - RNA, 21 nt, Homo sapiens
gaccuguaguaagcauucaca

SEQ ID NO: 26167 - RNA, 22 nt, Homo sapiens
gacuaggagagcagcugcccau

SEQ ID NO: 26168 - RNA, 22 nt, Homo sapiens
gacuagggaaaauuauuuuguu

SEQ ID NO: 26169 - RNA, 22 nt, Homo sapiens
gacuauguuaccuuacacauca

SEQ ID NO: 26170 - RNA, 22 nt, Homo sapiens
gacucagaacuaaggguguuuc

SEQ ID NO: 26171 - RNA, 19 nt, Homo sapiens
gacuccagaguugugugcu

SEQ ID NO: 26172 - RNA, 22 nt, Homo sapiens
gacucgagggcauaagagcuuu

SEQ ID NO: 26173 - RNA, 22 nt, Homo sapiens
gacucuguagacaaucacaucu

SEQ ID NO: 26174 - RNA, 22 nt, Homo sapiens
gacugaggaagcgcucucuccu

SEQ ID NO: 26175 - RNA, 22 nt, Homo sapiens
gacuggccauugauacagaggu

SEQ ID NO: 26176 - RNA, 22 nt, Homo sapiens
gacuggcuguuuucuuuauuau

SEQ ID NO: 26177 - RNA, 18 nt, Homo sapiens
gacuuggaguuuacagug

SEQ ID NO: 26178 - RNA, 22 nt, Homo sapiens
gagaacagagauaauuuuacuu

SEQ ID NO: 26179 - RNA, 22 nt, Homo sapiens
gagaacugacauuaucguguau

SEQ ID NO: 26180 - RNA, 20 nt, Homo sapiens
gagaacugagaugcguuuga

SEQ ID NO: 26181 - RNA, 22 nt, Homo sapiens
gagaacuggcgugaacugcacg

SEQ ID NO: 26182 - RNA, 22 nt, Homo sapiens
gagaaugagauuaugguuacau

SEQ ID NO: 26183 - RNA, 22 nt, Homo sapiens
gagagcaugugcuggcaucagu

SEQ ID NO: 26184 - RNA, 22 nt, Homo sapiens
gagagcauuaagccaucaucau

SEQ ID NO: 26185 - RNA, 22 nt, Homo sapiens
gagagguaguuuuuuggucguc

SEQ ID NO: 26186 - RNA, 22 nt, Homo sapiens
gagagucacagugaauguggca

SEQ ID NO: 26187 - RNA, 22 nt, Homo sapiens
gagauacacccagugcagaggc

SEQ ID NO: 26188 - RNA, 22 nt, Homo sapiens
gagauauguuggcagcugguau

SEQ ID NO: 26189 - RNA, 22 nt, Homo sapiens
gagauauucugguuuacuaaau

SEQ ID NO: 26190 - RNA, 22 nt, Homo sapiens
gagaucuauuccucacccuucu

SEQ ID NO: 26191 - RNA, 22 nt, Homo sapiens
gagaucuucguguggggagaca

SEQ ID NO: 26192 - RNA, 22 nt, Homo sapiens
gagaucuuuaagaacuacugcu

SEQ ID NO: 26193 - RNA, 22 nt, Homo sapiens
gagauuauuuaaaaggugauuu

SEQ ID NO: 26194 - RNA, 22 nt, Homo sapiens
gagauuuucagcuugacuggga

SEQ ID NO: 26195 - RNA, 22 nt, Homo sapiens
gagcaucauucaacaaaagucu

SEQ ID NO: 26196 - RNA, 22 nt, Homo sapiens
gagccuguaggaggagaggugg

SEQ ID NO: 26197 - RNA, 22 nt, Homo sapiens
gagcuacacugauucauuuguu

SEQ ID NO: 26198 - RNA, 22 nt, Homo sapiens
gagcuaguagagugcacccggc

SEQ ID NO: 26199 - RNA, 22 nt, Homo sapiens
gagcuagugcuuaugcaccacu

SEQ ID NO: 26200 - RNA, 22 nt, Homo sapiens
gagcuguuuuucacuagaccaa

SEQ ID NO: 26201 - RNA, 22 nt, Homo sapiens
gagcuuggguuaaaguugccuu

SEQ ID NO: 26202 - RNA, 22 nt, Homo sapiens
gaggagauauucugcuggaugg

SEQ ID NO: 26203 - RNA, 22 nt, Homo sapiens
gaggcaagaguaguuaaguuag

SEQ ID NO: 26204 - RNA, 22 nt, Homo sapiens
gaggcaauaugagggaggcuuc

SEQ ID NO: 26205 - RNA, 22 nt, Homo sapiens
gaggcacucuguacaaaucugc

SEQ ID NO: 26206 - RNA, 22 nt, Homo sapiens
gaggcagucugacccuuagcag

SEQ ID NO: 26207 - RNA, 22 nt, Homo sapiens
gaggcagucuguccauucucag

SEQ ID NO: 26208 - RNA, 22 nt, Homo sapiens
gaggcagucugucccuuagcag

SEQ ID NO: 26209 - RNA, 22 nt, Homo sapiens
gaggcuagauggggaugugucc

SEQ ID NO: 26210 - RNA, 22 nt, Homo sapiens
gagguaagaaagucaguccuuc

SEQ ID NO: 26211 - RNA, 22 nt, Homo sapiens
gagguaagaugauucguguccu

SEQ ID NO: 26212 - RNA, 22 nt, Homo sapiens
gagguaaguaagaauggcaagc

SEQ ID NO: 26213 - RNA, 21 nt, Homo sapiens
gagguaccucauguaagugga

SEQ ID NO: 26214 - RNA, 22 nt, Homo sapiens
gagguauggauaucuggagagg

SEQ ID NO: 26215 - RNA, 22 nt, Homo sapiens
gaggucaggacauuuuugcuuu

SEQ ID NO: 26216 - RNA, 22 nt, Homo sapiens
gaggucuuacauuuuaauauuu

SEQ ID NO: 26217 - RNA, 22 nt, Homo sapiens
gagguggugguggaggcauagc

SEQ ID NO: 26218 - RNA, 22 nt, Homo sapiens
gagguguagucaugccaagauc

SEQ ID NO: 26219 - RNA, 22 nt, Homo sapiens
gagguugggaugagggauacag

SEQ ID NO: 26220 - RNA, 22 nt, Homo sapiens
gaguaaaugucaaguacuuagg

SEQ ID NO: 26221 - RNA, 22 nt, Homo sapiens
gaguaaaugucacuguugcugu

SEQ ID NO: 26222 - RNA, 22 nt, Homo sapiens
gaguaacagcauaaauuuguga

SEQ ID NO: 26223 - RNA, 22 nt, Homo sapiens
gaguagaacugguuaucuaaua

SEQ ID NO: 26224 - RNA, 22 nt, Homo sapiens
gaguagugcugcaguaaacaca

SEQ ID NO: 26225 - RNA, 22 nt, Homo sapiens
gagugcaaagguccugaggugg

SEQ ID NO: 26226 - RNA, 21 nt, Homo sapiens
gagugcaaauaaagagagggc

SEQ ID NO: 26227 - RNA, 22 nt, Homo sapiens
gucauccaggcuggagugaagc

SEQ ID NO: 26228 - RNA, 22 nt, Homo sapiens
gucauggacaguuugcuaauug

SEQ ID NO: 26229 - RNA, 22 nt, Homo sapiens
gucauucauucagcaagcacug

SEQ ID NO: 26230 - RNA, 22 nt, Homo sapiens
gucauugaaguggaaucaucca

SEQ ID NO: 26231 - RNA, 22 nt, Homo sapiens
gucauugucaauugacaauugu

SEQ ID NO: 26232 - RNA, 22 nt, Homo sapiens
gucauuguguggacauggagaa

SEQ ID NO: 26233 - RNA, 22 nt, Homo sapiens
guccaaauccaugggauguaca

SEQ ID NO: 26234 - RNA, 22 nt, Homo sapiens
guccaagacuaggaguuggcag

SEQ ID NO: 26235 - RNA, 22 nt, Homo sapiens
guccaguacucuuuccugaaaa

SEQ ID NO: 26236 - RNA, 22 nt, Homo sapiens
guccaguguuggagguuuuacc

SEQ ID NO: 26237 - RNA, 20 nt, Homo sapiens
guccauuugcugccauugcu

SEQ ID NO: 26238 - RNA, 22 nt, Homo sapiens
gugcuuguguuaauauguagcu

SEQ ID NO: 26239 - RNA, 22 nt, Homo sapiens
guggaaagaacacaaaauuagg

SEQ ID NO: 26240 - RNA, 22 nt, Homo sapiens
guggaaaucucugugugacuua

SEQ ID NO: 26241 - RNA, 22 nt, Homo sapiens
guggaagucuuugguauuggua

SEQ ID NO: 26242 - RNA, 22 nt, Homo sapiens
guggaaguguaaaagcucuugg

SEQ ID NO: 26243 - RNA, 22 nt, Homo sapiens
guggaaguuaagugacuuucug

SEQ ID NO: 26244 - RNA, 22 nt, Homo sapiens
guggaaucuagagaggcaguag

SEQ ID NO: 26245 - RNA, 22 nt, Homo sapiens
guggaaugaaaacucucucaca

SEQ ID NO: 26246 - RNA, 22 nt, Homo sapiens
guggaaugauaucucauugugg

SEQ ID NO: 26247 - RNA, 17 nt, Homo sapiens
guggaaugucaugucaa

SEQ ID NO: 26248 - RNA, 22 nt, Homo sapiens
guggacagagacuaaauguugu

SEQ ID NO: 26249 - RNA, 22 nt, Homo sapiens
guggacggagguugcagugagc

SEQ ID NO: 26250 - RNA, 22 nt, Homo sapiens
guggaggagaaagaagcauuuc

SEQ ID NO: 26251 - RNA, 22 nt, Homo sapiens
guggaguacugagggucacuua

SEQ ID NO: 26252 - RNA, 22 nt, Homo sapiens
guggaucacuugaggucaagag

SEQ ID NO: 26253 - RNA, 22 nt, Homo sapiens
guggcaaacucagcaugcccca

SEQ ID NO: 26254 - RNA, 22 nt, Homo sapiens
guggcaaguguuccaagaggcg

SEQ ID NO: 26255 - RNA, 22 nt, Homo sapiens
guggcagugugaggauccugcu

SEQ ID NO: 26256 - RNA, 22 nt, Homo sapiens
guggcaugaaagcaucugugau

SEQ ID NO: 26257 - RNA, 22 nt, Homo sapiens
guggcgaagauggauugaguca

SEQ ID NO: 26258 - RNA, 22 nt, Homo sapiens
gugggaagcuggaacucccucc

SEQ ID NO: 26259 - RNA, 22 nt, Homo sapiens
gugggagugucccguuuuucca

SEQ ID NO: 26260 - RNA, 22 nt, Homo sapiens
gugggauauaaucaguccugua

SEQ ID NO: 26261 - RNA, 22 nt, Homo sapiens
gugggaugcaaguaaaauuguc

SEQ ID NO: 26262 - RNA, 22 nt, Homo sapiens
gugggauggaaaugggcuucag

SEQ ID NO: 26263 - RNA, 22 nt, Homo sapiens
gugggguagcaggcuccuaucu

SEQ ID NO: 26264 - RNA, 22 nt, Homo sapiens
guggggucaucucauuugugga

SEQ ID NO: 26265 - RNA, 22 nt, Homo sapiens
gugguaggaaagugcaaaugua

SEQ ID NO: 26266 - RNA, 22 nt, Homo sapiens
gugguucuagaauugaguaucc

SEQ ID NO: 26267 - RNA, 22 nt, Homo sapiens
gugguucuagagggacagaaug

SEQ ID NO: 26268 - RNA, 22 nt, Homo sapiens
gugguuguuggaguggcaauuu

SEQ ID NO: 26269 - RNA, 22 nt, Homo sapiens
gugguuuuaucccagaaauuaa

SEQ ID NO: 26270 - RNA, 22 nt, Homo sapiens
gugguuuucaacuccaccugca

SEQ ID NO: 26271 - RNA, 22 nt, Homo sapiens
guguaaaucaaucuguugucuu

SEQ ID NO: 26272 - RNA, 22 nt, Homo sapiens
guguaaaucugcugugaacauu

SEQ ID NO: 26273 - RNA, 22 nt, Homo sapiens
guguaauaaucguggacuaugu

SEQ ID NO: 26274 - RNA, 22 nt, Homo sapiens
guguauguuguccauggaugcg

SEQ ID NO: 26275 - RNA, 22 nt, Homo sapiens
guguauguuucucccugucccu

SEQ ID NO: 26276 - RNA, 22 nt, Homo sapiens
gugucacuguauaauauuuauu

SEQ ID NO: 26277 - RNA, 22 nt, Homo sapiens
gugucaguggggagugaucuuc

SEQ ID NO: 26278 - RNA, 22 nt, Homo sapiens
gugugaacaucauagaguguau

SEQ ID NO: 26279 - RNA, 22 nt, Homo sapiens
gugugcaaauguguaccuacau

SEQ ID NO: 26280 - RNA, 22 nt, Homo sapiens
gugugcacaaucuggcaugugc

SEQ ID NO: 26281 - RNA, 19 nt, Homo sapiens
gugugcauaucacagagca

SEQ ID NO: 26282 - RNA, 22 nt, Homo sapiens
gugugcaugucuuuuuaguagg

SEQ ID NO: 26283 - RNA, 20 nt, Homo sapiens
gugugcauuucagauuuugg

SEQ ID NO: 26284 - RNA, 22 nt, Homo sapiens
gugugcucaucacaugcaauag

SEQ ID NO: 26285 - RNA, 21 nt, Homo sapiens
gugugcuugaauucagcuguc

SEQ ID NO: 26286 - RNA, 22 nt, Homo sapiens
guguuaaucucaaguacucuca

SEQ ID NO: 26287 - RNA, 22 nt, Homo sapiens
guguucaaacccaggucugucu

SEQ ID NO: 26288 - RNA, 22 nt, Homo sapiens
guguucaaauucugacagagag

SEQ ID NO: 26289 - RNA, 22 nt, Homo sapiens
guguuugguugauagagccacu

SEQ ID NO: 26290 - RNA, 22 nt, Homo sapiens
guuaaagacauccacauaggag

SEQ ID NO: 26291 - RNA, 23 nt, Homo sapiens
guuaagugaauguguacucuauu

SEQ ID NO: 26292 - RNA, 22 nt, Homo sapiens
guuauauguuuggaaugaggaa

SEQ ID NO: 26293 - RNA, 22 nt, Homo sapiens
guuaugcagcuuagaaaaugaa

SEQ ID NO: 26294 - RNA, 22 nt, Homo sapiens
guuauggaguauaugugaacug

SEQ ID NO: 26295 - RNA, 22 nt, Homo sapiens
guuauugcucucgaagacucuc

SEQ ID NO: 26296 - RNA, 22 nt, Homo sapiens
guucaagugauagcugggauua

SEQ ID NO: 26297 - RNA, 22 nt, Homo sapiens
guucacaguuucuaaucccagc

SEQ ID NO: 26298 - RNA, 20 nt, Homo sapiens
guucauguaauuaguucagg

SEQ ID NO: 26299 - RNA, 22 nt, Homo sapiens
guucccaguugaaaugauuagu

SEQ ID NO: 26300 - RNA, 22 nt, Homo sapiens
guucuauguugggaguucacua

SEQ ID NO: 26301 - RNA, 20 nt, Homo sapiens
guugaugcugaaguugcuua

SEQ ID NO: 26302 - RNA, 22 nt, Homo sapiens
guugcccuuagcacuucagccu

SEQ ID NO: 26303 - RNA, 22 nt, Homo sapiens
guugccuaggcuggagugcagu

SEQ ID NO: 26304 - RNA, 22 nt, Homo sapiens
guugcucaggcuggagugcagu

SEQ ID NO: 26305 - RNA, 22 nt, Homo sapiens
guuggucaaugugauuaggcca

SEQ ID NO: 26306 - RNA, 22 nt, Homo sapiens
guuguggagucuucuguucugg

SEQ ID NO: 26307 - RNA, 22 nt, Homo sapiens
guuuacagucgacuugggaaua

SEQ ID NO: 26308 - RNA, 22 nt, Homo sapiens
guuuaggaaugagaauauuuag

SEQ ID NO: 26309 - RNA, 22 nt, Homo sapiens
guuugcagaucaugaagaaccc

SEQ ID NO: 26310 - RNA, 22 nt, Homo sapiens
guuuguaacucuagugacuaga

SEQ ID NO: 26311 - RNA, 22 nt, Homo sapiens
guuugugcuccuaugagaaccu

SEQ ID NO: 26312 - RNA, 15 nt, Homo sapiens
guuuuuggauacaau

SEQ ID NO: 26313 - RNA, 22 nt, Homo sapiens
uaaaccacguuuacauuugaga

SEQ ID NO: 26314 - RNA, 22 nt, Homo sapiens
uaaagauaaggcucgcuuggau

SEQ ID NO: 26315 - RNA, 22 nt, Homo sapiens
uaaagcacuuuuuucugcaugg

SEQ ID NO: 26316 - RNA, 22 nt, Homo sapiens
uaaagcuagagcuggaguggca

SEQ ID NO: 26317 - RNA, 22 nt, Homo sapiens
uaaagcuuagauccaugguggc

SEQ ID NO: 26318 - RNA, 21 nt, Homo sapiens
uaaagcuuagcuauaguggcu

SEQ ID NO: 26319 - RNA, 22 nt, Homo sapiens
uaaagcuuggauuuaggcuaau

SEQ ID NO: 26320 - RNA, 22 nt, Homo sapiens
uaaagugcugagaugaggcugg

SEQ ID NO: 26321 - RNA, 20 nt, Homo sapiens
uaaaugccucaugcuuuauu

SEQ ID NO: 26322 - RNA, 22 nt, Homo sapiens
uaacaacauucuaacugacggc

SEQ ID NO: 26323 - RNA, 16 nt, Homo sapiens
uaacacaguucccacc

SEQ ID NO: 26324 - RNA, 22 nt, Homo sapiens
uaacagcucuacagcugcucuu

SEQ ID NO: 26325 - RNA, 22 nt, Homo sapiens
uaacaguauauuuaccaaaccu

SEQ ID NO: 26326 - RNA, 22 nt, Homo sapiens
uaacaguggucugugguaucug

SEQ ID NO: 26327 - RNA, 22 nt, Homo sapiens
uaacaguguauuccuuuggaca

SEQ ID NO: 26328 - RNA, 19 nt, Homo sapiens
ucuaaaucucuugauagac

SEQ ID NO: 26329 - RNA, 22 nt, Homo sapiens
ucuaagaauucauuuauaagcc

SEQ ID NO: 26330 - RNA, 22 nt, Homo sapiens
ucuaauguaaccugcaaauauu

SEQ ID NO: 26331 - RNA, 22 nt, Homo sapiens
ucuacagccaguucaggaagaa

SEQ ID NO: 26332 - RNA, 22 nt, Homo sapiens
ucuaguaaugagaggcaggaga

SEQ ID NO: 26333 - RNA, 22 nt, Homo sapiens
ucuauggaguuugaaugagaaa

SEQ ID NO: 26334 - RNA, 22 nt, Homo sapiens
ucuauugguaggggcugaggca

SEQ ID NO: 26335 - RNA, 22 nt, Homo sapiens
ucuauuugggguaccuguggua

SEQ ID NO: 26336 - RNA, 22 nt, Homo sapiens
ucucaaccuccacacuacaaua

SEQ ID NO: 26337 - RNA, 22 nt, Homo sapiens
ucucaaguggucgcaguuagau

SEQ ID NO: 26338 - RNA, 22 nt, Homo sapiens
guccauuuguuuccagagcacu

SEQ ID NO: 26339 - RNA, 22 nt, Homo sapiens
guccugaagaccuuccucugga

SEQ ID NO: 26340 - RNA, 18 nt, Homo sapiens
gucucacaugguggaagc

SEQ ID NO: 26341 - RNA, 22 nt, Homo sapiens
gucucccagccuacauauuucu

SEQ ID NO: 26342 - RNA, 22 nt, Homo sapiens
gucucugagaugucaacaccua

SEQ ID NO: 26343 - RNA, 22 nt, Homo sapiens
gucugagcauggggccggcagg

SEQ ID NO: 26344 - RNA, 22 nt, Homo sapiens
gucuggcaauggcagacuggca

SEQ ID NO: 26345 - RNA, 22 nt, Homo sapiens
gucuggcacagggaaaguacaa

SEQ ID NO: 26346 - RNA, 22 nt, Homo sapiens
gucuggcuuaucucacuuacca

SEQ ID NO: 26347 - RNA, 22 nt, Homo sapiens
gucuggguuuguuuguacuugc

SEQ ID NO: 26348 - RNA, 21 nt, Homo sapiens
gucugguguuuuaaugaggac

SEQ ID NO: 26349 - RNA, 22 nt, Homo sapiens
gucugguuggaguaguuuucag

SEQ ID NO: 26350 - RNA, 22 nt, Homo sapiens
gucugugguuccuaugucaccu

SEQ ID NO: 26351 - RNA, 21 nt, Homo sapiens
gucuuacagccagaugccucu

SEQ ID NO: 26352 - RNA, 22 nt, Homo sapiens
gucuuagguuuaaucacuucua

SEQ ID NO: 26353 - RNA, 22 nt, Homo sapiens
gucuuccagccuccaucuuucu

SEQ ID NO: 26354 - RNA, 17 nt, Homo sapiens
gucuuugguugaguuua

SEQ ID NO: 26355 - RNA, 22 nt, Homo sapiens
gucuuuguuauuaugaaucaac

SEQ ID NO: 26356 - RNA, 22 nt, Homo sapiens
gucuuuguuuggucuguaucag

SEQ ID NO: 26357 - RNA, 22 nt, Homo sapiens
gucuuuguuuugauuuaccaga

SEQ ID NO: 26358 - RNA, 22 nt, Homo sapiens
gugaaaagaugagcaccauaca

SEQ ID NO: 26359 - RNA, 22 nt, Homo sapiens
gugaaagacagcauuaauggcu

SEQ ID NO: 26360 - RNA, 22 nt, Homo sapiens
gugaagugugaccucagcaucu

SEQ ID NO: 26361 - RNA, 22 nt, Homo sapiens
gugaaguuuuuugcugagaguc

SEQ ID NO: 26362 - RNA, 22 nt, Homo sapiens
gugaaugaaugggugaauacau

SEQ ID NO: 26363 - RNA, 22 nt, Homo sapiens
gugacacagcaagacuccgucu

SEQ ID NO: 26364 - RNA, 22 nt, Homo sapiens
gugacaguggagacuuacuuca

SEQ ID NO: 26365 - RNA, 22 nt, Homo sapiens
gugaccaaagauagcucaaguu

SEQ ID NO: 26366 - RNA, 22 nt, Homo sapiens
gugaccucuguugcugucacua

SEQ ID NO: 26367 - RNA, 22 nt, Homo sapiens
gugacuggacucugaagaaaau

SEQ ID NO: 26368 - RNA, 22 nt, Homo sapiens
gugagacugaguuucgcucuug

SEQ ID NO: 26369 - RNA, 22 nt, Homo sapiens
gugagauaaugucucauugugg

SEQ ID NO: 26370 - RNA, 22 nt, Homo sapiens
gugagcagagaucgcgugauug

SEQ ID NO: 26371 - RNA, 22 nt, Homo sapiens
gugagcauaggaggcuucuguu

SEQ ID NO: 26372 - RNA, 21 nt, Homo sapiens
gugaggaguuacuggcuuuga

SEQ ID NO: 26373 - RNA, 22 nt, Homo sapiens
gugaggcuuuuccuguuagacu

SEQ ID NO: 26374 - RNA, 22 nt, Homo sapiens
gugagguaauuagcucccuuag

SEQ ID NO: 26375 - RNA, 22 nt, Homo sapiens
gugagguacgugucaagaacca

SEQ ID NO: 26376 - RNA, 21 nt, Homo sapiens
gugaggucauugggcuuucug

SEQ ID NO: 26377 - RNA, 22 nt, Homo sapiens
gugauacugaugacuuagagaa

SEQ ID NO: 26378 - RNA, 22 nt, Homo sapiens
gugauaucuuacaauucucuuu

SEQ ID NO: 26379 - RNA, 22 nt, Homo sapiens
gugauauguuaggaucuaaguc

SEQ ID NO: 26380 - RNA, 22 nt, Homo sapiens
gugaucuuucaggcuugaccau

SEQ ID NO: 26381 - RNA, 22 nt, Homo sapiens
gugaugacauucagagaugaag

SEQ ID NO: 26382 - RNA, 22 nt, Homo sapiens
gugauuauccacgucuuuguga

SEQ ID NO: 26383 - RNA, 22 nt, Homo sapiens
gugauugcauuaugaauauuau

SEQ ID NO: 26384 - RNA, 22 nt, Homo sapiens
gugcaaauuccagcucaacucc

SEQ ID NO: 26385 - RNA, 22 nt, Homo sapiens
gugcaacaugccuggcuaauuu

SEQ ID NO: 26386 - RNA, 22 nt, Homo sapiens
gugcacaaaucuuaaauguaca

SEQ ID NO: 26387 - RNA, 22 nt, Homo sapiens
gugcacaaugugcagguuuguu

SEQ ID NO: 26388 - RNA, 22 nt, Homo sapiens
gugcacaucgugcagguuuguu

SEQ ID NO: 26389 - RNA, 22 nt, Homo sapiens
gugcacaucuguguuccagcua

SEQ ID NO: 26390 - RNA, 22 nt, Homo sapiens
gugcaguuuuaagugaguuucu

SEQ ID NO: 26391 - RNA, 22 nt, Homo sapiens
gugcauguccacuaguccauau

SEQ ID NO: 26392 - RNA, 22 nt, Homo sapiens
gugcaugucugugacgacccug

SEQ ID NO: 26393 - RNA, 22 nt, Homo sapiens
gugccacaguguuaagggauuc

SEQ ID NO: 26394 - RNA, 22 nt, Homo sapiens
gugcccacugucuguccuguag

SEQ ID NO: 26395 - RNA, 22 nt, Homo sapiens
gugccuucuagcuaugguuggc

SEQ ID NO: 26396 - RNA, 22 nt, Homo sapiens
guggaaaaguaguugcgguuuu

SEQ ID NO: 26397 - RNA, 22 nt, Homo sapiens
guggaaaauuauugcuguuuuu

SEQ ID NO: 26398 - RNA, 21 nt, Homo sapiens
guggaaauggaauuuacuaau

SEQ ID NO: 26399 - RNA, 22 nt, Homo sapiens
guggaagaccagacuuuccaac

SEQ ID NO: 26400 - RNA, 22 nt, Homo sapiens
guggaagguaaugcagcuuacu

SEQ ID NO: 26401 - RNA, 20 nt, Homo sapiens
guggaaguagaaacauaugu

SEQ ID NO: 26402 - RNA, 22 nt, Homo sapiens
guggaauauaaagcaucgugua

SEQ ID NO: 26403 - RNA, 22 nt, Homo sapiens
guggaauuauagagacaucuug

SEQ ID NO: 26404 - RNA, 22 nt, Homo sapiens
guggacaugaauuuuggaggca

SEQ ID NO: 26405 - RNA, 22 nt, Homo sapiens
guggcaagaauguacaaaaggu

SEQ ID NO: 26406 - RNA, 22 nt, Homo sapiens
guggcaagaugacuacucacug

SEQ ID NO: 26407 - RNA, 22 nt, Homo sapiens
guggcacaauuaaguagcuauu

SEQ ID NO: 26408 - RNA, 22 nt, Homo sapiens
guggcacgaugaucugggcuca

SEQ ID NO: 26409 - RNA, 21 nt, Homo sapiens
guggccuuuggagcaugucag

SEQ ID NO: 26410 - RNA, 22 nt, Homo sapiens
guggcuaaagauuuggaaucug

SEQ ID NO: 26411 - RNA, 22 nt, Homo sapiens
guggcuuuauuuagaagcaggg

SEQ ID NO: 26412 - RNA, 22 nt, Homo sapiens
gugggauaauuuuuggugcugu

SEQ ID NO: 26413 - RNA, 22 nt, Homo sapiens
gugggaugaucacaguucacug

SEQ ID NO: 26414 - RNA, 22 nt, Homo sapiens
gugggauggagagaagguauga

SEQ ID NO: 26415 - RNA, 22 nt, Homo sapiens
gugggcucguucguguuagaca

SEQ ID NO: 26416 - RNA, 22 nt, Homo sapiens
gugggguaggaggaguacuucc

SEQ ID NO: 26417 - RNA, 22 nt, Homo sapiens
guggguaaaucucuggggcucu

SEQ ID NO: 26418 - RNA, 22 nt, Homo sapiens
gugguacuaucuuugguuucag

SEQ ID NO: 26419 - RNA, 22 nt, Homo sapiens
gugguagaaaguaccaaacuag

SEQ ID NO: 26420 - RNA, 22 nt, Homo sapiens
gugguaguagaauuucggaaau

SEQ ID NO: 26421 - RNA, 22 nt, Homo sapiens
gugguaucauuuaaccauuaga

SEQ ID NO: 26422 - RNA, 22 nt, Homo sapiens
gugguguccugcaccuauaguc

SEQ ID NO: 26423 - RNA, 22 nt, Homo sapiens
guguaauacacacauauaugca

SEQ ID NO: 26424 - RNA, 22 nt, Homo sapiens
guguaguuugagguaugggggc

SEQ ID NO: 26425 - RNA, 21 nt, Homo sapiens
gugucacagacaugacagaug

SEQ ID NO: 26426 - RNA, 22 nt, Homo sapiens
gugucaugaagguuuuaugcag

SEQ ID NO: 26427 - RNA, 21 nt, Homo sapiens
gugucaugguugacuuuggca

SEQ ID NO: 26428 - RNA, 22 nt, Homo sapiens
guguccucgaguacacaucagg

SEQ ID NO: 26429 - RNA, 22 nt, Homo sapiens
uaaucucagcugagcugagauu

SEQ ID NO: 26430 - RNA, 22 nt, Homo sapiens
uaaugcaucaugguuggcaaac

SEQ ID NO: 26431 - RNA, 22 nt, Homo sapiens
uaaugcuguggucuaaugggga

SEQ ID NO: 26432 - RNA, 22 nt, Homo sapiens
uaaugcuugguuguuuggaaaa

SEQ ID NO: 26433 - RNA, 22 nt, Homo sapiens
uaaugugaauagugcuguaaug

SEQ ID NO: 26434 - RNA, 22 nt, Homo sapiens
uaauucuguauguaucagaguu

SEQ ID NO: 26435 - RNA, 22 nt, Homo sapiens
uagcaggaaaccuguguugagg

SEQ ID NO: 26436 - RNA, 22 nt, Homo sapiens
uagcaguauaugagagcuauug

SEQ ID NO: 26437 - RNA, 22 nt, Homo sapiens
uagcagucucagaaugcauggu

SEQ ID NO: 26438 - RNA, 22 nt, Homo sapiens
uagcaucagauuccauauucua

SEQ ID NO: 26439 - RNA, 22 nt, Homo sapiens
uagcaugacacuuguugaaugc

SEQ ID NO: 26440 - RNA, 22 nt, Homo sapiens
uagcaugucagucgccacacgu

SEQ ID NO: 26441 - RNA, 22 nt, Homo sapiens
uagcuccagugggguuacugcu

SEQ ID NO: 26442 - RNA, 22 nt, Homo sapiens
uagcugcacuuacaagugagaa

SEQ ID NO: 26443 - RNA, 22 nt, Homo sapiens
uagcugcugcuaggcuaaggau

SEQ ID NO: 26444 - RNA, 22 nt, Homo sapiens
uaggaaguacaucucagaaucu

SEQ ID NO: 26445 - RNA, 22 nt, Homo sapiens
uaggacacagaccuggauggaa

SEQ ID NO: 26446 - RNA, 22 nt, Homo sapiens
uaggacacagauggagaaaagc

SEQ ID NO: 26447 - RNA, 22 nt, Homo sapiens
uaggacacaggacauauguaga

SEQ ID NO: 26448 - RNA, 19 nt, Homo sapiens
uaggacccugguggccccc

SEQ ID NO: 26449 - RNA, 22 nt, Homo sapiens
uaggacuuuucuugagagugac

SEQ ID NO: 26450 - RNA, 22 nt, Homo sapiens
uaggagcacaaaccccauugug

SEQ ID NO: 26451 - RNA, 22 nt, Homo sapiens
uaggcauuuuucugauaaacua

SEQ ID NO: 26452 - RNA, 22 nt, Homo sapiens
uaggcgagauguguguuucaug

SEQ ID NO: 26453 - RNA, 22 nt, Homo sapiens
uagggcauguguggaguguaug

SEQ ID NO: 26454 - RNA, 22 nt, Homo sapiens
uagguagaaucuugaagccauu

SEQ ID NO: 26455 - RNA, 22 nt, Homo sapiens
uagguagcuuuggcguuucuug

SEQ ID NO: 26456 - RNA, 22 nt, Homo sapiens
uagguagugugugcaugagagg

SEQ ID NO: 26457 - RNA, 22 nt, Homo sapiens
uagguaguugugggcuugaaug

SEQ ID NO: 26458 - RNA, 22 nt, Homo sapiens
uaggucuccuuuuugccuaaau

SEQ ID NO: 26459 - RNA, 22 nt, Homo sapiens
uaggugaaugcuggaagaaaug

SEQ ID NO: 26460 - RNA, 22 nt, Homo sapiens
uagguuguucuauuaucuuaca

SEQ ID NO: 26461 - RNA, 22 nt, Homo sapiens
uaguaaacaccucagguaauuc

SEQ ID NO: 26462 - RNA, 22 nt, Homo sapiens
uaguaaacagcucugccacaau

SEQ ID NO: 26463 - RNA, 22 nt, Homo sapiens
uagugaauguuggcuauuaaua

SEQ ID NO: 26464 - RNA, 22 nt, Homo sapiens
uagugcugagauugagaagccc

SEQ ID NO: 26465 - RNA, 21 nt, Homo sapiens
uagugcugaggcaguauggga

SEQ ID NO: 26466 - RNA, 18 nt, Homo sapiens
uagugcuguucucaugau

SEQ ID NO: 26467 - RNA, 22 nt, Homo sapiens
uagugguaguagcaguaauauu

SEQ ID NO: 26468 - RNA, 22 nt, Homo sapiens
uaguuauggaguaauuuuaagc

SEQ ID NO: 26469 - RNA, 22 nt, Homo sapiens
uaguucauuuuucuugcuuaga

SEQ ID NO: 26470 - RNA, 22 nt, Homo sapiens
uaguugcauucaggauaugacg

SEQ ID NO: 26471 - RNA, 22 nt, Homo sapiens
uaguugcauuggcugcuaugcu

SEQ ID NO: 26472 - RNA, 22 nt, Homo sapiens
uaguuuaucuucuggauggaca

SEQ ID NO: 26473 - RNA, 22 nt, Homo sapiens
uauaacaaugcaagaauggccu

SEQ ID NO: 26474 - RNA, 20 nt, Homo sapiens
uauaacaguuuggacccagu

SEQ ID NO: 26475 - RNA, 23 nt, Homo sapiens
uauaacuuuuaauuuacuggccu

SEQ ID NO: 26476 - RNA, 22 nt, Homo sapiens
uauaagacuagcagcugaauug

SEQ ID NO: 26477 - RNA, 22 nt, Homo sapiens
uauacacgugugcauauauaca

SEQ ID NO: 26478 - RNA, 22 nt, Homo sapiens
uauacaugugggcaucaggaga

SEQ ID NO: 26479 - RNA, 20 nt, Homo sapiens
uauagcaauuuuuuucuccu

SEQ ID NO: 26480 - RNA, 22 nt, Homo sapiens
uauagcacugcaauauuucccu

SEQ ID NO: 26481 - RNA, 17 nt, Homo sapiens
uauagcacuucucacau

SEQ ID NO: 26482 - RNA, 21 nt, Homo sapiens
uauagcagcacgauuuauaau

SEQ ID NO: 26483 - RNA, 22 nt, Homo sapiens
uauagcaguguaagaaucgagu

SEQ ID NO: 26484 - RNA, 22 nt, Homo sapiens
uauagcccuugguguggaaaug

SEQ ID NO: 26485 - RNA, 22 nt, Homo sapiens
uauagcuagucacugcuggauu

SEQ ID NO: 26486 - RNA, 22 nt, Homo sapiens
uauagcuaugggauguauuugc

SEQ ID NO: 26487 - RNA, 22 nt, Homo sapiens
uauaucacaugcacucauuuuc

SEQ ID NO: 26488 - RNA, 21 nt, Homo sapiens
uauaugacuuacuauugccuc

SEQ ID NO: 26489 - RNA, 22 nt, Homo sapiens
uauaugucuuuguuauguugag

SEQ ID NO: 26490 - RNA, 22 nt, Homo sapiens
uauauguucuugcacuggaaag

SEQ ID NO: 26491 - RNA, 22 nt, Homo sapiens
uaucaagauggauaaggauaga

SEQ ID NO: 26492 - RNA, 19 nt, Homo sapiens
uaucaaguaugcacuguac

SEQ ID NO: 26493 - RNA, 22 nt, Homo sapiens
uaucacagaggguauccuagag

SEQ ID NO: 26494 - RNA, 22 nt, Homo sapiens
uaucacaguaaaucugggugca

SEQ ID NO: 26495 - RNA, 21 nt, Homo sapiens
uaucacaguagaauaggaucu

SEQ ID NO: 26496 - RNA, 22 nt, Homo sapiens
uaucacaguaucuagcacagug

SEQ ID NO: 26497 - RNA, 20 nt, Homo sapiens
uaucacaguucaggaacucu

SEQ ID NO: 26498 - RNA, 22 nt, Homo sapiens
uaucacaguugcauauuuaagg

SEQ ID NO: 26499 - RNA, 21 nt, Homo sapiens
uaucacauuggugauuaaguu

SEQ ID NO: 26500 - RNA, 22 nt, Homo sapiens
uaucaccauguccguuuuaaaa

SEQ ID NO: 26501 - RNA, 22 nt, Homo sapiens
uaucacuauucauccuagcucc

SEQ ID NO: 26502 - RNA, 22 nt, Homo sapiens
uaucaucauguuuuugcugugu

SEQ ID NO: 26503 - RNA, 22 nt, Homo sapiens
uaucaugucuguguguaccuag

SEQ ID NO: 26504 - RNA, 22 nt, Homo sapiens
uaucauugccucaaucuguauu

SEQ ID NO: 26505 - RNA, 22 nt, Homo sapiens
uaucccaauguaauaucacaaa

SEQ ID NO: 26506 - RNA, 22 nt, Homo sapiens
uaucccaguggauguaccccau

SEQ ID NO: 26507 - RNA, 22 nt, Homo sapiens
uauccuagugggguuucaguca

SEQ ID NO: 26508 - RNA, 22 nt, Homo sapiens
uauccugaagcuuuauuuaagu

SEQ ID NO: 26509 - RNA, 22 nt, Homo sapiens
uaucucagagaaucagauuuac

SEQ ID NO: 26510 - RNA, 22 nt, Homo sapiens
uaucucagaugagacuuguaac

SEQ ID NO: 26511 - RNA, 18 nt, Homo sapiens
uaucucauuucuuagguc

SEQ ID NO: 26512 - RNA, 22 nt, Homo sapiens
uaucucuguggguagugcugaa

SEQ ID NO: 26513 - RNA, 20 nt, Homo sapiens
uaugaaacaguguagagcaa

SEQ ID NO: 26514 - RNA, 22 nt, Homo sapiens
uaugaagccaggauuuauuauu

SEQ ID NO: 26515 - RNA, 22 nt, Homo sapiens
uaugaauuuuauccaggauaua

SEQ ID NO: 26516 - RNA, 22 nt, Homo sapiens
uaugacauaguccuuaacccuc

SEQ ID NO: 26517 - RNA, 20 nt, Homo sapiens
uaugaccugucuuuucucuc

SEQ ID NO: 26518 - RNA, 22 nt, Homo sapiens
uaugacuguuugcucauucagg

SEQ ID NO: 26519 - RNA, 22 nt, Homo sapiens
uaugagacugguuaauuuuugu

SEQ ID NO: 26520 - RNA, 22 nt, Homo sapiens
uaugagcacauauguaucuaug

SEQ ID NO: 26521 - RNA, 22 nt, Homo sapiens
uaugauuuuugggagaggucaa

SEQ ID NO: 26522 - RNA, 22 nt, Homo sapiens
uaugcacacucucccaggaggg

SEQ ID NO: 26523 - RNA, 22 nt, Homo sapiens
uaugcacuauggaaguagcuca

SEQ ID NO: 26524 - RNA, 22 nt, Homo sapiens
uaugccucuucauaaaguauga

SEQ ID NO: 26525 - RNA, 22 nt, Homo sapiens
uaugccuuucucacuaagcuua

SEQ ID NO: 26526 - RNA, 22 nt, Homo sapiens
uauggaaaucuuaccuuauggu

SEQ ID NO: 26527 - RNA, 22 nt, Homo sapiens
uauggauuugccuauucuguau

SEQ ID NO: 26528 - RNA, 22 nt, Homo sapiens
uauggcauguauguguggcgca

SEQ ID NO: 26529 - RNA, 22 nt, Homo sapiens
uauggcauuauuuugauagaca

SEQ ID NO: 26530 - RNA, 22 nt, Homo sapiens
uaggagcacaaacccuacugug

SEQ ID NO: 26531 - RNA, 22 nt, Homo sapiens
uaggagcauaggauuguuugag

SEQ ID NO: 26532 - RNA, 22 nt, Homo sapiens
uaggauaguccuccugagaccu

SEQ ID NO: 26533 - RNA, 22 nt, Homo sapiens
ugagcagagaagugcccugcgc

SEQ ID NO: 26534 - RNA, 22 nt, Homo sapiens
ugagcagagggagaaguaaauu

SEQ ID NO: 26535 - RNA, 22 nt, Homo sapiens
ugagcaucauucacaccuuggu

SEQ ID NO: 26536 - RNA, 22 nt, Homo sapiens
ugagcaucucuaaaaggagcaa

SEQ ID NO: 26537 - RNA, 22 nt, Homo sapiens
ugagcauuguguuugacuguga

SEQ ID NO: 26538 - RNA, 22 nt, Homo sapiens
ugagcccauuguccugguuuau

SEQ ID NO: 26539 - RNA, 20 nt, Homo sapiens
ugagccccuggacucaagcg

SEQ ID NO: 26540 - RNA, 22 nt, Homo sapiens
ugagcuagggccuggaauaggg

SEQ ID NO: 26541 - RNA, 22 nt, Homo sapiens
ugagcugagaaaugcagcagcu

SEQ ID NO: 26542 - RNA, 22 nt, Homo sapiens
ugagcugagaucacacuacugu

SEQ ID NO: 26543 - RNA, 22 nt, Homo sapiens
ugagcugagauuaagcugcugc

SEQ ID NO: 26544 - RNA, 22 nt, Homo sapiens
ugagcuguuugaagaagcauuu

SEQ ID NO: 26545 - RNA, 20 nt, Homo sapiens
ugagcuuguaaacacuguuu

SEQ ID NO: 26546 - RNA, 22 nt, Homo sapiens
ugaggauaguguugaaggcagg

SEQ ID NO: 26547 - RNA, 22 nt, Homo sapiens
ugaggaucucuaggaauuuauc

SEQ ID NO: 26548 - RNA, 22 nt, Homo sapiens
ugaggcaaggcugaaugaaggc

SEQ ID NO: 26549 - RNA, 22 nt, Homo sapiens
ugagguacaacauggacugaag

SEQ ID NO: 26550 - RNA, 22 nt, Homo sapiens
ugagguaugacuuauuauucuu

SEQ ID NO: 26551 - RNA, 22 nt, Homo sapiens
ugaggugaaguaauauucuaag

SEQ ID NO: 26552 - RNA, 22 nt, Homo sapiens
ugaggugagauggcuaccccaa

SEQ ID NO: 26553 - RNA, 22 nt, Homo sapiens
ugagguugaaggacauuuuuau

SEQ ID NO: 26554 - RNA, 22 nt, Homo sapiens
ugagguuggggucagggcuagc

SEQ ID NO: 26555 - RNA, 22 nt, Homo sapiens
ugaguagauccaagacuguccu

SEQ ID NO: 26556 - RNA, 23 nt, Homo sapiens
ugaguagguccacguaugugagu

SEQ ID NO: 26557 - RNA, 22 nt, Homo sapiens
ugaguaguauucuaugguaugu

SEQ ID NO: 26558 - RNA, 22 nt, Homo sapiens
ugagugaaagaagcacuaagga

SEQ ID NO: 26559 - RNA, 22 nt, Homo sapiens
ugagugaacgcugagaccaaau

SEQ ID NO: 26560 - RNA, 22 nt, Homo sapiens
ugaguguccaccccuuucacag

SEQ ID NO: 26561 - RNA, 22 nt, Homo sapiens
ugaguuaaucucuacgauagaa

SEQ ID NO: 26562 - RNA, 22 nt, Homo sapiens
ugaguucuuuguagauucugug

SEQ ID NO: 26563 - RNA, 22 nt, Homo sapiens
ugaguuguugcauucuuggugu

SEQ ID NO: 26564 - RNA, 22 nt, Homo sapiens
ugauaacauuucuucugguaca

SEQ ID NO: 26565 - RNA, 22 nt, Homo sapiens
ugauaagugaaagugcucuauc

SEQ ID NO: 26566 - RNA, 17 nt, Homo sapiens
ugauaagugugagguga

SEQ ID NO: 26567 - RNA, 22 nt, Homo sapiens
ugauaauuuugucagguuuugg

SEQ ID NO: 26568 - RNA, 22 nt, Homo sapiens
ugauaguugucagugggggacc

SEQ ID NO: 26569 - RNA, 22 nt, Homo sapiens
ugauaugaaguuagcuggcugu

SEQ ID NO: 26570 - RNA, 22 nt, Homo sapiens
ugauaugaaucaaucacucuuc

SEQ ID NO: 26571 - RNA, 22 nt, Homo sapiens
ugauauguaugugaccuagaaa

SEQ ID NO: 26572 - RNA, 22 nt, Homo sapiens
ugauaugugaguauaugguuau

SEQ ID NO: 26573 - RNA, 22 nt, Homo sapiens
ugauauguggcuauugagauug

SEQ ID NO: 26574 - RNA, 20 nt, Homo sapiens
ugauauuucuggaaguggag

SEQ ID NO: 26575 - RNA, 17 nt, Homo sapiens
ugauauuuucccagaua

SEQ ID NO: 26576 - RNA, 22 nt, Homo sapiens
ugauauuuuugauccuuaaguu

SEQ ID NO: 26577 - RNA, 22 nt, Homo sapiens
ugaucaaagugcuggaauuaca

SEQ ID NO: 26578 - RNA, 22 nt, Homo sapiens
ugaucacagcuugacuaaagga

SEQ ID NO: 26579 - RNA, 22 nt, Homo sapiens
ugaucugucacuuaucacauuu

SEQ ID NO: 26580 - RNA, 22 nt, Homo sapiens
ugaucuguccaccucagcuucc

SEQ ID NO: 26581 - RNA, 22 nt, Homo sapiens
ugaucuuuuuaauguccauggg

SEQ ID NO: 26582 - RNA, 22 nt, Homo sapiens
ugaugacauugucacagucuga

SEQ ID NO: 26583 - RNA, 22 nt, Homo sapiens
ugaugcugaugccugccagaag

SEQ ID NO: 26584 - RNA, 22 nt, Homo sapiens
ugauggcaauggcauucauuuu

SEQ ID NO: 26585 - RNA, 22 nt, Homo sapiens
ugaugguaguucagucaaugua

SEQ ID NO: 26586 - RNA, 22 nt, Homo sapiens
ugaugguguuaccaucuuuacu

SEQ ID NO: 26587 - RNA, 22 nt, Homo sapiens
ugaugucuugcaggcacgagau

SEQ ID NO: 26588 - RNA, 22 nt, Homo sapiens
ugauuagagcccaagcuuugaa

SEQ ID NO: 26589 - RNA, 22 nt, Homo sapiens
ugauuggagaugaauuucguuu

SEQ ID NO: 26590 - RNA, 22 nt, Homo sapiens
ugauuuguccauguggcacgug

SEQ ID NO: 26591 - RNA, 19 nt, Homo sapiens
ugcaaagucuuuuccuauu

SEQ ID NO: 26592 - RNA, 22 nt, Homo sapiens
ugcaaauguuaggugucauuau

SEQ ID NO: 26593 - RNA, 22 nt, Homo sapiens
ugcaaauguuaguaacaccacu

SEQ ID NO: 26594 - RNA, 22 nt, Homo sapiens
ugcaacauguguaccacucugu

SEQ ID NO: 26595 - RNA, 22 nt, Homo sapiens
ugcaagacugcaguuacuuuug

SEQ ID NO: 26596 - RNA, 22 nt, Homo sapiens
ugcaagcacacccagggauugu

SEQ ID NO: 26597 - RNA, 22 nt, Homo sapiens
ugcaaguaauuccagcuacuga

SEQ ID NO: 26598 - RNA, 22 nt, Homo sapiens
ugcaaucauuuggaggagaaga

SEQ ID NO: 26599 - RNA, 22 nt, Homo sapiens
ugcaaugucuucugaggggagc

SEQ ID NO: 26600 - RNA, 17 nt, Homo sapiens
ugcaauuuaagcuagau

SEQ ID NO: 26601 - RNA, 22 nt, Homo sapiens
ugcaccauggcacuccaggcug

SEQ ID NO: 26602 - RNA, 22 nt, Homo sapiens
ugcaccauugcauuccagccug

SEQ ID NO: 26603 - RNA, 22 nt, Homo sapiens
ugcagaaucccuucagauccga

SEQ ID NO: 26604 - RNA, 19 nt, Homo sapiens
ugcagcaauguaaaagaca

SEQ ID NO: 26605 - RNA, 22 nt, Homo sapiens
ugcagcacuguucacaauagcc

SEQ ID NO: 26606 - RNA, 22 nt, Homo sapiens
ugcagcauguaggcacguuauu

SEQ ID NO: 26607 - RNA, 21 nt, Homo sapiens
ugcagccauucagcccuaugc

SEQ ID NO: 26608 - RNA, 23 nt, Homo sapiens
ugcagcuacauguggccaugugc

SEQ ID NO: 26609 - RNA, 22 nt, Homo sapiens
ugcaguacuuugaaauauacug

SEQ ID NO: 26610 - RNA, 22 nt, Homo sapiens
ugcagugucaauaauaauuagu

SEQ ID NO: 26611 - RNA, 22 nt, Homo sapiens
ugcaguuuaggaacugguaaca

SEQ ID NO: 26612 - RNA, 22 nt, Homo sapiens
ugcauacacaagcauacaugua

SEQ ID NO: 26613 - RNA, 18 nt, Homo sapiens
ugcauacuaucugauuuu

SEQ ID NO: 26614 - RNA, 22 nt, Homo sapiens
ugcauacugaaauauuuuagag

SEQ ID NO: 26615 - RNA, 22 nt, Homo sapiens
ugcauagaauguucuguaaaua

SEQ ID NO: 26616 - RNA, 22 nt, Homo sapiens
ugcauagcaaaauaggauuaga

SEQ ID NO: 26617 - RNA, 22 nt, Homo sapiens
ugcauaucuucuuuugagaaau

SEQ ID NO: 26618 - RNA, 22 nt, Homo sapiens
ugcauaucuuguggaauaucuc

SEQ ID NO: 26619 - RNA, 22 nt, Homo sapiens
ugcauauucuaggauuuuguau

SEQ ID NO: 26620 - RNA, 22 nt, Homo sapiens
ugcaucacaguacuccagccug

SEQ ID NO: 26621 - RNA, 22 nt, Homo sapiens
ugcauccauucuagacucaucu

SEQ ID NO: 26622 - RNA, 22 nt, Homo sapiens
ugcaugcaucuuuuauaguagc

SEQ ID NO: 26623 - RNA, 22 nt, Homo sapiens
ugcauggaagggagggaaagag

SEQ ID NO: 26624 - RNA, 22 nt, Homo sapiens
ugcauggagcucucuuuggacu

SEQ ID NO: 26625 - RNA, 22 nt, Homo sapiens
ugcauguucuuacucauacaug

SEQ ID NO: 26626 - RNA, 22 nt, Homo sapiens
ugcauuaguaaguaauuuuaau

SEQ ID NO: 26627 - RNA, 21 nt, Homo sapiens
ugcauugucuugaguuuaaau

SEQ ID NO: 26628 - RNA, 22 nt, Homo sapiens
ugcauuguggaucuaaaugcau

SEQ ID NO: 26629 - RNA, 22 nt, Homo sapiens
ugcauuguuccgaauguguccu

SEQ ID NO: 26630 - RNA, 22 nt, Homo sapiens
ugccaacaugccuggcuguuuu

SEQ ID NO: 26631 - RNA, 22 nt, Homo sapiens
ucugugcauuguaacaacuaaa

SEQ ID NO: 26632 - RNA, 22 nt, Homo sapiens
ucugugcugagaguugaaaguu

SEQ ID NO: 26633 - RNA, 22 nt, Homo sapiens
ucugugcuugucauaugcuuug

SEQ ID NO: 26634 - RNA, 22 nt, Homo sapiens
ucuguggucagaguccuuggcc

SEQ ID NO: 26635 - RNA, 22 nt, Homo sapiens
ucuguguuuagacccaggguag

SEQ ID NO: 26636 - RNA, 22 nt, Homo sapiens
ucuuagugcggcugcugcagcc

SEQ ID NO: 26637 - RNA, 22 nt, Homo sapiens
ucuuaguuggaaugggauaagg

SEQ ID NO: 26638 - RNA, 22 nt, Homo sapiens
ucuuaguuuagauuagcaauuc

SEQ ID NO: 26639 - RNA, 17 nt, Homo sapiens
ucuucuguuacuguggc

SEQ ID NO: 26640 - RNA, 22 nt, Homo sapiens
ucuugaacuucugcacacucag

SEQ ID NO: 26641 - RNA, 22 nt, Homo sapiens
ucuugcacacaguaaguguuuu

SEQ ID NO: 26642 - RNA, 22 nt, Homo sapiens
ucuuggacuuuugugagaaauc

SEQ ID NO: 26643 - RNA, 22 nt, Homo sapiens
ucuuggcauggcugaagauucc

SEQ ID NO: 26644 - RNA, 22 nt, Homo sapiens
ucuugggugaguuugugaauaa

SEQ ID NO: 26645 - RNA, 21 nt, Homo sapiens
ucuuggguugaauucucccag

SEQ ID NO: 26646 - RNA, 20 nt, Homo sapiens
ucuugguuggaggucuuuua

SEQ ID NO: 26647 - RNA, 22 nt, Homo sapiens
ucuugguuuauugugguaugaa

SEQ ID NO: 26648 - RNA, 17 nt, Homo sapiens
ucuugugguucuugaau

SEQ ID NO: 26649 - RNA, 19 nt, Homo sapiens
ucuuuagucacauuuuuau

SEQ ID NO: 26650 - RNA, 22 nt, Homo sapiens
ucuuucacuuagcaugauguuu

SEQ ID NO: 26651 - RNA, 22 nt, Homo sapiens
ucuuugagugcccugagucccu

SEQ ID NO: 26652 - RNA, 22 nt, Homo sapiens
ucuuuggaggcgaucuguuuga

SEQ ID NO: 26653 - RNA, 22 nt, Homo sapiens
ucuuuggcugugaagaauaaug

SEQ ID NO: 26654 - RNA, 22 nt, Homo sapiens
ucuuugggauauucugaaaggg

SEQ ID NO: 26655 - RNA, 22 nt, Homo sapiens
ucuuuggguguauuucacagcc

SEQ ID NO: 26656 - RNA, 22 nt, Homo sapiens
ucuuugguauugugaauagugu

SEQ ID NO: 26657 - RNA, 22 nt, Homo sapiens
ucuuugguauuuguggggaauu

SEQ ID NO: 26658 - RNA, 22 nt, Homo sapiens
ucuuugucuacauccuguuaaa

SEQ ID NO: 26659 - RNA, 22 nt, Homo sapiens
ucuuuguuagaacccucuccuu

SEQ ID NO: 26660 - RNA, 22 nt, Homo sapiens
ucuuuguucaggagccaacucc

SEQ ID NO: 26661 - RNA, 22 nt, Homo sapiens
ucuuuguugcauaggcuuguuc

SEQ ID NO: 26662 - RNA, 22 nt, Homo sapiens
ucuuuguuuucugauccugaag

SEQ ID NO: 26663 - RNA, 22 nt, Homo sapiens
ucuuuuggguauggagccauca

SEQ ID NO: 26664 - RNA, 22 nt, Homo sapiens
ucuuuugguuucuagaggccgc

SEQ ID NO: 26665 - RNA, 22 nt, Homo sapiens
ucuuuuguucuauucaggccuu

SEQ ID NO: 26666 - RNA, 22 nt, Homo sapiens
ugaaaagucuaagauuaagguu

SEQ ID NO: 26667 - RNA, 20 nt, Homo sapiens
ugaaacacauggacuggggu

SEQ ID NO: 26668 - RNA, 18 nt, Homo sapiens
ugaaacacauuuuuuccu

SEQ ID NO: 26669 - RNA, 22 nt, Homo sapiens
ugaaagacacagaaguugccca

SEQ ID NO: 26670 - RNA, 22 nt, Homo sapiens
ugaaagcuacagucuccuagga

SEQ ID NO: 26671 - RNA, 22 nt, Homo sapiens
ugaaagguuuaauucugugaga

SEQ ID NO: 26672 - RNA, 22 nt, Homo sapiens
ugaaauacuuaauuucuccaug

SEQ ID NO: 26673 - RNA, 22 nt, Homo sapiens
ugaaauacuuuggcucuuuguu

SEQ ID NO: 26674 - RNA, 20 nt, Homo sapiens
ugaaaucuucacuaagucuc

SEQ ID NO: 26675 - RNA, 22 nt, Homo sapiens
ugaaauguguuaucugggccug

SEQ ID NO: 26676 - RNA, 22 nt, Homo sapiens
ugaaauuuuuuauucguuggcu

SEQ ID NO: 26677 - RNA, 22 nt, Homo sapiens
ugaacacaucuccugguaccug

SEQ ID NO: 26678 - RNA, 22 nt, Homo sapiens
ugaacacuggauaaggagucag

SEQ ID NO: 26679 - RNA, 22 nt, Homo sapiens
ugaacagcaccuccuagaguug

SEQ ID NO: 26680 - RNA, 22 nt, Homo sapiens
ugaacagucaucucucuuguau

SEQ ID NO: 26681 - RNA, 20 nt, Homo sapiens
ugaacugguuacuuucuguc

SEQ ID NO: 26682 - RNA, 22 nt, Homo sapiens
ugaagacucaauuauuaugaac

SEQ ID NO: 26683 - RNA, 22 nt, Homo sapiens
ugaaggacauaaggcagaguga

SEQ ID NO: 26684 - RNA, 22 nt, Homo sapiens
ugaaggcaggagggagaaaagu

SEQ ID NO: 26685 - RNA, 22 nt, Homo sapiens
ugaagggcauuguuuugccaaa

SEQ ID NO: 26686 - RNA, 22 nt, Homo sapiens
ugaaguaauguuuuauucuauu

SEQ ID NO: 26687 - RNA, 22 nt, Homo sapiens
ugaaguaggcauaaguuaagcu

SEQ ID NO: 26688 - RNA, 22 nt, Homo sapiens
ugaagugaagcaguaguguggg

SEQ ID NO: 26689 - RNA, 22 nt, Homo sapiens
ugaaguguuuauuuuggccuuc

SEQ ID NO: 26690 - RNA, 22 nt, Homo sapiens
ugaauagacacuaaagacugua

SEQ ID NO: 26691 - RNA, 22 nt, Homo sapiens
ugaauagagcugcaguggacau

SEQ ID NO: 26692 - RNA, 22 nt, Homo sapiens
ugaauauguuucuaaaagugca

SEQ ID NO: 26693 - RNA, 19 nt, Homo sapiens
ugaaugacaucuaaagucc

SEQ ID NO: 26694 - RNA, 22 nt, Homo sapiens
ugaaugcauggggccaagaagg

SEQ ID NO: 26695 - RNA, 22 nt, Homo sapiens
ugaauggauccaauucuuagua

SEQ ID NO: 26696 - RNA, 22 nt, Homo sapiens
ugaauguccugacgcugcaguu

SEQ ID NO: 26697 - RNA, 22 nt, Homo sapiens
ugaauguuugcagcuuauacca

SEQ ID NO: 26698 - RNA, 22 nt, Homo sapiens
ugaauguuugcuuacuuccaua

SEQ ID NO: 26699 - RNA, 22 nt, Homo sapiens
ugaauucuguccaaaauaacug

SEQ ID NO: 26700 - RNA, 22 nt, Homo sapiens
ugaauugucucucacuggguuc

SEQ ID NO: 26701 - RNA, 22 nt, Homo sapiens
ugaauuguuuacgagaugugag

SEQ ID NO: 26702 - RNA, 22 nt, Homo sapiens
ugacaagaaagcgucuucuuuu

SEQ ID NO: 26703 - RNA, 20 nt, Homo sapiens
ugacaaggugcaaagaauca

SEQ ID NO: 26704 - RNA, 18 nt, Homo sapiens
ugacaaugcuaguccugg

SEQ ID NO: 26705 - RNA, 22 nt, Homo sapiens
ugacacagugggggauccuuuu

SEQ ID NO: 26706 - RNA, 22 nt, Homo sapiens
ugacagagaagcauugaguuca

SEQ ID NO: 26707 - RNA, 22 nt, Homo sapiens
ugacagaggucuuuuaauagcu

SEQ ID NO: 26708 - RNA, 22 nt, Homo sapiens
ugacagcugaggcccagaguac

SEQ ID NO: 26709 - RNA, 22 nt, Homo sapiens
ugacaggagauuaugugauguu

SEQ ID NO: 26710 - RNA, 22 nt, Homo sapiens
ugacaggauggagaucgguauu

SEQ ID NO: 26711 - RNA, 22 nt, Homo sapiens
ugacagguugauaggugcagca

SEQ ID NO: 26712 - RNA, 22 nt, Homo sapiens
ugacaguaucuacagcuucuua

SEQ ID NO: 26713 - RNA, 23 nt, Homo sapiens
ugacagugcuugaaauugcucuu

SEQ ID NO: 26714 - RNA, 22 nt, Homo sapiens
ugacagugugagauccugucuc

SEQ ID NO: 26715 - RNA, 22 nt, Homo sapiens
ugacaguuuccagggcugucuc

SEQ ID NO: 26716 - RNA, 20 nt, Homo sapiens
ugacaucagcaauguaauaa

SEQ ID NO: 26717 - RNA, 22 nt, Homo sapiens
ugacaugaagaaaaacagauuu

SEQ ID NO: 26718 - RNA, 22 nt, Homo sapiens
ugacauggaaguagguauacau

SEQ ID NO: 26719 - RNA, 22 nt, Homo sapiens
ugacauggagguggaggaagau

SEQ ID NO: 26720 - RNA, 22 nt, Homo sapiens
ugacuacaggucaggaagcugu

SEQ ID NO: 26721 - RNA, 22 nt, Homo sapiens
ugacuagagcaauuggaaacaa

SEQ ID NO: 26722 - RNA, 22 nt, Homo sapiens
ugacuaggggcccuggcuucuu

SEQ ID NO: 26723 - RNA, 22 nt, Homo sapiens
ugacucagauagguguguauuc

SEQ ID NO: 26724 - RNA, 22 nt, Homo sapiens
ugacucaguuguuagucuucau

SEQ ID NO: 26725 - RNA, 22 nt, Homo sapiens
uuagcagcaugagaauggacua

SEQ ID NO: 26726 - RNA, 22 nt, Homo sapiens
uuagcaguggauggguggagaa

SEQ ID NO: 26727 - RNA, 22 nt, Homo sapiens
uuagcagugugagcacagacua

SEQ ID NO: 26728 - RNA, 22 nt, Homo sapiens
uuagcaugucuacuaauuugcu

SEQ ID NO: 26729 - RNA, 22 nt, Homo sapiens
uuagcccagugggugcuucucu

SEQ ID NO: 26730 - RNA, 21 nt, Homo sapiens
uuaggcagugucagaggugag

SEQ ID NO: 26731 - RNA, 22 nt, Homo sapiens
uuagguagucucugucagaggg

SEQ ID NO: 26732 - RNA, 22 nt, Homo sapiens
uucugugcuuguggaugaagug

SEQ ID NO: 26733 - RNA, 22 nt, Homo sapiens
uucugugguagaaaucucaaau

SEQ ID NO: 26734 - RNA, 22 nt, Homo sapiens
uucuucugguuaugaaauuuga

SEQ ID NO: 26735 - RNA, 22 nt, Homo sapiens
uucuugaggcaugccgcuggga

SEQ ID NO: 26736 - RNA, 22 nt, Homo sapiens
uucuugcugaauugugcccuuc

SEQ ID NO: 26737 - RNA, 18 nt, Homo sapiens
uucuuguguugauauuuu

SEQ ID NO: 26738 - RNA, 21 nt, Homo sapiens
uucuuugcucaguguuagagu

SEQ ID NO: 26739 - RNA, 22 nt, Homo sapiens
uucuuugcuuggaagcggggga

SEQ ID NO: 26740 - RNA, 22 nt, Homo sapiens
uucuuuggaaacaguacuaauu

SEQ ID NO: 26741 - RNA, 22 nt, Homo sapiens
uugaaagaugaacuggauugga

SEQ ID NO: 26742 - RNA, 22 nt, Homo sapiens
uugaaagcuaucagagauucca

SEQ ID NO: 26743 - RNA, 22 nt, Homo sapiens
uugaaagucauggcacaggcaa

SEQ ID NO: 26744 - RNA, 22 nt, Homo sapiens
uugaaaguguucacaaugguau

SEQ ID NO: 26745 - RNA, 22 nt, Homo sapiens
uugaaauguguaagcuccgaaa

SEQ ID NO: 26746 - RNA, 22 nt, Homo sapiens
uugaaccauucuuuugauagag

SEQ ID NO: 26747 - RNA, 22 nt, Homo sapiens
uugaacuagaaccugcaaauuu

SEQ ID NO: 26748 - RNA, 22 nt, Homo sapiens
uugaagacuaauuuagauaaug

SEQ ID NO: 26749 - RNA, 22 nt, Homo sapiens
uugaagacuaccuaccauacuu

SEQ ID NO: 26750 - RNA, 22 nt, Homo sapiens
uugaaguagcauuucaugucua

SEQ ID NO: 26751 - RNA, 22 nt, Homo sapiens
uugaaguguguauacauugugg

SEQ ID NO: 26752 - RNA, 22 nt, Homo sapiens
uugaauagaaguguugaaagug

SEQ ID NO: 26753 - RNA, 18 nt, Homo sapiens
uugaauaguguccaaucu

SEQ ID NO: 26754 - RNA, 22 nt, Homo sapiens
uugaaugaaaugaugucauuug

SEQ ID NO: 26755 - RNA, 17 nt, Homo sapiens
uugaaugcauuacuugg

SEQ ID NO: 26756 - RNA, 22 nt, Homo sapiens
uugaauggaauguuggaacuau

SEQ ID NO: 26757 - RNA, 22 nt, Homo sapiens
uugaauguguugggaagcccuu

SEQ ID NO: 26758 - RNA, 23 nt, Homo sapiens
uugaauguuuccccucccaaauu

SEQ ID NO: 26759 - RNA, 22 nt, Homo sapiens
uugacaaugcacugugcuaagu

SEQ ID NO: 26760 - RNA, 20 nt, Homo sapiens
uugacagagggaaaguugcu

SEQ ID NO: 26761 - RNA, 22 nt, Homo sapiens
uugaccacugggcacaguaagu

SEQ ID NO: 26762 - RNA, 22 nt, Homo sapiens
uugaccuaugggaguuugacua

SEQ ID NO: 26763 - RNA, 22 nt, Homo sapiens
uugaccucaucacuucccaaag

SEQ ID NO: 26764 - RNA, 23 nt, Homo sapiens
uugacuguggguacaaugugaua

SEQ ID NO: 26765 - RNA, 22 nt, Homo sapiens
uugacugugguaauggaagcug

SEQ ID NO: 26766 - RNA, 21 nt, Homo sapiens
uugagaagaauuagcucuucc

SEQ ID NO: 26767 - RNA, 22 nt, Homo sapiens
uugagacgaagucucacucuug

SEQ ID NO: 26768 - RNA, 22 nt, Homo sapiens
uugagagaaaaaauuuauuggu

SEQ ID NO: 26769 - RNA, 22 nt, Homo sapiens
uugagaguggaggcuauaucuu

SEQ ID NO: 26770 - RNA, 22 nt, Homo sapiens
uugagauacauaauuaugaaug

SEQ ID NO: 26771 - RNA, 22 nt, Homo sapiens
uugagauaggagcuguuguucu

SEQ ID NO: 26772 - RNA, 22 nt, Homo sapiens
uugagauauccauaaaugggaa

SEQ ID NO: 26773 - RNA, 22 nt, Homo sapiens
uugagaugauggauaugcuaau

SEQ ID NO: 26774 - RNA, 22 nt, Homo sapiens
uugagauggagccucacucugc

SEQ ID NO: 26775 - RNA, 22 nt, Homo sapiens
uugagauggagucucacucugc

SEQ ID NO: 26776 - RNA, 22 nt, Homo sapiens
uugagauggagucucacugugu

SEQ ID NO: 26777 - RNA, 22 nt, Homo sapiens
uugagauggagucuugcucugu

SEQ ID NO: 26778 - RNA, 22 nt, Homo sapiens
uugagauguggcaguuuaugag

SEQ ID NO: 26779 - RNA, 22 nt, Homo sapiens
uugagcaauccuccugccaugu

SEQ ID NO: 26780 - RNA, 22 nt, Homo sapiens
uugagcacaguagguuguggcu

SEQ ID NO: 26781 - RNA, 22 nt, Homo sapiens
uugaggaaugugauuucaaaua

SEQ ID NO: 26782 - RNA, 22 nt, Homo sapiens
uugaggaguacugauuagguau

SEQ ID NO: 26783 - RNA, 23 nt, Homo sapiens
uugaggcauguaccaucaauauc

SEQ ID NO: 26784 - RNA, 16 nt, Homo sapiens
uugaggcaugucucag

SEQ ID NO: 26785 - RNA, 22 nt, Homo sapiens
uugagggagccuguuagucccg

SEQ ID NO: 26786 - RNA, 22 nt, Homo sapiens
uugaggugggaggaucacuuga

SEQ ID NO: 26787 - RNA, 22 nt, Homo sapiens
uugaguagugugaugcaugucu

SEQ ID NO: 26788 - RNA, 22 nt, Homo sapiens
uugaguccccacacuggguccc

SEQ ID NO: 26789 - RNA, 21 nt, Homo sapiens
uugaguugaagcaaggaggga

SEQ ID NO: 26790 - RNA, 22 nt, Homo sapiens
uugauaagaaaugccaguuugg

SEQ ID NO: 26791 - RNA, 22 nt, Homo sapiens
uugauaucugaugccuauggaa

SEQ ID NO: 26792 - RNA, 22 nt, Homo sapiens
uugaucaaaucugagugagaau

SEQ ID NO: 26793 - RNA, 22 nt, Homo sapiens
uugaucacuguacuaugacuau

SEQ ID NO: 26794 - RNA, 22 nt, Homo sapiens
uugaucuaugugucuguuuuua

SEQ ID NO: 26795 - RNA, 22 nt, Homo sapiens
uugaucuggagagaggcccgug

SEQ ID NO: 26796 - RNA, 22 nt, Homo sapiens
uugaugauguuucugccuugcc

SEQ ID NO: 26797 - RNA, 22 nt, Homo sapiens
uugauguaggcauucaaggcua

SEQ ID NO: 26798 - RNA, 22 nt, Homo sapiens
uugauguguuuccaggauuugu

SEQ ID NO: 26799 - RNA, 23 nt, Homo sapiens
uugcaaagccugaaacucuucag

SEQ ID NO: 26800 - RNA, 22 nt, Homo sapiens
uugcaaggugcagcuuaugcaa

SEQ ID NO: 26801 - RNA, 22 nt, Homo sapiens
uugcaaguggagcuuccagggc

SEQ ID NO: 26802 - RNA, 22 nt, Homo sapiens
uugcacaauggaauuuaucuuu

SEQ ID NO: 26803 - RNA, 22 nt, Homo sapiens
uugcacauggcuggggaggccu

SEQ ID NO: 26804 - RNA, 22 nt, Homo sapiens
uugcacauugauuuuguaucuu

SEQ ID NO: 26805 - RNA, 22 nt, Homo sapiens
uugcacuccagccuggaugaca

SEQ ID NO: 26806 - RNA, 18 nt, Homo sapiens
uugcacuccugccugggu

SEQ ID NO: 26807 - RNA, 22 nt, Homo sapiens
uugcacucuagccugggugaca

SEQ ID NO: 26808 - RNA, 22 nt, Homo sapiens
uugcacucuccagccucggcaa

SEQ ID NO: 26809 - RNA, 22 nt, Homo sapiens
uugcacugagauuuugcuuaca

SEQ ID NO: 26810 - RNA, 22 nt, Homo sapiens
uugcacuucauguaggccaaag

SEQ ID NO: 26811 - RNA, 22 nt, Homo sapiens
uugcagagccccugcaaggguc

SEQ ID NO: 26812 - RNA, 22 nt, Homo sapiens
uugcagaucccacacucacccu

SEQ ID NO: 26813 - RNA, 22 nt, Homo sapiens
uugcagcaaagagggaggggca

SEQ ID NO: 26814 - RNA, 22 nt, Homo sapiens
uugcaggcaugagccaccgugc

SEQ ID NO: 26815 - RNA, 22 nt, Homo sapiens
uugcaguacuucuggcuuuaca

SEQ ID NO: 26816 - RNA, 19 nt, Homo sapiens
uugcaguauccuauauguu

SEQ ID NO: 26817 - RNA, 22 nt, Homo sapiens
uugcagugguuucacuggcaaa

SEQ ID NO: 26818 - RNA, 23 nt, Homo sapiens
uugcauagacauccucauagauu

SEQ ID NO: 26819 - RNA, 19 nt, Homo sapiens
uugcauauguugaaccagc

SEQ ID NO: 26820 - RNA, 22 nt, Homo sapiens
uugcauauguugaaccagccuu

SEQ ID NO: 26821 - RNA, 19 nt, Homo sapiens
uugcauauguugaaccagg

SEQ ID NO: 26822 - RNA, 22 nt, Homo sapiens
uugcaugguggaacuuggagcu

SEQ ID NO: 26823 - RNA, 22 nt, Homo sapiens
uggaaguauagauaauugaaag

SEQ ID NO: 26824 - RNA, 22 nt, Homo sapiens
uggaauacaugucgcugagcug

SEQ ID NO: 26825 - RNA, 22 nt, Homo sapiens
uggaauaucaugagaguuuguu

SEQ ID NO: 26826 - RNA, 22 nt, Homo sapiens
uggaauaugagacgggguuguc

SEQ ID NO: 26827 - RNA, 22 nt, Homo sapiens
uggaaucaucaacgaaugaaau

SEQ ID NO: 26828 - RNA, 20 nt, Homo sapiens
uggaaucuaggcggagguuu

SEQ ID NO: 26829 - RNA, 21 nt, Homo sapiens
uggaaucuauuauuccaguuu

SEQ ID NO: 26830 - RNA, 22 nt, Homo sapiens
uggaaucuuaggugaaggcuuu

SEQ ID NO: 26831 - RNA, 20 nt, Homo sapiens
uggaaugcagccuccuucug

SEQ ID NO: 26832 - RNA, 22 nt, Homo sapiens
uggaaugcucuccccacggacu

SEQ ID NO: 26833 - RNA, 22 nt, Homo sapiens
uucaucaguugagcugguugcu

SEQ ID NO: 26834 - RNA, 22 nt, Homo sapiens
uucaugcaucuguagugguuaa

SEQ ID NO: 26835 - RNA, 22 nt, Homo sapiens
uucauggaugcauuugaggggu

SEQ ID NO: 26836 - RNA, 22 nt, Homo sapiens
uucauguaaucaaggcagcuaa

SEQ ID NO: 26837 - RNA, 22 nt, Homo sapiens
uucauguagucaucauccugcu

SEQ ID NO: 26838 - RNA, 22 nt, Homo sapiens
uuccaauguuccguguugcagu

SEQ ID NO: 26839 - RNA, 22 nt, Homo sapiens
uuccagagucaccuuucugucg

SEQ ID NO: 26840 - RNA, 22 nt, Homo sapiens
uuccaggugggcgugggccugg

SEQ ID NO: 26841 - RNA, 22 nt, Homo sapiens
uuccaguauuugggcaagcgca

SEQ ID NO: 26842 - RNA, 21 nt, Homo sapiens
uuccagugagccuagaugccu

SEQ ID NO: 26843 - RNA, 22 nt, Homo sapiens
uuccaguggaguaaauggacaa

SEQ ID NO: 26844 - RNA, 22 nt, Homo sapiens
uuccagugggacgagaugugga

SEQ ID NO: 26845 - RNA, 22 nt, Homo sapiens
uuccaguguguucauccucaga

SEQ ID NO: 26846 - RNA, 22 nt, Homo sapiens
uuccauaggcuagaucaaccag

SEQ ID NO: 26847 - RNA, 22 nt, Homo sapiens
uuccaugagaugcaucaaagcu

SEQ ID NO: 26848 - RNA, 22 nt, Homo sapiens
uucccagagaaaaggguuucuu

SEQ ID NO: 26849 - RNA, 22 nt, Homo sapiens
uucccagagccugggagugagg

SEQ ID NO: 26850 - RNA, 22 nt, Homo sapiens
uucccaguaaacucuaucccuc

SEQ ID NO: 26851 - RNA, 22 nt, Homo sapiens
uucccagucaaacgaaggacuu

SEQ ID NO: 26852 - RNA, 22 nt, Homo sapiens
uucccauuguuggccagcaugu

SEQ ID NO: 26853 - RNA, 22 nt, Homo sapiens
uucccucagaaacacacagccc

SEQ ID NO: 26854 - RNA, 22 nt, Homo sapiens
uucccugaaauauucacuuuca

SEQ ID NO: 26855 - RNA, 22 nt, Homo sapiens
uucccugagcaucuguugagcc

SEQ ID NO: 26856 - RNA, 23 nt, Homo sapiens
uucccuuagaagaaggggagaaa

SEQ ID NO: 26857 - RNA, 22 nt, Homo sapiens
uucccuuuguuaaauuggaaga

SEQ ID NO: 26858 - RNA, 19 nt, Homo sapiens
uuccugagaacaagggcuu

SEQ ID NO: 26859 - RNA, 22 nt, Homo sapiens
uuccugucuuccaagagagauu

SEQ ID NO: 26860 - RNA, 22 nt, Homo sapiens
uuccuugguucagggaaggucc

SEQ ID NO: 26861 - RNA, 22 nt, Homo sapiens
uuccuuguuuauuuacaggagg

SEQ ID NO: 26862 - RNA, 21 nt, Homo sapiens
uucuaaguaaauguuggacau

SEQ ID NO: 26863 - RNA, 22 nt, Homo sapiens
uucuacaugggucgucggugag

SEQ ID NO: 26864 - RNA, 22 nt, Homo sapiens
uucuacuccucauggcagguug

SEQ ID NO: 26865 - RNA, 22 nt, Homo sapiens
uucuagcaauggcagagugucu

SEQ ID NO: 26866 - RNA, 22 nt, Homo sapiens
uucuagcacuuugggagacuga

SEQ ID NO: 26867 - RNA, 22 nt, Homo sapiens
uucuaguacucccuggagcugg

SEQ ID NO: 26868 - RNA, 22 nt, Homo sapiens
uucuaugguuuaauaguuuggg

SEQ ID NO: 26869 - RNA, 22 nt, Homo sapiens
uucuauguuguuagacccacca

SEQ ID NO: 26870 - RNA, 22 nt, Homo sapiens
uucucaauggaugugggaccag

SEQ ID NO: 26871 - RNA, 22 nt, Homo sapiens
uucucagugaacuccagcuugu

SEQ ID NO: 26872 - RNA, 22 nt, Homo sapiens
uucucagugaaguuuagaacau

SEQ ID NO: 26873 - RNA, 22 nt, Homo sapiens
uucucauggaacaucuguacug

SEQ ID NO: 26874 - RNA, 22 nt, Homo sapiens
uucuccugguggacccuaaacg

SEQ ID NO: 26875 - RNA, 22 nt, Homo sapiens
uucucgcuuuuuccaccuguau

SEQ ID NO: 26876 - RNA, 22 nt, Homo sapiens
uucucugggacauaggucgggu

SEQ ID NO: 26877 - RNA, 22 nt, Homo sapiens
uucugagguuauauucucucaa

SEQ ID NO: 26878 - RNA, 22 nt, Homo sapiens
uucugauggaguaguccacaga

SEQ ID NO: 26879 - RNA, 22 nt, Homo sapiens
uucugcuugaucuaguguguug

SEQ ID NO: 26880 - RNA, 22 nt, Homo sapiens
uucuggaaaucagcagagggug

SEQ ID NO: 26881 - RNA, 22 nt, Homo sapiens
uucuggccccucccaaucucau

SEQ ID NO: 26882 - RNA, 22 nt, Homo sapiens
uucugugguuucauuuaccugu

SEQ ID NO: 26883 - RNA, 22 nt, Homo sapiens
uucuuagucauguaauagucca

SEQ ID NO: 26884 - RNA, 20 nt, Homo sapiens
uucuugaguuaacaaguuac

SEQ ID NO: 26885 - RNA, 22 nt, Homo sapiens
uucuugcacuuaacugacauuc

SEQ ID NO: 26886 - RNA, 22 nt, Homo sapiens
uucuugguugcucacacccauc

SEQ ID NO: 26887 - RNA, 22 nt, Homo sapiens
uucuugguuggcaaccaacagu

SEQ ID NO: 26888 - RNA, 22 nt, Homo sapiens
uucuuuggauaaaguuuuaugc

SEQ ID NO: 26889 - RNA, 19 nt, Homo sapiens
uucuuuguugugggggcug

SEQ ID NO: 26890 - RNA, 22 nt, Homo sapiens
uugaaagacaucaccuacugcu

SEQ ID NO: 26891 - RNA, 22 nt, Homo sapiens
uugaaagucauuucuucuaagu

SEQ ID NO: 26892 - RNA, 22 nt, Homo sapiens
uugaaagucuaggcuuacagua

SEQ ID NO: 26893 - RNA, 22 nt, Homo sapiens
uugaaaucuuccacagcccaag

SEQ ID NO: 26894 - RNA, 22 nt, Homo sapiens
uugaacugguaguuggaaaucu

SEQ ID NO: 26895 - RNA, 22 nt, Homo sapiens
uugaagacuauaugauucuuca

SEQ ID NO: 26896 - RNA, 22 nt, Homo sapiens
uugaagagaaccgcggcuuauu

SEQ ID NO: 26897 - RNA, 22 nt, Homo sapiens
uugaaguagguaccguucaauu

SEQ ID NO: 26898 - RNA, 22 nt, Homo sapiens
uugaauagaagguuuuuuguuc

SEQ ID NO: 26899 - RNA, 22 nt, Homo sapiens
uugaaugcguuguguggcccgu

SEQ ID NO: 26900 - RNA, 22 nt, Homo sapiens
uugaauguacuuguucucacua

SEQ ID NO: 26901 - RNA, 22 nt, Homo sapiens
uugacaaggagccauugcaucu

SEQ ID NO: 26902 - RNA, 22 nt, Homo sapiens
uugacaaguuguccaguaugag

SEQ ID NO: 26903 - RNA, 22 nt, Homo sapiens
uugacacuuuguaagaaagggg

SEQ ID NO: 26904 - RNA, 22 nt, Homo sapiens
uugacaguugggcagggaaguu

SEQ ID NO: 26905 - RNA, 22 nt, Homo sapiens
uugacauugcuguaguguccag

SEQ ID NO: 26906 - RNA, 22 nt, Homo sapiens
uugacuccagagugaguaaaug

SEQ ID NO: 26907 - RNA, 22 nt, Homo sapiens
uugacuuagacauucaguugga

SEQ ID NO: 26908 - RNA, 22 nt, Homo sapiens
uugagaaucuuucgaauguucu

SEQ ID NO: 26909 - RNA, 22 nt, Homo sapiens
uugagaaucuuugcuaaaggaa

SEQ ID NO: 26910 - RNA, 22 nt, Homo sapiens
uugagacggagucucacucugu

SEQ ID NO: 26911 - RNA, 22 nt, Homo sapiens
cugagaguugaugaaauauggu

SEQ ID NO: 26912 - RNA, 22 nt, Homo sapiens
cugagauaggacucugcuggcu

SEQ ID NO: 26913 - RNA, 22 nt, Homo sapiens
cugagaucaagucuugcucugu

SEQ ID NO: 26914 - RNA, 22 nt, Homo sapiens
cugagauuuuuagauccuggcg

SEQ ID NO: 26915 - RNA, 22 nt, Homo sapiens
cugagcuaguagcauuguguca

SEQ ID NO: 26916 - RNA, 22 nt, Homo sapiens
cugaggaaguucuuuaacaguu

SEQ ID NO: 26917 - RNA, 22 nt, Homo sapiens
cugagguagcucaggguauugc

SEQ ID NO: 26918 - RNA, 22 nt, Homo sapiens
cugaggucugaauccagguauc

SEQ ID NO: 26919 - RNA, 22 nt, Homo sapiens
cugaggugggagaaucacauaa

SEQ ID NO: 26920 - RNA, 22 nt, Homo sapiens
cugagugcaagugauccuccca

SEQ ID NO: 26921 - RNA, 22 nt, Homo sapiens
cugauacugagaccuuggguua

SEQ ID NO: 26922 - RNA, 21 nt, Homo sapiens
cugaucacaggugagcugccu

SEQ ID NO: 26923 - RNA, 22 nt, Homo sapiens
cugaucuguagcagccaccaca

SEQ ID NO: 26924 - RNA, 22 nt, Homo sapiens
cugaucuguuauacuuuucuau

SEQ ID NO: 26925 - RNA, 22 nt, Homo sapiens
cugauugucuauuuaguucacu

SEQ ID NO: 26926 - RNA, 22 nt, Homo sapiens
cugcaaauacuugugggauuuu

SEQ ID NO: 26927 - RNA, 20 nt, Homo sapiens
cugcacauccacucuacuuc

SEQ ID NO: 26928 - RNA, 22 nt, Homo sapiens
cugcacugagacccucuuugcu

SEQ ID NO: 26929 - RNA, 22 nt, Homo sapiens
cugccacugacaccucaaggac

SEQ ID NO: 26930 - RNA, 22 nt, Homo sapiens
cugcuaagagaaugagacuuag

SEQ ID NO: 26931 - RNA, 20 nt, Homo sapiens
cugcuccccuacaaaucuca

SEQ ID NO: 26932 - RNA, 22 nt, Homo sapiens
cuggaaagaaucaggcuaaacu

SEQ ID NO: 26933 - RNA, 22 nt, Homo sapiens
cuggaaagcaaguccauugcuc

SEQ ID NO: 26934 - RNA, 22 nt, Homo sapiens
cuggaagaaaaucacgccaucu

SEQ ID NO: 26935 - RNA, 22 nt, Homo sapiens
cuggaaggaaaaacaaccacag

SEQ ID NO: 26936 - RNA, 22 nt, Homo sapiens
cuggaaucuauggauaacaucg

SEQ ID NO: 26937 - RNA, 22 nt, Homo sapiens
cuggacaaaucuggaaagaacc

SEQ ID NO: 26938 - RNA, 22 nt, Homo sapiens
cuggagauuaaccaauugccau

SEQ ID NO: 26939 - RNA, 22 nt, Homo sapiens
cauugcacuuagacaacuuuug

SEQ ID NO: 26940 - RNA, 22 nt, Homo sapiens
cauugcagauccuucaaaugac

SEQ ID NO: 26941 - RNA, 22 nt, Homo sapiens
cauugcaguggaguggggaaga

SEQ ID NO: 26942 - RNA, 22 nt, Homo sapiens
cauugcauuuucuuuguaccuu

SEQ ID NO: 26943 - RNA, 22 nt, Homo sapiens
cauugcccuccagccugggcaa

SEQ ID NO: 26944 - RNA, 22 nt, Homo sapiens
cauuggugauuagugaaugaac

SEQ ID NO: 26945 - RNA, 22 nt, Homo sapiens
cauugguuaguuaacuuuaaga

SEQ ID NO: 26946 - RNA, 22 nt, Homo sapiens
cauugguuccaguuuguccuua

SEQ ID NO: 26947 - RNA, 22 nt, Homo sapiens
cauugguuuauagauggggaaa

SEQ ID NO: 26948 - RNA, 22 nt, Homo sapiens
cauugucccucaaugucuauga

SEQ ID NO: 26949 - RNA, 22 nt, Homo sapiens
ccaaaucucauguugaaaugug

SEQ ID NO: 26950 - RNA, 22 nt, Homo sapiens
ccaaguguuuucauuguuccau

SEQ ID NO: 26951 - RNA, 23 nt, Homo sapiens
ccacaaugguugaacuagauuac

SEQ ID NO: 26952 - RNA, 22 nt, Homo sapiens
ccacccuuccacacccugggua

SEQ ID NO: 26953 - RNA, 22 nt, Homo sapiens
ccacugcacuccagcccggcaa

SEQ ID NO: 26954 - RNA, 22 nt, Homo sapiens
ccacugggcaguuuauuaucag

SEQ ID NO: 26955 - RNA, 22 nt, Homo sapiens
ccacuguuuaaauggcugagga

SEQ ID NO: 26956 - RNA, 22 nt, Homo sapiens
ccagaauucucauuggaaggaa

SEQ ID NO: 26957 - RNA, 22 nt, Homo sapiens
ccagaguucuaggcauuggaaa

SEQ ID NO: 26958 - RNA, 22 nt, Homo sapiens
ccagcaccauuuauuaaauagg

SEQ ID NO: 26959 - RNA, 20 nt, Homo sapiens
ccagcaucauuagauucugg

SEQ ID NO: 26960 - RNA, 22 nt, Homo sapiens
ccaguauugaacacaaugaaag

SEQ ID NO: 26961 - RNA, 23 nt, Homo sapiens
ccaguauuuauguaaggaagugu

SEQ ID NO: 26962 - RNA, 22 nt, Homo sapiens
ccagugauuguauggugaaggu

SEQ ID NO: 26963 - RNA, 22 nt, Homo sapiens
ccagugcauggaucccaggggg

SEQ ID NO: 26964 - RNA, 20 nt, Homo sapiens
ccaguguuauuuauguucua

SEQ ID NO: 26965 - RNA, 22 nt, Homo sapiens
ccaguucaaugauauggaaacu

SEQ ID NO: 26966 - RNA, 17 nt, Homo sapiens
ccaguuuucccucagug

SEQ ID NO: 26967 - RNA, 22 nt, Homo sapiens
ccaguuuuuggcaaugaugaau

SEQ ID NO: 26968 - RNA, 22 nt, Homo sapiens
ccauacugucaaauagauuucc

SEQ ID NO: 26969 - RNA, 22 nt, Homo sapiens
ccaugaacuagaauagaacaug

SEQ ID NO: 26970 - RNA, 18 nt, Homo sapiens
ccauucaacagauuuguc

SEQ ID NO: 26971 - RNA, 23 nt, Homo sapiens
ccauugcacuccagccucaguga

SEQ ID NO: 26972 - RNA, 22 nt, Homo sapiens
ccauugcacuucagccuaggug

SEQ ID NO: 26973 - RNA, 22 nt, Homo sapiens
ccauuucacucuuccugaagga

SEQ ID NO: 26974 - RNA, 22 nt, Homo sapiens
cccacaguggccucauauccuu

SEQ ID NO: 26975 - RNA, 22 nt, Homo sapiens
cccagagacagaaugauaaacu

SEQ ID NO: 26976 - RNA, 22 nt, Homo sapiens
cccagcguucggcauggcugag

SEQ ID NO: 26977 - RNA, 22 nt, Homo sapiens
cccagugguuacauaaggagua

SEQ ID NO: 26978 - RNA, 22 nt, Homo sapiens
cccagugugaacuuggcauuuu

SEQ ID NO: 26979 - RNA, 22 nt, Homo sapiens
cccagugugcugggugacagcu

SEQ ID NO: 26980 - RNA, 22 nt, Homo sapiens
cccaguguuacgugacagccug

SEQ ID NO: 26981 - RNA, 22 nt, Homo sapiens
ccccagguuucaauaaagccca

SEQ ID NO: 26982 - RNA, 22 nt, Homo sapiens
ccccggguucugucugcccuug

SEQ ID NO: 26983 - RNA, 20 nt, Homo sapiens
ccccguguuuagcauaucau

SEQ ID NO: 26984 - RNA, 22 nt, Homo sapiens
ccccuguaaacuggcuucccug

SEQ ID NO: 26985 - RNA, 20 nt, Homo sapiens
cccuaagccagaugcugggg

SEQ ID NO: 26986 - RNA, 22 nt, Homo sapiens
cccuggacacacacuuuuauuc

SEQ ID NO: 26987 - RNA, 19 nt, Homo sapiens
cccuggcacauggaaaaug

SEQ ID NO: 26988 - RNA, 22 nt, Homo sapiens
cccuguguuguucaaggaucug

SEQ ID NO: 26989 - RNA, 22 nt, Homo sapiens
ccuaaguaauggcaguuuuugc

SEQ ID NO: 26990 - RNA, 19 nt, Homo sapiens
ccucaaguacuaauauguu

SEQ ID NO: 26991 - RNA, 21 nt, Homo sapiens
ccuccauuuguauucuugccc

SEQ ID NO: 26992 - RNA, 22 nt, Homo sapiens
ccuccauuugugucaggaaguc

SEQ ID NO: 26993 - RNA, 21 nt, Homo sapiens
ccugaguacaacccacuccac

SEQ ID NO: 26994 - RNA, 21 nt, Homo sapiens
ccugaugaccucugagaguua

SEQ ID NO: 26995 - RNA, 23 nt, Homo sapiens
ccuguagaaugucugugauacuu

SEQ ID NO: 26996 - RNA, 22 nt, Homo sapiens
ccugugguuaaccagcuagaug

SEQ ID NO: 26997 - RNA, 22 nt, Homo sapiens
ccuugcacuucccaggugaggc

SEQ ID NO: 26998 - RNA, 22 nt, Homo sapiens
cgaggaguaucuuugugguguu

SEQ ID NO: 26999 - RNA, 22 nt, Homo sapiens
cgcuggugaucuagacccccaa

SEQ ID NO: 27000 - RNA, 22 nt, Homo sapiens
cgcuggugucuaagcgacagcu

SEQ ID NO: 27001 - RNA, 22 nt, Homo sapiens
cggucacagugauucaaggguc

SEQ ID NO: 27002 - RNA, 22 nt, Homo sapiens
cuaaaguauugagugguaaaga

SEQ ID NO: 27003 - RNA, 22 nt, Homo sapiens
cuaaagugcuuaaaaucucauu

SEQ ID NO: 27004 - RNA, 22 nt, Homo sapiens
cuaaaugcacugucaaaggaag

SEQ ID NO: 27005 - RNA, 17 nt, Homo sapiens
cuaaggcaagagucugc

SEQ ID NO: 27006 - RNA, 22 nt, Homo sapiens
cuaagggaggaagcugugcagg

SEQ ID NO: 27007 - RNA, 22 nt, Homo sapiens
cuaaugcagucaggagaaggaa

SEQ ID NO: 27008 - RNA, 22 nt, Homo sapiens
cuacagugggucuguaguccuu

SEQ ID NO: 27009 - RNA, 21 nt, Homo sapiens
cuacccuguauuagagaaaga

SEQ ID NO: 27010 - RNA, 22 nt, Homo sapiens
cuacccuuaaguuucugugggg

SEQ ID NO: 27011 - RNA, 22 nt, Homo sapiens
cuacucugugguguauuugcau

SEQ ID NO: 27012 - RNA, 22 nt, Homo sapiens
ggcaguggaagugccaguuucu

SEQ ID NO: 27013 - RNA, 22 nt, Homo sapiens
ggcaguguggcugcauauagca

SEQ ID NO: 27014 - RNA, 22 nt, Homo sapiens
ggcaguuuggcaguuucauaaa

SEQ ID NO: 27015 - RNA, 22 nt, Homo sapiens
ggcaguuuguucuugcuccuuu

SEQ ID NO: 27016 - RNA, 22 nt, Homo sapiens
ggcaugaaguagcccacaggca

SEQ ID NO: 27017 - RNA, 22 nt, Homo sapiens
ggcaugaugcgcacgccuguag

SEQ ID NO: 27018 - RNA, 22 nt, Homo sapiens
ggcaugguggugugugccuaua

SEQ ID NO: 27019 - RNA, 22 nt, Homo sapiens
ggcauguauucuuauuauuccu

SEQ ID NO: 27020 - RNA, 22 nt, Homo sapiens
ggcauguguggguuauuaaaga

SEQ ID NO: 27021 - RNA, 22 nt, Homo sapiens
ggccagaugaucuaugaaggaa

SEQ ID NO: 27022 - RNA, 22 nt, Homo sapiens
ggcuagagaauagugccacuaa

SEQ ID NO: 27023 - RNA, 22 nt, Homo sapiens
ggcuagagacaaguugcugaga

SEQ ID NO: 27024 - RNA, 22 nt, Homo sapiens
ggcuagauauucacauauggcu

SEQ ID NO: 27025 - RNA, 22 nt, Homo sapiens
ggcugguuuucaguuacugagu

SEQ ID NO: 27026 - RNA, 22 nt, Homo sapiens
ggcuuggaggaaugugagggcu

SEQ ID NO: 27027 - RNA, 22 nt, Homo sapiens
gggaagguaaucauuacuugau

SEQ ID NO: 27028 - RNA, 22 nt, Homo sapiens
gggagguuguauguaugcgggg

SEQ ID NO: 27029 - RNA, 22 nt, Homo sapiens
gggaugaauuagguauguuuau

SEQ ID NO: 27030 - RNA, 22 nt, Homo sapiens
gggauuguaauacugaguuggu

SEQ ID NO: 27031 - RNA, 21 nt, Homo sapiens
gggcaaaucuuuauccuaagc

SEQ ID NO: 27032 - RNA, 22 nt, Homo sapiens
gggcaagaagucuuguaguuuu

SEQ ID NO: 27033 - RNA, 22 nt, Homo sapiens
gggcacgugugugcugugcuca

SEQ ID NO: 27034 - RNA, 23 nt, Homo sapiens
gggcuagaugagagcuuccuggg

SEQ ID NO: 27035 - RNA, 22 nt, Homo sapiens
ggggcaaaaugccacgagucuc

SEQ ID NO: 27036 - RNA, 22 nt, Homo sapiens
ggggcauugugucuggguuccu

SEQ ID NO: 27037 - RNA, 22 nt, Homo sapiens
gggggagugugguacccagcau

SEQ ID NO: 27038 - RNA, 22 nt, Homo sapiens
cuggagcaaaggugacucuugu

SEQ ID NO: 27039 - RNA, 22 nt, Homo sapiens
cuggcaaauguuuucuguaaag

SEQ ID NO: 27040 - RNA, 22 nt, Homo sapiens
cuggcaccauacacuguuguug

SEQ ID NO: 27041 - RNA, 22 nt, Homo sapiens
cuggcaccauuuugaucaaagg

SEQ ID NO: 27042 - RNA, 22 nt, Homo sapiens
cuggcaguguuucuugugggcu

SEQ ID NO: 27043 - RNA, 22 nt, Homo sapiens
cuggcaucuaaauacuugaugu

SEQ ID NO: 27044 - RNA, 22 nt, Homo sapiens
cugggaucaguucuagucagaa

SEQ ID NO: 27045 - RNA, 22 nt, Homo sapiens
cugggucaguuucugauuauug

SEQ ID NO: 27046 - RNA, 22 nt, Homo sapiens
cuggucaagagcaaaggccagg

SEQ ID NO: 27047 - RNA, 21 nt, Homo sapiens
cugguguuagcacuucuuccc

SEQ ID NO: 27048 - RNA, 22 nt, Homo sapiens
cugguuguuacaugcuugccag

SEQ ID NO: 27049 - RNA, 22 nt, Homo sapiens
cugguuuguaaaguuccugaga

SEQ ID NO: 27050 - RNA, 22 nt, Homo sapiens
cuguaaagaucacagagcuggu

SEQ ID NO: 27051 - RNA, 23 nt, Homo sapiens
cuguacacauauacaucuaagua

SEQ ID NO: 27052 - RNA, 22 nt, Homo sapiens
cuguaugugagaaauaauaagu

SEQ ID NO: 27053 - RNA, 22 nt, Homo sapiens
cuguauguuucuaugaauguga

SEQ ID NO: 27054 - RNA, 22 nt, Homo sapiens
cugucaucauuucuaugugcca

SEQ ID NO: 27055 - RNA, 22 nt, Homo sapiens
cugugaagaaagucauugguag

SEQ ID NO: 27056 - RNA, 22 nt, Homo sapiens
cugugcaaacaagugaaccccu

SEQ ID NO: 27057 - RNA, 22 nt, Homo sapiens
cugugcauucuuaaaucaggaa

SEQ ID NO: 27058 - RNA, 23 nt, Homo sapiens
cuguggauaugaguuguaaaugg

SEQ ID NO: 27059 - RNA, 22 nt, Homo sapiens
cuguggauguauugcacagucu

SEQ ID NO: 27060 - RNA, 20 nt, Homo sapiens
cugugguagggaccaggaau

SEQ ID NO: 27061 - RNA, 22 nt, Homo sapiens
cugugguauuauuagaaauauc

SEQ ID NO: 27062 - RNA, 23 nt, Homo sapiens
cuguggugaggcccuagaaucug

SEQ ID NO: 27063 - RNA, 22 nt, Homo sapiens
cugugguugagcuuugccauga

SEQ ID NO: 27064 - RNA, 22 nt, Homo sapiens
cuguuaacauguuguggauaau

SEQ ID NO: 27065 - RNA, 22 nt, Homo sapiens
cuguuugguaaggaugccucag

SEQ ID NO: 27066 - RNA, 22 nt, Homo sapiens
cuuagcaaugucguguacucac

SEQ ID NO: 27067 - RNA, 22 nt, Homo sapiens
cuuagguuaugauaaauuuagu

SEQ ID NO: 27068 - RNA, 17 nt, Homo sapiens
cuucaaauaauuucccc

SEQ ID NO: 27069 - RNA, 22 nt, Homo sapiens
cuucacuuuguuaaacuccaau

SEQ ID NO: 27070 - RNA, 22 nt, Homo sapiens
cuucaguucuguaaggacagca

SEQ ID NO: 27071 - RNA, 22 nt, Homo sapiens
cuucaucugguuugugaacuuu

SEQ ID NO: 27072 - RNA, 22 nt, Homo sapiens
cuuccauaguauuuuuacaaaa

SEQ ID NO: 27073 - RNA, 18 nt, Homo sapiens
cuuccuuagucugguuaa

SEQ ID NO: 27074 - RNA, 22 nt, Homo sapiens
cuucugauugaaaauggaguag

SEQ ID NO: 27075 - RNA, 21 nt, Homo sapiens
cuucuuggggcagggcagggu

SEQ ID NO: 27076 - RNA, 20 nt, Homo sapiens
cuugaagacuaugcugcuga

SEQ ID NO: 27077 - RNA, 22 nt, Homo sapiens
cuugaauguaaauaauguacag

SEQ ID NO: 27078 - RNA, 22 nt, Homo sapiens
cuugacaaugcuucaggcugaa

SEQ ID NO: 27079 - RNA, 22 nt, Homo sapiens
cuugacacugucacucaggcca

SEQ ID NO: 27080 - RNA, 22 nt, Homo sapiens
cuugagcauauucuauauuaaa

SEQ ID NO: 27081 - RNA, 22 nt, Homo sapiens
cuugagcuugagauccuuucug

SEQ ID NO: 27082 - RNA, 22 nt, Homo sapiens
cuugcacauuacagaucugcau

SEQ ID NO: 27083 - RNA, 22 nt, Homo sapiens
cuugcacucagaagauucaguu

SEQ ID NO: 27084 - RNA, 22 nt, Homo sapiens
cuugcacuugaaauuccaguuu

SEQ ID NO: 27085 - RNA, 22 nt, Homo sapiens
cuugcagaggcccuggggagag

SEQ ID NO: 27086 - RNA, 19 nt, Homo sapiens
cuugccccauucauccucu

SEQ ID NO: 27087 - RNA, 22 nt, Homo sapiens
cuugccuuugucuucaaaggcu

SEQ ID NO: 27088 - RNA, 22 nt, Homo sapiens
cuuggacaccucaugcccaccu

SEQ ID NO: 27089 - RNA, 22 nt, Homo sapiens
cuuggcaugaagaauaauuuuu

SEQ ID NO: 27090 - RNA, 22 nt, Homo sapiens
cuugggauauguguuacucugu

SEQ ID NO: 27091 - RNA, 22 nt, Homo sapiens
cuugggccccacccaaaucuua

SEQ ID NO: 27092 - RNA, 22 nt, Homo sapiens
cuugguuacauuuuccuagaaa

SEQ ID NO: 27093 - RNA, 22 nt, Homo sapiens
cuuguacacuguuggugggaau

SEQ ID NO: 27094 - RNA, 18 nt, Homo sapiens
cuugucaaaucuuuccuc

SEQ ID NO: 27095 - RNA, 21 nt, Homo sapiens
cuugucuugcuuagaauagac

SEQ ID NO: 27096 - RNA, 22 nt, Homo sapiens
cuuguucuccuaagaugaaugc

SEQ ID NO: 27097 - RNA, 22 nt, Homo sapiens
cuuucacacuguuggugggaau

SEQ ID NO: 27098 - RNA, 22 nt, Homo sapiens
cuuugcaaauggccuuuccaag

SEQ ID NO: 27099 - RNA, 18 nt, Homo sapiens
cuuugcagcuuccagagg

SEQ ID NO: 27100 - RNA, 22 nt, Homo sapiens
cuuuggagaaaaguucuugggc

SEQ ID NO: 27101 - RNA, 22 nt, Homo sapiens
cuuuggcaaugucauuuucaau

SEQ ID NO: 27102 - RNA, 21 nt, Homo sapiens
cuuugguagaguuuuuagggu

SEQ ID NO: 27103 - RNA, 22 nt, Homo sapiens
cuuuggucaauugcugcgggga

SEQ ID NO: 27104 - RNA, 22 nt, Homo sapiens
cuuugguggagucuuuagguuc

SEQ ID NO: 27105 - RNA, 22 nt, Homo sapiens
cuuugguguauuuucagagacc

SEQ ID NO: 27106 - RNA, 22 nt, Homo sapiens
cuuugguuaauaggauauggca

SEQ ID NO: 27107 - RNA, 22 nt, Homo sapiens
cuuuguaugucaugacaacugu

SEQ ID NO: 27108 - RNA, 22 nt, Homo sapiens
cuuuguccuucaagguguguca

SEQ ID NO: 27109 - RNA, 22 nt, Homo sapiens
cuuuguggggucuuuccucaaa

SEQ ID NO: 27110 - RNA, 22 nt, Homo sapiens
cuuuguguaggugccucuggcu

SEQ ID NO: 27111 - RNA, 22 nt, Homo sapiens
cuuuuacacugguggugggaau

SEQ ID NO: 27112 - RNA, 22 nt, Homo sapiens
cuuuuacacuguuagugggaau

SEQ ID NO: 27113 - RNA, 20 nt, Homo sapiens
cuuuuagcagcagcaagaga

SEQ ID NO: 27114 - RNA, 21 nt, Homo sapiens
cuuuugcacuccagccugggu

SEQ ID NO: 27115 - RNA, 22 nt, Homo sapiens
cuuuugcugggucagcgguggu

SEQ ID NO: 27116 - RNA, 22 nt, Homo sapiens
cuuuuggcuuaagauugucuug

SEQ ID NO: 27117 - RNA, 22 nt, Homo sapiens
cuuuuggcuuagaauugucuug

SEQ ID NO: 27118 - RNA, 22 nt, Homo sapiens
cuuuuggucuaucagagaagca

SEQ ID NO: 27119 - RNA, 22 nt, Homo sapiens
gaaagacuuucugcuguggaua

SEQ ID NO: 27120 - RNA, 22 nt, Homo sapiens
gaaagugcugcaaggccaugca

SEQ ID NO: 27121 - RNA, 22 nt, Homo sapiens
gaaaguguugagauuacaggca

SEQ ID NO: 27122 - RNA, 18 nt, Homo sapiens
gaaaugccucuugcuuac

SEQ ID NO: 27123 - RNA, 22 nt, Homo sapiens
gaaauggaucagagcaagcuuu

SEQ ID NO: 27124 - RNA, 22 nt, Homo sapiens
gaaauguugauagugggcauug

SEQ ID NO: 27125 - RNA, 22 nt, Homo sapiens
gaaauguuuuucaugugggcaa

SEQ ID NO: 27126 - RNA, 22 nt, Homo sapiens
gaagaaguacaagacaaauuuu

SEQ ID NO: 27127 - RNA, 18 nt, Homo sapiens
gaagaaguaggcauggca

SEQ ID NO: 27128 - RNA, 22 nt, Homo sapiens
gaagacauuuacaugggagacc

SEQ ID NO: 27129 - RNA, 22 nt, Homo sapiens
gaagagacagguucccacaaaa

SEQ ID NO: 27130 - RNA, 22 nt, Homo sapiens
gaagcagcauucugguuuuugg

SEQ ID NO: 27131 - RNA, 22 nt, Homo sapiens
gaaggcacugugugccacccug

SEQ ID NO: 27132 - RNA, 22 nt, Homo sapiens
gaagguaguuuauagauguggu

SEQ ID NO: 27133 - RNA, 22 nt, Homo sapiens
gaagugcaguggcacagucaug

SEQ ID NO: 27134 - RNA, 22 nt, Homo sapiens
gaagugcuuuuggacuaacagu

SEQ ID NO: 27135 - RNA, 22 nt, Homo sapiens
gaauacugacuauuucaucugg

SEQ ID NO: 27136 - RNA, 22 nt, Homo sapiens
gaauagugcugcgauaaacaua

SEQ ID NO: 27137 - RNA, 22 nt, Homo sapiens
gaaucacaguuauuagagcagc

SEQ ID NO: 27138 - RNA, 22 nt, Homo sapiens
cucauugcaaucuccaccuccc

SEQ ID NO: 27139 - RNA, 22 nt, Homo sapiens
cuccacgugaaugccaaguauu

SEQ ID NO: 27140 - RNA, 22 nt, Homo sapiens
cuccacugagcaggugggaggc

SEQ ID NO: 27141 - RNA, 22 nt, Homo sapiens
cuccaggugagguuaagggacu

SEQ ID NO: 27142 - RNA, 22 nt, Homo sapiens
cuccagugcaaagucaugauca

SEQ ID NO: 27143 - RNA, 22 nt, Homo sapiens
cucccauugcaaacaacagaag

SEQ ID NO: 27144 - RNA, 22 nt, Homo sapiens
cucccugagccagggcuuugac

SEQ ID NO: 27145 - RNA, 22 nt, Homo sapiens
cucucaagaugcugggauuaca

SEQ ID NO: 27146 - RNA, 22 nt, Homo sapiens
cucucaguguggaggccagaaa

SEQ ID NO: 27147 - RNA, 21 nt, Homo sapiens
cucucugcuuaugaauaguga

SEQ ID NO: 27148 - RNA, 22 nt, Homo sapiens
cucucuguuugucuguuauugg

SEQ ID NO: 27149 - RNA, 22 nt, Homo sapiens
cucugacagugguuagcacugu

SEQ ID NO: 27150 - RNA, 22 nt, Homo sapiens
cucugauggagauauacaagga

SEQ ID NO: 27151 - RNA, 22 nt, Homo sapiens
cucugguucugcagugcacccu

SEQ ID NO: 27152 - RNA, 22 nt, Homo sapiens
cucuuuuguuccuaguuugauc

SEQ ID NO: 27153 - RNA, 22 nt, Homo sapiens
cugaaaucagccaguuaguuuc

SEQ ID NO: 27154 - RNA, 22 nt, Homo sapiens
cugaagugugaaagucuuuuuu

SEQ ID NO: 27155 - RNA, 22 nt, Homo sapiens
cugaauagucaacgauggacug

SEQ ID NO: 27156 - RNA, 22 nt, Homo sapiens
cugaauguuucacucugaaaug

SEQ ID NO: 27157 - RNA, 22 nt, Homo sapiens
cugacacuucaaaacugccaau

SEQ ID NO: 27158 - RNA, 22 nt, Homo sapiens
cugacagucucauugauuugcu

SEQ ID NO: 27159 - RNA, 22 nt, Homo sapiens
cugacaucuucaagugaggaga

SEQ ID NO: 27160 - RNA, 22 nt, Homo sapiens
cugacauuguugaucacagcca

SEQ ID NO: 27161 - RNA, 22 nt, Homo sapiens
cugacuuuagaacccaaaaagu

SEQ ID NO: 27162 - RNA, 22 nt, Homo sapiens
cugagagaggagcuaaaacugc

SEQ ID NO: 27163 - RNA, 22 nt, Homo sapiens
cugagauacacuaauagucucu

SEQ ID NO: 27164 - RNA, 22 nt, Homo sapiens
cugagaucaugggucagguggu

SEQ ID NO: 27165 - RNA, 22 nt, Homo sapiens
cugagaucugaaccaggagugu

SEQ ID NO: 27166 - RNA, 22 nt, Homo sapiens
cugagaucuuauuagaaaugca

SEQ ID NO: 27167 - RNA, 22 nt, Homo sapiens
cugagcaaaaugaagacacgau

SEQ ID NO: 27168 - RNA, 22 nt, Homo sapiens
cugagcaaaguucuauuuaugg

SEQ ID NO: 27169 - RNA, 22 nt, Homo sapiens
cugagcacugagauccucuagc

SEQ ID NO: 27170 - RNA, 22 nt, Homo sapiens
cugaggcacggcgaccuuaagu

SEQ ID NO: 27171 - RNA, 22 nt, Homo sapiens
cugaggguagaaggaucacuug

SEQ ID NO: 27172 - RNA, 22 nt, Homo sapiens
cugagguaggcccugagaauau

SEQ ID NO: 27173 - RNA, 22 nt, Homo sapiens
cugaggugauauauacauauuu

SEQ ID NO: 27174 - RNA, 22 nt, Homo sapiens
cugagguuaggaguuugagacc

SEQ ID NO: 27175 - RNA, 18 nt, Homo sapiens
cugagucauuccuggguc

SEQ ID NO: 27176 - RNA, 20 nt, Homo sapiens
cugauacagccugagcucuc

SEQ ID NO: 27177 - RNA, 22 nt, Homo sapiens
cugauaguucucuuuagaguuu

SEQ ID NO: 27178 - RNA, 22 nt, Homo sapiens
cugaucuaugaacacaggauau

SEQ ID NO: 27179 - RNA, 22 nt, Homo sapiens
cugaugaaguauuuguucugga

SEQ ID NO: 27180 - RNA, 22 nt, Homo sapiens
cugauguagguggucugugauc

SEQ ID NO: 27181 - RNA, 22 nt, Homo sapiens
cugauugucaucaauauuauua

SEQ ID NO: 27182 - RNA, 22 nt, Homo sapiens
cugauugugcagagguguaauu

SEQ ID NO: 27183 - RNA, 20 nt, Homo sapiens
cugcaaaugcugcugcugau

SEQ ID NO: 27184 - RNA, 19 nt, Homo sapiens
cugcaagguaauaggucag

SEQ ID NO: 27185 - RNA, 22 nt, Homo sapiens
cugcaguaaacuuucccauuca

SEQ ID NO: 27186 - RNA, 22 nt, Homo sapiens
cugcagucaucugaagauuuug

SEQ ID NO: 27187 - RNA, 22 nt, Homo sapiens
cugcauuugaugacguauggug

SEQ ID NO: 27188 - RNA, 22 nt, Homo sapiens
cugccaguuugauucgggccac

SEQ ID NO: 27189 - RNA, 22 nt, Homo sapiens
cugccugagaaaauggagggca

SEQ ID NO: 27190 - RNA, 22 nt, Homo sapiens
cuggaaagcaaagggugcauug

SEQ ID NO: 27191 - RNA, 22 nt, Homo sapiens
cuggaagcacaacgcauuuauu

SEQ ID NO: 27192 - RNA, 22 nt, Homo sapiens
cuggaaugcagcuuuaggggcu

SEQ ID NO: 27193 - RNA, 22 nt, Homo sapiens
cuggacguugaggcugcaguga

SEQ ID NO: 27194 - RNA, 22 nt, Homo sapiens
cuggaguuugaggcugcaguga

SEQ ID NO: 27195 - RNA, 22 nt, Homo sapiens
cuggauagucaggagauauaua

SEQ ID NO: 27196 - RNA, 20 nt, Homo sapiens
cuggaugucgaggcagaggu

SEQ ID NO: 27197 - RNA, 22 nt, Homo sapiens
cuggcaaaaagagggcaauaau

SEQ ID NO: 27198 - RNA, 19 nt, Homo sapiens
cuggcaaaugcuuuggcca

SEQ ID NO: 27199 - RNA, 22 nt, Homo sapiens
cuggcaauaggcagugucccaa

SEQ ID NO: 27200 - RNA, 22 nt, Homo sapiens
cuggcagugcuuguuauccugg

SEQ ID NO: 27201 - RNA, 22 nt, Homo sapiens
cuggcccaguucugcguuuugc

SEQ ID NO: 27202 - RNA, 22 nt, Homo sapiens
cuggcucauuucauuuagcaua

SEQ ID NO: 27203 - RNA, 22 nt, Homo sapiens
cuggcucugggcuaaagaaaua

SEQ ID NO: 27204 - RNA, 22 nt, Homo sapiens
cuggcucuguuagaagaaccag

SEQ ID NO: 27205 - RNA, 22 nt, Homo sapiens
cuggcugagugguaaguagagg

SEQ ID NO: 27206 - RNA, 22 nt, Homo sapiens
cugggauggaggagaauuagag

SEQ ID NO: 27207 - RNA, 22 nt, Homo sapiens
cuggguacccuuuaaacaggaa

SEQ ID NO: 27208 - RNA, 22 nt, Homo sapiens
cuggugagaugucuuuccucuu

SEQ ID NO: 27209 - RNA, 22 nt, Homo sapiens
cugguuguuacaaagagccugg

SEQ ID NO: 27210 - RNA, 22 nt, Homo sapiens
cugguuguucuggaugggcagg

SEQ ID NO: 27211 - RNA, 22 nt, Homo sapiens
cuguaagcauuauaaagagaua

SEQ ID NO: 27212 - RNA, 22 nt, Homo sapiens
cuguaauguaaugagacuacau

SEQ ID NO: 27213 - RNA, 22 nt, Homo sapiens
cugucacaguuuuggaggccag

SEQ ID NO: 27214 - RNA, 22 nt, Homo sapiens
cugucacugggaggggcagcag

SEQ ID NO: 27215 - RNA, 22 nt, Homo sapiens
cuguccugcagagucagaauga

SEQ ID NO: 27216 - RNA, 22 nt, Homo sapiens
cugucuaugagccaggaagcca

SEQ ID NO: 27217 - RNA, 22 nt, Homo sapiens
cugucuggaguccuucgugugc

SEQ ID NO: 27218 - RNA, 22 nt, Homo sapiens
cugucuguuucaaaagugguua

SEQ ID NO: 27219 - RNA, 22 nt, Homo sapiens
cugugacugcagggcauauuug

SEQ ID NO: 27220 - RNA, 22 nt, Homo sapiens
cugugaucuuuuuucauguggu

SEQ ID NO: 27221 - RNA, 22 nt, Homo sapiens
cugugcauguaugcgugaguuc

SEQ ID NO: 27222 - RNA, 22 nt, Homo sapiens
cugugcauguuguccaauucuu

SEQ ID NO: 27223 - RNA, 19 nt, Homo sapiens
cugugcauuucuguggaag

SEQ ID NO: 27224 - RNA, 22 nt, Homo sapiens
cugugcuugagagaugacacag

SEQ ID NO: 27225 - RNA, 22 nt, Homo sapiens
cugugcuugauuauaugagugu

SEQ ID NO: 27226 - RNA, 22 nt, Homo sapiens
cugugguguaacucuuggggcg

SEQ ID NO: 27227 - RNA, 22 nt, Homo sapiens
cuguucaaauuguuugugaagu

SEQ ID NO: 27228 - RNA, 22 nt, Homo sapiens
cuguugcaguuauggcugcagg

SEQ ID NO: 27229 - RNA, 22 nt, Homo sapiens
cuguugguuaaauuccaugcag

SEQ ID NO: 27230 - RNA, 22 nt, Homo sapiens
cuguuugguuaucuuuuccugu

SEQ ID NO: 27231 - RNA, 20 nt, Homo sapiens
cuuaaugcagcauuucucag

SEQ ID NO: 27232 - RNA, 22 nt, Homo sapiens
cuuagcaugucagcaccggguu

SEQ ID NO: 27233 - RNA, 19 nt, Homo sapiens
cuuaggugaccaguuccca

SEQ ID NO: 27234 - RNA, 20 nt, Homo sapiens
cuuaucaguggcaaguauaa

SEQ ID NO: 27235 - RNA, 22 nt, Homo sapiens
cuucagcaauauauccccuggg

SEQ ID NO: 27236 - RNA, 22 nt, Homo sapiens
cuucaugagacuuuuggaaggc

SEQ ID NO: 27237 - RNA, 22 nt, Homo sapiens
cuucaugggagaaccacaggua

SEQ ID NO: 27238 - RNA, 22 nt, Homo sapiens
gggguuuuaccuucguauucuu

SEQ ID NO: 27239 - RNA, 22 nt, Homo sapiens
ggguaggcaagcggaugucaga

SEQ ID NO: 27240 - RNA, 22 nt, Homo sapiens
gggucaguuuugagaaagcgug

SEQ ID NO: 27241 - RNA, 22 nt, Homo sapiens
gggucauggaugugaagcuaga

SEQ ID NO: 27242 - RNA, 22 nt, Homo sapiens
gguaauguaacugguauucugu

SEQ ID NO: 27243 - RNA, 22 nt, Homo sapiens
gguagacucuguaagugaucau

SEQ ID NO: 27244 - RNA, 22 nt, Homo sapiens
gguauguuuagaccauuuacau

SEQ ID NO: 27245 - RNA, 22 nt, Homo sapiens
ggucaagcuagauuuuaaugau

SEQ ID NO: 27246 - RNA, 22 nt, Homo sapiens
ggucacauuggacuaucaaguu

SEQ ID NO: 27247 - RNA, 19 nt, Homo sapiens
ggucagcaaagucuagcug

SEQ ID NO: 27248 - RNA, 22 nt, Homo sapiens
ggucauggagcuuuacuuuaug

SEQ ID NO: 27249 - RNA, 22 nt, Homo sapiens
ggucuuggagaauuguccuggg

SEQ ID NO: 27250 - RNA, 22 nt, Homo sapiens
ggugacugguuuaucuggcagu

SEQ ID NO: 27251 - RNA, 22 nt, Homo sapiens
ggugagauaucugcugauguuu

SEQ ID NO: 27252 - RNA, 22 nt, Homo sapiens
ggugagcacagaaugcccugag

SEQ ID NO: 27253 - RNA, 22 nt, Homo sapiens
ggugagguaggaaaaguuagga

SEQ ID NO: 27254 - RNA, 22 nt, Homo sapiens
ggugcagcacaccaacauggca

SEQ ID NO: 27255 - RNA, 22 nt, Homo sapiens
ggugucuuguuuaauacucauu

SEQ ID NO: 27256 - RNA, 22 nt, Homo sapiens
gguuagaaacagguccucagga

SEQ ID NO: 27257 - RNA, 20 nt, Homo sapiens
guaaacucucagcauagaug

SEQ ID NO: 27258 - RNA, 22 nt, Homo sapiens
guaaagacacaugcacacguau

SEQ ID NO: 27259 - RNA, 22 nt, Homo sapiens
guaaauaccaguuucuggaaca

SEQ ID NO: 27260 - RNA, 22 nt, Homo sapiens
guaacuggccuucaauuucuuc

SEQ ID NO: 27261 - RNA, 22 nt, Homo sapiens
guaagucucaugagaucugaug

SEQ ID NO: 27262 - RNA, 22 nt, Homo sapiens
guaauacuuuugggauauuaga

SEQ ID NO: 27263 - RNA, 22 nt, Homo sapiens
guaaucucagcuacgcgggagg

SEQ ID NO: 27264 - RNA, 22 nt, Homo sapiens
guaaucucagcuacuugggagu

SEQ ID NO: 27265 - RNA, 22 nt, Homo sapiens
guaaucucagcuccucaugagg

SEQ ID NO: 27266 - RNA, 19 nt, Homo sapiens
guaaucucaguacuuuggu

SEQ ID NO: 27267 - RNA, 22 nt, Homo sapiens
guaaugcacucccaaagaucca

SEQ ID NO: 27268 - RNA, 19 nt, Homo sapiens
guaaugugcuucaguagca

SEQ ID NO: 27269 - RNA, 22 nt, Homo sapiens
guacacaacaugcagguuuguu

SEQ ID NO: 27270 - RNA, 17 nt, Homo sapiens
guacacuucuucuguga

SEQ ID NO: 27271 - RNA, 22 nt, Homo sapiens
guacaggugcaggaugggcagg

SEQ ID NO: 27272 - RNA, 22 nt, Homo sapiens
guacaguauaguaauaggauuu

SEQ ID NO: 27273 - RNA, 22 nt, Homo sapiens
guacaguucucuuuguugucag

SEQ ID NO: 27274 - RNA, 22 nt, Homo sapiens
guacaugcaugcaugggugugc

SEQ ID NO: 27275 - RNA, 22 nt, Homo sapiens
guacauggaaugaaauucaaaa

SEQ ID NO: 27276 - RNA, 22 nt, Homo sapiens
guagaaagcauuucagauuugc

SEQ ID NO: 27277 - RNA, 22 nt, Homo sapiens
guagaaaguuugcugucacaug

SEQ ID NO: 27278 - RNA, 22 nt, Homo sapiens
guagaccauuuaucuggggagu

SEQ ID NO: 27279 - RNA, 22 nt, Homo sapiens
guagagagaaauacaaagcugu

SEQ ID NO: 27280 - RNA, 22 nt, Homo sapiens
guagaggaauggcuccaccaua

SEQ ID NO: 27281 - RNA, 22 nt, Homo sapiens
guagcagcaauuuacuccauac

SEQ ID NO: 27282 - RNA, 22 nt, Homo sapiens
guaguaccauuaggauauuucu

SEQ ID NO: 27283 - RNA, 22 nt, Homo sapiens
guauaugccucaguuauagcac

SEQ ID NO: 27284 - RNA, 22 nt, Homo sapiens
guaucaucauguuggccaggcu

SEQ ID NO: 27285 - RNA, 22 nt, Homo sapiens
guaugaaaaucggagauugggu

SEQ ID NO: 27286 - RNA, 22 nt, Homo sapiens
guaugacacaggaagcuuaacc

SEQ ID NO: 27287 - RNA, 22 nt, Homo sapiens
guaugaguuuucugaugugugg

SEQ ID NO: 27288 - RNA, 22 nt, Homo sapiens
guaugcaagugauaugacauau

SEQ ID NO: 27289 - RNA, 22 nt, Homo sapiens
guauugcuugagcccaggaguu

SEQ ID NO: 27290 - RNA, 22 nt, Homo sapiens
guauuugauuauagcaugcuua

SEQ ID NO: 27291 - RNA, 22 nt, Homo sapiens
gucaaaugcacagaaccauuaa

SEQ ID NO: 27292 - RNA, 22 nt, Homo sapiens
gucaagauuuguaggacagaga

SEQ ID NO: 27293 - RNA, 22 nt, Homo sapiens
gucaaggaauuuauccauuucu

SEQ ID NO: 27294 - RNA, 22 nt, Homo sapiens
gucaagugaagaccugacucuu

SEQ ID NO: 27295 - RNA, 22 nt, Homo sapiens
gucaaguguuuucaaggcuucc

SEQ ID NO: 27296 - RNA, 22 nt, Homo sapiens
gucacagaggcuaagaccccac

SEQ ID NO: 27297 - RNA, 22 nt, Homo sapiens
gucacugccugaggcugaugca

SEQ ID NO: 27298 - RNA, 20 nt, Homo sapiens
gucacuggcccagggcuugu

SEQ ID NO: 27299 - RNA, 22 nt, Homo sapiens
gucacugugacggcaguuacau

SEQ ID NO: 27300 - RNA, 22 nt, Homo sapiens
gucagagcacugaguugugggc

SEQ ID NO: 27301 - RNA, 22 nt, Homo sapiens
gucagcaaagaggaauaguuug

SEQ ID NO: 27302 - RNA, 22 nt, Homo sapiens
gucagugcauguaaacauaaaa

SEQ ID NO: 27303 - RNA, 22 nt, Homo sapiens
gucaguggagaaaaggacaugu

SEQ ID NO: 27304 - RNA, 22 nt, Homo sapiens
gucaguggauacugucucuguc

SEQ ID NO: 27305 - RNA, 22 nt, Homo sapiens
gucaucaucaguccucugugca

SEQ ID NO: 27306 - RNA, 22 nt, Homo sapiens
gucaugcaggguucgccagccc

SEQ ID NO: 27307 - RNA, 22 nt, Homo sapiens
gucauggaaaucuacauuguua

SEQ ID NO: 27308 - RNA, 22 nt, Homo sapiens
gucauggacaaggugugagcca

SEQ ID NO: 27309 - RNA, 22 nt, Homo sapiens
gucaugggguacuacacauggg

SEQ ID NO: 27310 - RNA, 22 nt, Homo sapiens
gucauggguuaaagguggauac

SEQ ID NO: 27311 - RNA, 22 nt, Homo sapiens
gucauggugcuagcgggaaugu

SEQ ID NO: 27312 - RNA, 22 nt, Homo sapiens
gucauugagucagggaguaucu

SEQ ID NO: 27313 - RNA, 22 nt, Homo sapiens
gucauugcacuccagccuggac

SEQ ID NO: 27314 - RNA, 22 nt, Homo sapiens
gucccugaggaacauccagggc

SEQ ID NO: 27315 - RNA, 22 nt, Homo sapiens
ucauacuguugugaaacaaaac

SEQ ID NO: 27316 - RNA, 22 nt, Homo sapiens
ucauaucauuagaucuacugua

SEQ ID NO: 27317 - RNA, 16 nt, Homo sapiens
ucaucacagucucugg

SEQ ID NO: 27318 - RNA, 22 nt, Homo sapiens
ucaucagguaugucagcggagu

SEQ ID NO: 27319 - RNA, 22 nt, Homo sapiens
ucaucaguggggaugugguuga

SEQ ID NO: 27320 - RNA, 22 nt, Homo sapiens
ucauccauacaguuagcaaagg

SEQ ID NO: 27321 - RNA, 22 nt, Homo sapiens
ucaucucaguuucuugccguac

SEQ ID NO: 27322 - RNA, 22 nt, Homo sapiens
ucaugacacagcauacugacuu

SEQ ID NO: 27323 - RNA, 23 nt, Homo sapiens
ucaugaggccauucaaauccauu

SEQ ID NO: 27324 - RNA, 22 nt, Homo sapiens
ucaugggagcccccaucaugag

SEQ ID NO: 27325 - RNA, 22 nt, Homo sapiens
ucauucauucauccagcuugag

SEQ ID NO: 27326 - RNA, 22 nt, Homo sapiens
ucauucauucuucaguggguac

SEQ ID NO: 27327 - RNA, 22 nt, Homo sapiens
ucauugcaaucucugccucccg

SEQ ID NO: 27328 - RNA, 22 nt, Homo sapiens
ucauugcacuucuuuaguugca

SEQ ID NO: 27329 - RNA, 22 nt, Homo sapiens
ucauugguagcucauggaaccg

SEQ ID NO: 27330 - RNA, 22 nt, Homo sapiens
ucauugguugcguaauuugauu

SEQ ID NO: 27331 - RNA, 21 nt, Homo sapiens
ucauugguuggcugcccugua

SEQ ID NO: 27332 - RNA, 22 nt, Homo sapiens
uccaaaucucuggcacugggau

SEQ ID NO: 27333 - RNA, 22 nt, Homo sapiens
uccaauguaaucaucauugaau

SEQ ID NO: 27334 - RNA, 22 nt, Homo sapiens
uccacaauggagaagaguauga

SEQ ID NO: 27335 - RNA, 19 nt, Homo sapiens
uccacagugguugaacuag

SEQ ID NO: 27336 - RNA, 22 nt, Homo sapiens
uccacagugguugaacuaguuu

SEQ ID NO: 27337 - RNA, 22 nt, Homo sapiens
uccacuuuugugcugaauugga

SEQ ID NO: 27338 - RNA, 22 nt, Homo sapiens
uccagaguggugaugcuggggc

SEQ ID NO: 27339 - RNA, 22 nt, Homo sapiens
uccagguacucagggggcugag

SEQ ID NO: 27340 - RNA, 22 nt, Homo sapiens
uccaguacaggucucucauuuc

SEQ ID NO: 27341 - RNA, 22 nt, Homo sapiens
uccagugcauucagacacuugg

SEQ ID NO: 27342 - RNA, 22 nt, Homo sapiens
uccauagacauuuuaagguagu

SEQ ID NO: 27343 - RNA, 22 nt, Homo sapiens
uccauaguacuagaaacugacc

SEQ ID NO: 27344 - RNA, 22 nt, Homo sapiens
uccaugagaauaguuaggcucu

SEQ ID NO: 27345 - RNA, 18 nt, Homo sapiens
uccauugcagcauuauuu

SEQ ID NO: 27346 - RNA, 22 nt, Homo sapiens
uccauugucuagauguaacaca

SEQ ID NO: 27347 - RNA, 19 nt, Homo sapiens
ucccaagaugcucauacau

SEQ ID NO: 27348 - RNA, 23 nt, Homo sapiens
ucccaagauggaccagaccaagg

SEQ ID NO: 27349 - RNA, 22 nt, Homo sapiens
ucccaguggucuugaaacaggg

SEQ ID NO: 27350 - RNA, 22 nt, Homo sapiens
ucccauguagcuaggauuacag

SEQ ID NO: 27351 - RNA, 22 nt, Homo sapiens
ucccauugucucugaccuugcc

SEQ ID NO: 27352 - RNA, 22 nt, Homo sapiens
uccccgaggcuggagugcagug

SEQ ID NO: 27353 - RNA, 23 nt, Homo sapiens
uccccgggagcaccagcuuguug

SEQ ID NO: 27354 - RNA, 22 nt, Homo sapiens
ucccgaggacaucugggggcaa

SEQ ID NO: 27355 - RNA, 20 nt, Homo sapiens
ucccuaagagccuuuccuuc

SEQ ID NO: 27356 - RNA, 22 nt, Homo sapiens
ucccugaagcugcagcaacaca

SEQ ID NO: 27357 - RNA, 22 nt, Homo sapiens
ucccugacagggucugagcuuu

SEQ ID NO: 27358 - RNA, 22 nt, Homo sapiens
ucccugacagucacagagcuac

SEQ ID NO: 27359 - RNA, 22 nt, Homo sapiens
ucccugagguccuggauuauug

SEQ ID NO: 27360 - RNA, 22 nt, Homo sapiens
ucccuguguuccuuuugaauug

SEQ ID NO: 27361 - RNA, 22 nt, Homo sapiens
ucccuuaaugaugaacaaugag

SEQ ID NO: 27362 - RNA, 22 nt, Homo sapiens
ucccuuagccaaauccccagcc

SEQ ID NO: 27363 - RNA, 22 nt, Homo sapiens
uccucauggagaaccucugcua

SEQ ID NO: 27364 - RNA, 22 nt, Homo sapiens
uccugagucagcauccguuugu

SEQ ID NO: 27365 - RNA, 22 nt, Homo sapiens
uccuggcuccacuguuuauucc

SEQ ID NO: 27366 - RNA, 22 nt, Homo sapiens
uccuguaaucccagcuaccaga

SEQ ID NO: 27367 - RNA, 22 nt, Homo sapiens
uccuuggucaaaaagaaagugu

SEQ ID NO: 27368 - RNA, 22 nt, Homo sapiens
uccuugguugauccugugcaga

SEQ ID NO: 27369 - RNA, 22 nt, Homo sapiens
uccuuuggucaguauucuuuug

SEQ ID NO: 27370 - RNA, 22 nt, Homo sapiens
ucgcaccauugcacuccagcca

SEQ ID NO: 27371 - RNA, 22 nt, Homo sapiens
ucgcagcucacuggagccucga

SEQ ID NO: 27372 - RNA, 17 nt, Homo sapiens
ucuaauaauaugcauuu

SEQ ID NO: 27373 - RNA, 22 nt, Homo sapiens
ucuagcacuuacuggcugugug

SEQ ID NO: 27374 - RNA, 22 nt, Homo sapiens
ucuaucacagccccacacucuc

SEQ ID NO: 27375 - RNA, 22 nt, Homo sapiens
ucuauugguugaaauugcuuuu

SEQ ID NO: 27376 - RNA, 22 nt, Homo sapiens
ucucaagaugguagaugggaau

SEQ ID NO: 27377 - RNA, 22 nt, Homo sapiens
ucucaaguaacugggacaauaa

SEQ ID NO: 27378 - RNA, 22 nt, Homo sapiens
ucucacacugaauguguguggg

SEQ ID NO: 27379 - RNA, 22 nt, Homo sapiens
ucucagcacagucagggcgccu

SEQ ID NO: 27380 - RNA, 22 nt, Homo sapiens
ucucagugaauugguuuugucu

SEQ ID NO: 27381 - RNA, 22 nt, Homo sapiens
ucucaguggcacccccaacacc

SEQ ID NO: 27382 - RNA, 22 nt, Homo sapiens
ucucaguguuaucuaucugccu

SEQ ID NO: 27383 - RNA, 19 nt, Homo sapiens
ucucaguguuggucaggug

SEQ ID NO: 27384 - RNA, 22 nt, Homo sapiens
ucucaguuuucaagcugucgau

SEQ ID NO: 27385 - RNA, 22 nt, Homo sapiens
ucucaugaagguggagaguagg

SEQ ID NO: 27386 - RNA, 23 nt, Homo sapiens
ucucauuccuugaaaauaaugac

SEQ ID NO: 27387 - RNA, 22 nt, Homo sapiens
ucucuagagagccugguguuca

SEQ ID NO: 27388 - RNA, 21 nt, Homo sapiens
ucucucaaccaggaagugggc

SEQ ID NO: 27389 - RNA, 22 nt, Homo sapiens
ucucugagaaaaguuucuccca

SEQ ID NO: 27390 - RNA, 19 nt, Homo sapiens
ucucugguguuggagggga

SEQ ID NO: 27391 - RNA, 22 nt, Homo sapiens
ucucuguuuagagccagcaauu

SEQ ID NO: 27392 - RNA, 22 nt, Homo sapiens
ucucuuggcggaaguugcagug

SEQ ID NO: 27393 - RNA, 19 nt, Homo sapiens
ucugacagccccagucaac

SEQ ID NO: 27394 - RNA, 22 nt, Homo sapiens
ucugacucuggagucucagguu

SEQ ID NO: 27395 - RNA, 22 nt, Homo sapiens
ucugagaucaugucugugcugu

SEQ ID NO: 27396 - RNA, 22 nt, Homo sapiens
ucugagcaauagauguggauau

SEQ ID NO: 27397 - RNA, 22 nt, Homo sapiens
ucugagcaugcaucuugccugg

SEQ ID NO: 27398 - RNA, 22 nt, Homo sapiens
ucugagguaggugcauggauac

SEQ ID NO: 27399 - RNA, 21 nt, Homo sapiens
ucugagucauucaguggccug

SEQ ID NO: 27400 - RNA, 22 nt, Homo sapiens
ucugcauauucuagggcaccaa

SEQ ID NO: 27401 - RNA, 22 nt, Homo sapiens
ucugccacugucauugugugau

SEQ ID NO: 27402 - RNA, 22 nt, Homo sapiens
ucuggagugugaaguggauaug

SEQ ID NO: 27403 - RNA, 22 nt, Homo sapiens
ucuggcaagagccgagggcagu

SEQ ID NO: 27404 - RNA, 21 nt, Homo sapiens
ucuggccccuccaaaucucau

SEQ ID NO: 27405 - RNA, 22 nt, Homo sapiens
ucuggccccucucaaaucucau

SEQ ID NO: 27406 - RNA, 22 nt, Homo sapiens
ucuggccuacaucauuuuuccg

SEQ ID NO: 27407 - RNA, 22 nt, Homo sapiens
ucuggcuccaaagucuauuuuu

SEQ ID NO: 27408 - RNA, 22 nt, Homo sapiens
ucuggcuuauuucacuuagcau

SEQ ID NO: 27409 - RNA, 21 nt, Homo sapiens
ucuggcuuucauuccccuucu

SEQ ID NO: 27410 - RNA, 22 nt, Homo sapiens
ucuggguuuuguaccgugcucg

SEQ ID NO: 27411 - RNA, 22 nt, Homo sapiens
ucuggguuuuuccauugccggu

SEQ ID NO: 27412 - RNA, 22 nt, Homo sapiens
ucugguggugaugagagacagu

SEQ ID NO: 27413 - RNA, 22 nt, Homo sapiens
ucugguguuacugagccuccca

SEQ ID NO: 27414 - RNA, 23 nt, Homo sapiens
ucugguguugucaaaugcugguu

SEQ ID NO: 27415 - RNA, 22 nt, Homo sapiens
ugacaagugauuaaggcauauu

SEQ ID NO: 27416 - RNA, 21 nt, Homo sapiens
ugacagaaaauugaguuugcu

SEQ ID NO: 27417 - RNA, 22 nt, Homo sapiens
ugacagagcaggacuucaucuc

SEQ ID NO: 27418 - RNA, 22 nt, Homo sapiens
ugacagcugaagauguugaacc

SEQ ID NO: 27419 - RNA, 22 nt, Homo sapiens
ugacaggucuaauuuacugaca

SEQ ID NO: 27420 - RNA, 22 nt, Homo sapiens
uuaaggguuuuagaauuuucca

SEQ ID NO: 27421 - RNA, 22 nt, Homo sapiens
uuaagguaugugggcauuuugu

SEQ ID NO: 27422 - RNA, 22 nt, Homo sapiens
uuaaggugaaguucucagaugc

SEQ ID NO: 27423 - RNA, 22 nt, Homo sapiens
uuaagugguagguggugcccaa

SEQ ID NO: 27424 - RNA, 22 nt, Homo sapiens
uuaauagugacucauuuuccac

SEQ ID NO: 27425 - RNA, 22 nt, Homo sapiens
uuaauccugccuuauuucagua

SEQ ID NO: 27426 - RNA, 22 nt, Homo sapiens
uuaaucugucuaugauuuuggu

SEQ ID NO: 27427 - RNA, 21 nt, Homo sapiens
uuaaugcuaugcagaaaaucu

SEQ ID NO: 27428 - RNA, 22 nt, Homo sapiens
uuaauggagaguuucauuggug

SEQ ID NO: 27429 - RNA, 22 nt, Homo sapiens
uuaaugugaaucaggaugcauu

SEQ ID NO: 27430 - RNA, 22 nt, Homo sapiens
uuaauuguaucuauagauguca

SEQ ID NO: 27431 - RNA, 22 nt, Homo sapiens
uuaauuguccaaguucaucucu

SEQ ID NO: 27432 - RNA, 19 nt, Homo sapiens
uuacacaaccuaguggggc

SEQ ID NO: 27433 - RNA, 22 nt, Homo sapiens
uuacacaguugguaggggcaga

SEQ ID NO: 27434 - RNA, 22 nt, Homo sapiens
uuacaccuguaauccagcacuu

SEQ ID NO: 27435 - RNA, 17 nt, Homo sapiens
uuacaggugcugagagu

SEQ ID NO: 27436 - RNA, 22 nt, Homo sapiens
uuacagguggagaaguaaggcu

SEQ ID NO: 27437 - RNA, 22 nt, Homo sapiens
uuacaguaugaguaagaguucu

SEQ ID NO: 27438 - RNA, 23 nt, Homo sapiens
uuacaguggcaugaucucugcuc

SEQ ID NO: 27439 - RNA, 21 nt, Homo sapiens
uuacaguugguugugaggugg

SEQ ID NO: 27440 - RNA, 22 nt, Homo sapiens
uuacauguggugugaagaagag

SEQ ID NO: 27441 - RNA, 22 nt, Homo sapiens
uuaccagucugauaaacagaaa

SEQ ID NO: 27442 - RNA, 22 nt, Homo sapiens
uuacccauuagagaauuuaaga

SEQ ID NO: 27443 - RNA, 22 nt, Homo sapiens
uuacccuuuaacccuuuaaagu

SEQ ID NO: 27444 - RNA, 22 nt, Homo sapiens
uuacuagaacauuuagggaacu

SEQ ID NO: 27445 - RNA, 22 nt, Homo sapiens
uuacugcuagcugugugcucuu

SEQ ID NO: 27446 - RNA, 22 nt, Homo sapiens
uuagaaaguagaaaagcugguu

SEQ ID NO: 27447 - RNA, 22 nt, Homo sapiens
uuagaacaguguuugccucgcu

SEQ ID NO: 27448 - RNA, 22 nt, Homo sapiens
uuagaacuagaggaguuugagu

SEQ ID NO: 27449 - RNA, 17 nt, Homo sapiens
uuagacagacauccugc

SEQ ID NO: 27450 - RNA, 19 nt, Homo sapiens
uuagagaucaucugcuuca

SEQ ID NO: 27451 - RNA, 22 nt, Homo sapiens
uuagaguguagcaggaagaggc

SEQ ID NO: 27452 - RNA, 22 nt, Homo sapiens
uuagaugguucaccaugaguag

SEQ ID NO: 27453 - RNA, 22 nt, Homo sapiens
uuagcaauugauucucauaagc

SEQ ID NO: 27454 - RNA, 22 nt, Homo sapiens
uuagcacauuuccagcacaugg

SEQ ID NO: 27455 - RNA, 20 nt, Homo sapiens
uuagcagcaugauuuauaau

SEQ ID NO: 27456 - RNA, 22 nt, Homo sapiens
uuagccggguguguuggcgggc

SEQ ID NO: 27457 - RNA, 22 nt, Homo sapiens
uuaggacaauguucguuuuuug

SEQ ID NO: 27458 - RNA, 22 nt, Homo sapiens
uuaggacacuguggguggguca

SEQ ID NO: 27459 - RNA, 22 nt, Homo sapiens
uuaggagacuggauaucucuuu

SEQ ID NO: 27460 - RNA, 22 nt, Homo sapiens
uuaggcuaguugauauaguuug

SEQ ID NO: 27461 - RNA, 22 nt, Homo sapiens
uuagggaggacaguuacaacag

SEQ ID NO: 27462 - RNA, 22 nt, Homo sapiens
uuagggaggagucccucuuuuu

SEQ ID NO: 27463 - RNA, 22 nt, Homo sapiens
uuagggaguaaucuaaaaaugg

SEQ ID NO: 27464 - RNA, 22 nt, Homo sapiens
uuaggucaucgcuguccuucag

SEQ ID NO: 27465 - RNA, 23 nt, Homo sapiens
uuaguaaacucaaugacaccaca

SEQ ID NO: 27466 - RNA, 22 nt, Homo sapiens
uuauaacagagacuccugugcu

SEQ ID NO: 27467 - RNA, 22 nt, Homo sapiens
uuauaacucugcagccugguau

SEQ ID NO: 27468 - RNA, 20 nt, Homo sapiens
uuauagcuacaucuugacug

SEQ ID NO: 27469 - RNA, 22 nt, Homo sapiens
uuauaggcaggugguguagaug

SEQ ID NO: 27470 - RNA, 21 nt, Homo sapiens
uuauaguggcaugauuuauaa

SEQ ID NO: 27471 - RNA, 22 nt, Homo sapiens
uuauauguuacucccucuagca

SEQ ID NO: 27472 - RNA, 22 nt, Homo sapiens
uuaucaaacccuaggagguggu

SEQ ID NO: 27473 - RNA, 22 nt, Homo sapiens
uuaucccacuuucuguuccugu

SEQ ID NO: 27474 - RNA, 22 nt, Homo sapiens
uuaugacuuucagcuaggggau

SEQ ID NO: 27475 - RNA, 22 nt, Homo sapiens
uuaugcaucuuccacacucauu

SEQ ID NO: 27476 - RNA, 22 nt, Homo sapiens
uuaugccuauugugccuuggau

SEQ ID NO: 27477 - RNA, 22 nt, Homo sapiens
uuauggccauucuuguaggagu

SEQ ID NO: 27478 - RNA, 22 nt, Homo sapiens
uuauuagagauauuugguuagg

SEQ ID NO: 27479 - RNA, 22 nt, Homo sapiens
uuauuauguuggugcaaaggua

SEQ ID NO: 27480 - RNA, 17 nt, Homo sapiens
uuauugcuauaagcuga

SEQ ID NO: 27481 - RNA, 22 nt, Homo sapiens
uuauuugguuauuguaauuggg

SEQ ID NO: 27482 - RNA, 22 nt, Homo sapiens
uucaaaggauuuagauuagcua

SEQ ID NO: 27483 - RNA, 22 nt, Homo sapiens
uucaaaguaaagggauggagac

SEQ ID NO: 27484 - RNA, 22 nt, Homo sapiens
uucaaaguuggaggacaaacug

SEQ ID NO: 27485 - RNA, 22 nt, Homo sapiens
uucaagauggcaccagugagug

SEQ ID NO: 27486 - RNA, 22 nt, Homo sapiens
uucaagauggccccagugagcc

SEQ ID NO: 27487 - RNA, 22 nt, Homo sapiens
uucaaguagguaggaccacagg

SEQ ID NO: 27488 - RNA, 22 nt, Homo sapiens
uucaagucaaggaaagaggucu

SEQ ID NO: 27489 - RNA, 22 nt, Homo sapiens
uucaaguguucaggagcuacag

SEQ ID NO: 27490 - RNA, 22 nt, Homo sapiens
uucaauaugucauuggcaggca

SEQ ID NO: 27491 - RNA, 22 nt, Homo sapiens
uucacacuagccacucugguag

SEQ ID NO: 27492 - RNA, 22 nt, Homo sapiens
uucaccaguuuugucacgaaug

SEQ ID NO: 27493 - RNA, 22 nt, Homo sapiens
uucaccuggaguucaggauaag

SEQ ID NO: 27494 - RNA, 23 nt, Homo sapiens
uucaccugguuauuaauagccuc

SEQ ID NO: 27495 - RNA, 22 nt, Homo sapiens
uucacugcaugaaaaggacagc

SEQ ID NO: 27496 - RNA, 22 nt, Homo sapiens
uucacugcauuucagccugggc

SEQ ID NO: 27497 - RNA, 22 nt, Homo sapiens
uucacuggagcccaggaguugg

SEQ ID NO: 27498 - RNA, 21 nt, Homo sapiens
uucacuggucuauuucccuuu

SEQ ID NO: 27499 - RNA, 22 nt, Homo sapiens
uucacugugaacucauauucag

SEQ ID NO: 27500 - RNA, 22 nt, Homo sapiens
uucacugugcuuaaauucugcu

SEQ ID NO: 27501 - RNA, 22 nt, Homo sapiens
gcaacugguuucaguuuuucag

SEQ ID NO: 27502 - RNA, 22 nt, Homo sapiens
gcaagaaugagaaggauuaauu

SEQ ID NO: 27503 - RNA, 22 nt, Homo sapiens
gcaagaauggaacaggagagcc

SEQ ID NO: 27504 - RNA, 22 nt, Homo sapiens
gcaagacaugucuaagguuuaa

SEQ ID NO: 27505 - RNA, 22 nt, Homo sapiens
gcaauggaaucccuugaucaau

SEQ ID NO: 27506 - RNA, 22 nt, Homo sapiens
gcacauggccccaucgugccga

SEQ ID NO: 27507 - RNA, 22 nt, Homo sapiens
gcacugagagaagccccaagua

SEQ ID NO: 27508 - RNA, 17 nt, Homo sapiens
gcacuggcguaucccac

SEQ ID NO: 27509 - RNA, 22 nt, Homo sapiens
gcagaauugacucuguuuuuuc

SEQ ID NO: 27510 - RNA, 23 nt, Homo sapiens
gcagcaaugucacagggguccgg

SEQ ID NO: 27511 - RNA, 22 nt, Homo sapiens
gcagcacauggcagaacauauu

SEQ ID NO: 27512 - RNA, 22 nt, Homo sapiens
gcagcagugugggcugaaccua

SEQ ID NO: 27513 - RNA, 22 nt, Homo sapiens
gcagcauuaccaagacauggca

SEQ ID NO: 27514 - RNA, 22 nt, Homo sapiens
gcagguauuagagagccugaaa

SEQ ID NO: 27515 - RNA, 22 nt, Homo sapiens
gcaguacacuguugguaggaau

SEQ ID NO: 27516 - RNA, 20 nt, Homo sapiens
gcaguacuuuuaguucuaag

SEQ ID NO: 27517 - RNA, 19 nt, Homo sapiens
gcaguauugaaggccaguc

SEQ ID NO: 27518 - RNA, 22 nt, Homo sapiens
gcagucacagggagauggugac

SEQ ID NO: 27519 - RNA, 22 nt, Homo sapiens
gcagugcaguggcgcgaucucg

SEQ ID NO: 27520 - RNA, 22 nt, Homo sapiens
gcagugcuggagcccccgugug

SEQ ID NO: 27521 - RNA, 22 nt, Homo sapiens
gcaguguuggggccggaggcug

SEQ ID NO: 27522 - RNA, 22 nt, Homo sapiens
gcaguucuguaguugaaauuua

SEQ ID NO: 27523 - RNA, 20 nt, Homo sapiens
gcauaugucuuuauggcagc

SEQ ID NO: 27524 - RNA, 17 nt, Homo sapiens
gcauauguugaaccagc

SEQ ID NO: 27525 - RNA, 22 nt, Homo sapiens
gcauauguuuggguguguauau

SEQ ID NO: 27526 - RNA, 22 nt, Homo sapiens
gcaugcauuuuccuaacuagaa

SEQ ID NO: 27527 - RNA, 22 nt, Homo sapiens
gcauggagaaggggacugauuc

SEQ ID NO: 27528 - RNA, 22 nt, Homo sapiens
gcauggauguugauggcugcug

SEQ ID NO: 27529 - RNA, 22 nt, Homo sapiens
gcauguaguagauguugaauaa

SEQ ID NO: 27530 - RNA, 22 nt, Homo sapiens
ccuuuguuuaguugaauuguau

SEQ ID NO: 27531 - RNA, 22 nt, Homo sapiens
cgacuggccuagacuaguguuu

SEQ ID NO: 27532 - RNA, 22 nt, Homo sapiens
cgccgggggaugggcaccagcg

SEQ ID NO: 27533 - RNA, 22 nt, Homo sapiens
cuaaaugucucuacuaaguuua

SEQ ID NO: 27534 - RNA, 22 nt, Homo sapiens
cuaacuaugucucaggaugucc

SEQ ID NO: 27535 - RNA, 18 nt, Homo sapiens
cuaagacacuuggcagag

SEQ ID NO: 27536 - RNA, 22 nt, Homo sapiens
cuaaggaaggacugaaaggaca

SEQ ID NO: 27537 - RNA, 22 nt, Homo sapiens
cuaaggcaguagccugaauaau

SEQ ID NO: 27538 - RNA, 22 nt, Homo sapiens
cuaauucuguaccuggcacaua

SEQ ID NO: 27539 - RNA, 22 nt, Homo sapiens
cuacagguaugaaagggaguau

SEQ ID NO: 27540 - RNA, 23 nt, Homo sapiens
cuacagugccugucucuuuggcc

SEQ ID NO: 27541 - RNA, 22 nt, Homo sapiens
cuacaguguauuuauggagggu

SEQ ID NO: 27542 - RNA, 22 nt, Homo sapiens
cuagaacuagaacugcuggggu

SEQ ID NO: 27543 - RNA, 22 nt, Homo sapiens
cuagaagguaagagcuggaugc

SEQ ID NO: 27544 - RNA, 22 nt, Homo sapiens
cuagacacugacguuccuccga

SEQ ID NO: 27545 - RNA, 22 nt, Homo sapiens
cuagcuuuugauguaaagugag

SEQ ID NO: 27546 - RNA, 22 nt, Homo sapiens
cuaggaaguauguguuauugcu

SEQ ID NO: 27547 - RNA, 22 nt, Homo sapiens
cuaggcacgccugggucuccag

SEQ ID NO: 27548 - RNA, 22 nt, Homo sapiens
cuaggugcaugagccguacagu

SEQ ID NO: 27549 - RNA, 22 nt, Homo sapiens
cuagucacaggaguugaaggau

SEQ ID NO: 27550 - RNA, 22 nt, Homo sapiens
cuauaguauaguuugaagucag

SEQ ID NO: 27551 - RNA, 22 nt, Homo sapiens
cuauauacugccugcugauuag

SEQ ID NO: 27552 - RNA, 22 nt, Homo sapiens
cuauaugucuguuuugguacca

SEQ ID NO: 27553 - RNA, 22 nt, Homo sapiens
cuauggcucugguuauggcugu

SEQ ID NO: 27554 - RNA, 22 nt, Homo sapiens
cuauggugauagaaaucagaau

SEQ ID NO: 27555 - RNA, 22 nt, Homo sapiens
cuaugguuucucaaacuccuga

SEQ ID NO: 27556 - RNA, 22 nt, Homo sapiens
cuaugguuucuccauaucauca

SEQ ID NO: 27557 - RNA, 22 nt, Homo sapiens
cuauguaccuggaacuguauua

SEQ ID NO: 27558 - RNA, 22 nt, Homo sapiens
cuaugucuuucauauuuugggg

SEQ ID NO: 27559 - RNA, 22 nt, Homo sapiens
cuauuagguuggggcgaaagua

SEQ ID NO: 27560 - RNA, 22 nt, Homo sapiens
cuauuagguuggugcaaaaguc

SEQ ID NO: 27561 - RNA, 20 nt, Homo sapiens
cuauugacauuuggggcuag

SEQ ID NO: 27562 - RNA, 21 nt, Homo sapiens
cucaaaguacugauauuacag

SEQ ID NO: 27563 - RNA, 22 nt, Homo sapiens
cucaaaguguggucuguggguu

SEQ ID NO: 27564 - RNA, 22 nt, Homo sapiens
cucaaaugguccagcuaguggu

SEQ ID NO: 27565 - RNA, 22 nt, Homo sapiens
cucaaguaauccucccgccuug

SEQ ID NO: 27566 - RNA, 22 nt, Homo sapiens
cucacagucagaagggacuugc

SEQ ID NO: 27567 - RNA, 22 nt, Homo sapiens
cucaccuugugauccacccacc

SEQ ID NO: 27568 - RNA, 22 nt, Homo sapiens
cucaccuugugauccacccgcc

SEQ ID NO: 27569 - RNA, 22 nt, Homo sapiens
cucaccuugugauccuccugcc

SEQ ID NO: 27570 - RNA, 22 nt, Homo sapiens
cucacggcccugcgcacuggca

SEQ ID NO: 27571 - RNA, 22 nt, Homo sapiens
cucacuaggaaguaaaguuugu

SEQ ID NO: 27572 - RNA, 22 nt, Homo sapiens
cucacugggaccacucugaagu

SEQ ID NO: 27573 - RNA, 22 nt, Homo sapiens
cucagagcacaguuuaugacag

SEQ ID NO: 27574 - RNA, 22 nt, Homo sapiens
cucagcuacuugagaggcuuag

SEQ ID NO: 27575 - RNA, 22 nt, Homo sapiens
cucagugguugauuuauuuauc

SEQ ID NO: 27576 - RNA, 22 nt, Homo sapiens
cucaguguuaaggccaccucug

SEQ ID NO: 27577 - RNA, 22 nt, Homo sapiens
cucaguguucccauucuaccuu

SEQ ID NO: 27578 - RNA, 22 nt, Homo sapiens
cucauggagauagagaauagaa

SEQ ID NO: 27579 - RNA, 22 nt, Homo sapiens
cucauuaguuguuuuaagauga

SEQ ID NO: 27580 - RNA, 22 nt, Homo sapiens
cucauugcaaucucugccuccc

SEQ ID NO: 27581 - RNA, 22 nt, Homo sapiens
cuccaggugucauccaccuccu

SEQ ID NO: 27582 - RNA, 22 nt, Homo sapiens
cuccauuuaucugaaauuuuau

SEQ ID NO: 27583 - RNA, 22 nt, Homo sapiens
cucccagugacccaggaacagg

SEQ ID NO: 27584 - RNA, 22 nt, Homo sapiens
cuccccuuuaguuucuuaauaa

SEQ ID NO: 27585 - RNA, 22 nt, Homo sapiens
cucccuuugcugaauguuuuuc

SEQ ID NO: 27586 - RNA, 22 nt, Homo sapiens
cuccuggugauuggagugugaa

SEQ ID NO: 27587 - RNA, 22 nt, Homo sapiens
cucgagagaaaaugcuucacug

SEQ ID NO: 27588 - RNA, 20 nt, Homo sapiens
cucuaguaauaaaguuuccc

SEQ ID NO: 27589 - RNA, 22 nt, Homo sapiens
cucucugagccccagacaccuu

SEQ ID NO: 27590 - RNA, 22 nt, Homo sapiens
cucugagguuauucguaauauu

SEQ ID NO: 27591 - RNA, 22 nt, Homo sapiens
cucuggauauuccugucuaaaa

SEQ ID NO: 27592 - RNA, 20 nt, Homo sapiens
cucugguugugaauugucuu

SEQ ID NO: 27593 - RNA, 22 nt, Homo sapiens
cucuuugcuucuggcaucauug

SEQ ID NO: 27594 - RNA, 22 nt, Homo sapiens
cucuuuuguuuagcugagaggg

SEQ ID NO: 27595 - RNA, 22 nt, Homo sapiens
cugaaagagcauguaacacagu

SEQ ID NO: 27596 - RNA, 22 nt, Homo sapiens
cugaagugcuugccacauaaaa

SEQ ID NO: 27597 - RNA, 22 nt, Homo sapiens
cugaauguuuucuucuauucug

SEQ ID NO: 27598 - RNA, 22 nt, Homo sapiens
cugacguguuuuccagaccuuu

SEQ ID NO: 27599 - RNA, 22 nt, Homo sapiens
cugacugaggaucaguucauca

SEQ ID NO: 27600 - RNA, 22 nt, Homo sapiens
cugagaacaucauucagauauu

SEQ ID NO: 27601 - RNA, 22 nt, Homo sapiens
cugagaauguaaaugaagcuuu

SEQ ID NO: 27602 - RNA, 22 nt, Homo sapiens
uacugagagaggaauauugaaa

SEQ ID NO: 27603 - RNA, 22 nt, Homo sapiens
uacugcacauaugaagguuccc

SEQ ID NO: 27604 - RNA, 19 nt, Homo sapiens
uacugcaccucaaccuggg

SEQ ID NO: 27605 - RNA, 20 nt, Homo sapiens
uacugcacuccaaccuaggc

SEQ ID NO: 27606 - RNA, 22 nt, Homo sapiens
uacugcacuccacccuggguga

SEQ ID NO: 27607 - RNA, 22 nt, Homo sapiens
uacugcacuccagccugccaac

SEQ ID NO: 27608 - RNA, 22 nt, Homo sapiens
uacugcaucuacuuagagccag

SEQ ID NO: 27609 - RNA, 19 nt, Homo sapiens
uacuggcucgggaauuuuc

SEQ ID NO: 27610 - RNA, 22 nt, Homo sapiens
uacuguguaguuagaccucaga

SEQ ID NO: 27611 - RNA, 22 nt, Homo sapiens
uacuuagagacaugcagcacug

SEQ ID NO: 27612 - RNA, 22 nt, Homo sapiens
uacuuaguagcuuauccugugg

SEQ ID NO: 27613 - RNA, 22 nt, Homo sapiens
uacuuuguuauagcagcaggaa

SEQ ID NO: 27614 - RNA, 22 nt, Homo sapiens
uagaacaauugcuggauccgaa

SEQ ID NO: 27615 - RNA, 18 nt, Homo sapiens
uagaauauaggucauucu

SEQ ID NO: 27616 - RNA, 22 nt, Homo sapiens
uagaauguaacuuccaugucau

SEQ ID NO: 27617 - RNA, 22 nt, Homo sapiens
uagaaugucagcuucuugaggg

SEQ ID NO: 27618 - RNA, 23 nt, Homo sapiens
uagaauguuuuuccauguuucuu

SEQ ID NO: 27619 - RNA, 22 nt, Homo sapiens
uagacccauuacguaguuucca

SEQ ID NO: 27620 - RNA, 22 nt, Homo sapiens
gagauggagacuuggccuuaaa

SEQ ID NO: 27621 - RNA, 22 nt, Homo sapiens
gagauggagucuuuuucuguca

SEQ ID NO: 27622 - RNA, 22 nt, Homo sapiens
gagauggugugcuguuggaagu

SEQ ID NO: 27623 - RNA, 22 nt, Homo sapiens
gagauguaagaauuuauuuguu

SEQ ID NO: 27624 - RNA, 22 nt, Homo sapiens
gagaugugugugauuauauaau

SEQ ID NO: 27625 - RNA, 22 nt, Homo sapiens
gagauguuuguuucacugucac

SEQ ID NO: 27626 - RNA, 22 nt, Homo sapiens
gagauuaacauuugaggagcug

SEQ ID NO: 27627 - RNA, 22 nt, Homo sapiens
gagauuaauacacaucaaaugc

SEQ ID NO: 27628 - RNA, 22 nt, Homo sapiens
gagauucuucaauauuuauucu

SEQ ID NO: 27629 - RNA, 22 nt, Homo sapiens
gagcaacaguggcagugguggg

SEQ ID NO: 27630 - RNA, 22 nt, Homo sapiens
gagcaaugauugagccacugua

SEQ ID NO: 27631 - RNA, 21 nt, Homo sapiens
gagcacauuguccucuaacgc

SEQ ID NO: 27632 - RNA, 22 nt, Homo sapiens
gagcaccagucccugucagugc

SEQ ID NO: 27633 - RNA, 18 nt, Homo sapiens
gagcaccuuuuuugcaga

SEQ ID NO: 27634 - RNA, 20 nt, Homo sapiens
gagcaucacaggccucugcu

SEQ ID NO: 27635 - RNA, 22 nt, Homo sapiens
gagcaucauggggccaaagcgc

SEQ ID NO: 27636 - RNA, 22 nt, Homo sapiens
gagccauggagaaaacagcuau

SEQ ID NO: 27637 - RNA, 22 nt, Homo sapiens
gagcccauuucacuuguccagc

SEQ ID NO: 27638 - RNA, 22 nt, Homo sapiens
gagcuagcauuuagacaucugg

SEQ ID NO: 27639 - RNA, 22 nt, Homo sapiens
gagcuaguagauuuuaaauauu

SEQ ID NO: 27640 - RNA, 22 nt, Homo sapiens
gagcucaccuuaccucuggagc

SEQ ID NO: 27641 - RNA, 22 nt, Homo sapiens
gagcucauuaaaguaggaccua

SEQ ID NO: 27642 - RNA, 22 nt, Homo sapiens
gagcucguuuuugcugacucuu

SEQ ID NO: 27643 - RNA, 22 nt, Homo sapiens
gagcugguccuuuaaggaugca

SEQ ID NO: 27644 - RNA, 22 nt, Homo sapiens
gaggaaguaauuuuaggccugu

SEQ ID NO: 27645 - RNA, 22 nt, Homo sapiens
gaggaucucuugagcccagaag

SEQ ID NO: 27646 - RNA, 22 nt, Homo sapiens
gaggcaguguguccguucucgg

SEQ ID NO: 27647 - RNA, 22 nt, Homo sapiens
gaggcauuauucccaucuuaca

SEQ ID NO: 27648 - RNA, 22 nt, Homo sapiens
gagguagaauguuuuucagcug

SEQ ID NO: 27649 - RNA, 22 nt, Homo sapiens
gagguaggaggauugcuuaagg

SEQ ID NO: 27650 - RNA, 22 nt, Homo sapiens
gagguaggggccuuaaagaugc

SEQ ID NO: 27651 - RNA, 22 nt, Homo sapiens
gagguagguuugguuacaaaag

SEQ ID NO: 27652 - RNA, 22 nt, Homo sapiens
gagguaucauuauguugcccag

SEQ ID NO: 27653 - RNA, 22 nt, Homo sapiens
gagguaugugggcagacauuua

SEQ ID NO: 27654 - RNA, 22 nt, Homo sapiens
gaggucaugucgggccccagga

SEQ ID NO: 27655 - RNA, 22 nt, Homo sapiens
gaggugaaggucucaauaaaua

SEQ ID NO: 27656 - RNA, 22 nt, Homo sapiens
gagguuauuggggugcuugugu

SEQ ID NO: 27657 - RNA, 23 nt, Homo sapiens
gaguacauuaaaagcccagacug

SEQ ID NO: 27658 - RNA, 22 nt, Homo sapiens
gaguagugcugcaguaaacaua

SEQ ID NO: 27659 - RNA, 22 nt, Homo sapiens
gaguauauuugcacuguuaugu

SEQ ID NO: 27660 - RNA, 22 nt, Homo sapiens
gagucuauucaauguaguuaga

SEQ ID NO: 27661 - RNA, 23 nt, Homo sapiens
gaguggagacucauugauuuccu

SEQ ID NO: 27662 - RNA, 22 nt, Homo sapiens
gagugguaguuucuagaggugu

SEQ ID NO: 27663 - RNA, 22 nt, Homo sapiens
gagugguucuauauguaauugg

SEQ ID NO: 27664 - RNA, 22 nt, Homo sapiens
gaguuagguugucaaugucuua

SEQ ID NO: 27665 - RNA, 22 nt, Homo sapiens
gaguuuguaaacuauucacuaa

SEQ ID NO: 27666 - RNA, 22 nt, Homo sapiens
gauacuguauccuaaaagcuuu

SEQ ID NO: 27667 - RNA, 22 nt, Homo sapiens
gauagguagaagauguuuucau

SEQ ID NO: 27668 - RNA, 21 nt, Homo sapiens
gauaugacauggguaaaacca

SEQ ID NO: 27669 - RNA, 22 nt, Homo sapiens
gauauguaguaguugaaaaaga

SEQ ID NO: 27670 - RNA, 22 nt, Homo sapiens
gauauguguaucuauguacaug

SEQ ID NO: 27671 - RNA, 19 nt, Homo sapiens
gauauguugagcacccuuu

SEQ ID NO: 27672 - RNA, 22 nt, Homo sapiens
gauauguuguuggauucgguua

SEQ ID NO: 27673 - RNA, 22 nt, Homo sapiens
gauauguuucuucaauaccuag

SEQ ID NO: 27674 - RNA, 22 nt, Homo sapiens
gaucacaguuccucacgggcau

SEQ ID NO: 27675 - RNA, 22 nt, Homo sapiens
gaucacauggccauuucuagcu

SEQ ID NO: 27676 - RNA, 22 nt, Homo sapiens
gaucacauuguuucauacauau

SEQ ID NO: 27677 - RNA, 22 nt, Homo sapiens
gaucaguuucuggagauacgua

SEQ ID NO: 27678 - RNA, 22 nt, Homo sapiens
gaucucaguggauacugugaug

SEQ ID NO: 27679 - RNA, 22 nt, Homo sapiens
gaucuggagguuuuccucauga

SEQ ID NO: 27680 - RNA, 22 nt, Homo sapiens
gaucuggucuuugauuagacac

SEQ ID NO: 27681 - RNA, 22 nt, Homo sapiens
gaugagaugagcauuugaauug

SEQ ID NO: 27682 - RNA, 22 nt, Homo sapiens
gaugaucaugaccuacagaugg

SEQ ID NO: 27683 - RNA, 22 nt, Homo sapiens
gauggcacuaagccauguagga

SEQ ID NO: 27684 - RNA, 22 nt, Homo sapiens
gauggcacuguagcaacacaaa

SEQ ID NO: 27685 - RNA, 22 nt, Homo sapiens
gauggcacuuaagagcaagagc

SEQ ID NO: 27686 - RNA, 22 nt, Homo sapiens
gaugugaaaucauaguuucuag

SEQ ID NO: 27687 - RNA, 22 nt, Homo sapiens
gauguguuuuaggaucucagca

SEQ ID NO: 27688 - RNA, 22 nt, Homo sapiens
gauuagugacguugagcacugu

SEQ ID NO: 27689 - RNA, 22 nt, Homo sapiens
gauuccacuuacuuagcauucc

SEQ ID NO: 27690 - RNA, 22 nt, Homo sapiens
gauuuugguuagggaaggauac

SEQ ID NO: 27691 - RNA, 22 nt, Homo sapiens
gauuuuuggggaagccucuuau

SEQ ID NO: 27692 - RNA, 21 nt, Homo sapiens
gcaaacauccuuugaugccag

SEQ ID NO: 27693 - RNA, 22 nt, Homo sapiens
gcaaaguguuuuccaacuuggu

SEQ ID NO: 27694 - RNA, 22 nt, Homo sapiens
gcaaaguguuuuuaggaagucu

SEQ ID NO: 27695 - RNA, 22 nt, Homo sapiens
gcaaaucuuauguccucacauu

SEQ ID NO: 27696 - RNA, 22 nt, Homo sapiens
gcaaaugcuaugccauuuuaua

SEQ ID NO: 27697 - RNA, 20 nt, Homo sapiens
gcaaauggaucccacaagcc

SEQ ID NO: 27698 - RNA, 22 nt, Homo sapiens
gcaagagguaucuuauuuuccc

SEQ ID NO: 27699 - RNA, 22 nt, Homo sapiens
gcaagaguauuucaaggaagau

SEQ ID NO: 27700 - RNA, 22 nt, Homo sapiens
gcaagauguuaccauuagggaa

SEQ ID NO: 27701 - RNA, 22 nt, Homo sapiens
gcaauguuacugaauguguuuu

SEQ ID NO: 27702 - RNA, 22 nt, Homo sapiens
gcacaaugccugacgaguccug

SEQ ID NO: 27703 - RNA, 22 nt, Homo sapiens
ggcaccauggaaggacgggagc

SEQ ID NO: 27704 - RNA, 22 nt, Homo sapiens
ggcacuguugccggccugaauu

SEQ ID NO: 27705 - RNA, 22 nt, Homo sapiens
ggcagacuguggaguucuuucu

SEQ ID NO: 27706 - RNA, 22 nt, Homo sapiens
ggcagcaugggugccuuuguga

SEQ ID NO: 27707 - RNA, 17 nt, Homo sapiens
ggcaggauccaggaucc

SEQ ID NO: 27708 - RNA, 22 nt, Homo sapiens
ggcagguaaggagugggagccu

SEQ ID NO: 27709 - RNA, 22 nt, Homo sapiens
ggcaguuucucaggcaggggua

SEQ ID NO: 27710 - RNA, 21 nt, Homo sapiens
ggcaugaauggaaaagugaga

SEQ ID NO: 27711 - RNA, 22 nt, Homo sapiens
ggcaugaggccauaaaaguaag

SEQ ID NO: 27712 - RNA, 22 nt, Homo sapiens
ggcauguugauagguagaugua

SEQ ID NO: 27713 - RNA, 23 nt, Homo sapiens
ggcauuguggcucacaucuguaa

SEQ ID NO: 27714 - RNA, 22 nt, Homo sapiens
ggccuguaggguauugguaggg

SEQ ID NO: 27715 - RNA, 22 nt, Homo sapiens
ggcuagaugcuagagauaucau

SEQ ID NO: 27716 - RNA, 22 nt, Homo sapiens
ggcucagugaucuguuucugua

SEQ ID NO: 27717 - RNA, 22 nt, Homo sapiens
guaugguuuauagggaaauugu

SEQ ID NO: 27718 - RNA, 22 nt, Homo sapiens
guaugucuugucuauggcugcu

SEQ ID NO: 27719 - RNA, 22 nt, Homo sapiens
guaugucuuuauagcagugugg

SEQ ID NO: 27720 - RNA, 22 nt, Homo sapiens
guauuagaugguauuugaagau

SEQ ID NO: 27721 - RNA, 22 nt, Homo sapiens
guauuaguuuccuguugcugcu

SEQ ID NO: 27722 - RNA, 22 nt, Homo sapiens
guauugccugugugccagccac

SEQ ID NO: 27723 - RNA, 22 nt, Homo sapiens
guauuguacuacaagcucuuua

SEQ ID NO: 27724 - RNA, 19 nt, Homo sapiens
guauuugguaaacucucca

SEQ ID NO: 27725 - RNA, 22 nt, Homo sapiens
guauuugguuauugcagccuga

SEQ ID NO: 27726 - RNA, 22 nt, Homo sapiens
guauuuguugcagcagcacuau

SEQ ID NO: 27727 - RNA, 22 nt, Homo sapiens
gucacaggaaacuaauaugcgc

SEQ ID NO: 27728 - RNA, 22 nt, Homo sapiens
gucacaguggccagugauguuc

SEQ ID NO: 27729 - RNA, 22 nt, Homo sapiens
gucacauugaugcccauggugg

SEQ ID NO: 27730 - RNA, 22 nt, Homo sapiens
gucacugucuacuguaauagcc

SEQ ID NO: 27731 - RNA, 22 nt, Homo sapiens
gucaggaccucgguggcauucu

SEQ ID NO: 27732 - RNA, 22 nt, Homo sapiens
gucaggcaccgauacaguuuuu

SEQ ID NO: 27733 - RNA, 22 nt, Homo sapiens
gucagggagucucuaucagugg

SEQ ID NO: 27734 - RNA, 22 nt, Homo sapiens
gucagugccugucccaggcuuu

SEQ ID NO: 27735 - RNA, 18 nt, Homo sapiens
gucauagaaugaugguuc

SEQ ID NO: 27736 - RNA, 22 nt, Homo sapiens
gucauaugcucggaaaauguua

SEQ ID NO: 27737 - RNA, 21 nt, Homo sapiens
guccaaaacaguguccaaugc

SEQ ID NO: 27738 - RNA, 22 nt, Homo sapiens
guccaaagugggagaggugggg

SEQ ID NO: 27739 - RNA, 22 nt, Homo sapiens
guccagagaagucauuacuuca

SEQ ID NO: 27740 - RNA, 22 nt, Homo sapiens
guccaugagaugaauccacaca

SEQ ID NO: 27741 - RNA, 22 nt, Homo sapiens
gucccagagauauugugucuuu

SEQ ID NO: 27742 - RNA, 22 nt, Homo sapiens
guccuugaggcuuugacugugg

SEQ ID NO: 27743 - RNA, 22 nt, Homo sapiens
gucguggagcucacagugugcc

SEQ ID NO: 27744 - RNA, 22 nt, Homo sapiens
gucuagaacuucugaccuuagg

SEQ ID NO: 27745 - RNA, 22 nt, Homo sapiens
gucucacaggcaugaugccagc

SEQ ID NO: 27746 - RNA, 22 nt, Homo sapiens
gucuccgagccguguggagccg

SEQ ID NO: 27747 - RNA, 22 nt, Homo sapiens
gucucugguugcuuuuguacca

SEQ ID NO: 27748 - RNA, 22 nt, Homo sapiens
gucugcaugucauaugauagua

SEQ ID NO: 27749 - RNA, 22 nt, Homo sapiens
gucuggagacuugggucaucaa

SEQ ID NO: 27750 - RNA, 22 nt, Homo sapiens
gucugguacuuguuuguaaggg

SEQ ID NO: 27751 - RNA, 22 nt, Homo sapiens
gucugguugacagcauguggcc

SEQ ID NO: 27752 - RNA, 22 nt, Homo sapiens
gucugucuuuugucuuugaaau

SEQ ID NO: 27753 - RNA, 22 nt, Homo sapiens
gucuguuugauccagaucaaaa

SEQ ID NO: 27754 - RNA, 20 nt, Homo sapiens
gucuugcuccguugcccagg

SEQ ID NO: 27755 - RNA, 22 nt, Homo sapiens
gucuuuaguugaaacauguggu

SEQ ID NO: 27756 - RNA, 22 nt, Homo sapiens
gucuuugcauguauguucauga

SEQ ID NO: 27757 - RNA, 22 nt, Homo sapiens
gucuuuugcuagccagagagcu

SEQ ID NO: 27758 - RNA, 22 nt, Homo sapiens
gugaaagacauauaugguuuga

SEQ ID NO: 27759 - RNA, 22 nt, Homo sapiens
gugaaagauuaaaccagugugu

SEQ ID NO: 27760 - RNA, 22 nt, Homo sapiens
gugaaauauuuaacguccaggu

SEQ ID NO: 27761 - RNA, 22 nt, Homo sapiens
gugaacaauguuuuauccuggg

SEQ ID NO: 27762 - RNA, 22 nt, Homo sapiens
gugaacagaaccugggaucgaa

SEQ ID NO: 27763 - RNA, 22 nt, Homo sapiens
gugaagaucccuguccuguucc

SEQ ID NO: 27764 - RNA, 22 nt, Homo sapiens
gugaaucuguuuucuucuguuc

SEQ ID NO: 27765 - RNA, 22 nt, Homo sapiens
gugaaugcauuaagaaggggga

SEQ ID NO: 27766 - RNA, 22 nt, Homo sapiens
gugacacuggagcuggcacaau

SEQ ID NO: 27767 - RNA, 22 nt, Homo sapiens
gugacauuuuuacugaugagag

SEQ ID NO: 27768 - RNA, 22 nt, Homo sapiens
gugacgucauuguuccuggcuc

SEQ ID NO: 27769 - RNA, 22 nt, Homo sapiens
gugacugcauccauccaggcuu

SEQ ID NO: 27770 - RNA, 22 nt, Homo sapiens
gugacugggaguggugaagaua

SEQ ID NO: 27771 - RNA, 22 nt, Homo sapiens
gugagaacugugucuuauaaac

SEQ ID NO: 27772 - RNA, 22 nt, Homo sapiens
gugagaagaaaaauauggcugu

SEQ ID NO: 27773 - RNA, 22 nt, Homo sapiens
gugagaaucaaacuacauaaau

SEQ ID NO: 27774 - RNA, 22 nt, Homo sapiens
gugagaccaauguacuaccuuc

SEQ ID NO: 27775 - RNA, 22 nt, Homo sapiens
gugagaggaggcagcuuuuaca

SEQ ID NO: 27776 - RNA, 22 nt, Homo sapiens
gugagauuaccauuuaaaucag

SEQ ID NO: 27777 - RNA, 22 nt, Homo sapiens
gugagcaaacuuaccuaagguu

SEQ ID NO: 27778 - RNA, 19 nt, Homo sapiens
gugagcaaugcauugcacu

SEQ ID NO: 27779 - RNA, 22 nt, Homo sapiens
gugagcauucaaggaaggagcu

SEQ ID NO: 27780 - RNA, 22 nt, Homo sapiens
gugagccaugauuuuaccacug

SEQ ID NO: 27781 - RNA, 22 nt, Homo sapiens
gugagcuagaccacuuggcucc

SEQ ID NO: 27782 - RNA, 22 nt, Homo sapiens
gugagcuccucuucugcugcag

SEQ ID NO: 27783 - RNA, 22 nt, Homo sapiens
gugaggaaggaaaccugcuagc

SEQ ID NO: 27784 - RNA, 22 nt, Homo sapiens
gugaggcacugcugcuuuccag

SEQ ID NO: 27785 - RNA, 22 nt, Homo sapiens
gugagguaagaguugcuuugcu

SEQ ID NO: 27786 - RNA, 20 nt, Homo sapiens
gugagguagaggguuaccug

SEQ ID NO: 27787 - RNA, 22 nt, Homo sapiens
gugagguauacugggaucacua

SEQ ID NO: 27788 - RNA, 17 nt, Homo sapiens
gugagguauccucaaaa

SEQ ID NO: 27789 - RNA, 22 nt, Homo sapiens
gugagguguuaaccaaccugug

SEQ ID NO: 27790 - RNA, 22 nt, Homo sapiens
gugagguugaaaauaauggaaa

SEQ ID NO: 27791 - RNA, 22 nt, Homo sapiens
gugaguaaagguucauugaauu

SEQ ID NO: 27792 - RNA, 22 nt, Homo sapiens
gugauacugcuuauuaauuuaa

SEQ ID NO: 27793 - RNA, 22 nt, Homo sapiens
gugauagguugucacugucacu

SEQ ID NO: 27794 - RNA, 23 nt, Homo sapiens
gugaucauuguuguggguugaau

SEQ ID NO: 27795 - RNA, 22 nt, Homo sapiens
gugaucuguccuucauagccug

SEQ ID NO: 27796 - RNA, 22 nt, Homo sapiens
gugaucuucauggaaggugaaa

SEQ ID NO: 27797 - RNA, 22 nt, Homo sapiens
gugaugguaguuuguauuucug

SEQ ID NO: 27798 - RNA, 22 nt, Homo sapiens
gugauuauuaugcacugcaugc

SEQ ID NO: 27799 - RNA, 22 nt, Homo sapiens
gugauugugaaaacauuaagaa

SEQ ID NO: 27800 - RNA, 22 nt, Homo sapiens
gugcaaaucucugaguaucuuu

SEQ ID NO: 27801 - RNA, 22 nt, Homo sapiens
gugcaaccaucaccacugacuc

SEQ ID NO: 27802 - RNA, 22 nt, Homo sapiens
gugcaaguguaauacagcuagg

SEQ ID NO: 27803 - RNA, 22 nt, Homo sapiens
gugcaaugagaaggggcucugg

SEQ ID NO: 27804 - RNA, 22 nt, Homo sapiens
caagugcuacagagaaaucuuu

SEQ ID NO: 27805 - RNA, 22 nt, Homo sapiens
caagugcuugaugaaugaucaa

SEQ ID NO: 27806 - RNA, 22 nt, Homo sapiens
caagugcuuucuuggggauuua

SEQ ID NO: 27807 - RNA, 22 nt, Homo sapiens
caaguguuuccuuaaauacuug

SEQ ID NO: 27808 - RNA, 22 nt, Homo sapiens
caauacuguguugaauaagagu

SEQ ID NO: 27809 - RNA, 19 nt, Homo sapiens
caauacuucuuggcauaca

SEQ ID NO: 27810 - RNA, 22 nt, Homo sapiens
caaugcauuauucucccacuuc

SEQ ID NO: 27811 - RNA, 21 nt, Homo sapiens
caauggcacaaucucugcuca

SEQ ID NO: 27812 - RNA, 22 nt, Homo sapiens
cacaaaguagauuagucuucca

SEQ ID NO: 27813 - RNA, 22 nt, Homo sapiens
cacaaugucuaagauguuucua

SEQ ID NO: 27814 - RNA, 22 nt, Homo sapiens
cacacugucuucaauggguggu

SEQ ID NO: 27815 - RNA, 22 nt, Homo sapiens
cacaggucauccuggaucaagg

SEQ ID NO: 27816 - RNA, 22 nt, Homo sapiens
cacaguagaauagagcacuagg

SEQ ID NO: 27817 - RNA, 22 nt, Homo sapiens
cacagucuugcaauauugagau

SEQ ID NO: 27818 - RNA, 22 nt, Homo sapiens
cacaguguuacugguaugaagu

SEQ ID NO: 27819 - RNA, 22 nt, Homo sapiens
cacaguguucauagccaucagg

SEQ ID NO: 27820 - RNA, 22 nt, Homo sapiens
cacauagucccugcuaaucuuc

SEQ ID NO: 27821 - RNA, 21 nt, Homo sapiens
cacauggaggcagagagugua

SEQ ID NO: 27822 - RNA, 22 nt, Homo sapiens
cacauguuugcuacauuuuucu

SEQ ID NO: 27823 - RNA, 22 nt, Homo sapiens
cacccuugcagggacagcuuug

SEQ ID NO: 27824 - RNA, 22 nt, Homo sapiens
cacgugcuuucuuuucauuuag

SEQ ID NO: 27825 - RNA, 22 nt, Homo sapiens
cacuagagaauagguaguucug

SEQ ID NO: 27826 - RNA, 22 nt, Homo sapiens
cacucaguuugugguacuuugu

SEQ ID NO: 27827 - RNA, 22 nt, Homo sapiens
cacugcacuccagcuugugggc

SEQ ID NO: 27828 - RNA, 22 nt, Homo sapiens
cacugcaguggaagauuaagaa

SEQ ID NO: 27829 - RNA, 22 nt, Homo sapiens
cacugcauccuccaccuccugg

SEQ ID NO: 27830 - RNA, 22 nt, Homo sapiens
cacugcauccuccauauccugg

SEQ ID NO: 27831 - RNA, 22 nt, Homo sapiens
cacugcauggccacccauguua

SEQ ID NO: 27832 - RNA, 22 nt, Homo sapiens
cacugcauuggaugguuccucc

SEQ ID NO: 27833 - RNA, 22 nt, Homo sapiens
cacuggacauguugaagcuuuu

SEQ ID NO: 27834 - RNA, 22 nt, Homo sapiens
cacugggugagauccauguuua

SEQ ID NO: 27835 - RNA, 21 nt, Homo sapiens
cagagaucaucucuguuuuaa

SEQ ID NO: 27836 - RNA, 22 nt, Homo sapiens
cagagaucaugcaacugcucgc

SEQ ID NO: 27837 - RNA, 20 nt, Homo sapiens
cagagcaaagcaguccuggc

SEQ ID NO: 27838 - RNA, 22 nt, Homo sapiens
cagagcaaugcuuuugcuuuga

SEQ ID NO: 27839 - RNA, 22 nt, Homo sapiens
cagagucaagcucuuguuccau

SEQ ID NO: 27840 - RNA, 22 nt, Homo sapiens
cagagugcauguuuagaugagu

SEQ ID NO: 27841 - RNA, 22 nt, Homo sapiens
cagauaguuguagauaugcagc

SEQ ID NO: 27842 - RNA, 22 nt, Homo sapiens
cagauaguuguagguguguggc

SEQ ID NO: 27843 - RNA, 20 nt, Homo sapiens
cagcacgcacaugagacugu

SEQ ID NO: 27844 - RNA, 22 nt, Homo sapiens
cagcccuacacagacugacuca

SEQ ID NO: 27845 - RNA, 22 nt, Homo sapiens
cagcuagcaugcguaacuuucu

SEQ ID NO: 27846 - RNA, 22 nt, Homo sapiens
cagcucauugcagucucgaccu

SEQ ID NO: 27847 - RNA, 22 nt, Homo sapiens
cagcuggugcugcaccaguggg

SEQ ID NO: 27848 - RNA, 22 nt, Homo sapiens
cagcuggugggagcuggguucc

SEQ ID NO: 27849 - RNA, 22 nt, Homo sapiens
cagcuguguuauaaacuaccau

SEQ ID NO: 27850 - RNA, 22 nt, Homo sapiens
cagcuguuguuaugucugcagg

SEQ ID NO: 27851 - RNA, 22 nt, Homo sapiens
cagcuguuguuccagucuuuua

SEQ ID NO: 27852 - RNA, 22 nt, Homo sapiens
caggcaacauggcgaaacucug

SEQ ID NO: 27853 - RNA, 22 nt, Homo sapiens
caggcauuguccaugcugaagg

SEQ ID NO: 27854 - RNA, 22 nt, Homo sapiens
caggcuuuuccacacauggguu

SEQ ID NO: 27855 - RNA, 22 nt, Homo sapiens
cagggaauguuauuuaauagca

SEQ ID NO: 27856 - RNA, 22 nt, Homo sapiens
cagggcauuggcugguaccugg

SEQ ID NO: 27857 - RNA, 22 nt, Homo sapiens
cagguaagaugcuuucucuuau

SEQ ID NO: 27858 - RNA, 22 nt, Homo sapiens
cagguacaugcaugugugugca

SEQ ID NO: 27859 - RNA, 21 nt, Homo sapiens
cagguagugucugaagccaga

SEQ ID NO: 27860 - RNA, 19 nt, Homo sapiens
cagguagugugcugacaug

SEQ ID NO: 27861 - RNA, 22 nt, Homo sapiens
caggugcuuacuuaauagccau

SEQ ID NO: 27862 - RNA, 22 nt, Homo sapiens
agugguauaauauuauuuugaa

SEQ ID NO: 27863 - RNA, 23 nt, Homo sapiens
aguggucuccugggcccagcugu

SEQ ID NO: 27864 - RNA, 22 nt, Homo sapiens
aguguuuuuaacaagaaagggu

SEQ ID NO: 27865 - RNA, 22 nt, Homo sapiens
aguguuuuucaugggauacuuu

SEQ ID NO: 27866 - RNA, 22 nt, Homo sapiens
aguuagcaaaacucccaaaggu

SEQ ID NO: 27867 - RNA, 22 nt, Homo sapiens
aguuccuacuggcuguaaagaa

SEQ ID NO: 27868 - RNA, 22 nt, Homo sapiens
aguuggugauugauugggucug

SEQ ID NO: 27869 - RNA, 22 nt, Homo sapiens
aguuuugguugaguuacuagca

SEQ ID NO: 27870 - RNA, 22 nt, Homo sapiens
aguuuuugcugauagcaugcuu

SEQ ID NO: 27871 - RNA, 17 nt, Homo sapiens
auaaacucaucauuuuu

SEQ ID NO: 27872 - RNA, 22 nt, Homo sapiens
auaaagcaagucucuggccuca

SEQ ID NO: 27873 - RNA, 22 nt, Homo sapiens
auaaagccaggagacguaauug

SEQ ID NO: 27874 - RNA, 22 nt, Homo sapiens
auaaagguaauaauaguugcau

SEQ ID NO: 27875 - RNA, 22 nt, Homo sapiens
auaaauaguaguugugguggcc

SEQ ID NO: 27876 - RNA, 18 nt, Homo sapiens
auaaccuggugcuuucaa

SEQ ID NO: 27877 - RNA, 22 nt, Homo sapiens
auaagaguaguacauaugagac

SEQ ID NO: 27878 - RNA, 22 nt, Homo sapiens
auaagauaguggaagugggauu

SEQ ID NO: 27879 - RNA, 22 nt, Homo sapiens
auaaggcuaaggacuugaguua

SEQ ID NO: 27880 - RNA, 22 nt, Homo sapiens
auaaggcugguauagacauuca

SEQ ID NO: 27881 - RNA, 22 nt, Homo sapiens
auaauagguugauugacauugc

SEQ ID NO: 27882 - RNA, 22 nt, Homo sapiens
auaaucaugucugaaaccuuug

SEQ ID NO: 27883 - RNA, 22 nt, Homo sapiens
auaauguuugauugagcagaua

SEQ ID NO: 27884 - RNA, 22 nt, Homo sapiens
auaauugcuaagugaagauggu

SEQ ID NO: 27885 - RNA, 18 nt, Homo sapiens
auacaagcagcagagauu

SEQ ID NO: 27886 - RNA, 22 nt, Homo sapiens
auacaagugccauguuggugug

SEQ ID NO: 27887 - RNA, 22 nt, Homo sapiens
auacacauuccugggccucacc

SEQ ID NO: 27888 - RNA, 22 nt, Homo sapiens
auacacguguauauguguaucu

SEQ ID NO: 27889 - RNA, 22 nt, Homo sapiens
auacagcuaaaauauuaaguua

SEQ ID NO: 27890 - RNA, 22 nt, Homo sapiens
auacaguaucuucuggcaagca

SEQ ID NO: 27891 - RNA, 22 nt, Homo sapiens
auacagugaauacuuacagugu

SEQ ID NO: 27892 - RNA, 22 nt, Homo sapiens
auacaguguauguauaguacau

SEQ ID NO: 27893 - RNA, 22 nt, Homo sapiens
auacaugcauuugcacgagagu

SEQ ID NO: 27894 - RNA, 22 nt, Homo sapiens
auacaugugccauggugguuug

SEQ ID NO: 27895 - RNA, 22 nt, Homo sapiens
auacaugugccauguugguaug

SEQ ID NO: 27896 - RNA, 22 nt, Homo sapiens
auacaugugccauguugguuug

SEQ ID NO: 27897 - RNA, 22 nt, Homo sapiens
auacaugugucauguugguuug

SEQ ID NO: 27898 - RNA, 22 nt, Homo sapiens
auacaugugugagcgaagaugu

SEQ ID NO: 27899 - RNA, 22 nt, Homo sapiens
auacauguuucauguuggugug

SEQ ID NO: 27900 - RNA, 20 nt, Homo sapiens
auacccaguagcacaacagc

SEQ ID NO: 27901 - RNA, 22 nt, Homo sapiens
auacccauacauauuggugacu

SEQ ID NO: 27902 - RNA, 22 nt, Homo sapiens
auacuguauaggauuguagccu

SEQ ID NO: 27903 - RNA, 22 nt, Homo sapiens
auacugucucuugcuccugccc

SEQ ID NO: 27904 - RNA, 22 nt, Homo sapiens
auacuguuucugaacuuugauu

SEQ ID NO: 27905 - RNA, 20 nt, Homo sapiens
auagaagacuagugcagcag

SEQ ID NO: 27906 - RNA, 22 nt, Homo sapiens
auagagcuaccauagaauccag

SEQ ID NO: 27907 - RNA, 22 nt, Homo sapiens
auagagcuggcagacacccuua

SEQ ID NO: 27908 - RNA, 22 nt, Homo sapiens
auagaguuagaaagaaauguuu

SEQ ID NO: 27909 - RNA, 22 nt, Homo sapiens
auagaucuauuuauguaucccu

SEQ ID NO: 27910 - RNA, 22 nt, Homo sapiens
auagcaagaugauugauccauu

SEQ ID NO: 27911 - RNA, 22 nt, Homo sapiens
auagcaaugccccaauccuugg

SEQ ID NO: 27912 - RNA, 22 nt, Homo sapiens
auagcaaugccccauucccagu

SEQ ID NO: 27913 - RNA, 22 nt, Homo sapiens
auagcacauggcauccucucuu

SEQ ID NO: 27914 - RNA, 22 nt, Homo sapiens
auagcagcuugucagggcagac

SEQ ID NO: 27915 - RNA, 22 nt, Homo sapiens
auagcauaucccacaugucaga

SEQ ID NO: 27916 - RNA, 22 nt, Homo sapiens
auagccaguagagagcuguuag

SEQ ID NO: 27917 - RNA, 22 nt, Homo sapiens
auagccuguaggccuuaaggug

SEQ ID NO: 27918 - RNA, 22 nt, Homo sapiens
auagcucuugcuuacccacugu

SEQ ID NO: 27919 - RNA, 22 nt, Homo sapiens
auagcugcucaggcuuuccuca

SEQ ID NO: 27920 - RNA, 22 nt, Homo sapiens
auaggagugugcacagaguagg

SEQ ID NO: 27921 - RNA, 22 nt, Homo sapiens
auagguauuuuuaaaugacugu

SEQ ID NO: 27922 - RNA, 22 nt, Homo sapiens
auagguuauuagagcaaagcuu

SEQ ID NO: 27923 - RNA, 22 nt, Homo sapiens
auaguagagagggcaaaaugcu

SEQ ID NO: 27924 - RNA, 22 nt, Homo sapiens
aacaguaucuaacgagugauga

SEQ ID NO: 27925 - RNA, 21 nt, Homo sapiens
aacagugcugaacagacaccu

SEQ ID NO: 27926 - RNA, 22 nt, Homo sapiens
aacagugcuguuauaaauguac

SEQ ID NO: 27927 - RNA, 22 nt, Homo sapiens
aacagugcuucauucacacauu

SEQ ID NO: 27928 - RNA, 20 nt, Homo sapiens
aacaguguguaaguuuccuu

SEQ ID NO: 27929 - RNA, 22 nt, Homo sapiens
aacaucaaccaugaggguugga

SEQ ID NO: 27930 - RNA, 22 nt, Homo sapiens
aacucacauucuuucuugguac

SEQ ID NO: 27931 - RNA, 22 nt, Homo sapiens
aacuggcauagccagacuucuc

SEQ ID NO: 27932 - RNA, 22 nt, Homo sapiens
aacuggccuccuugggaaauua

SEQ ID NO: 27933 - RNA, 22 nt, Homo sapiens
aacuggccugagaugaaaagug

SEQ ID NO: 27934 - RNA, 22 nt, Homo sapiens
aacugguauuucccaugaauuu

SEQ ID NO: 27935 - RNA, 22 nt, Homo sapiens
aacuggucuuaugcaagcacua

SEQ ID NO: 27936 - RNA, 22 nt, Homo sapiens
aagagaacugacaguaccuggg

SEQ ID NO: 27937 - RNA, 20 nt, Homo sapiens
aagagcucaccagaauaucu

SEQ ID NO: 27938 - RNA, 22 nt, Homo sapiens
aagagcucucuguagcauguga

SEQ ID NO: 27939 - RNA, 22 nt, Homo sapiens
aagagguagucugucccuuagc

SEQ ID NO: 27940 - RNA, 22 nt, Homo sapiens
aagagguuguaccuaaaguguu

SEQ ID NO: 27941 - RNA, 22 nt, Homo sapiens
aagagguuuaacugacucacag

SEQ ID NO: 27942 - RNA, 22 nt, Homo sapiens
aagagugucuuugugcuggccc

SEQ ID NO: 27943 - RNA, 22 nt, Homo sapiens
aagauaguaaacauuuucugcu

SEQ ID NO: 27944 - RNA, 22 nt, Homo sapiens
aagaugauguucuuuuucuuag

SEQ ID NO: 27945 - RNA, 22 nt, Homo sapiens
aagaugcagucauacuggagga

SEQ ID NO: 27946 - RNA, 22 nt, Homo sapiens
aagaugcagucauacuggagua

SEQ ID NO: 27947 - RNA, 22 nt, Homo sapiens
aagcaacacaucugccccgguu

SEQ ID NO: 27948 - RNA, 22 nt, Homo sapiens
aagcacaauuucaccuucuugu

SEQ ID NO: 27949 - RNA, 22 nt, Homo sapiens
aagcagauguguugaaaguacu

SEQ ID NO: 27950 - RNA, 22 nt, Homo sapiens
aagccacuguaccugucucuua

SEQ ID NO: 27951 - RNA, 22 nt, Homo sapiens
aagcuacauuuuauuuauguca

SEQ ID NO: 27952 - RNA, 22 nt, Homo sapiens
aagcuccauuucugccaugaga

SEQ ID NO: 27953 - RNA, 22 nt, Homo sapiens
aagcugcauuuucuagaugcuu

SEQ ID NO: 27954 - RNA, 22 nt, Homo sapiens
aagcugccuugugaaggcauuc

SEQ ID NO: 27955 - RNA, 22 nt, Homo sapiens
aagcuggauuuaguguggagca

SEQ ID NO: 27956 - RNA, 22 nt, Homo sapiens
aagcugguuuuauaucugugag

SEQ ID NO: 27957 - RNA, 22 nt, Homo sapiens
aagcuguugguggaucuaccau

SEQ ID NO: 27958 - RNA, 22 nt, Homo sapiens
aagcuuucaacuguuugccauu

SEQ ID NO: 27959 - RNA, 22 nt, Homo sapiens
aaggaauacuggugguugcuau

SEQ ID NO: 27960 - RNA, 22 nt, Homo sapiens
aaggaauucaaauuuucucugg

SEQ ID NO: 27961 - RNA, 22 nt, Homo sapiens
aaggagcaguggacggguccua

SEQ ID NO: 27962 - RNA, 22 nt, Homo sapiens
aaggaguauugaaugaccaagu

SEQ ID NO: 27963 - RNA, 22 nt, Homo sapiens
aucacuguaaguuuacacuuug

SEQ ID NO: 27964 - RNA, 22 nt, Homo sapiens
aucacugugauuucuacugugc

SEQ ID NO: 27965 - RNA, 22 nt, Homo sapiens
aucagaaucucuagaggacugu

SEQ ID NO: 27966 - RNA, 22 nt, Homo sapiens
aucagaaucucuugagaguguu

SEQ ID NO: 27967 - RNA, 21 nt, Homo sapiens
aucagagacccaggcuuccuc

SEQ ID NO: 27968 - RNA, 22 nt, Homo sapiens
aucagagugaauaaugacaaaa

SEQ ID NO: 27969 - RNA, 22 nt, Homo sapiens
aucagaguggguuuuaaaagug

SEQ ID NO: 27970 - RNA, 22 nt, Homo sapiens
aucagcacugaucauacagcuu

SEQ ID NO: 27971 - RNA, 22 nt, Homo sapiens
aucagcagcaugaaaacggacu

SEQ ID NO: 27972 - RNA, 22 nt, Homo sapiens
aucagcagcaugaaaagcaacu

SEQ ID NO: 27973 - RNA, 22 nt, Homo sapiens
aucagcaugcagaagucggggg

SEQ ID NO: 27974 - RNA, 22 nt, Homo sapiens
aucagugaaagugaaaucuccg

SEQ ID NO: 27975 - RNA, 22 nt, Homo sapiens
aucagugcauaguauuuaauga

SEQ ID NO: 27976 - RNA, 22 nt, Homo sapiens
aucagugcauguuuguugagcu

SEQ ID NO: 27977 - RNA, 22 nt, Homo sapiens
aucauacuguuuugauuacugu

SEQ ID NO: 27978 - RNA, 22 nt, Homo sapiens
aucauaucauuggugaacagug

SEQ ID NO: 27979 - RNA, 22 nt, Homo sapiens
aucaucaugcacuacagccugg

SEQ ID NO: 27980 - RNA, 22 nt, Homo sapiens
aucaugcacaugcauagguaug

SEQ ID NO: 27981 - RNA, 22 nt, Homo sapiens
aucaugucuucccagugauucu

SEQ ID NO: 27982 - RNA, 22 nt, Homo sapiens
aucauugugcaucuucauucca

SEQ ID NO: 27983 - RNA, 22 nt, Homo sapiens
aucauugugugaguugauggga

SEQ ID NO: 27984 - RNA, 22 nt, Homo sapiens
auccacaugcaguuggaaacag

SEQ ID NO: 27985 - RNA, 22 nt, Homo sapiens
auccacauucauggaccagucc

SEQ ID NO: 27986 - RNA, 22 nt, Homo sapiens
auccauugcacuauggaaagug

SEQ ID NO: 27987 - RNA, 22 nt, Homo sapiens
aucccugagccugacucucaga

SEQ ID NO: 27988 - RNA, 22 nt, Homo sapiens
aucccuguaguaauauucuagc

SEQ ID NO: 27989 - RNA, 22 nt, Homo sapiens
auccucaguggcuuaaguauag

SEQ ID NO: 27990 - RNA, 22 nt, Homo sapiens
auccuuuagacuguccaguuga

SEQ ID NO: 27991 - RNA, 22 nt, Homo sapiens
aucgcacuccauccugggcaac

SEQ ID NO: 27992 - RNA, 22 nt, Homo sapiens
aucgcgccauuguacuccagcc

SEQ ID NO: 27993 - RNA, 22 nt, Homo sapiens
aucgcugagaaagggacuuuca

SEQ ID NO: 27994 - RNA, 22 nt, Homo sapiens
aucuacagccagucugguuugu

SEQ ID NO: 27995 - RNA, 22 nt, Homo sapiens
aucuagagaggcagucuggccg

SEQ ID NO: 27996 - RNA, 22 nt, Homo sapiens
aucucagcaacuaaagauccuu

SEQ ID NO: 27997 - RNA, 22 nt, Homo sapiens
aucuccaggugccagcugcgcc

SEQ ID NO: 27998 - RNA, 22 nt, Homo sapiens
aucugcuccuggugaggguuuc

SEQ ID NO: 27999 - RNA, 19 nt, Homo sapiens
aucuggaguuccuggggcu

SEQ ID NO: 28000 - RNA, 22 nt, Homo sapiens
aucuggcguuuacuuccuuccu

SEQ ID NO: 28001 - RNA, 22 nt, Homo sapiens
aucuggcuccuuuugacaaugc

SEQ ID NO: 28002 - RNA, 22 nt, Homo sapiens
aucuggguccguucugcuucuc

SEQ ID NO: 28003 - RNA, 22 nt, Homo sapiens
aucugguauuacugcaacugua

SEQ ID NO: 28004 - RNA, 22 nt, Homo sapiens
aucugguguuuccuucacauug

SEQ ID NO: 28005 - RNA, 22 nt, Homo sapiens
aucugguguuuuucucccucgu

SEQ ID NO: 28006 - RNA, 22 nt, Homo sapiens
aucuguagauucagcacaagcu

SEQ ID NO: 28007 - RNA, 21 nt, Homo sapiens
aucugugagaccuuggggguu

SEQ ID NO: 28008 - RNA, 22 nt, Homo sapiens
aucuucucuugaagggugggga

SEQ ID NO: 28009 - RNA, 22 nt, Homo sapiens
aucuuugauuagacugauggau

SEQ ID NO: 28010 - RNA, 22 nt, Homo sapiens
aucuuugauugaagggacccug

SEQ ID NO: 28011 - RNA, 22 nt, Homo sapiens
aucuuugcugagaugcauggca

SEQ ID NO: 28012 - RNA, 22 nt, Homo sapiens
augaaacuggcuaauuuuugua

SEQ ID NO: 28013 - RNA, 22 nt, Homo sapiens
augaaagugauaaaugucucua

SEQ ID NO: 28014 - RNA, 22 nt, Homo sapiens
augaaaucacugugaugcccua

SEQ ID NO: 28015 - RNA, 22 nt, Homo sapiens
augaaaucuuuggcagaucuua

SEQ ID NO: 28016 - RNA, 22 nt, Homo sapiens
augaaauguaugagucuggguu

SEQ ID NO: 28017 - RNA, 19 nt, Homo sapiens
augaacucaucauuucuca

SEQ ID NO: 28018 - RNA, 22 nt, Homo sapiens
augaacucaucauuuuuauggc

SEQ ID NO: 28019 - RNA, 22 nt, Homo sapiens
augaacucaucauuuuuugugg

SEQ ID NO: 28020 - RNA, 17 nt, Homo sapiens
augaacucaucguucuu

SEQ ID NO: 28021 - RNA, 22 nt, Homo sapiens
aaugcuaucuggaacauuguug

SEQ ID NO: 28022 - RNA, 22 nt, Homo sapiens
aauggcacacaccuggucuaac

SEQ ID NO: 28023 - RNA, 22 nt, Homo sapiens
aauggcucuuccuggaguugug

SEQ ID NO: 28024 - RNA, 21 nt, Homo sapiens
aaugguguugccaacaaggug

SEQ ID NO: 28025 - RNA, 22 nt, Homo sapiens
aaugucaucuucaguuguacag

SEQ ID NO: 28026 - RNA, 22 nt, Homo sapiens
aaugugcuucuggcugugguca

SEQ ID NO: 28027 - RNA, 22 nt, Homo sapiens
aauuacucgugucuuuacugcu

SEQ ID NO: 28028 - RNA, 22 nt, Homo sapiens
aauuaguaaccuaauuccaucu

SEQ ID NO: 28029 - RNA, 22 nt, Homo sapiens
aauuaguugucgugagaguggu

SEQ ID NO: 28030 - RNA, 22 nt, Homo sapiens
aauucuguauuguuuagggacu

SEQ ID NO: 28031 - RNA, 22 nt, Homo sapiens
aauugcaauggacaaugcagca

SEQ ID NO: 28032 - RNA, 23 nt, Homo sapiens
aauugcacauuccuugcuggcag

SEQ ID NO: 28033 - RNA, 22 nt, Homo sapiens
aauugcacuggaaguaacugag

SEQ ID NO: 28034 - RNA, 22 nt, Homo sapiens
aauugccucaagugaucauggc

SEQ ID NO: 28035 - RNA, 22 nt, Homo sapiens
aauugcuucuguauuuuggaca

SEQ ID NO: 28036 - RNA, 22 nt, Homo sapiens
aauuguacucccaucauuccua

SEQ ID NO: 28037 - RNA, 16 nt, Homo sapiens
acaaagcuggcuaucu

SEQ ID NO: 28038 - RNA, 22 nt, Homo sapiens
acaaaguauggaauguuggugu

SEQ ID NO: 28039 - RNA, 22 nt, Homo sapiens
acaaagugccuccuuuuagagu

SEQ ID NO: 28040 - RNA, 22 nt, Homo sapiens
acaagugaauacaggauucucu

SEQ ID NO: 28041 - RNA, 22 nt, Homo sapiens
acaauggaauggaguggaaagu

SEQ ID NO: 28042 - RNA, 23 nt, Homo sapiens
acacaguaaacuaaaagcuagcu

SEQ ID NO: 28043 - RNA, 22 nt, Homo sapiens
acacaguaaauauguauugaau

SEQ ID NO: 28044 - RNA, 22 nt, Homo sapiens
acacucuaguguucuuaaucag

SEQ ID NO: 28045 - RNA, 22 nt, Homo sapiens
acacucucucauuacuuguuug

SEQ ID NO: 28046 - RNA, 22 nt, Homo sapiens
acacuguacuuauguuuugcag

SEQ ID NO: 28047 - RNA, 22 nt, Homo sapiens
acacugucucuugcugaccaug

SEQ ID NO: 28048 - RNA, 22 nt, Homo sapiens
acacuguuuuguggagaaugua

SEQ ID NO: 28049 - RNA, 22 nt, Homo sapiens
acagaauucucagaacugggag

SEQ ID NO: 28050 - RNA, 22 nt, Homo sapiens
acagagcaaugagcuacggucu

SEQ ID NO: 28051 - RNA, 19 nt, Homo sapiens
acagauagaauguucuaca

SEQ ID NO: 28052 - RNA, 20 nt, Homo sapiens
acagcauagccuuuuaaagc

SEQ ID NO: 28053 - RNA, 22 nt, Homo sapiens
acagccauuccagccaaauacu

SEQ ID NO: 28054 - RNA, 22 nt, Homo sapiens
acaggagugggauuugaguccu

SEQ ID NO: 28055 - RNA, 22 nt, Homo sapiens
acagguacacagaauauccaga

SEQ ID NO: 28056 - RNA, 22 nt, Homo sapiens
acaggugaaguauuacacuaag

SEQ ID NO: 28057 - RNA, 22 nt, Homo sapiens
acaguacucugcucuuuugauu

SEQ ID NO: 28058 - RNA, 22 nt, Homo sapiens
acaguacuguuguuugcugcca

SEQ ID NO: 28059 - RNA, 22 nt, Homo sapiens
acagugacagaaagcugauuau

SEQ ID NO: 28060 - RNA, 18 nt, Homo sapiens
acagugcuggcaugagau

SEQ ID NO: 28061 - RNA, 22 nt, Homo sapiens
acagugcuguggucaugggucu

SEQ ID NO: 28062 - RNA, 22 nt, Homo sapiens
acaguggaauguaggguuugag

SEQ ID NO: 28063 - RNA, 22 nt, Homo sapiens
acaguggugcgaucucggcuca

SEQ ID NO: 28064 - RNA, 22 nt, Homo sapiens
aggaaguaauaaguuugguucu

SEQ ID NO: 28065 - RNA, 22 nt, Homo sapiens
aggaagugucuucuuuuaggca

SEQ ID NO: 28066 - RNA, 22 nt, Homo sapiens
aggaaugucaaugguaguuuaa

SEQ ID NO: 28067 - RNA, 22 nt, Homo sapiens
aggagaauugguucuucuugau

SEQ ID NO: 28068 - RNA, 21 nt, Homo sapiens
aggagcauucucuugcuuugu

SEQ ID NO: 28069 - RNA, 22 nt, Homo sapiens
aggagguaggaauugugcuagg

SEQ ID NO: 28070 - RNA, 22 nt, Homo sapiens
aggauacugguaugggcugaau

SEQ ID NO: 28071 - RNA, 22 nt, Homo sapiens
aggauaguaaugauagagaggc

SEQ ID NO: 28072 - RNA, 21 nt, Homo sapiens
aggcaagauuacuuacgagca

SEQ ID NO: 28073 - RNA, 21 nt, Homo sapiens
aggcaagguguuauuauugaa

SEQ ID NO: 28074 - RNA, 22 nt, Homo sapiens
aggcaagugggagacagcauuu

SEQ ID NO: 28075 - RNA, 22 nt, Homo sapiens
aggcaaugugagaguuuauuca

SEQ ID NO: 28076 - RNA, 22 nt, Homo sapiens
aggcacacaacccuggaccuga

SEQ ID NO: 28077 - RNA, 22 nt, Homo sapiens
aggcagaugagguccucagcug

SEQ ID NO: 28078 - RNA, 22 nt, Homo sapiens
aggcagcuguuauauacugagu

SEQ ID NO: 28079 - RNA, 22 nt, Homo sapiens
aggcaggugaaagauaguuuua

SEQ ID NO: 28080 - RNA, 22 nt, Homo sapiens
aggcaugaguucagaggguaug

SEQ ID NO: 28081 - RNA, 23 nt, Homo sapiens
aggccaguuuuuccugcuugcug

SEQ ID NO: 28082 - RNA, 22 nt, Homo sapiens
aggccaguuuuuggagggaaac

SEQ ID NO: 28083 - RNA, 22 nt, Homo sapiens
aggcuagacuuugagaauuuuu

SEQ ID NO: 28084 - RNA, 23 nt, Homo sapiens
agggcacuauagauguuauucua

SEQ ID NO: 28085 - RNA, 22 nt, Homo sapiens
agguaagaugugacuugguguu

SEQ ID NO: 28086 - RNA, 22 nt, Homo sapiens
agguaauuuucccagagggaaa

SEQ ID NO: 28087 - RNA, 20 nt, Homo sapiens
agguagauagaugauagaua

SEQ ID NO: 28088 - RNA, 22 nt, Homo sapiens
agguagucuuuuccuauuguca

SEQ ID NO: 28089 - RNA, 20 nt, Homo sapiens
agguaguuauacaaaugugu

SEQ ID NO: 28090 - RNA, 22 nt, Homo sapiens
agguauauuggacagauguaaa

SEQ ID NO: 28091 - RNA, 22 nt, Homo sapiens
aggugacugguuuaucuggcag

SEQ ID NO: 28092 - RNA, 22 nt, Homo sapiens
aggugcugacaggauagguuuc

SEQ ID NO: 28093 - RNA, 22 nt, Homo sapiens
agguguuguugaggagauuuca

SEQ ID NO: 28094 - RNA, 22 nt, Homo sapiens
agguuguguuugugauuagaua

SEQ ID NO: 28095 - RNA, 22 nt, Homo sapiens
agguuuucagccccagccuagg

SEQ ID NO: 28096 - RNA, 22 nt, Homo sapiens
aguaacaggauccaaagaaugu

SEQ ID NO: 28097 - RNA, 22 nt, Homo sapiens
aguaagauggcaacucuccaca

SEQ ID NO: 28098 - RNA, 22 nt, Homo sapiens
aguacaauguugaguagaagug

SEQ ID NO: 28099 - RNA, 22 nt, Homo sapiens
aguaccauuacucacuuauuuu

SEQ ID NO: 28100 - RNA, 22 nt, Homo sapiens
aguagcaauggcucugagcuau

SEQ ID NO: 28101 - RNA, 22 nt, Homo sapiens
aguagguguugguagagguuuc

SEQ ID NO: 28102 - RNA, 16 nt, Homo sapiens
aguaguuuuacagauu

SEQ ID NO: 28103 - RNA, 22 nt, Homo sapiens
aguaucaagccacacaugguca

SEQ ID NO: 28104 - RNA, 22 nt, Homo sapiens
aguaucacaguggguguauacc

SEQ ID NO: 28105 - RNA, 22 nt, Homo sapiens
agucaaaugcuuauguauaaag

SEQ ID NO: 28106 - RNA, 22 nt, Homo sapiens
agucaagaaucucagcaucuuu

SEQ ID NO: 28107 - RNA, 22 nt, Homo sapiens
agucacaugcauuuucuucaau

SEQ ID NO: 28108 - RNA, 22 nt, Homo sapiens
agucacaugccagcacacccag

SEQ ID NO: 28109 - RNA, 22 nt, Homo sapiens
agucagauuggcauuuguuggg

SEQ ID NO: 28110 - RNA, 22 nt, Homo sapiens
agucaugguaguaaauuuggac

SEQ ID NO: 28111 - RNA, 19 nt, Homo sapiens
agucaugugaggacccuug

SEQ ID NO: 28112 - RNA, 22 nt, Homo sapiens
aguccagguuuuguaauggcaa

SEQ ID NO: 28113 - RNA, 22 nt, Homo sapiens
agugaaaucugaagaaggucau

SEQ ID NO: 28114 - RNA, 22 nt, Homo sapiens
agugacaugggaucaaaucuga

SEQ ID NO: 28115 - RNA, 19 nt, Homo sapiens
agugagccaagauccuacc

SEQ ID NO: 28116 - RNA, 22 nt, Homo sapiens
agugcauuugcaucucaauaua

SEQ ID NO: 28117 - RNA, 22 nt, Homo sapiens
acugcauuugguaaagucaaga

SEQ ID NO: 28118 - RNA, 22 nt, Homo sapiens
acuggcuguuaggaauuaccuc

SEQ ID NO: 28119 - RNA, 22 nt, Homo sapiens
acuggcuuauuucacuuagcau

SEQ ID NO: 28120 - RNA, 22 nt, Homo sapiens
acuggcuuuugagaaaaacacu

SEQ ID NO: 28121 - RNA, 22 nt, Homo sapiens
acugggauauuauugguaauau

SEQ ID NO: 28122 - RNA, 22 nt, Homo sapiens
acuggguuaauuugaagguuga

SEQ ID NO: 28123 - RNA, 22 nt, Homo sapiens
acugguguaugggaggucccaa

SEQ ID NO: 28124 - RNA, 22 nt, Homo sapiens
acuguacuccauccugggugac

SEQ ID NO: 28125 - RNA, 22 nt, Homo sapiens
acuguacugucuggggcagucu

SEQ ID NO: 28126 - RNA, 22 nt, Homo sapiens
acuguauagauggaguugauuu

SEQ ID NO: 28127 - RNA, 22 nt, Homo sapiens
acuuggcaaaguuuuaaacagc

SEQ ID NO: 28128 - RNA, 21 nt, Homo sapiens
acuuucuguggcaguccauuc

SEQ ID NO: 28129 - RNA, 22 nt, Homo sapiens
acuuuuguuauacagugugaua

SEQ ID NO: 28130 - RNA, 20 nt, Homo sapiens
acuuuuugaugaggucguuu

SEQ ID NO: 28131 - RNA, 22 nt, Homo sapiens
agaaagcgcuucccuuugcugg

SEQ ID NO: 28132 - RNA, 22 nt, Homo sapiens
agaaagugcuucccuuugguga

SEQ ID NO: 28133 - RNA, 22 nt, Homo sapiens
agaacacugaguucagggucag

SEQ ID NO: 28134 - RNA, 22 nt, Homo sapiens
agaauaauguccccccaaggga

SEQ ID NO: 28135 - RNA, 19 nt, Homo sapiens
agaaucuaaauuauuucug

SEQ ID NO: 28136 - RNA, 22 nt, Homo sapiens
agaauguauauucuguaguugu

SEQ ID NO: 28137 - RNA, 22 nt, Homo sapiens
agaaugucaguauuggcuaaaa

SEQ ID NO: 28138 - RNA, 22 nt, Homo sapiens
agaauucugucauguuuauauu

SEQ ID NO: 28139 - RNA, 20 nt, Homo sapiens
agacagcugcagcccacauc

SEQ ID NO: 28140 - RNA, 20 nt, Homo sapiens
agacuagggagcagaaagcc

SEQ ID NO: 28141 - RNA, 22 nt, Homo sapiens
agacucauuuccauagucagcu

SEQ ID NO: 28142 - RNA, 22 nt, Homo sapiens
agacucauuuuuaucgagcaug

SEQ ID NO: 28143 - RNA, 23 nt, Homo sapiens
agacugaaguaucugagacucag

SEQ ID NO: 28144 - RNA, 22 nt, Homo sapiens
agacuguaaugcauaauuuacu

SEQ ID NO: 28145 - RNA, 22 nt, Homo sapiens
agagaacugauuggaguugggc

SEQ ID NO: 28146 - RNA, 22 nt, Homo sapiens
agagaacuggcuucaccauucu

SEQ ID NO: 28147 - RNA, 22 nt, Homo sapiens
agagagcuugggguguuaaauu

SEQ ID NO: 28148 - RNA, 22 nt, Homo sapiens
agagagguggguggagccccca

SEQ ID NO: 28149 - RNA, 22 nt, Homo sapiens
agagauccucauuuuauagaca

SEQ ID NO: 28150 - RNA, 22 nt, Homo sapiens
agagaugauuaacauuuuggua

SEQ ID NO: 28151 - RNA, 22 nt, Homo sapiens
agagauuauccuggcuucucug

SEQ ID NO: 28152 - RNA, 20 nt, Homo sapiens
agagcaaagccgcaccccua

SEQ ID NO: 28153 - RNA, 22 nt, Homo sapiens
agagcacugcugcaggguucug

SEQ ID NO: 28154 - RNA, 22 nt, Homo sapiens
agagcacuguggguccaaauau

SEQ ID NO: 28155 - RNA, 22 nt, Homo sapiens
agagguauuggaaggaguguca

SEQ ID NO: 28156 - RNA, 22 nt, Homo sapiens
agagguuuugcacugguucuuu

SEQ ID NO: 28157 - RNA, 22 nt, Homo sapiens
agaguacaggcaaguuagucau

SEQ ID NO: 28158 - RNA, 22 nt, Homo sapiens
agaguauagcaacuuaguaaaa

SEQ ID NO: 28159 - RNA, 19 nt, Homo sapiens
agaguauuguuacuucucu

SEQ ID NO: 28160 - RNA, 22 nt, Homo sapiens
agagugcaaagguuggggcugg

SEQ ID NO: 28161 - RNA, 22 nt, Homo sapiens
agagugcuaaggaaguaauuua

SEQ ID NO: 28162 - RNA, 22 nt, Homo sapiens
agauacaucuaugugucugugu

SEQ ID NO: 28163 - RNA, 22 nt, Homo sapiens
agauauguuauugauguuaaug

SEQ ID NO: 28164 - RNA, 22 nt, Homo sapiens
agauauuuguuaggucugucag

SEQ ID NO: 28165 - RNA, 22 nt, Homo sapiens
auugaacuuuugucacugacau

SEQ ID NO: 28166 - RNA, 22 nt, Homo sapiens
auugaaucuaaaaugagucucu

SEQ ID NO: 28167 - RNA, 23 nt, Homo sapiens
auugauagugccuuugugcuaau

SEQ ID NO: 28168 - RNA, 19 nt, Homo sapiens
auugauuaaguuugcuguc

SEQ ID NO: 28169 - RNA, 22 nt, Homo sapiens
auugcaaugggaaacuaugaaa

SEQ ID NO: 28170 - RNA, 22 nt, Homo sapiens
auugcacaaagagggaaacuga

SEQ ID NO: 28171 - RNA, 21 nt, Homo sapiens
auugcacaauauacccaugua

SEQ ID NO: 28172 - RNA, 22 nt, Homo sapiens
auugcacaccagucugggcaaa

SEQ ID NO: 28173 - RNA, 22 nt, Homo sapiens
auugcacaucugcacuacagcc

SEQ ID NO: 28174 - RNA, 22 nt, Homo sapiens
auugcacuccagccuaggcaac

SEQ ID NO: 28175 - RNA, 22 nt, Homo sapiens
auugcacuccagccuggcagca

SEQ ID NO: 28176 - RNA, 22 nt, Homo sapiens
auugcacuccagccugggcaac

SEQ ID NO: 28177 - RNA, 21 nt, Homo sapiens
auugcacuccagccugggcga

SEQ ID NO: 28178 - RNA, 22 nt, Homo sapiens
auugcacucuagccuuggcgac

SEQ ID NO: 28179 - RNA, 22 nt, Homo sapiens
auugcacuggggguuagaauuu

SEQ ID NO: 28180 - RNA, 22 nt, Homo sapiens
auugcagauucgcuuuguguug

SEQ ID NO: 28181 - RNA, 22 nt, Homo sapiens
auugcagcuugcagggugugua

SEQ ID NO: 28182 - RNA, 19 nt, Homo sapiens
auugcaguguaaaacuauu

SEQ ID NO: 28183 - RNA, 22 nt, Homo sapiens
auugcaguuucaacuccagggc

SEQ ID NO: 28184 - RNA, 22 nt, Homo sapiens
auugcauaaacacauuucuuau

SEQ ID NO: 28185 - RNA, 22 nt, Homo sapiens
auugcccaggcuggagugcagu

SEQ ID NO: 28186 - RNA, 18 nt, Homo sapiens
auugcccucauggggcuu

SEQ ID NO: 28187 - RNA, 22 nt, Homo sapiens
auugcuaacugaaauaagacca

SEQ ID NO: 28188 - RNA, 22 nt, Homo sapiens
auugcucaaaucaguacuugag

SEQ ID NO: 28189 - RNA, 22 nt, Homo sapiens
auuggaguuguacgcacgcuca

SEQ ID NO: 28190 - RNA, 22 nt, Homo sapiens
auuggcagaaaucuuuauagua

SEQ ID NO: 28191 - RNA, 22 nt, Homo sapiens
auuguacauacaccggugugua

SEQ ID NO: 28192 - RNA, 22 nt, Homo sapiens
auugucacuuaaaagugcaugu

SEQ ID NO: 28193 - RNA, 22 nt, Homo sapiens
auugucauuuucugagaaguaa

SEQ ID NO: 28194 - RNA, 22 nt, Homo sapiens
auuuagcaauggagguagugua

SEQ ID NO: 28195 - RNA, 22 nt, Homo sapiens
auuuaugguuaauauaggaagu

SEQ ID NO: 28196 - RNA, 22 nt, Homo sapiens
auuuggcaguauaaugcuuugg

SEQ ID NO: 28197 - RNA, 22 nt, Homo sapiens
auuuguccugccuuuuccuccu

SEQ ID NO: 28198 - RNA, 18 nt, Homo sapiens
auuuuugcaguccacaug

SEQ ID NO: 28199 - RNA, 22 nt, Homo sapiens
auuuuugguuucaccugcacgc

SEQ ID NO: 28200 - RNA, 22 nt, Homo sapiens
caaaggcuucugaaacugcaga

SEQ ID NO: 28201 - RNA, 22 nt, Homo sapiens
caaaggugcuuuccagguccaa

SEQ ID NO: 28202 - RNA, 22 nt, Homo sapiens
caaaguaauuacgguuuuggcc

SEQ ID NO: 28203 - RNA, 22 nt, Homo sapiens
caaaguaauugcuguuuugcca

SEQ ID NO: 28204 - RNA, 22 nt, Homo sapiens
caaauccucaccucaucaugaa

SEQ ID NO: 28205 - RNA, 22 nt, Homo sapiens
caaaugacaucauuucauucaa

SEQ ID NO: 28206 - RNA, 22 nt, Homo sapiens
caacacagugaaacccgucucu

SEQ ID NO: 28207 - RNA, 22 nt, Homo sapiens
caacacuguuuauuggauagcc

SEQ ID NO: 28208 - RNA, 22 nt, Homo sapiens
caaccguagauuguucugggcu

SEQ ID NO: 28209 - RNA, 22 nt, Homo sapiens
caagacuguccaacauauuggg

SEQ ID NO: 28210 - RNA, 22 nt, Homo sapiens
caagagagcugaugguuuuaaa

SEQ ID NO: 28211 - RNA, 22 nt, Homo sapiens
caagaucauuuaugcuaaaauu

SEQ ID NO: 28212 - RNA, 22 nt, Homo sapiens
caaggaauucucaauagaguua

SEQ ID NO: 28213 - RNA, 22 nt, Homo sapiens
caaggcacagccccuacuuccu

SEQ ID NO: 28214 - RNA, 22 nt, Homo sapiens
caagggguggaaaugguagugu

SEQ ID NO: 28215 - RNA, 22 nt, Homo sapiens
agcuuguauuuguagccuguug

SEQ ID NO: 28216 - RNA, 22 nt, Homo sapiens
agcuugugauuuagagugagag

SEQ ID NO: 28217 - RNA, 22 nt, Homo sapiens
agcuugugcuguaugaagggcc

SEQ ID NO: 28218 - RNA, 22 nt, Homo sapiens
agcuuuuugggcagcuauugac

SEQ ID NO: 28219 - RNA, 22 nt, Homo sapiens
aggaaaucuuagcugaggggau

SEQ ID NO: 28220 - RNA, 16 nt, Homo sapiens
aggaagacuuagagau

SEQ ID NO: 28221 - RNA, 22 nt, Homo sapiens
aggaagcuagcauuuguucagu

SEQ ID NO: 28222 - RNA, 23 nt, Homo sapiens
aggaaguaacuaucuuuucuguc

SEQ ID NO: 28223 - RNA, 23 nt, Homo sapiens
aggaauggaaaaccaaguaucau

SEQ ID NO: 28224 - RNA, 22 nt, Homo sapiens
aggaauggaaacuuuugauggu

SEQ ID NO: 28225 - RNA, 22 nt, Homo sapiens
aggacacugauagucuuuggca

SEQ ID NO: 28226 - RNA, 22 nt, Homo sapiens
aggaccauuguguagcagacau

SEQ ID NO: 28227 - RNA, 22 nt, Homo sapiens
aggagaugaagcuuuaucuaaa

SEQ ID NO: 28228 - RNA, 22 nt, Homo sapiens
aggagcacaauggucaugugga

SEQ ID NO: 28229 - RNA, 18 nt, Homo sapiens
aggagcauagugcuauga

SEQ ID NO: 28230 - RNA, 21 nt, Homo sapiens
aggagcauucaugacgagguu

SEQ ID NO: 28231 - RNA, 21 nt, Homo sapiens
aggagcauuguugugguggag

SEQ ID NO: 28232 - RNA, 22 nt, Homo sapiens
aggagguugguaccaucuguuu

SEQ ID NO: 28233 - RNA, 22 nt, Homo sapiens
aggauuagagacuucucuaccu

SEQ ID NO: 28234 - RNA, 21 nt, Homo sapiens
aggcaaaugaagcagccgcuc

SEQ ID NO: 28235 - RNA, 22 nt, Homo sapiens
aggcagucucugccggcugagg

SEQ ID NO: 28236 - RNA, 22 nt, Homo sapiens
aggcagucugaguuuugaaagg

SEQ ID NO: 28237 - RNA, 22 nt, Homo sapiens
aggcaguuucagugagagguga

SEQ ID NO: 28238 - RNA, 22 nt, Homo sapiens
aggcaugauggcuccagaucau

SEQ ID NO: 28239 - RNA, 22 nt, Homo sapiens
aggcauggagacuaaaauuaua

SEQ ID NO: 28240 - RNA, 22 nt, Homo sapiens
aggcaugguggcacauacaugu

SEQ ID NO: 28241 - RNA, 19 nt, Homo sapiens
aggcauugugcucaucugu

SEQ ID NO: 28242 - RNA, 22 nt, Homo sapiens
aggcuguguggauaauauuggg

SEQ ID NO: 28243 - RNA, 22 nt, Homo sapiens
aggcuuuauuacagggucucag

SEQ ID NO: 28244 - RNA, 22 nt, Homo sapiens
agggaagugugcuaugcauuua

SEQ ID NO: 28245 - RNA, 22 nt, Homo sapiens
agggaauguaaguuuuaugaga

SEQ ID NO: 28246 - RNA, 22 nt, Homo sapiens
agggcaagacuuguuaagaaca

SEQ ID NO: 28247 - RNA, 22 nt, Homo sapiens
agggcauuguacaaaucaucau

SEQ ID NO: 28248 - RNA, 22 nt, Homo sapiens
agggccuuuguagauguacuca

SEQ ID NO: 28249 - RNA, 22 nt, Homo sapiens
agggcuuuugagcugagauggu

SEQ ID NO: 28250 - RNA, 22 nt, Homo sapiens
agguaauuuuaucauuauguga

SEQ ID NO: 28251 - RNA, 22 nt, Homo sapiens
agguacuugagauucugaacug

SEQ ID NO: 28252 - RNA, 22 nt, Homo sapiens
agguagugugaugcuccuguuu

SEQ ID NO: 28253 - RNA, 21 nt, Homo sapiens
aggucaugaagauguucuaau

SEQ ID NO: 28254 - RNA, 22 nt, Homo sapiens
agguccauugguauuauagcau

SEQ ID NO: 28255 - RNA, 22 nt, Homo sapiens
aggucccauguccucccugacc

SEQ ID NO: 28256 - RNA, 22 nt, Homo sapiens
aggugcaugcuucacuggauau

SEQ ID NO: 28257 - RNA, 22 nt, Homo sapiens
aggugcuugaaucuaugagcuc

SEQ ID NO: 28258 - RNA, 22 nt, Homo sapiens
aggugcuugagggaagaaauua

SEQ ID NO: 28259 - RNA, 22 nt, Homo sapiens
aggugguuuugaugagcaggua

SEQ ID NO: 28260 - RNA, 22 nt, Homo sapiens
aggugguuuuucaacacacacu

SEQ ID NO: 28261 - RNA, 22 nt, Homo sapiens
aguaaagccagaccuguuaauu

SEQ ID NO: 28262 - RNA, 22 nt, Homo sapiens
aguacaucuggcuggauagaua

SEQ ID NO: 28263 - RNA, 22 nt, Homo sapiens
aguaccauuugacaugggaccc

SEQ ID NO: 28264 - RNA, 22 nt, Homo sapiens
aguacugucugguuaccugaca

SEQ ID NO: 28265 - RNA, 22 nt, Homo sapiens
aguaucacaagguguacaccca

SEQ ID NO: 28266 - RNA, 22 nt, Homo sapiens
caccacuacaccccaggcuggg

SEQ ID NO: 28267 - RNA, 22 nt, Homo sapiens
caccagcuggcauugaauaccu

SEQ ID NO: 28268 - RNA, 22 nt, Homo sapiens
caccagguggcugaggccauga

SEQ ID NO: 28269 - RNA, 22 nt, Homo sapiens
caccauguguucagaaggauug

SEQ ID NO: 28270 - RNA, 22 nt, Homo sapiens
cacccaguaagcaugaggcccu

SEQ ID NO: 28271 - RNA, 22 nt, Homo sapiens
caccccuaccugagucaggagu

SEQ ID NO: 28272 - RNA, 22 nt, Homo sapiens
caccugagcgggaugcucgccu

SEQ ID NO: 28273 - RNA, 22 nt, Homo sapiens
cacugcacuccagucccgucuc

SEQ ID NO: 28274 - RNA, 22 nt, Homo sapiens
cacugcacuccagucugacgac

SEQ ID NO: 28275 - RNA, 22 nt, Homo sapiens
cacugcacuccaguuuggauga

SEQ ID NO: 28276 - RNA, 22 nt, Homo sapiens
cacugcacucuucuucugggca

SEQ ID NO: 28277 - RNA, 22 nt, Homo sapiens
cacugcaguaaauugcgucggu

SEQ ID NO: 28278 - RNA, 22 nt, Homo sapiens
cacugcauggucuagcuggguu

SEQ ID NO: 28279 - RNA, 22 nt, Homo sapiens
cacugcauucuccaccucccag

SEQ ID NO: 28280 - RNA, 22 nt, Homo sapiens
cacugcgaccuccaccucccgg

SEQ ID NO: 28281 - RNA, 22 nt, Homo sapiens
cacuggcacuguguuuagaugg

SEQ ID NO: 28282 - RNA, 22 nt, Homo sapiens
cacuggucucauggcaugagag

SEQ ID NO: 28283 - RNA, 21 nt, Homo sapiens
cacugguguugcuauaucaaa

SEQ ID NO: 28284 - RNA, 18 nt, Homo sapiens
cacuuggcuuugccccuc

SEQ ID NO: 28285 - RNA, 22 nt, Homo sapiens
cagacaugucuuguggccgugg

SEQ ID NO: 28286 - RNA, 22 nt, Homo sapiens
cagagaacauucagagcuguag

SEQ ID NO: 28287 - RNA, 22 nt, Homo sapiens
cagagaacugaguuauuuucuu

SEQ ID NO: 28288 - RNA, 22 nt, Homo sapiens
cagagagcuugcccuuguauau

SEQ ID NO: 28289 - RNA, 22 nt, Homo sapiens
cagauacucauggaacuggguu

SEQ ID NO: 28290 - RNA, 22 nt, Homo sapiens
cagaugguggucccacagccca

SEQ ID NO: 28291 - RNA, 22 nt, Homo sapiens
cagcacauuacaaguacuuggu

SEQ ID NO: 28292 - RNA, 22 nt, Homo sapiens
cagcgaggucugcgucacauug

SEQ ID NO: 28293 - RNA, 22 nt, Homo sapiens
cagcuaguaauuuauugaagau

SEQ ID NO: 28294 - RNA, 22 nt, Homo sapiens
cagcugaugucgaaugcacucu

SEQ ID NO: 28295 - RNA, 22 nt, Homo sapiens
cagcugcuuuggaaaauauuuu

SEQ ID NO: 28296 - RNA, 23 nt, Homo sapiens
cagcuggugauuuuaaguugaag

SEQ ID NO: 28297 - RNA, 22 nt, Homo sapiens
cagcuguuguugggguauagga

SEQ ID NO: 28298 - RNA, 22 nt, Homo sapiens
cagcuugugguauugcugguug

SEQ ID NO: 28299 - RNA, 22 nt, Homo sapiens
caggaaugugaggguucccugc

SEQ ID NO: 28300 - RNA, 22 nt, Homo sapiens
caggcaaggugaaguguacugg

SEQ ID NO: 28301 - RNA, 22 nt, Homo sapiens
caggcacgcuugggagacacac

SEQ ID NO: 28302 - RNA, 22 nt, Homo sapiens
cagggcaugugggucuauuggc

SEQ ID NO: 28303 - RNA, 22 nt, Homo sapiens
auggcagcaccccacucuacug

SEQ ID NO: 28304 - RNA, 22 nt, Homo sapiens
auggcaguguaugauuauauua

SEQ ID NO: 28305 - RNA, 22 nt, Homo sapiens
auggcaguuuauucuaaaucaa

SEQ ID NO: 28306 - RNA, 22 nt, Homo sapiens
auggcauggugaagucuuugga

SEQ ID NO: 28307 - RNA, 22 nt, Homo sapiens
auggccuaugacagguauguug

SEQ ID NO: 28308 - RNA, 22 nt, Homo sapiens
auggccuuucuggcacauuucc

SEQ ID NO: 28309 - RNA, 22 nt, Homo sapiens
auggcggugugggcggugcagc

SEQ ID NO: 28310 - RNA, 22 nt, Homo sapiens
auggcguggagauauggucagc

SEQ ID NO: 28311 - RNA, 22 nt, Homo sapiens
auggcuauucuucuuuugucag

SEQ ID NO: 28312 - RNA, 22 nt, Homo sapiens
auggcucaauucuuucccugaa

SEQ ID NO: 28313 - RNA, 22 nt, Homo sapiens
auggcucuguuccaugugucuu

SEQ ID NO: 28314 - RNA, 22 nt, Homo sapiens
auggcucuuauuauuugaggua

SEQ ID NO: 28315 - RNA, 22 nt, Homo sapiens
auggcugagugauuucaaacag

SEQ ID NO: 28316 - RNA, 22 nt, Homo sapiens
auggcugugagaucgacuuauu

SEQ ID NO: 28317 - RNA, 22 nt, Homo sapiens
auggcuguuuuuuauguuacag

SEQ ID NO: 28318 - RNA, 22 nt, Homo sapiens
auggcuucuucuaaaagugggg

SEQ ID NO: 28319 - RNA, 22 nt, Homo sapiens
auggcuuguuaugcauuaguac

SEQ ID NO: 28320 - RNA, 22 nt, Homo sapiens
auggcuuuaagagugucugaau

SEQ ID NO: 28321 - RNA, 22 nt, Homo sapiens
auggcuuucaggacguggcgag

SEQ ID NO: 28322 - RNA, 22 nt, Homo sapiens
auggcuuuguguucagagcuga

SEQ ID NO: 28323 - RNA, 22 nt, Homo sapiens
augggcacugauguauucugug

SEQ ID NO: 28324 - RNA, 22 nt, Homo sapiens
augggguaggcuugcuguagua

SEQ ID NO: 28325 - RNA, 22 nt, Homo sapiens
augguaagcugaaaauaucgaa

SEQ ID NO: 28326 - RNA, 22 nt, Homo sapiens
augguacucucuugucugcaaa

SEQ ID NO: 28327 - RNA, 22 nt, Homo sapiens
augguaguagaugugugguuuu

SEQ ID NO: 28328 - RNA, 22 nt, Homo sapiens
augguauuuaacagucuuucua

SEQ ID NO: 28329 - RNA, 22 nt, Homo sapiens
auggucuuuucccuggauuaua

SEQ ID NO: 28330 - RNA, 21 nt, Homo sapiens
auggugagaaaguagugucaa

SEQ ID NO: 28331 - RNA, 22 nt, Homo sapiens
auguaacaguauuuggagaugu

SEQ ID NO: 28332 - RNA, 21 nt, Homo sapiens
auguaaugaagaagccacugg

SEQ ID NO: 28333 - RNA, 20 nt, Homo sapiens
auguaauguaugauauguac

SEQ ID NO: 28334 - RNA, 22 nt, Homo sapiens
auguaauugagguuuuugccau

SEQ ID NO: 28335 - RNA, 22 nt, Homo sapiens
auguaguagcagaaaauauuuu

SEQ ID NO: 28336 - RNA, 22 nt, Homo sapiens
auguagugugauuuucacuaga

SEQ ID NO: 28337 - RNA, 22 nt, Homo sapiens
augucaacauagacaguagagu

SEQ ID NO: 28338 - RNA, 22 nt, Homo sapiens
augucacagguccuagccaagu

SEQ ID NO: 28339 - RNA, 20 nt, Homo sapiens
augucagaguguggguacgg

SEQ ID NO: 28340 - RNA, 22 nt, Homo sapiens
augucauagaagccugugaacc

SEQ ID NO: 28341 - RNA, 21 nt, Homo sapiens
augucauggaugacuaauuca

SEQ ID NO: 28342 - RNA, 22 nt, Homo sapiens
augucuuucauagagacccaga

SEQ ID NO: 28343 - RNA, 22 nt, Homo sapiens
augugacugauggagaauaugu

SEQ ID NO: 28344 - RNA, 22 nt, Homo sapiens
augugacuugugaaaaguucag

SEQ ID NO: 28345 - RNA, 22 nt, Homo sapiens
augugcaauguguacguagccc

SEQ ID NO: 28346 - RNA, 21 nt, Homo sapiens
augugcacuaugucauuuaau

SEQ ID NO: 28347 - RNA, 20 nt, Homo sapiens
augugcaguguggcaaccaa

SEQ ID NO: 28348 - RNA, 20 nt, Homo sapiens
augugcuaauauuaauaugu

SEQ ID NO: 28349 - RNA, 22 nt, Homo sapiens
auguggcacuugacuuucucgc

SEQ ID NO: 28350 - RNA, 22 nt, Homo sapiens
auguggcuuuucaacuguguga

SEQ ID NO: 28351 - RNA, 22 nt, Homo sapiens
auguggugguagccaggacagg

SEQ ID NO: 28352 - RNA, 23 nt, Homo sapiens
augugguuuuagguguugaacug

SEQ ID NO: 28353 - RNA, 22 nt, Homo sapiens
auguuaacaucuuaguuuucau

SEQ ID NO: 28354 - RNA, 22 nt, Homo sapiens
auguuagcaucaauauucauca

SEQ ID NO: 28355 - RNA, 18 nt, Homo sapiens
auguuauguuuguagaag

SEQ ID NO: 28356 - RNA, 20 nt, Homo sapiens
auguucuggaggacagaagc

SEQ ID NO: 28357 - RNA, 22 nt, Homo sapiens
auguuugguaagaauauuguua

SEQ ID NO: 28358 - RNA, 22 nt, Homo sapiens
auuaagugaaugaaguuguucc

SEQ ID NO: 28359 - RNA, 22 nt, Homo sapiens
auuacauagucaaggugucuca

SEQ ID NO: 28360 - RNA, 22 nt, Homo sapiens
auuacuuugcaccaaccuaaua

SEQ ID NO: 28361 - RNA, 22 nt, Homo sapiens
auuagaugguuauaggugugag

SEQ ID NO: 28362 - RNA, 22 nt, Homo sapiens
auuagguagugagaugcugcug

SEQ ID NO: 28363 - RNA, 22 nt, Homo sapiens
auuagguuagugcaaaaguaau

SEQ ID NO: 28364 - RNA, 22 nt, Homo sapiens
auuauaguguauacuugaaauu

SEQ ID NO: 28365 - RNA, 22 nt, Homo sapiens
auuauauguguaugugcauacc

SEQ ID NO: 28366 - RNA, 22 nt, Homo sapiens
auuaucacaguuuugcauaugg

SEQ ID NO: 28367 - RNA, 22 nt, Homo sapiens
gacguagagaaaugugaaaugg

SEQ ID NO: 28368 - RNA, 22 nt, Homo sapiens
gacuagauauuguucuauguca

SEQ ID NO: 28369 - RNA, 22 nt, Homo sapiens
gacuggagcuguaugugguuac

SEQ ID NO: 28370 - RNA, 20 nt, Homo sapiens
gacuucagaagcuucagagu

SEQ ID NO: 28371 - RNA, 22 nt, Homo sapiens
gacuugaagaaucuaagggagg

SEQ ID NO: 28372 - RNA, 22 nt, Homo sapiens
gacuuugguagaggaaaaaucu

SEQ ID NO: 28373 - RNA, 22 nt, Homo sapiens
gagaacauuuaagccacucagg

SEQ ID NO: 28374 - RNA, 22 nt, Homo sapiens
gagaacuaaugguuugauaagg

SEQ ID NO: 28375 - RNA, 22 nt, Homo sapiens
gagaagugcgucguuugaugau

SEQ ID NO: 28376 - RNA, 21 nt, Homo sapiens
gagaaucaucauggcugcaua

SEQ ID NO: 28377 - RNA, 22 nt, Homo sapiens
gagaaugaacagacugccucuu

SEQ ID NO: 28378 - RNA, 22 nt, Homo sapiens
gagacauguuugcuuaucugag

SEQ ID NO: 28379 - RNA, 22 nt, Homo sapiens
gagacauugacuuuguuccaga

SEQ ID NO: 28380 - RNA, 23 nt, Homo sapiens
gagaccagcuucagaaagcacga

SEQ ID NO: 28381 - RNA, 22 nt, Homo sapiens
gagacugagucucacucuguca

SEQ ID NO: 28382 - RNA, 22 nt, Homo sapiens
gagacugagucucgcucugccg

SEQ ID NO: 28383 - RNA, 22 nt, Homo sapiens
gagacugagucuugcucugucg

SEQ ID NO: 28384 - RNA, 22 nt, Homo sapiens
gagacugaguuuugcucuuguu

SEQ ID NO: 28385 - RNA, 21 nt, Homo sapiens
gagaggauucgccagccucuu

SEQ ID NO: 28386 - RNA, 22 nt, Homo sapiens
gagagugcuuuggguguaggcc

SEQ ID NO: 28387 - RNA, 22 nt, Homo sapiens
gagauaaauaggucacaguucu

SEQ ID NO: 28388 - RNA, 22 nt, Homo sapiens
gagauaggauucacuuucaugu

SEQ ID NO: 28389 - RNA, 22 nt, Homo sapiens
gagauauuauuucccuuucaca

SEQ ID NO: 28390 - RNA, 22 nt, Homo sapiens
gagaucacuguuuauauucucu

SEQ ID NO: 28391 - RNA, 22 nt, Homo sapiens
gagaucaugcugguucucucau

SEQ ID NO: 28392 - RNA, 22 nt, Homo sapiens
gagaucauucugauccagaguc

SEQ ID NO: 28393 - RNA, 22 nt, Homo sapiens
gagaucauugugggccaagcug

SEQ ID NO: 28394 - RNA, 22 nt, Homo sapiens
gagaugaagugucaauaaggau

SEQ ID NO: 28395 - RNA, 22 nt, Homo sapiens
gagaugaaguuaaggaucuuua

SEQ ID NO: 28396 - RNA, 22 nt, Homo sapiens
gagaugaucaugugguuuuguc

SEQ ID NO: 28397 - RNA, 22 nt, Homo sapiens
gagaugguacacauacgauucu

SEQ ID NO: 28398 - RNA, 22 nt, Homo sapiens
gagaugugguucaaggguguuu

SEQ ID NO: 28399 - RNA, 22 nt, Homo sapiens
gagauguuuuguuaucaaagga

SEQ ID NO: 28400 - RNA, 22 nt, Homo sapiens
gagauuauugucucccucacca

SEQ ID NO: 28401 - RNA, 20 nt, Homo sapiens
uguugcacucuagccugggu

SEQ ID NO: 28402 - RNA, 22 nt, Homo sapiens
uguuggacuuacuuggcagauu

SEQ ID NO: 28403 - RNA, 22 nt, Homo sapiens
uguuucuacugucucuguagua

SEQ ID NO: 28404 - RNA, 19 nt, Homo sapiens
uguuuggcuauaggucuaa

SEQ ID NO: 28405 - RNA, 22 nt, Homo sapiens
uguuuuggaggccagaagucca

SEQ ID NO: 28406 - RNA, 22 nt, Homo sapiens
uguuuuggagguccucacuaga

SEQ ID NO: 28407 - RNA, 22 nt, Homo sapiens
uguuuugguugucccuggccag

SEQ ID NO: 28408 - RNA, 21 nt, Homo sapiens
uguuuuugcuguguaucucuc

SEQ ID NO: 28409 - RNA, 22 nt, Homo sapiens
uuaaaagcuaucuccaagguca

SEQ ID NO: 28410 - RNA, 22 nt, Homo sapiens
uuaaaguauaguuccucugguu

SEQ ID NO: 28411 - RNA, 22 nt, Homo sapiens
uuaaaugcuagaauuuucuuug

SEQ ID NO: 28412 - RNA, 22 nt, Homo sapiens
uuaaaugcucacauaaagguag

SEQ ID NO: 28413 - RNA, 22 nt, Homo sapiens
uuaaaugucuguagaugugcug

SEQ ID NO: 28414 - RNA, 22 nt, Homo sapiens
uuaagacaccaaucauuggauu

SEQ ID NO: 28415 - RNA, 22 nt, Homo sapiens
uuaagcaguggauuagaauuuu

SEQ ID NO: 28416 - RNA, 22 nt, Homo sapiens
uuaagccacucaagagauagag

SEQ ID NO: 28417 - RNA, 22 nt, Homo sapiens
uuaaggaguagugucugguauu

SEQ ID NO: 28418 - RNA, 22 nt, Homo sapiens
uuaaggcauucuuugucuucau

SEQ ID NO: 28419 - RNA, 22 nt, Homo sapiens
uuaagggaggagcuucaagaug

SEQ ID NO: 28420 - RNA, 22 nt, Homo sapiens
ugucaaaugcagugauauuuga

SEQ ID NO: 28421 - RNA, 20 nt, Homo sapiens
ugucaagaaacauuacuuau

SEQ ID NO: 28422 - RNA, 21 nt, Homo sapiens
ugucaagaugacugcugcggc

SEQ ID NO: 28423 - RNA, 20 nt, Homo sapiens
ugucaaggaauucccaaauc

SEQ ID NO: 28424 - RNA, 22 nt, Homo sapiens
ugucacccuuuauccauuuccu

SEQ ID NO: 28425 - RNA, 22 nt, Homo sapiens
ugucaccuugcucauccucgga

SEQ ID NO: 28426 - RNA, 22 nt, Homo sapiens
ugucacugugcagucaugcauu

SEQ ID NO: 28427 - RNA, 22 nt, Homo sapiens
ugucagcacaacucagguuccu

SEQ ID NO: 28428 - RNA, 22 nt, Homo sapiens
ugucaggaguuuuagaaucuua

SEQ ID NO: 28429 - RNA, 22 nt, Homo sapiens
ugucaguuucuugagauggaac

SEQ ID NO: 28430 - RNA, 22 nt, Homo sapiens
ugucaguuuuaacuagggaaua

SEQ ID NO: 28431 - RNA, 22 nt, Homo sapiens
ugucauauagaauguucuauga

SEQ ID NO: 28432 - RNA, 22 nt, Homo sapiens
ugucaugaaauauguuuuucua

SEQ ID NO: 28433 - RNA, 22 nt, Homo sapiens
ugucauguaaagaguaaauggu

SEQ ID NO: 28434 - RNA, 22 nt, Homo sapiens
ugucauguggcuaacgauucau

SEQ ID NO: 28435 - RNA, 22 nt, Homo sapiens
ugucauguugguguacugcacc

SEQ ID NO: 28436 - RNA, 22 nt, Homo sapiens
ugucauucaggaaauucuaagu

SEQ ID NO: 28437 - RNA, 22 nt, Homo sapiens
ugucauuguggugcagauauaa

SEQ ID NO: 28438 - RNA, 16 nt, Homo sapiens
uguccaaauaaauaca

SEQ ID NO: 28439 - RNA, 22 nt, Homo sapiens
uguccuggugaugcccaaauuc

SEQ ID NO: 28440 - RNA, 21 nt, Homo sapiens
ugucgugcaggaucuguggga

SEQ ID NO: 28441 - RNA, 21 nt, Homo sapiens
ugucuagaccucauccuacag

SEQ ID NO: 28442 - RNA, 22 nt, Homo sapiens
ugucuaguuuugaaguauagca

SEQ ID NO: 28443 - RNA, 22 nt, Homo sapiens
ugucucaguuucuguggguuag

SEQ ID NO: 28444 - RNA, 22 nt, Homo sapiens
ugucuggaaggguggccuccug

SEQ ID NO: 28445 - RNA, 22 nt, Homo sapiens
ugucuguuugcgaaauugcuuc

SEQ ID NO: 28446 - RNA, 22 nt, Homo sapiens
ugucuugagagaggacaugacu

SEQ ID NO: 28447 - RNA, 22 nt, Homo sapiens
ugucuuggagaauccuggguuu

SEQ ID NO: 28448 - RNA, 22 nt, Homo sapiens
ugucuuugguucaggcaaggag

SEQ ID NO: 28449 - RNA, 22 nt, Homo sapiens
ugugaaaucagauagccuuuuu

SEQ ID NO: 28450 - RNA, 22 nt, Homo sapiens
ugugaacauuuuguauauauua

SEQ ID NO: 28451 - RNA, 22 nt, Homo sapiens
ugugaaugauggagugucgaau

SEQ ID NO: 28452 - RNA, 22 nt, Homo sapiens
ugugaauggugcugcaaugaac

SEQ ID NO: 28453 - RNA, 22 nt, Homo sapiens
ugugaauguaagaaaauccaac

SEQ ID NO: 28454 - RNA, 22 nt, Homo sapiens
ugugacagcacagcaucucuuu

SEQ ID NO: 28455 - RNA, 22 nt, Homo sapiens
ugugacagguagguaauuuuug

SEQ ID NO: 28456 - RNA, 22 nt, Homo sapiens
ugugacaguuaguuugguguua

SEQ ID NO: 28457 - RNA, 21 nt, Homo sapiens
ugugaccucugucucugaguc

SEQ ID NO: 28458 - RNA, 21 nt, Homo sapiens
ugugacuguugcauuugucgu

SEQ ID NO: 28459 - RNA, 20 nt, Homo sapiens
ugugagacugguuuugaacu

SEQ ID NO: 28460 - RNA, 22 nt, Homo sapiens
ugugaugaagaguccaagaaca

SEQ ID NO: 28461 - RNA, 22 nt, Homo sapiens
ugugaugugaugagaaguuccu

SEQ ID NO: 28462 - RNA, 22 nt, Homo sapiens
ugugcaaauuagcacaacccga

SEQ ID NO: 28463 - RNA, 22 nt, Homo sapiens
ugugcaaucagcuucauuacau

SEQ ID NO: 28464 - RNA, 22 nt, Homo sapiens
ugugcauagugugugcggggcg

SEQ ID NO: 28465 - RNA, 22 nt, Homo sapiens
ugugcaugaaauuuaccuuuaa

SEQ ID NO: 28466 - RNA, 22 nt, Homo sapiens
ugugcaugacagcauacaaacg

SEQ ID NO: 28467 - RNA, 22 nt, Homo sapiens
ugugccacuccaaccuggguga

SEQ ID NO: 28468 - RNA, 22 nt, Homo sapiens
ugugccacuccagcucuagcuu

SEQ ID NO: 28469 - RNA, 22 nt, Homo sapiens
ugugccacuccaggaggcuguu

SEQ ID NO: 28470 - RNA, 22 nt, Homo sapiens
ugugccacugcacuccugccug

SEQ ID NO: 28471 - RNA, 22 nt, Homo sapiens
ugugccacugcacuccugggug

SEQ ID NO: 28472 - RNA, 22 nt, Homo sapiens
ugugccacugcacucuggccug

SEQ ID NO: 28473 - RNA, 22 nt, Homo sapiens
ugugccacugcacuucagccug

SEQ ID NO: 28474 - RNA, 22 nt, Homo sapiens
ugugcgcaucggggccugcuuc

SEQ ID NO: 28475 - RNA, 22 nt, Homo sapiens
uguggaaauaaaagaaagguua

SEQ ID NO: 28476 - RNA, 22 nt, Homo sapiens
uguggcucuucuguucuccacu

SEQ ID NO: 28477 - RNA, 22 nt, Homo sapiens
uguggcuuuguaaccauggguc

SEQ ID NO: 28478 - RNA, 22 nt, Homo sapiens
ugugggugguaaaauacaauga

SEQ ID NO: 28479 - RNA, 22 nt, Homo sapiens
ugugguagugcuuaccugcagu

SEQ ID NO: 28480 - RNA, 22 nt, Homo sapiens
uguguaaauacaagugcuugaa

SEQ ID NO: 28481 - RNA, 22 nt, Homo sapiens
uguguaauacucuaaugaugca

SEQ ID NO: 28482 - RNA, 22 nt, Homo sapiens
uguguacaucucuacacacaug

SEQ ID NO: 28483 - RNA, 22 nt, Homo sapiens
uguguagagaaauauuacuuau

SEQ ID NO: 28484 - RNA, 22 nt, Homo sapiens
ugugucacugaggguuagugua

SEQ ID NO: 28485 - RNA, 22 nt, Homo sapiens
ugugucacugcacuccagcgug

SEQ ID NO: 28486 - RNA, 22 nt, Homo sapiens
ugugucuugaauuuuguaugua

SEQ ID NO: 28487 - RNA, 22 nt, Homo sapiens
ugugucuugcuggugccugcau

SEQ ID NO: 28488 - RNA, 22 nt, Homo sapiens
ugugucuuguuuauagcuuucu

SEQ ID NO: 28489 - RNA, 22 nt, Homo sapiens
uguguuugauaaguccauaguu

SEQ ID NO: 28490 - RNA, 22 nt, Homo sapiens
uguguuuuuauguaaaauggaa

SEQ ID NO: 28491 - RNA, 22 nt, Homo sapiens
uguuacagcagaauugaaagag

SEQ ID NO: 28492 - RNA, 22 nt, Homo sapiens
uguuacagcagaauugauugca

SEQ ID NO: 28493 - RNA, 22 nt, Homo sapiens
uguuaucauuacguucuuaguu

SEQ ID NO: 28494 - RNA, 22 nt, Homo sapiens
uguuauguuuuagagguuucaa

SEQ ID NO: 28495 - RNA, 22 nt, Homo sapiens
uguuauugagguuacuuauaag

SEQ ID NO: 28496 - RNA, 22 nt, Homo sapiens
uguucuggagccgguucaaaug

SEQ ID NO: 28497 - RNA, 22 nt, Homo sapiens
uguucuugaguugggaguacaa

SEQ ID NO: 28498 - RNA, 22 nt, Homo sapiens
uguugcaccugccuugcuuuag

SEQ ID NO: 28499 - RNA, 22 nt, Homo sapiens
uguugcuuaagccacccagucu

SEQ ID NO: 28500 - RNA, 22 nt, Homo sapiens
uguuugcuguguggaguagcag

SEQ ID NO: 28501 - RNA, 22 nt, Homo sapiens
uguuuuggaguggacuuugcau

SEQ ID NO: 28502 - RNA, 22 nt, Homo sapiens
uguuuuguuagcacucugggaa

SEQ ID NO: 28503 - RNA, 22 nt, Homo sapiens
uuaaacucaucacccagguagu

SEQ ID NO: 28504 - RNA, 22 nt, Homo sapiens
uuaaacugcuugaauuggguuu

SEQ ID NO: 28505 - RNA, 22 nt, Homo sapiens
uuaaaggcaugguuagacaugg

SEQ ID NO: 28506 - RNA, 22 nt, Homo sapiens
uuaaaguguuuucaaaauguca

SEQ ID NO: 28507 - RNA, 19 nt, Homo sapiens
uggaacugauucaguucug

SEQ ID NO: 28508 - RNA, 22 nt, Homo sapiens
uggaagacacauaccugauaac

SEQ ID NO: 28509 - RNA, 20 nt, Homo sapiens
uggaaggcaucugcauuauu

SEQ ID NO: 28510 - RNA, 22 nt, Homo sapiens
uggaaggucauuguucauuuga

SEQ ID NO: 28511 - RNA, 22 nt, Homo sapiens
uggaaguaaucaugagguagca

SEQ ID NO: 28512 - RNA, 22 nt, Homo sapiens
uggaagugaacaaccaaggcag

SEQ ID NO: 28513 - RNA, 19 nt, Homo sapiens
uggaaugaaauguuagggg

SEQ ID NO: 28514 - RNA, 22 nt, Homo sapiens
uggaaugguaucuuguuggggu

SEQ ID NO: 28515 - RNA, 22 nt, Homo sapiens
uggaaugguuggugugauuuua

SEQ ID NO: 28516 - RNA, 22 nt, Homo sapiens
uggaauguaacuugaaacuuuu

SEQ ID NO: 28517 - RNA, 17 nt, Homo sapiens
uggaaugucuaagccug

SEQ ID NO: 28518 - RNA, 22 nt, Homo sapiens
uggaaugucuuuuccccaaagc

SEQ ID NO: 28519 - RNA, 22 nt, Homo sapiens
uggaauguuuaucaaaacagua

SEQ ID NO: 28520 - RNA, 20 nt, Homo sapiens
uggaccagagagguggggac

SEQ ID NO: 28521 - RNA, 22 nt, Homo sapiens
uuaauguaucuaucacaucaca

SEQ ID NO: 28522 - RNA, 22 nt, Homo sapiens
uuacaaguggcaucucucugga

SEQ ID NO: 28523 - RNA, 22 nt, Homo sapiens
uuacacaguaggucccuaguaa

SEQ ID NO: 28524 - RNA, 22 nt, Homo sapiens
uuacagauggauggcagcuggc

SEQ ID NO: 28525 - RNA, 22 nt, Homo sapiens
uuacaguagaugaggguauaau

SEQ ID NO: 28526 - RNA, 22 nt, Homo sapiens
uuacagucaaguuacauuucuc

SEQ ID NO: 28527 - RNA, 22 nt, Homo sapiens
uuacagucaccugggggacaua

SEQ ID NO: 28528 - RNA, 22 nt, Homo sapiens
uuacagucucaagagugcugca

SEQ ID NO: 28529 - RNA, 22 nt, Homo sapiens
uuacagucuuaggcagugcuuu

SEQ ID NO: 28530 - RNA, 22 nt, Homo sapiens
uuacaguggugaccuuguauug

SEQ ID NO: 28531 - RNA, 22 nt, Homo sapiens
uuacagugguugcuauugugaa

SEQ ID NO: 28532 - RNA, 19 nt, Homo sapiens
uuacagugugcccuuuuag

SEQ ID NO: 28533 - RNA, 22 nt, Homo sapiens
uuacaguucugguggagaggua

SEQ ID NO: 28534 - RNA, 19 nt, Homo sapiens
uuacauccauugcauuuca

SEQ ID NO: 28535 - RNA, 22 nt, Homo sapiens
uuacauguuguggguuguggcc

SEQ ID NO: 28536 - RNA, 22 nt, Homo sapiens
uuaccuugcacugagucugaaa

SEQ ID NO: 28537 - RNA, 22 nt, Homo sapiens
uuacuguauagaaucaucuuga

SEQ ID NO: 28538 - RNA, 22 nt, Homo sapiens
uuacuugagauggggugucacu

SEQ ID NO: 28539 - RNA, 22 nt, Homo sapiens
uuagaacagugcucaccacaaa

SEQ ID NO: 28540 - RNA, 22 nt, Homo sapiens
uuagacaguggugcacugcacu

SEQ ID NO: 28541 - RNA, 20 nt, Homo sapiens
uuagaguaguaugauuuaua

SEQ ID NO: 28542 - RNA, 22 nt, Homo sapiens
uuagaugaagucacagaaccca

SEQ ID NO: 28543 - RNA, 22 nt, Homo sapiens
uuagaugaaugucucuuaaaca

SEQ ID NO: 28544 - RNA, 18 nt, Homo sapiens
uuagaugguuuuaaaacu

SEQ ID NO: 28545 - RNA, 22 nt, Homo sapiens
uuagcacaucuuucuauguaag

SEQ ID NO: 28546 - RNA, 22 nt, Homo sapiens
uuagcaccacacacuuuagagg

SEQ ID NO: 28547 - RNA, 22 nt, Homo sapiens
uuagcacugagaauggcuugcu

SEQ ID NO: 28548 - RNA, 22 nt, Homo sapiens
uuagcagcaucccuggccugua

SEQ ID NO: 28549 - RNA, 22 nt, Homo sapiens
uuagcagcaugaaaauggacug

SEQ ID NO: 28550 - RNA, 22 nt, Homo sapiens
uuagcccaucuugaggaaagua

SEQ ID NO: 28551 - RNA, 22 nt, Homo sapiens
uuaggugcauggaaguguuuuc

SEQ ID NO: 28552 - RNA, 22 nt, Homo sapiens
uuaggugguacacagccccagu

SEQ ID NO: 28553 - RNA, 22 nt, Homo sapiens
uuagguuauuacugacaauaau

SEQ ID NO: 28554 - RNA, 22 nt, Homo sapiens
uuaguaguagcugcaugucagu

SEQ ID NO: 28555 - RNA, 22 nt, Homo sapiens
uuaguaguagugcuguaauuuu

SEQ ID NO: 28556 - RNA, 22 nt, Homo sapiens
uuaguaguaguuugcauuuacc

SEQ ID NO: 28557 - RNA, 22 nt, Homo sapiens
uuaguaucauccuucugcauuc

SEQ ID NO: 28558 - RNA, 22 nt, Homo sapiens
uuagugaaugggugugauuugu

SEQ ID NO: 28559 - RNA, 22 nt, Homo sapiens
uuauaaacaugaagauuugggg

SEQ ID NO: 28560 - RNA, 22 nt, Homo sapiens
uuauacacugugggaguguaaa

SEQ ID NO: 28561 - RNA, 18 nt, Homo sapiens
uuauacuccccaggcaau

SEQ ID NO: 28562 - RNA, 22 nt, Homo sapiens
uuauacucgucugaaugauucu

SEQ ID NO: 28563 - RNA, 19 nt, Homo sapiens
uuauauaguuucugaggcu

SEQ ID NO: 28564 - RNA, 22 nt, Homo sapiens
uuauaugcuaaacaaggggugg

SEQ ID NO: 28565 - RNA, 22 nt, Homo sapiens
uuauauguuuguacuuaggccu

SEQ ID NO: 28566 - RNA, 22 nt, Homo sapiens
uuaucacauugacugauuugca

SEQ ID NO: 28567 - RNA, 22 nt, Homo sapiens
uuaucagcagugcgaaaacaga

SEQ ID NO: 28568 - RNA, 21 nt, Homo sapiens
uuaucccagugucucugcagg

SEQ ID NO: 28569 - RNA, 22 nt, Homo sapiens
uuauccugucaguaaauauuuu

SEQ ID NO: 28570 - RNA, 22 nt, Homo sapiens
uuaucucagugaacugagugga

SEQ ID NO: 28571 - RNA, 22 nt, Homo sapiens
uuauggcuuugcgguguuagca

SEQ ID NO: 28572 - RNA, 22 nt, Homo sapiens
uuaugguacaugugcacaaugu

SEQ ID NO: 28573 - RNA, 22 nt, Homo sapiens
uuaugguuuuuagcagaguaau

SEQ ID NO: 28574 - RNA, 22 nt, Homo sapiens
uuaugucauuuuuggauguuaa

SEQ ID NO: 28575 - RNA, 22 nt, Homo sapiens
uuaugucuuugagcaaugcugu

SEQ ID NO: 28576 - RNA, 22 nt, Homo sapiens
uuauuagcacccuaccaugugg

SEQ ID NO: 28577 - RNA, 22 nt, Homo sapiens
uuauuagguuaaccuauagcua

SEQ ID NO: 28578 - RNA, 22 nt, Homo sapiens
uuauucagcaccugcuguguuc

SEQ ID NO: 28579 - RNA, 22 nt, Homo sapiens
uuauugcucauuugggcauucu

SEQ ID NO: 28580 - RNA, 22 nt, Homo sapiens
uuauugcuccagaggcugauuu

SEQ ID NO: 28581 - RNA, 22 nt, Homo sapiens
uuauugcuuaugauuagguguu

SEQ ID NO: 28582 - RNA, 22 nt, Homo sapiens
uuauuguccaaguuucccuuug

SEQ ID NO: 28583 - RNA, 22 nt, Homo sapiens
uucaaaaccucugcuuaagccc

SEQ ID NO: 28584 - RNA, 22 nt, Homo sapiens
uucaaaguaaaaauguguucac

SEQ ID NO: 28585 - RNA, 22 nt, Homo sapiens
uucaaaucuuuggcucccacua

SEQ ID NO: 28586 - RNA, 22 nt, Homo sapiens
uucaagcuacaguggcaggguu

SEQ ID NO: 28587 - RNA, 22 nt, Homo sapiens
uucaaguaagaaagacaucagg

SEQ ID NO: 28588 - RNA, 22 nt, Homo sapiens
uucaaguaguucucaugccuca

SEQ ID NO: 28589 - RNA, 22 nt, Homo sapiens
uucaagucaauuuuugaaugac

SEQ ID NO: 28590 - RNA, 22 nt, Homo sapiens
uucaagugaacaaaaugaggag

SEQ ID NO: 28591 - RNA, 20 nt, Homo sapiens
uucaagugauucucaugccu

SEQ ID NO: 28592 - RNA, 22 nt, Homo sapiens
uucaauacuguugauccuuaug

SEQ ID NO: 28593 - RNA, 22 nt, Homo sapiens
uucaauuaauauuauacucuca

SEQ ID NO: 28594 - RNA, 22 nt, Homo sapiens
uucacagaaaaaggcgaugagg

SEQ ID NO: 28595 - RNA, 22 nt, Homo sapiens
uucacagccgcaccccaucacu

SEQ ID NO: 28596 - RNA, 22 nt, Homo sapiens
uucacagucacccuucuccaug

SEQ ID NO: 28597 - RNA, 22 nt, Homo sapiens
uucacaguggugggagacguca

SEQ ID NO: 28598 - RNA, 22 nt, Homo sapiens
uucacagugugaucuaugggca

SEQ ID NO: 28599 - RNA, 22 nt, Homo sapiens
uucacaguguuucucacgguua

SEQ ID NO: 28600 - RNA, 23 nt, Homo sapiens
uucaccguguuggccaggcuggu

SEQ ID NO: 28601 - RNA, 22 nt, Homo sapiens
uucaccuugggucccacuugcu

SEQ ID NO: 28602 - RNA, 20 nt, Homo sapiens
uucacugggcucucuguugg

SEQ ID NO: 28603 - RNA, 22 nt, Homo sapiens
uucagagcauugguuuuuugaa

SEQ ID NO: 28604 - RNA, 22 nt, Homo sapiens
uucagagugguaugaagugaug

SEQ ID NO: 28605 - RNA, 22 nt, Homo sapiens
uucagcaggccaggcccugacu

SEQ ID NO: 28606 - RNA, 22 nt, Homo sapiens
uguacuucaagauuaugguuua

SEQ ID NO: 28607 - RNA, 22 nt, Homo sapiens
uguagcacauuugaagagaagc

SEQ ID NO: 28608 - RNA, 18 nt, Homo sapiens
uguagcaccuuucuugug

SEQ ID NO: 28609 - RNA, 22 nt, Homo sapiens
uguagggagagggaguugcacc

SEQ ID NO: 28610 - RNA, 22 nt, Homo sapiens
uguagucauuccuuuuugcuuu

SEQ ID NO: 28611 - RNA, 22 nt, Homo sapiens
uguagucauuuggaguccagcu

SEQ ID NO: 28612 - RNA, 21 nt, Homo sapiens
uguauacauauguuaggugca

SEQ ID NO: 28613 - RNA, 22 nt, Homo sapiens
uguaugcuuuugagagauauuu

SEQ ID NO: 28614 - RNA, 22 nt, Homo sapiens
uguauguaauugaaguuaaguu

SEQ ID NO: 28615 - RNA, 22 nt, Homo sapiens
uguauguugauguuauauucug

SEQ ID NO: 28616 - RNA, 22 nt, Homo sapiens
ugucaaacauuaugaugcucua

SEQ ID NO: 28617 - RNA, 19 nt, Homo sapiens
ugucaaaugucuccugggg

SEQ ID NO: 28618 - RNA, 22 nt, Homo sapiens
ugucaagaaaucaaggugugag

SEQ ID NO: 28619 - RNA, 22 nt, Homo sapiens
ugucaauauguaauaacugaau

SEQ ID NO: 28620 - RNA, 22 nt, Homo sapiens
ugucacauccaagaaggugcag

SEQ ID NO: 28621 - RNA, 22 nt, Homo sapiens
ugucaccauuuguaggugagga

SEQ ID NO: 28622 - RNA, 22 nt, Homo sapiens
ugucaggaugcuccuuuuggcu

SEQ ID NO: 28623 - RNA, 22 nt, Homo sapiens
ugucagggaggcucggccgcac

SEQ ID NO: 28624 - RNA, 22 nt, Homo sapiens
ugucaguggacugugaaaggca

SEQ ID NO: 28625 - RNA, 22 nt, Homo sapiens
ugucauagauugcuuggaaaaa

SEQ ID NO: 28626 - RNA, 22 nt, Homo sapiens
ugucaucauuugagagaagaaa

SEQ ID NO: 28627 - RNA, 22 nt, Homo sapiens
ugucauggauucugagucuggg

SEQ ID NO: 28628 - RNA, 22 nt, Homo sapiens
ugucauggggaaaauaacagac

SEQ ID NO: 28629 - RNA, 22 nt, Homo sapiens
ugucaugguagcaaggacgagg

SEQ ID NO: 28630 - RNA, 22 nt, Homo sapiens
ugucauguagaaauuguccauu

SEQ ID NO: 28631 - RNA, 22 nt, Homo sapiens
ugucauguuucuacugaccaaa

SEQ ID NO: 28632 - RNA, 22 nt, Homo sapiens
ugucauuggacuucuuucaugg

SEQ ID NO: 28633 - RNA, 22 nt, Homo sapiens
uguccauuuuuaugcuuauggu

SEQ ID NO: 28634 - RNA, 20 nt, Homo sapiens
ugucccaaccccauggguuc

SEQ ID NO: 28635 - RNA, 22 nt, Homo sapiens
ugucccguuuucgaggcugcag

SEQ ID NO: 28636 - RNA, 22 nt, Homo sapiens
ugucccugagccuggauuccug

SEQ ID NO: 28637 - RNA, 22 nt, Homo sapiens
ugucuaaagaauggcagacuca

SEQ ID NO: 28638 - RNA, 22 nt, Homo sapiens
ugucuacugaugauguaguuaa

SEQ ID NO: 28639 - RNA, 22 nt, Homo sapiens
ugucugagacuguuuuacuuuc

SEQ ID NO: 28640 - RNA, 21 nt, Homo sapiens
ugucugagagaggagaucuac

SEQ ID NO: 28641 - RNA, 22 nt, Homo sapiens
ugucuuagagauaaagaaugaa

SEQ ID NO: 28642 - RNA, 18 nt, Homo sapiens
ugucuuagagcuugaccc

SEQ ID NO: 28643 - RNA, 22 nt, Homo sapiens
ugucuuguagacaauguauagu

SEQ ID NO: 28644 - RNA, 22 nt, Homo sapiens
ugugaaacacgaaagucuaaaa

SEQ ID NO: 28645 - RNA, 22 nt, Homo sapiens
ugugaaacauggauagaacugg

SEQ ID NO: 28646 - RNA, 22 nt, Homo sapiens
ugugaacagcuccaaaugugga

SEQ ID NO: 28647 - RNA, 19 nt, Homo sapiens
ugugaacaucacagagugu

SEQ ID NO: 28648 - RNA, 22 nt, Homo sapiens
ugugaacaugacagugggcuag

SEQ ID NO: 28649 - RNA, 22 nt, Homo sapiens
ugugaaugaagaaugcuaaccu

SEQ ID NO: 28650 - RNA, 22 nt, Homo sapiens
ugugaauggugcugccgugaag

SEQ ID NO: 28651 - RNA, 22 nt, Homo sapiens
ugugaauggugcuuccuagaug

SEQ ID NO: 28652 - RNA, 22 nt, Homo sapiens
ugugaauguaaccuuauuugga

SEQ ID NO: 28653 - RNA, 22 nt, Homo sapiens
ugugacaaauuuaguggacugu

SEQ ID NO: 28654 - RNA, 22 nt, Homo sapiens
ugugacacugaauggcagaacu

SEQ ID NO: 28655 - RNA, 18 nt, Homo sapiens
ugugacauugagcauguc

SEQ ID NO: 28656 - RNA, 22 nt, Homo sapiens
ugugagacugacagggcagggu

SEQ ID NO: 28657 - RNA, 22 nt, Homo sapiens
ugugagacugguucugaaccca

SEQ ID NO: 28658 - RNA, 22 nt, Homo sapiens
ugugagaucucagaauugaacu

SEQ ID NO: 28659 - RNA, 19 nt, Homo sapiens
ugugagcauuagcauuuag

SEQ ID NO: 28660 - RNA, 22 nt, Homo sapiens
ugugagcuauggaguuguagag

SEQ ID NO: 28661 - RNA, 22 nt, Homo sapiens
ugugaucaauuagugaugucug

SEQ ID NO: 28662 - RNA, 22 nt, Homo sapiens
ugugaucaugguauuaaucugc

SEQ ID NO: 28663 - RNA, 22 nt, Homo sapiens
ugugaucaugugugccuuaguc

SEQ ID NO: 28664 - RNA, 22 nt, Homo sapiens
ugugauggaguuucauggacug

SEQ ID NO: 28665 - RNA, 22 nt, Homo sapiens
ugugaugguuuggaagcuucuu

SEQ ID NO: 28666 - RNA, 22 nt, Homo sapiens
ugugauguggagggcagaucca

SEQ ID NO: 28667 - RNA, 20 nt, Homo sapiens
ugugauuauuuaguugcaug

SEQ ID NO: 28668 - RNA, 22 nt, Homo sapiens
ugugauugauuaaugugugcua

SEQ ID NO: 28669 - RNA, 22 nt, Homo sapiens
ugugcaaaaacaauugcgguuu

SEQ ID NO: 28670 - RNA, 22 nt, Homo sapiens
ugugcaauucgauggagcucau

SEQ ID NO: 28671 - RNA, 22 nt, Homo sapiens
ugugcacaacaugcagguuugu

SEQ ID NO: 28672 - RNA, 22 nt, Homo sapiens
ugugcacaacgugcagguuugu

SEQ ID NO: 28673 - RNA, 22 nt, Homo sapiens
ugugcacaugauauaucacaua

SEQ ID NO: 28674 - RNA, 22 nt, Homo sapiens
ugugcacauugugcagguugau

SEQ ID NO: 28675 - RNA, 23 nt, Homo sapiens
ugugcacauuuacauauauacac

SEQ ID NO: 28676 - RNA, 22 nt, Homo sapiens
ugugcauauaaguguguauaua

SEQ ID NO: 28677 - RNA, 22 nt, Homo sapiens
ugugccacuguucuguaaagug

SEQ ID NO: 28678 - RNA, 22 nt, Homo sapiens
ugugcguguaagagaucuaggu

SEQ ID NO: 28679 - RNA, 22 nt, Homo sapiens
ugugcuaaaaugggacuucuaa

SEQ ID NO: 28680 - RNA, 22 nt, Homo sapiens
ugugcuauguuauucacauggg

SEQ ID NO: 28681 - RNA, 22 nt, Homo sapiens
ugugcugaucgggcacgguguc

SEQ ID NO: 28682 - RNA, 22 nt, Homo sapiens
ugugcuugaaauucaguuuuga

SEQ ID NO: 28683 - RNA, 22 nt, Homo sapiens
uguggcaaagucuugugaauau

SEQ ID NO: 28684 - RNA, 22 nt, Homo sapiens
uguggcaaauggucaggaagaa

SEQ ID NO: 28685 - RNA, 20 nt, Homo sapiens
uguggcacuguaucucucag

SEQ ID NO: 28686 - RNA, 22 nt, Homo sapiens
uguggcacuguguccagagaaa

SEQ ID NO: 28687 - RNA, 22 nt, Homo sapiens
uguggcauugaauaaccuugga

SEQ ID NO: 28688 - RNA, 22 nt, Homo sapiens
uguggcuucuuugguucaguau

SEQ ID NO: 28689 - RNA, 22 nt, Homo sapiens
uguggcuuuuucuuggcugagg

SEQ ID NO: 28690 - RNA, 19 nt, Homo sapiens
uguggucauccugggacga

SEQ ID NO: 28691 - RNA, 22 nt, Homo sapiens
ugugguccucugaaggcuuuuc

SEQ ID NO: 28692 - RNA, 22 nt, Homo sapiens
ugugguuuuuuucuccaauagg

SEQ ID NO: 28693 - RNA, 22 nt, Homo sapiens
ugugucuugagagucucgagaa

SEQ ID NO: 28694 - RNA, 22 nt, Homo sapiens
uguuaacauggucucagucugu

SEQ ID NO: 28695 - RNA, 22 nt, Homo sapiens
uguuaaggcagagauaauacau

SEQ ID NO: 28696 - RNA, 22 nt, Homo sapiens
uguuacacugugcacuaaauuu

SEQ ID NO: 28697 - RNA, 22 nt, Homo sapiens
uguuacagcagcacaaaaugga

SEQ ID NO: 28698 - RNA, 22 nt, Homo sapiens
uguuaugaagaugccugguaca

SEQ ID NO: 28699 - RNA, 22 nt, Homo sapiens
uguuauguucuacuuuuaggug

SEQ ID NO: 28700 - RNA, 22 nt, Homo sapiens
uguuauuuuguguuagggcaca

SEQ ID NO: 28701 - RNA, 22 nt, Homo sapiens
uguucaugaguucucauuuuua

SEQ ID NO: 28702 - RNA, 22 nt, Homo sapiens
uguucuggagaguuuagucugg

SEQ ID NO: 28703 - RNA, 22 nt, Homo sapiens
uguugcacuccagccuagguga

SEQ ID NO: 28704 - RNA, 22 nt, Homo sapiens
uguugcacuccauccugggcga

SEQ ID NO: 28705 - RNA, 22 nt, Homo sapiens
uguugcacucuagccugggcaa

SEQ ID NO: 28706 - RNA, 22 nt, Homo sapiens
uuuuugaguagcuggagagcag

SEQ ID NO: 28707 - RNA, 22 nt, Homo sapiens
uuuuuggguaaugauuaucaau

SEQ ID NO: 28708 - RNA, 22 nt, Homo sapiens
uuggguccucugguccuugguu

SEQ ID NO: 28709 - RNA, 22 nt, Homo sapiens
uugguaaucccuagugucuaga

SEQ ID NO: 28710 - RNA, 22 nt, Homo sapiens
uugguaccccugguguacuaau

SEQ ID NO: 28711 - RNA, 22 nt, Homo sapiens
uugguacuaaaaaguagggugu

SEQ ID NO: 28712 - RNA, 22 nt, Homo sapiens
uugguacuacacuucuaaucuu

SEQ ID NO: 28713 - RNA, 22 nt, Homo sapiens
uuggucacugacauguuugaaa

SEQ ID NO: 28714 - RNA, 22 nt, Homo sapiens
uuggucagcucaauggagaggg

SEQ ID NO: 28715 - RNA, 22 nt, Homo sapiens
uuggucaggagccucccucuuu

SEQ ID NO: 28716 - RNA, 22 nt, Homo sapiens
uuggucaucucccuccuuuuag

SEQ ID NO: 28717 - RNA, 21 nt, Homo sapiens
uugguccacaugucauaguua

SEQ ID NO: 28718 - RNA, 22 nt, Homo sapiens
uugguccauuacauugaugaca

SEQ ID NO: 28719 - RNA, 22 nt, Homo sapiens
uugguccccacuccccugccaa

SEQ ID NO: 28720 - RNA, 22 nt, Homo sapiens
uuggucuucuaauguaccuguu

SEQ ID NO: 28721 - RNA, 22 nt, Homo sapiens
uugguuaucaucauuucagcaa

SEQ ID NO: 28722 - RNA, 19 nt, Homo sapiens
uugguugguuauuucuuac

SEQ ID NO: 28723 - RNA, 22 nt, Homo sapiens
uugguuuccuuccugcuuaacu

SEQ ID NO: 28724 - RNA, 22 nt, Homo sapiens
uuguaaagucugucucagucag

SEQ ID NO: 28725 - RNA, 22 nt, Homo sapiens
uuguaaaguucuuaggaagcuc

SEQ ID NO: 28726 - RNA, 22 nt, Homo sapiens
uuguaagaaucuagcucuuuau

SEQ ID NO: 28727 - RNA, 22 nt, Homo sapiens
uuguaauggagcaaacagguug

SEQ ID NO: 28728 - RNA, 22 nt, Homo sapiens
uuguagcaaauauauuuuggaa

SEQ ID NO: 28729 - RNA, 22 nt, Homo sapiens
uuguagcaaauguguaaacaaa

SEQ ID NO: 28730 - RNA, 22 nt, Homo sapiens
uuguaguagcauuauuuauaau

SEQ ID NO: 28731 - RNA, 22 nt, Homo sapiens
uuguauaggcucaguaagaauc

SEQ ID NO: 28732 - RNA, 22 nt, Homo sapiens
uuguauguuguuugucagagaa

SEQ ID NO: 28733 - RNA, 22 nt, Homo sapiens
uuguauguuucugugcacauga

SEQ ID NO: 28734 - RNA, 22 nt, Homo sapiens
uugucaaacucauucuccaucc

SEQ ID NO: 28735 - RNA, 22 nt, Homo sapiens
uugucacauggggcggcugccc

SEQ ID NO: 28736 - RNA, 22 nt, Homo sapiens
uugucaguguucacucaaagcu

SEQ ID NO: 28737 - RNA, 22 nt, Homo sapiens
aaaagugguguuguuucuaaau

SEQ ID NO: 28738 - RNA, 22 nt, Homo sapiens
aaacauugaccucauccuggca

SEQ ID NO: 28739 - RNA, 22 nt, Homo sapiens
aaagaagucagccuguccuuug

SEQ ID NO: 28740 - RNA, 23 nt, Homo sapiens
aaagacuagucaggugcaguggu

SEQ ID NO: 28741 - RNA, 22 nt, Homo sapiens
aaagagcugagaccugguggag

SEQ ID NO: 28742 - RNA, 22 nt, Homo sapiens
aaagcuaagguagcauuggaga

SEQ ID NO: 28743 - RNA, 22 nt, Homo sapiens
aaagcuacaggaccugcucauu

SEQ ID NO: 28744 - RNA, 22 nt, Homo sapiens
aaaggaccacauauaugguggc

SEQ ID NO: 28745 - RNA, 22 nt, Homo sapiens
aaaggcaucauuaguaccaagu

SEQ ID NO: 28746 - RNA, 20 nt, Homo sapiens
aaaggcugugagaacgagau

SEQ ID NO: 28747 - RNA, 22 nt, Homo sapiens
aaagggcuguuucuugacuugg

SEQ ID NO: 28748 - RNA, 22 nt, Homo sapiens
aaagggcuuuguaaacuucaag

SEQ ID NO: 28749 - RNA, 17 nt, Homo sapiens
aaaguccuuugcuaucu

SEQ ID NO: 28750 - RNA, 22 nt, Homo sapiens
aaagugauguccaggcuuucag

SEQ ID NO: 28751 - RNA, 22 nt, Homo sapiens
aaagugcugggauuggccgggc

SEQ ID NO: 28752 - RNA, 22 nt, Homo sapiens
aaagugcuucucuuuggugggu

SEQ ID NO: 28753 - RNA, 22 nt, Homo sapiens
aaaguggugugaguauguaucu

SEQ ID NO: 28754 - RNA, 22 nt, Homo sapiens
aaaguguuucugcaguagguuu

SEQ ID NO: 28755 - RNA, 15 nt, Homo sapiens
aaauaugucaguucu

SEQ ID NO: 28756 - RNA, 22 nt, Homo sapiens
aaauccaucucuuggggcauug

SEQ ID NO: 28757 - RNA, 22 nt, Homo sapiens
aaaugcaccacucuggugcagg

SEQ ID NO: 28758 - RNA, 22 nt, Homo sapiens
aaaugcacgcuacccagcuaga

SEQ ID NO: 28759 - RNA, 22 nt, Homo sapiens
aaaugcagauuccuaggcccca

SEQ ID NO: 28760 - RNA, 22 nt, Homo sapiens
aaaugccucccauucuacugac

SEQ ID NO: 28761 - RNA, 23 nt, Homo sapiens
aaaugcucucaggugccaguaga

SEQ ID NO: 28762 - RNA, 22 nt, Homo sapiens
aaaugcucuuuaugaaguugga

SEQ ID NO: 28763 - RNA, 22 nt, Homo sapiens
aaaugcuucuauguggcauguu

SEQ ID NO: 28764 - RNA, 22 nt, Homo sapiens
aaaugucauggaguguuucccc

SEQ ID NO: 28765 - RNA, 19 nt, Homo sapiens
aaaugugcacuguuuucca

SEQ ID NO: 28766 - RNA, 22 nt, Homo sapiens
aaauugcauugagcugcuuauu

SEQ ID NO: 28767 - RNA, 22 nt, Homo sapiens
aaauuguccuauugguuuaagc

SEQ ID NO: 28768 - RNA, 22 nt, Homo sapiens
aacagaccuagauaguauaguc

SEQ ID NO: 28769 - RNA, 22 nt, Homo sapiens
aacagagcuggugacuccaggu

SEQ ID NO: 28770 - RNA, 20 nt, Homo sapiens
aacagcacugucugaagcuu

SEQ ID NO: 28771 - RNA, 22 nt, Homo sapiens
aacagcauaguacccgugauaa

SEQ ID NO: 28772 - RNA, 22 nt, Homo sapiens
aacaggcuccuaggggugcacc

SEQ ID NO: 28773 - RNA, 22 nt, Homo sapiens
aacauguuuagcagauaccugu

SEQ ID NO: 28774 - RNA, 22 nt, Homo sapiens
aaccacauggcucaguggacau

SEQ ID NO: 28775 - RNA, 22 nt, Homo sapiens
aacccugacacaagcagaauuu

SEQ ID NO: 28776 - RNA, 22 nt, Homo sapiens
aagagagccagcugguauauuu

SEQ ID NO: 28777 - RNA, 22 nt, Homo sapiens
aagagcgcugauaacauguuug

SEQ ID NO: 28778 - RNA, 22 nt, Homo sapiens
aagagcucauccauaguuguca

SEQ ID NO: 28779 - RNA, 22 nt, Homo sapiens
aagaggccuaggaaucuguauu

SEQ ID NO: 28780 - RNA, 22 nt, Homo sapiens
aagagguagaagcuugccuucu

SEQ ID NO: 28781 - RNA, 22 nt, Homo sapiens
aagaguaguaguggcacucucu

SEQ ID NO: 28782 - RNA, 22 nt, Homo sapiens
aagauagcuaagcuucuucuaa

SEQ ID NO: 28783 - RNA, 22 nt, Homo sapiens
aagauauguuaguuauaaacuc

SEQ ID NO: 28784 - RNA, 19 nt, Homo sapiens
aagaugauguuugggcuaa

SEQ ID NO: 28785 - RNA, 22 nt, Homo sapiens
aagaugcagaagcccagauguu

SEQ ID NO: 28786 - RNA, 20 nt, Homo sapiens
aagcaagcauuugcaaucau

SEQ ID NO: 28787 - RNA, 23 nt, Homo sapiens
aagcaugcacagcuguuuguggu

SEQ ID NO: 28788 - RNA, 22 nt, Homo sapiens
aagcaugguuuccaggggucac

SEQ ID NO: 28789 - RNA, 22 nt, Homo sapiens
aagcgguguugaauuuuguuga

SEQ ID NO: 28790 - RNA, 22 nt, Homo sapiens
aagcugccuugcugaggagaaa

SEQ ID NO: 28791 - RNA, 22 nt, Homo sapiens
aagcuguguguaagcucucaca

SEQ ID NO: 28792 - RNA, 22 nt, Homo sapiens
aaggaaguaauuugguuuauag

SEQ ID NO: 28793 - RNA, 23 nt, Homo sapiens
aaggacacugaacacuucccagc

SEQ ID NO: 28794 - RNA, 22 nt, Homo sapiens
aaggagcuaagagaucauacau

SEQ ID NO: 28795 - RNA, 22 nt, Homo sapiens
aaggagcuuaagugacuuguac

SEQ ID NO: 28796 - RNA, 22 nt, Homo sapiens
aaggauuguaaaguugacaaau

SEQ ID NO: 28797 - RNA, 22 nt, Homo sapiens
aaggcaagguggauaaugaagc

SEQ ID NO: 28798 - RNA, 22 nt, Homo sapiens
aaggcaauuuguugugaggauu

SEQ ID NO: 28799 - RNA, 22 nt, Homo sapiens
aaggcuagagaagaagggcauc

SEQ ID NO: 28800 - RNA, 22 nt, Homo sapiens
aaggcuguuguguaauaggauu

SEQ ID NO: 28801 - RNA, 20 nt, Homo sapiens
aaggcuuucgaguuccaggg

SEQ ID NO: 28802 - RNA, 22 nt, Homo sapiens
aagggaaugcgcugccuguguu

SEQ ID NO: 28803 - RNA, 22 nt, Homo sapiens
aagggaauguuguggcugguuu

SEQ ID NO: 28804 - RNA, 22 nt, Homo sapiens
aagguagcugagugaagugguu

SEQ ID NO: 28805 - RNA, 22 nt, Homo sapiens
aagguauuucuaugggaauaga

SEQ ID NO: 28806 - RNA, 22 nt, Homo sapiens
aaggucauugugguuuuugcca

SEQ ID NO: 28807 - RNA, 22 nt, Homo sapiens
aaggugcuguaagcauccaugu

SEQ ID NO: 28808 - RNA, 21 nt, Homo sapiens
aaggugguggugauugagaug

SEQ ID NO: 28809 - RNA, 22 nt, Homo sapiens
aaggugguuuucucuuggaguc

SEQ ID NO: 28810 - RNA, 22 nt, Homo sapiens
aaguaagcauccaauaaauguu

SEQ ID NO: 28811 - RNA, 22 nt, Homo sapiens
aagcuggcuuucauugagugcu

SEQ ID NO: 28812 - RNA, 22 nt, Homo sapiens
aagcuguauuguguugcuauaa

SEQ ID NO: 28813 - RNA, 22 nt, Homo sapiens
aagcugugucuugucagcuacc

SEQ ID NO: 28814 - RNA, 22 nt, Homo sapiens
aaggaacuggaauauuuugaac

SEQ ID NO: 28815 - RNA, 22 nt, Homo sapiens
aaggagcagagagcccuguuuc

SEQ ID NO: 28816 - RNA, 22 nt, Homo sapiens
aaggaguagaggaauagcaaug

SEQ ID NO: 28817 - RNA, 22 nt, Homo sapiens
aaggaguaucuguuuucucacc

SEQ ID NO: 28818 - RNA, 22 nt, Homo sapiens
aaggaguguggugaucuugggc

SEQ ID NO: 28819 - RNA, 22 nt, Homo sapiens
aaggcaagaaaauggauucucc

SEQ ID NO: 28820 - RNA, 22 nt, Homo sapiens
aaggcagucacuaaauagugag

SEQ ID NO: 28821 - RNA, 22 nt, Homo sapiens
aaggcaguggcagaagauguca

SEQ ID NO: 28822 - RNA, 22 nt, Homo sapiens
aaggcauggugacuauuuaggc

SEQ ID NO: 28823 - RNA, 22 nt, Homo sapiens
aaggcauucucaaacuaguucu

SEQ ID NO: 28824 - RNA, 22 nt, Homo sapiens
aaggcuauuugagaaugugugu

SEQ ID NO: 28825 - RNA, 22 nt, Homo sapiens
aaggcucuuucaacguaaauua

SEQ ID NO: 28826 - RNA, 22 nt, Homo sapiens
aagggaaugcuuccaguuugug

SEQ ID NO: 28827 - RNA, 22 nt, Homo sapiens
aagggaaugugguagcugguuu

SEQ ID NO: 28828 - RNA, 22 nt, Homo sapiens
aagggagcugcauaaucuugug

SEQ ID NO: 28829 - RNA, 22 nt, Homo sapiens
aagguauuuuugucuauaucuu

SEQ ID NO: 28830 - RNA, 18 nt, Homo sapiens
aaggugcuucuguucuga

SEQ ID NO: 28831 - RNA, 22 nt, Homo sapiens
aaguaaacauugagagacaaga

SEQ ID NO: 28832 - RNA, 22 nt, Homo sapiens
aaguaauggaguuauuuuauga

SEQ ID NO: 28833 - RNA, 22 nt, Homo sapiens
aaguauuagcuaauugugcuua

SEQ ID NO: 28834 - RNA, 22 nt, Homo sapiens
aaguauuaugaguccuuguuuu

SEQ ID NO: 28835 - RNA, 22 nt, Homo sapiens
aagucauggagaagguggaggu

SEQ ID NO: 28836 - RNA, 22 nt, Homo sapiens
aagucauggaggaguaugugag

SEQ ID NO: 28837 - RNA, 22 nt, Homo sapiens
aaguccaugaagucuugugggu

SEQ ID NO: 28838 - RNA, 22 nt, Homo sapiens
aagugaauguuugguagcagug

SEQ ID NO: 28839 - RNA, 22 nt, Homo sapiens
aagugacauugugcccauuuga

SEQ ID NO: 28840 - RNA, 22 nt, Homo sapiens
aagugcaaaucuguggcugaaa

SEQ ID NO: 28841 - RNA, 21 nt, Homo sapiens
aagugcucugggacucuaaau

SEQ ID NO: 28842 - RNA, 22 nt, Homo sapiens
aagugcucuugaaacugccuua

SEQ ID NO: 28843 - RNA, 22 nt, Homo sapiens
aagugcucuugaaacugucuua

SEQ ID NO: 28844 - RNA, 22 nt, Homo sapiens
aagugcuuaggauagugugugg

SEQ ID NO: 28845 - RNA, 22 nt, Homo sapiens
aagugcuuuacacaugcaugau

SEQ ID NO: 28846 - RNA, 22 nt, Homo sapiens
aaguggaauguuuguggcacaa

SEQ ID NO: 28847 - RNA, 17 nt, Homo sapiens
aaguggcuuguucacca

SEQ ID NO: 28848 - RNA, 22 nt, Homo sapiens
aagugguguuuguauuuaugca

SEQ ID NO: 28849 - RNA, 22 nt, Homo sapiens
aagugguucuaugaguuugcaa

SEQ ID NO: 28850 - RNA, 22 nt, Homo sapiens
aagugguuuuuacaaagacaga

SEQ ID NO: 28851 - RNA, 22 nt, Homo sapiens
aaguguaaguuaauguuuaggu

SEQ ID NO: 28852 - RNA, 22 nt, Homo sapiens
aaguugcuuuagguaagucaau

SEQ ID NO: 28853 - RNA, 22 nt, Homo sapiens
aauaaagcauggcuacuccaua

SEQ ID NO: 28854 - RNA, 22 nt, Homo sapiens
aauaaagccugucucuuuagag

SEQ ID NO: 28855 - RNA, 22 nt, Homo sapiens
aauaaagucugaagugugcuua

SEQ ID NO: 28856 - RNA, 21 nt, Homo sapiens
aauacucuagguuaagagagc

SEQ ID NO: 28857 - RNA, 22 nt, Homo sapiens
aauacucuauaagggaagcugu

SEQ ID NO: 28858 - RNA, 22 nt, Homo sapiens
aauacugaaaguauuuucaaau

SEQ ID NO: 28859 - RNA, 22 nt, Homo sapiens
aauacuggcacugaagaccaug

SEQ ID NO: 28860 - RNA, 22 nt, Homo sapiens
aauagcauugaaucuaccaauu

SEQ ID NO: 28861 - RNA, 22 nt, Homo sapiens
aauagcuguuuuuaauuccugc

SEQ ID NO: 28862 - RNA, 22 nt, Homo sapiens
aauauguccuugaaauggugcu

SEQ ID NO: 28863 - RNA, 22 nt, Homo sapiens
aauaugucugcuaauuguuucu

SEQ ID NO: 28864 - RNA, 22 nt, Homo sapiens
aauaugucuugaaauuggguaa

SEQ ID NO: 28865 - RNA, 19 nt, Homo sapiens
aauauugacaguggugucu

SEQ ID NO: 28866 - RNA, 22 nt, Homo sapiens
aaucaacauuguuuuaagucaa

SEQ ID NO: 28867 - RNA, 22 nt, Homo sapiens
aaucacaguguucuugugaggg

SEQ ID NO: 28868 - RNA, 22 nt, Homo sapiens
aaucacaguuaguaagggagaa

SEQ ID NO: 28869 - RNA, 22 nt, Homo sapiens
aaucacauugaaucugcuaccu

SEQ ID NO: 28870 - RNA, 22 nt, Homo sapiens
aaucaccaugcacuacagccuu

SEQ ID NO: 28871 - RNA, 17 nt, Homo sapiens
aaucagauuucugagga

SEQ ID NO: 28872 - RNA, 22 nt, Homo sapiens
aauccauuugccgucuauccau

SEQ ID NO: 28873 - RNA, 22 nt, Homo sapiens
aaucccauuucucuguguuuuu

SEQ ID NO: 28874 - RNA, 22 nt, Homo sapiens
aaucgcuuuugguaggcaagga

SEQ ID NO: 28875 - RNA, 22 nt, Homo sapiens
agagcaaugacaugcuaugugg

SEQ ID NO: 28876 - RNA, 22 nt, Homo sapiens
agagcaccauuuagcaagguga

SEQ ID NO: 28877 - RNA, 22 nt, Homo sapiens
agagcauugaguuaaugguuca

SEQ ID NO: 28878 - RNA, 22 nt, Homo sapiens
agagccacauuaaauaugggaa

SEQ ID NO: 28879 - RNA, 21 nt, Homo sapiens
agaggacugaccacagcccua

SEQ ID NO: 28880 - RNA, 22 nt, Homo sapiens
agagguaagcaguggcaagugc

SEQ ID NO: 28881 - RNA, 22 nt, Homo sapiens
agagguaugccugggcuggagc

SEQ ID NO: 28882 - RNA, 22 nt, Homo sapiens
agaguaguaggaugaauggacu

SEQ ID NO: 28883 - RNA, 22 nt, Homo sapiens
agaguaguuuauuaugcuaagg

SEQ ID NO: 28884 - RNA, 22 nt, Homo sapiens
agagucacaugaggcccuucau

SEQ ID NO: 28885 - RNA, 22 nt, Homo sapiens
agagugaagcuuuuuauauucu

SEQ ID NO: 28886 - RNA, 22 nt, Homo sapiens
agagugcaauggcaccaucucg

SEQ ID NO: 28887 - RNA, 22 nt, Homo sapiens
agagugcuuuauuagauguagc

SEQ ID NO: 28888 - RNA, 22 nt, Homo sapiens
agaucaauugcugauucgcucu

SEQ ID NO: 28889 - RNA, 22 nt, Homo sapiens
agaucacaguaccguaaggcug

SEQ ID NO: 28890 - RNA, 22 nt, Homo sapiens
agauggauuuuguagccccagc

SEQ ID NO: 28891 - RNA, 22 nt, Homo sapiens
agauggugauaaaugugguacc

SEQ ID NO: 28892 - RNA, 22 nt, Homo sapiens
agcaaaucuaugaauguauauu

SEQ ID NO: 28893 - RNA, 22 nt, Homo sapiens
agcaaccuugaauagcccuuuc

SEQ ID NO: 28894 - RNA, 22 nt, Homo sapiens
agcacaguuaaaugaggcuucu

SEQ ID NO: 28895 - RNA, 22 nt, Homo sapiens
agcaccaauaacaguuucuagc

SEQ ID NO: 28896 - RNA, 22 nt, Homo sapiens
agcaccaccguugcucuauccc

SEQ ID NO: 28897 - RNA, 22 nt, Homo sapiens
agcaccauuucucuaaagcacu

SEQ ID NO: 28898 - RNA, 22 nt, Homo sapiens
agcacgaaaccaaauucuguga

SEQ ID NO: 28899 - RNA, 22 nt, Homo sapiens
agcagagcaguggauuuuguga

SEQ ID NO: 28900 - RNA, 22 nt, Homo sapiens
agcagauguuuagugagcgccu

SEQ ID NO: 28901 - RNA, 22 nt, Homo sapiens
agcagcaauuuuguaugguuua

SEQ ID NO: 28902 - RNA, 22 nt, Homo sapiens
agcagcaccaaacagacuaaga

SEQ ID NO: 28903 - RNA, 22 nt, Homo sapiens
agcagcauauuuuuauaaugua

SEQ ID NO: 28904 - RNA, 22 nt, Homo sapiens
agcagcauuccaaaaaucugcu

SEQ ID NO: 28905 - RNA, 20 nt, Homo sapiens
agcagccacagauuccucag

SEQ ID NO: 28906 - RNA, 22 nt, Homo sapiens
agcagguauucgggucaugggg

SEQ ID NO: 28907 - RNA, 22 nt, Homo sapiens
agcagguguggcuuauccugaa

SEQ ID NO: 28908 - RNA, 22 nt, Homo sapiens
agcaguacauaaaaagcauccu

SEQ ID NO: 28909 - RNA, 22 nt, Homo sapiens
agcaguagugaaaguagacuua

SEQ ID NO: 28910 - RNA, 19 nt, Homo sapiens
agcaguguggagauuucuc

SEQ ID NO: 28911 - RNA, 22 nt, Homo sapiens
agcaguguggccuuagacccgg

SEQ ID NO: 28912 - RNA, 20 nt, Homo sapiens
acugggcuaccgaaguaagg

SEQ ID NO: 28913 - RNA, 22 nt, Homo sapiens
acuguacuccagccugggcaac

SEQ ID NO: 28914 - RNA, 22 nt, Homo sapiens
acuguacuccagccugggugac

SEQ ID NO: 28915 - RNA, 22 nt, Homo sapiens
acugugcuguuuuaauuauuga

SEQ ID NO: 28916 - RNA, 17 nt, Homo sapiens
acuuuuugaggaggcau

SEQ ID NO: 28917 - RNA, 22 nt, Homo sapiens
acuuuuugauggggagaacauu

SEQ ID NO: 28918 - RNA, 22 nt, Homo sapiens
agaaacacagguggaauugcuu

SEQ ID NO: 28919 - RNA, 22 nt, Homo sapiens
agaaacauucucuugccuccuu

SEQ ID NO: 28920 - RNA, 22 nt, Homo sapiens
agaaccaaucccacauggauac

SEQ ID NO: 28921 - RNA, 22 nt, Homo sapiens
agaacccuuugaaauguguuug

SEQ ID NO: 28922 - RNA, 22 nt, Homo sapiens
agaagaacauagggugacugaa

SEQ ID NO: 28923 - RNA, 19 nt, Homo sapiens
agaagugcauggucuagag

SEQ ID NO: 28924 - RNA, 22 nt, Homo sapiens
agacacugaaauguauugaaga

SEQ ID NO: 28925 - RNA, 22 nt, Homo sapiens
agacagcuggaguaucauagcu

SEQ ID NO: 28926 - RNA, 22 nt, Homo sapiens
agacaguauuggcaaagugugu

SEQ ID NO: 28927 - RNA, 22 nt, Homo sapiens
agacuagaaaucauuuguugag

SEQ ID NO: 28928 - RNA, 22 nt, Homo sapiens
agagauaaagauuuuaauuuug

SEQ ID NO: 28929 - RNA, 22 nt, Homo sapiens
agagcaauguuaucagucucug

SEQ ID NO: 28930 - RNA, 18 nt, Homo sapiens
agagcacugaguuuuaga

SEQ ID NO: 28931 - RNA, 22 nt, Homo sapiens
agagccacacucuccuaacuca

SEQ ID NO: 28932 - RNA, 22 nt, Homo sapiens
agagguagaagauaggcuacag

SEQ ID NO: 28933 - RNA, 22 nt, Homo sapiens
agaggucuuaucaaacaugcuu

SEQ ID NO: 28934 - RNA, 23 nt, Homo sapiens
agagguuuaaucaggcaguugcu

SEQ ID NO: 28935 - RNA, 22 nt, Homo sapiens
agagguuuaauugauucacagu

SEQ ID NO: 28936 - RNA, 20 nt, Homo sapiens
agagguuuugauagguucug

SEQ ID NO: 28937 - RNA, 22 nt, Homo sapiens
agagguuuugcccucgagauaa

SEQ ID NO: 28938 - RNA, 22 nt, Homo sapiens
agagugcuauagauuagauuuc

SEQ ID NO: 28939 - RNA, 20 nt, Homo sapiens
agagugcuggacugaggagc

SEQ ID NO: 28940 - RNA, 20 nt, Homo sapiens
agagugcugucuguccugag

SEQ ID NO: 28941 - RNA, 22 nt, Homo sapiens
agauaugucugcuauuugcugu

SEQ ID NO: 28942 - RNA, 22 nt, Homo sapiens
agauauguuuaguuucaaaaug

SEQ ID NO: 28943 - RNA, 22 nt, Homo sapiens
agaugauguuucuggcacauga

SEQ ID NO: 28944 - RNA, 22 nt, Homo sapiens
agaugccuaugaagagaaauua

SEQ ID NO: 28945 - RNA, 22 nt, Homo sapiens
agaugguauuauagguuucugu

SEQ ID NO: 28946 - RNA, 22 nt, Homo sapiens
agauggucuucauaaguuuuaa

SEQ ID NO: 28947 - RNA, 22 nt, Homo sapiens
agaugguguuggcugaguguau

SEQ ID NO: 28948 - RNA, 22 nt, Homo sapiens
agauucauccaaguuguugcau

SEQ ID NO: 28949 - RNA, 23 nt, Homo sapiens
agcaaaugcucuagcacuccaac

SEQ ID NO: 28950 - RNA, 22 nt, Homo sapiens
agcaacauagugagacccccau

SEQ ID NO: 28951 - RNA, 22 nt, Homo sapiens
agcaacaucagcagcaggaaaa

SEQ ID NO: 28952 - RNA, 22 nt, Homo sapiens
agcaacauugagacugcaguug

SEQ ID NO: 28953 - RNA, 22 nt, Homo sapiens
agcaagaugaaguugagcuagg

SEQ ID NO: 28954 - RNA, 22 nt, Homo sapiens
agcaagauuguucccauuuucu

SEQ ID NO: 28955 - RNA, 22 nt, Homo sapiens
agcaauaugacauugcuacauc

SEQ ID NO: 28956 - RNA, 22 nt, Homo sapiens
agcacagccuuguguuuucuug

SEQ ID NO: 28957 - RNA, 22 nt, Homo sapiens
agcacauauauuucccaaaaca

SEQ ID NO: 28958 - RNA, 22 nt, Homo sapiens
agcacauuaguaucuaagaaca

SEQ ID NO: 28959 - RNA, 17 nt, Homo sapiens
agcaccacacucucuug

SEQ ID NO: 28960 - RNA, 22 nt, Homo sapiens
agcaccacauacuacagagaua

SEQ ID NO: 28961 - RNA, 23 nt, Homo sapiens
agcaccaccccaggucacaagug

SEQ ID NO: 28962 - RNA, 22 nt, Homo sapiens
agcaccagaaucugaguuauuc

SEQ ID NO: 28963 - RNA, 22 nt, Homo sapiens
agcaccauuuauugaaaagaca

SEQ ID NO: 28964 - RNA, 23 nt, Homo sapiens
agcaccuuuccuccacuaucugc

SEQ ID NO: 28965 - RNA, 22 nt, Homo sapiens
agcagcacaucccuuucuggcc

SEQ ID NO: 28966 - RNA, 22 nt, Homo sapiens
agcagcaugcaaauggacuaau

SEQ ID NO: 28967 - RNA, 22 nt, Homo sapiens
agcagcuuugaucugaaugauu

SEQ ID NO: 28968 - RNA, 22 nt, Homo sapiens
agcaggauuguuacaauaguaa

SEQ ID NO: 28969 - RNA, 22 nt, Homo sapiens
agcaggucuuaacuugugaggu

SEQ ID NO: 28970 - RNA, 22 nt, Homo sapiens
agcagguguccacaauguuugc

SEQ ID NO: 28971 - RNA, 22 nt, Homo sapiens
agcauagugccuugaaaacaau

SEQ ID NO: 28972 - RNA, 18 nt, Homo sapiens
agcaucacugaucauccu

SEQ ID NO: 28973 - RNA, 22 nt, Homo sapiens
agcauuaguugugaagccuuua

SEQ ID NO: 28974 - RNA, 22 nt, Homo sapiens
agccaagacucuguuccccuug

SEQ ID NO: 28975 - RNA, 22 nt, Homo sapiens
agccaguauuuccacagagugg

SEQ ID NO: 28976 - RNA, 22 nt, Homo sapiens
agccaguauuuugaguuggucu

SEQ ID NO: 28977 - RNA, 22 nt, Homo sapiens
agccaguuuggcuaauuuuggc

SEQ ID NO: 28978 - RNA, 22 nt, Homo sapiens
agccccauuuguugaaaagacg

SEQ ID NO: 28979 - RNA, 22 nt, Homo sapiens
agcccuuagauggcuccuucca

SEQ ID NO: 28980 - RNA, 23 nt, Homo sapiens
agccugguuucccugcuucuccc

SEQ ID NO: 28981 - RNA, 22 nt, Homo sapiens
agccuguguugaauuauagaaa

SEQ ID NO: 28982 - RNA, 22 nt, Homo sapiens
agcgccauugcacuccagccuu

SEQ ID NO: 28983 - RNA, 22 nt, Homo sapiens
agcuaaaucucauguugaauug

SEQ ID NO: 28984 - RNA, 22 nt, Homo sapiens
agcuaguguucaccagagguca

SEQ ID NO: 28985 - RNA, 22 nt, Homo sapiens
agcuaugucugaugccugauua

SEQ ID NO: 28986 - RNA, 22 nt, Homo sapiens
agcucacagccuagcacuguga

SEQ ID NO: 28987 - RNA, 18 nt, Homo sapiens
agcucaguguuugcuuac

SEQ ID NO: 28988 - RNA, 22 nt, Homo sapiens
agcuccauuguaaucaccuggu

SEQ ID NO: 28989 - RNA, 22 nt, Homo sapiens
agcuccuacuguuacaucauug

SEQ ID NO: 28990 - RNA, 22 nt, Homo sapiens
agcuccuuucugcaggcagguc

SEQ ID NO: 28991 - RNA, 22 nt, Homo sapiens
agcuccuuugcuuuuuccagga

SEQ ID NO: 28992 - RNA, 22 nt, Homo sapiens
agcugauggucuuguaugaugu

SEQ ID NO: 28993 - RNA, 22 nt, Homo sapiens
agcugcacaaauggaugugagg

SEQ ID NO: 28994 - RNA, 22 nt, Homo sapiens
agcugcacugguauaggagaaa

SEQ ID NO: 28995 - RNA, 22 nt, Homo sapiens
agcugcauuuacuuuugcacaa

SEQ ID NO: 28996 - RNA, 21 nt, Homo sapiens
agcugcguuuaggcauuuucc

SEQ ID NO: 28997 - RNA, 20 nt, Homo sapiens
agcuggguguguuggugcau

SEQ ID NO: 28998 - RNA, 22 nt, Homo sapiens
agcugguaugaaaaucucccca

SEQ ID NO: 28999 - RNA, 22 nt, Homo sapiens
agcugguauuuguuagggaguu

SEQ ID NO: 29000 - RNA, 22 nt, Homo sapiens
agcuggucucaggugcccugcu

SEQ ID NO: 29001 - RNA, 22 nt, Homo sapiens
agcugguuuaauaugcugucug

SEQ ID NO: 29002 - RNA, 21 nt, Homo sapiens
agcugguuuccacagugugcu

SEQ ID NO: 29003 - RNA, 22 nt, Homo sapiens
agcuguaguuugguggauguaa

SEQ ID NO: 29004 - RNA, 22 nt, Homo sapiens
agcuguguugucugaagucaga

SEQ ID NO: 29005 - RNA, 20 nt, Homo sapiens
agcuguuguuaugagguuua

SEQ ID NO: 29006 - RNA, 22 nt, Homo sapiens
agcuuaugcuuggaagagauga

SEQ ID NO: 29007 - RNA, 22 nt, Homo sapiens
agcuucauuccaacuuccuucu

SEQ ID NO: 29008 - RNA, 20 nt, Homo sapiens
agcuugguuuggaugaucac

SEQ ID NO: 29009 - RNA, 22 nt, Homo sapiens
agcuuguguuugucugccuggg

SEQ ID NO: 29010 - RNA, 22 nt, Homo sapiens
aaauucauuucagcucugggua

SEQ ID NO: 29011 - RNA, 18 nt, Homo sapiens
aaauucugucccuucuuc

SEQ ID NO: 29012 - RNA, 23 nt, Homo sapiens
aaauuugccuauuauuccuaugg

SEQ ID NO: 29013 - RNA, 22 nt, Homo sapiens
aacaccauucucuguaacaaga

SEQ ID NO: 29014 - RNA, 22 nt, Homo sapiens
aacagacugucacauaaaauug

SEQ ID NO: 29015 - RNA, 22 nt, Homo sapiens
aacagcuaguaccaauccacua

SEQ ID NO: 29016 - RNA, 22 nt, Homo sapiens
aacaggguggugccugguccau

SEQ ID NO: 29017 - RNA, 22 nt, Homo sapiens
aacagucuccaguuguauccau

SEQ ID NO: 29018 - RNA, 22 nt, Homo sapiens
aacagugccugucauuuaguag

SEQ ID NO: 29019 - RNA, 21 nt, Homo sapiens
aacagugcuuaguagauguuc

SEQ ID NO: 29020 - RNA, 22 nt, Homo sapiens
aacaguguuuuggguuuucugg

SEQ ID NO: 29021 - RNA, 22 nt, Homo sapiens
aacuccauuuuagacccuagau

SEQ ID NO: 29022 - RNA, 22 nt, Homo sapiens
aacucugucuccuucaaguuca

SEQ ID NO: 29023 - RNA, 22 nt, Homo sapiens
aacugccucugacauaggcagg

SEQ ID NO: 29024 - RNA, 22 nt, Homo sapiens
aacuggcacuacaucaagagcu

SEQ ID NO: 29025 - RNA, 22 nt, Homo sapiens
aacuggcauauucugguugcgg

SEQ ID NO: 29026 - RNA, 22 nt, Homo sapiens
aagagagcuaugugcauaauua

SEQ ID NO: 29027 - RNA, 22 nt, Homo sapiens
aagagcauuauuuaguaauuuc

SEQ ID NO: 29028 - RNA, 18 nt, Homo sapiens
aagagcucagcacagguu

SEQ ID NO: 29029 - RNA, 22 nt, Homo sapiens
aagagguaauaacaaagcuucu

SEQ ID NO: 29030 - RNA, 22 nt, Homo sapiens
aagagguaggaaauggucauuu

SEQ ID NO: 29031 - RNA, 22 nt, Homo sapiens
aagagugcucgugggacucagc

SEQ ID NO: 29032 - RNA, 22 nt, Homo sapiens
aagaugguauuucauuaguuuu

SEQ ID NO: 29033 - RNA, 22 nt, Homo sapiens
aagcaaacaucagcuugguuaa

SEQ ID NO: 29034 - RNA, 21 nt, Homo sapiens
aagcacauugaguguguguga

SEQ ID NO: 29035 - RNA, 22 nt, Homo sapiens
aagcaggugaugagugggugug

SEQ ID NO: 29036 - RNA, 22 nt, Homo sapiens
aagcaggugucugugucuguaa

SEQ ID NO: 29037 - RNA, 20 nt, Homo sapiens
aagcauggguuuuaggguca

SEQ ID NO: 29038 - RNA, 21 nt, Homo sapiens
aagcaugguguaucuuuccau

SEQ ID NO: 29039 - RNA, 22 nt, Homo sapiens
aagcucauugagaucuauggcu

SEQ ID NO: 29040 - RNA, 22 nt, Homo sapiens
aagcuggagugcaguggugcaa

SEQ ID NO: 29041 - RNA, 22 nt, Homo sapiens
aagcuggagugcaguggugcga

SEQ ID NO: 29042 - RNA, 22 nt, Homo sapiens
aagcuggauuucgcauccuguu

SEQ ID NO: 29043 - RNA, 22 nt, Homo sapiens
aagcugguguguauuauucacu

SEQ ID NO: 29044 - RNA, 22 nt, Homo sapiens
aagcugguguugcugcucuguu

SEQ ID NO: 29045 - RNA, 22 nt, Homo sapiens
aagcuguugguggauguaccau

SEQ ID NO: 29046 - RNA, 22 nt, Homo sapiens
aaggaagcuagcaggaauuggu

SEQ ID NO: 29047 - RNA, 22 nt, Homo sapiens
aaggaguagacaacauggcgcc

SEQ ID NO: 29048 - RNA, 22 nt, Homo sapiens
aaggagugugauucuucaguuu

SEQ ID NO: 29049 - RNA, 22 nt, Homo sapiens
aaggcaacgugaguuguugauu

SEQ ID NO: 29050 - RNA, 22 nt, Homo sapiens
aaggcaagaaugcgugcuuuca

SEQ ID NO: 29051 - RNA, 22 nt, Homo sapiens
aaggcagugugcacauaacacu

SEQ ID NO: 29052 - RNA, 22 nt, Homo sapiens
aagggaauguuguagcugguuu

SEQ ID NO: 29053 - RNA, 22 nt, Homo sapiens
aagggaauguugugguugguuu

SEQ ID NO: 29054 - RNA, 23 nt, Homo sapiens
aagguaagcuagaaagauguaga

SEQ ID NO: 29055 - RNA, 22 nt, Homo sapiens
aagguguagucucuggauaagc

SEQ ID NO: 29056 - RNA, 21 nt, Homo sapiens
aagguuuuuagugcuugacuu

SEQ ID NO: 29057 - RNA, 19 nt, Homo sapiens
aaguacuugucuuuugaag

SEQ ID NO: 29058 - RNA, 22 nt, Homo sapiens
aaguagcagaggcaagacuuga

SEQ ID NO: 29059 - RNA, 22 nt, Homo sapiens
aaguagugcuugugcucaucuc

SEQ ID NO: 29060 - RNA, 22 nt, Homo sapiens
aaguauguaucaagucauacuu

SEQ ID NO: 29061 - RNA, 22 nt, Homo sapiens
aaguauuagugaggauauggaa

SEQ ID NO: 29062 - RNA, 22 nt, Homo sapiens
aagucacugagacuuguggcug

SEQ ID NO: 29063 - RNA, 22 nt, Homo sapiens
aagucaguuugggagaagcuau

SEQ ID NO: 29064 - RNA, 22 nt, Homo sapiens
aagucaugaagaggaaaggaca

SEQ ID NO: 29065 - RNA, 23 nt, Homo sapiens
aagucauggaaucaaaugaggug

SEQ ID NO: 29066 - RNA, 22 nt, Homo sapiens
aagugaaugaugugaaguguaa

SEQ ID NO: 29067 - RNA, 19 nt, Homo sapiens
aagugaaugcuuuguucac

SEQ ID NO: 29068 - RNA, 22 nt, Homo sapiens
aagugaauucauuguguuauau

SEQ ID NO: 29069 - RNA, 23 nt, Homo sapiens
aagugagcuccaauugggugaga

SEQ ID NO: 29070 - RNA, 22 nt, Homo sapiens
aagugagugacaaaaacugggc

SEQ ID NO: 29071 - RNA, 20 nt, Homo sapiens
aagugaguguuaaacugaac

SEQ ID NO: 29072 - RNA, 22 nt, Homo sapiens
aagugauguuauugggugacuc

SEQ ID NO: 29073 - RNA, 22 nt, Homo sapiens
aagugcaaauucccaggcucug

SEQ ID NO: 29074 - RNA, 22 nt, Homo sapiens
aagugcuggccuacucaaucga

SEQ ID NO: 29075 - RNA, 22 nt, Homo sapiens
aagugcuguaugggagccuagg

SEQ ID NO: 29076 - RNA, 22 nt, Homo sapiens
aagugcuucagaagacaauauu

SEQ ID NO: 29077 - RNA, 22 nt, Homo sapiens
aagugcuucuuuccucgagaag

SEQ ID NO: 29078 - RNA, 22 nt, Homo sapiens
aaguggcauugaggaaaaaaau

SEQ ID NO: 29079 - RNA, 22 nt, Homo sapiens
aaguggccuagagcgaccauuu

SEQ ID NO: 29080 - RNA, 19 nt, Homo sapiens
aagugguuuaaacuuguau

SEQ ID NO: 29081 - RNA, 22 nt, Homo sapiens
aagugguuuuaaucuggugagu

SEQ ID NO: 29082 - RNA, 22 nt, Homo sapiens
aagugucagaguugcuaaugac

SEQ ID NO: 29083 - RNA, 22 nt, Homo sapiens
aaguuaauguuuaagacuccua

SEQ ID NO: 29084 - RNA, 22 nt, Homo sapiens
aaguuguaguuagagaguugcu

SEQ ID NO: 29085 - RNA, 22 nt, Homo sapiens
aauaaagcugaauccuuccuga

SEQ ID NO: 29086 - RNA, 22 nt, Homo sapiens
aauaaaguaggaggugaggaaa

SEQ ID NO: 29087 - RNA, 22 nt, Homo sapiens
aauaagaaguggaagggaccgg

SEQ ID NO: 29088 - RNA, 22 nt, Homo sapiens
aauacugcuuugauguaagcua

SEQ ID NO: 29089 - RNA, 22 nt, Homo sapiens
aauagugcugcaaaaacauacg

SEQ ID NO: 29090 - RNA, 22 nt, Homo sapiens
aauaucacaggguguacacuca

SEQ ID NO: 29091 - RNA, 22 nt, Homo sapiens
aauaucacaguuggguguacac

SEQ ID NO: 29092 - RNA, 22 nt, Homo sapiens
aauauugucaaaauggauucca

SEQ ID NO: 29093 - RNA, 22 nt, Homo sapiens
aaucacaggucuuggcugcaug

SEQ ID NO: 29094 - RNA, 21 nt, Homo sapiens
aaucacugucuguuuccccuu

SEQ ID NO: 29095 - RNA, 22 nt, Homo sapiens
aaucacuuugcuacaaggcagu

SEQ ID NO: 29096 - RNA, 22 nt, Homo sapiens
aaucagcacacugugcuuucca

SEQ ID NO: 29097 - RNA, 22 nt, Homo sapiens
aaucauggaguauuuguccuug

SEQ ID NO: 29098 - RNA, 16 nt, Homo sapiens
aauccauuggcccugc

SEQ ID NO: 29099 - RNA, 22 nt, Homo sapiens
aaucccuuuguccagucucuuu

SEQ ID NO: 29100 - RNA, 22 nt, Homo sapiens
aaucucagcauuuugggcugag

SEQ ID NO: 29101 - RNA, 22 nt, Homo sapiens
aaucugucuuuuguuauugagg

SEQ ID NO: 29102 - RNA, 22 nt, Homo sapiens
aaugacuaagaugguacauuuu

SEQ ID NO: 29103 - RNA, 17 nt, Homo sapiens
aaugagacauuucugcu

SEQ ID NO: 29104 - RNA, 22 nt, Homo sapiens
aaugauauguuauguuuagguu

SEQ ID NO: 29105 - RNA, 22 nt, Homo sapiens
aaugcacauaaaauccuccagg

SEQ ID NO: 29106 - RNA, 22 nt, Homo sapiens
aaugcacuccagccugggcgac

SEQ ID NO: 29107 - RNA, 22 nt, Homo sapiens
aaugccuagugugugacaggug

SEQ ID NO: 29108 - RNA, 22 nt, Homo sapiens
aauggcacaagacaugaagaag

SEQ ID NO: 29109 - RNA, 22 nt, Homo sapiens
aauggcaucuacguuaaauguc

SEQ ID NO: 29110 - RNA, 22 nt, Homo sapiens
cuuugcacaucucugcuuuccc

SEQ ID NO: 29111 - RNA, 21 nt, Homo sapiens
cuuugcacugcuccucagcuc

SEQ ID NO: 29112 - RNA, 22 nt, Homo sapiens
cuuuggguauucucccuugggg

SEQ ID NO: 29113 - RNA, 22 nt, Homo sapiens
cuuugguugugcucuccacuuu

SEQ ID NO: 29114 - RNA, 20 nt, Homo sapiens
cuuuguccuccugcugugcu

SEQ ID NO: 29115 - RNA, 22 nt, Homo sapiens
cuuugugugggccaagggcugg

SEQ ID NO: 29116 - RNA, 22 nt, Homo sapiens
cuuuuacacugcuggugggaau

SEQ ID NO: 29117 - RNA, 22 nt, Homo sapiens
cuuuuacacuguuggcaggauu

SEQ ID NO: 29118 - RNA, 22 nt, Homo sapiens
cuuuugugauucuucaguuacu

SEQ ID NO: 29119 - RNA, 21 nt, Homo sapiens
cuuuuuacucguucauaugca

SEQ ID NO: 29120 - RNA, 22 nt, Homo sapiens
cuuuuugcaaauacaacucuga

SEQ ID NO: 29121 - RNA, 22 nt, Homo sapiens
gaaagugcugcuugacugggau

SEQ ID NO: 29122 - RNA, 22 nt, Homo sapiens
gaaauguauuaaugaguugaaa

SEQ ID NO: 29123 - RNA, 23 nt, Homo sapiens
gaaaugucuuagugaaauugcuu

SEQ ID NO: 29124 - RNA, 22 nt, Homo sapiens
gaacacaucuuugguuagagga

SEQ ID NO: 29125 - RNA, 22 nt, Homo sapiens
gaagauaucuaguaccauuguc

SEQ ID NO: 29126 - RNA, 22 nt, Homo sapiens
gaagauguugcuuaccuuggag

SEQ ID NO: 29127 - RNA, 22 nt, Homo sapiens
gaagguacgcuuaggaaaugau

SEQ ID NO: 29128 - RNA, 22 nt, Homo sapiens
gaaggugcuuggugaaugcauu

SEQ ID NO: 29129 - RNA, 22 nt, Homo sapiens
gaaguaguaaaauuuauugcag

SEQ ID NO: 29130 - RNA, 19 nt, Homo sapiens
gaaguguuuguucuccaug

SEQ ID NO: 29131 - RNA, 22 nt, Homo sapiens
gaauacuguccaagagugaugg

SEQ ID NO: 29132 - RNA, 22 nt, Homo sapiens
gaauagugcugcaagaaacaua

SEQ ID NO: 29133 - RNA, 22 nt, Homo sapiens
gaauagugcugcaguaaacaua

SEQ ID NO: 29134 - RNA, 22 nt, Homo sapiens
gaaucacagauuaugaguaucu

SEQ ID NO: 29135 - RNA, 22 nt, Homo sapiens
gaaucauuguuucuaaguuugu

SEQ ID NO: 29136 - RNA, 22 nt, Homo sapiens
gaaugcagcagugacagggcug

SEQ ID NO: 29137 - RNA, 22 nt, Homo sapiens
gaaugcaugaggggaucagaug

SEQ ID NO: 29138 - RNA, 22 nt, Homo sapiens
gaaugcuaccagcaucuagugg

SEQ ID NO: 29139 - RNA, 22 nt, Homo sapiens
gaauguuuacuuuguuuaauac

SEQ ID NO: 29140 - RNA, 22 nt, Homo sapiens
gaauucugucgcuuacuagaug

SEQ ID NO: 29141 - RNA, 22 nt, Homo sapiens
gaauuguacugcaaucagggga

SEQ ID NO: 29142 - RNA, 22 nt, Homo sapiens
gacacugucuucugcucuuaaa

SEQ ID NO: 29143 - RNA, 22 nt, Homo sapiens
gacaguuucucaggcuuccuua

SEQ ID NO: 29144 - RNA, 20 nt, Homo sapiens
gacauaggcugguaucuggc

SEQ ID NO: 29145 - RNA, 19 nt, Homo sapiens
gacaugagauuuggugggg

SEQ ID NO: 29146 - RNA, 22 nt, Homo sapiens
gacauguuuacaguguugagag

SEQ ID NO: 29147 - RNA, 22 nt, Homo sapiens
gacauguuucucucuguuuacu

SEQ ID NO: 29148 - RNA, 22 nt, Homo sapiens
gacauguuuucauguauuugga

SEQ ID NO: 29149 - RNA, 22 nt, Homo sapiens
gaccacauuccacacaggcuuu

SEQ ID NO: 29150 - RNA, 22 nt, Homo sapiens
gacuagaaauuauuuagugagc

SEQ ID NO: 29151 - RNA, 22 nt, Homo sapiens
gacuaggagauauguuuucuuc

SEQ ID NO: 29152 - RNA, 22 nt, Homo sapiens
gacuaguuaggucucucacaga

SEQ ID NO: 29153 - RNA, 22 nt, Homo sapiens
gacucagucuuggauuuuuaau

SEQ ID NO: 29154 - RNA, 22 nt, Homo sapiens
gacugaguaagcagaagcaauu

SEQ ID NO: 29155 - RNA, 22 nt, Homo sapiens
gacugcauuugccccaucgaau

SEQ ID NO: 29156 - RNA, 22 nt, Homo sapiens
gacuggccuauaauggcgaauu

SEQ ID NO: 29157 - RNA, 16 nt, Homo sapiens
gacugggcugaggaau

SEQ ID NO: 29158 - RNA, 22 nt, Homo sapiens
gacuucaucauacuaugugugg

SEQ ID NO: 29159 - RNA, 20 nt, Homo sapiens
gacuugagagugggagagua

SEQ ID NO: 29160 - RNA, 22 nt, Homo sapiens
gagaacaguguuguauuuuuuc

SEQ ID NO: 29161 - RNA, 22 nt, Homo sapiens
gagaacauacggcauuugguuu

SEQ ID NO: 29162 - RNA, 22 nt, Homo sapiens
gagaaccuccagcaagguagua

SEQ ID NO: 29163 - RNA, 22 nt, Homo sapiens
gagaacugagauaagugauauu

SEQ ID NO: 29164 - RNA, 22 nt, Homo sapiens
gagaacugagugugcuggcgga

SEQ ID NO: 29165 - RNA, 22 nt, Homo sapiens
gagaaguaaauuuauuugcaaa

SEQ ID NO: 29166 - RNA, 22 nt, Homo sapiens
gagaaugaugauuuccaauuuc

SEQ ID NO: 29167 - RNA, 22 nt, Homo sapiens
gagacggagucucgcucugucg

SEQ ID NO: 29168 - RNA, 22 nt, Homo sapiens
gagacggagucuugcucuguug

SEQ ID NO: 29169 - RNA, 22 nt, Homo sapiens
gagacucuuagauuggaaaucu

SEQ ID NO: 29170 - RNA, 22 nt, Homo sapiens
gagacugagucuugcucuguca

SEQ ID NO: 29171 - RNA, 22 nt, Homo sapiens
gagacugagucuugcuuuguca

SEQ ID NO: 29172 - RNA, 22 nt, Homo sapiens
gagagaguacuugauauaauuu

SEQ ID NO: 29173 - RNA, 22 nt, Homo sapiens
gagagcuaggccacuggggcuu

SEQ ID NO: 29174 - RNA, 22 nt, Homo sapiens
gagagugcuuggcaucugcuga

SEQ ID NO: 29175 - RNA, 22 nt, Homo sapiens
gagauagguauuucauuuaccc

SEQ ID NO: 29176 - RNA, 22 nt, Homo sapiens
gagauauuuagaaauguguucu

SEQ ID NO: 29177 - RNA, 22 nt, Homo sapiens
gagaucacuucuguauucuaca

SEQ ID NO: 29178 - RNA, 22 nt, Homo sapiens
gagaucaguuaaugaagugagc

SEQ ID NO: 29179 - RNA, 22 nt, Homo sapiens
gagaucaucuaaucuggccucu

SEQ ID NO: 29180 - RNA, 22 nt, Homo sapiens
gagaucuuggccaaguuucuua

SEQ ID NO: 29181 - RNA, 22 nt, Homo sapiens
gagaugaaaucuugcucuguca

SEQ ID NO: 29182 - RNA, 22 nt, Homo sapiens
gagaugauuugccccauguauu

SEQ ID NO: 29183 - RNA, 22 nt, Homo sapiens
gagaugguguuccacugccagu

SEQ ID NO: 29184 - RNA, 22 nt, Homo sapiens
gagaugucuauuucagagaugu

SEQ ID NO: 29185 - RNA, 20 nt, Homo sapiens
gagauguugaucagggcuau

SEQ ID NO: 29186 - RNA, 22 nt, Homo sapiens
gagauuauuagauguucugcuu

SEQ ID NO: 29187 - RNA, 22 nt, Homo sapiens
gagauugucaugauuacauugu

SEQ ID NO: 29188 - RNA, 22 nt, Homo sapiens
gagcacccuuuguugauugcaa

SEQ ID NO: 29189 - RNA, 22 nt, Homo sapiens
gagcacugaauacugugguggu

SEQ ID NO: 29190 - RNA, 22 nt, Homo sapiens
gagcagacaugaggaccgcugg

SEQ ID NO: 29191 - RNA, 22 nt, Homo sapiens
gagcaucaauggcaugugggaa

SEQ ID NO: 29192 - RNA, 22 nt, Homo sapiens
gagcaucaguggccucaucuca

SEQ ID NO: 29193 - RNA, 22 nt, Homo sapiens
gagcuacauggauagucugcau

SEQ ID NO: 29194 - RNA, 21 nt, Homo sapiens
gagcuaggugaggcuguaaug

SEQ ID NO: 29195 - RNA, 22 nt, Homo sapiens
gagcuagguuuugaauccagac

SEQ ID NO: 29196 - RNA, 20 nt, Homo sapiens
gagcucaucuucuuuaccac

SEQ ID NO: 29197 - RNA, 22 nt, Homo sapiens
gagcucauuaaaaauguagaau

SEQ ID NO: 29198 - RNA, 22 nt, Homo sapiens
gagcuccuccccuuggcuuuca

SEQ ID NO: 29199 - RNA, 22 nt, Homo sapiens
gagcugaucuuuucugauucca

SEQ ID NO: 29200 - RNA, 22 nt, Homo sapiens
gagcugccuugccuaugcaaga

SEQ ID NO: 29201 - RNA, 22 nt, Homo sapiens
gagcuggacuucuuaccuuuuc

SEQ ID NO: 29202 - RNA, 20 nt, Homo sapiens
gagcugguguacugccgggc

SEQ ID NO: 29203 - RNA, 22 nt, Homo sapiens
gaggacauuaugcuaaguggaa

SEQ ID NO: 29204 - RNA, 22 nt, Homo sapiens
gaggaguauuuugucgaauguc

SEQ ID NO: 29205 - RNA, 22 nt, Homo sapiens
gaggcauugaaauauugcuuau

SEQ ID NO: 29206 - RNA, 22 nt, Homo sapiens
gagguacgaaauacacuguacu

SEQ ID NO: 29207 - RNA, 22 nt, Homo sapiens
gagguagagacuauguauuaga

SEQ ID NO: 29208 - RNA, 22 nt, Homo sapiens
gagguaggaauaaacauuugaa

SEQ ID NO: 29209 - RNA, 21 nt, Homo sapiens
gagguagggauuaaagaccuc

SEQ ID NO: 29210 - RNA, 22 nt, Homo sapiens
ucacuuugacggccaacuucua

SEQ ID NO: 29211 - RNA, 21 nt, Homo sapiens
ucagaagcucccagggaggac

SEQ ID NO: 29212 - RNA, 22 nt, Homo sapiens
ucagacacugagcaaacgacua

SEQ ID NO: 29213 - RNA, 22 nt, Homo sapiens
ucagacacuguggccuuuggac

SEQ ID NO: 29214 - RNA, 22 nt, Homo sapiens
ucagaguagaaacacuuccaua

SEQ ID NO: 29215 - RNA, 22 nt, Homo sapiens
ucagaguagagcgacuucuccu

SEQ ID NO: 29216 - RNA, 22 nt, Homo sapiens
ucagaguaguuccuggcagaaa

SEQ ID NO: 29217 - RNA, 22 nt, Homo sapiens
ucagaguguuuuccaacuuggu

SEQ ID NO: 29218 - RNA, 22 nt, Homo sapiens
ucagaucauauucuucgcugcu

SEQ ID NO: 29219 - RNA, 22 nt, Homo sapiens
ucagaugaucugguaagaacuu

SEQ ID NO: 29220 - RNA, 22 nt, Homo sapiens
ucagaugauucuguuguugugu

SEQ ID NO: 29221 - RNA, 22 nt, Homo sapiens
ucagaugcauccauaccccacu

SEQ ID NO: 29222 - RNA, 22 nt, Homo sapiens
ucagauguuugagaaguauacu

SEQ ID NO: 29223 - RNA, 22 nt, Homo sapiens
ucagcaaugaccuaagcaaaua

SEQ ID NO: 29224 - RNA, 22 nt, Homo sapiens
ucagcaccauguaacaauugau

SEQ ID NO: 29225 - RNA, 22 nt, Homo sapiens
ucagcagugagagaccucaccc

SEQ ID NO: 29226 - RNA, 22 nt, Homo sapiens
ucagcagugugaaaacaaacua

SEQ ID NO: 29227 - RNA, 22 nt, Homo sapiens
ucagcagugugaaaauggacua

SEQ ID NO: 29228 - RNA, 22 nt, Homo sapiens
ucagcaucacaggcagugagug

SEQ ID NO: 29229 - RNA, 22 nt, Homo sapiens
ucaggcaccuuccucuuaucug

SEQ ID NO: 29230 - RNA, 22 nt, Homo sapiens
ucaggcacuaguaagaaaaagg

SEQ ID NO: 29231 - RNA, 22 nt, Homo sapiens
ucaggcaugcagcaaugcagug

SEQ ID NO: 29232 - RNA, 20 nt, Homo sapiens
ucaggcuccgcauuaacuua

SEQ ID NO: 29233 - RNA, 22 nt, Homo sapiens
ucagggacgcuugacacaagcc

SEQ ID NO: 29234 - RNA, 23 nt, Homo sapiens
ucagguaggccuagaguauucuu

SEQ ID NO: 29235 - RNA, 20 nt, Homo sapiens
ucagguagggcuucaacauu

SEQ ID NO: 29236 - RNA, 22 nt, Homo sapiens
ucaggucauuccaggagggcca

SEQ ID NO: 29237 - RNA, 22 nt, Homo sapiens
ucaggugcaguggcucaugcuu

SEQ ID NO: 29238 - RNA, 23 nt, Homo sapiens
ucaguacucuauaagugccagcu

SEQ ID NO: 29239 - RNA, 19 nt, Homo sapiens
ucaguagugcacauaagcc

SEQ ID NO: 29240 - RNA, 22 nt, Homo sapiens
ucaguaguuuuuuuacuaggug

SEQ ID NO: 29241 - RNA, 22 nt, Homo sapiens
ucagucauguuuaccagacgua

SEQ ID NO: 29242 - RNA, 22 nt, Homo sapiens
ucaguccccucgcugagucuac

SEQ ID NO: 29243 - RNA, 22 nt, Homo sapiens
ucagugaauguuggccacuacu

SEQ ID NO: 29244 - RNA, 22 nt, Homo sapiens
ucagugacuggguauuaaauca

SEQ ID NO: 29245 - RNA, 20 nt, Homo sapiens
ucagugcagauuguccaagu

SEQ ID NO: 29246 - RNA, 22 nt, Homo sapiens
ucagugcaggaaucucuagcca

SEQ ID NO: 29247 - RNA, 22 nt, Homo sapiens
ucagugccauugccauaugagu

SEQ ID NO: 29248 - RNA, 22 nt, Homo sapiens
ucagugccucaguuuuuaaaga

SEQ ID NO: 29249 - RNA, 22 nt, Homo sapiens
ucagugcuuggcacagagagcu

SEQ ID NO: 29250 - RNA, 22 nt, Homo sapiens
ucaguggacuuagucuuucccc

SEQ ID NO: 29251 - RNA, 22 nt, Homo sapiens
ucaguggagagcuuccaggauu

SEQ ID NO: 29252 - RNA, 22 nt, Homo sapiens
ucaguggauuuaaccugaauca

SEQ ID NO: 29253 - RNA, 22 nt, Homo sapiens
ucaguguuuggaaucucaauuu

SEQ ID NO: 29254 - RNA, 22 nt, Homo sapiens
ucaguguuuuauccuccagagc

SEQ ID NO: 29255 - RNA, 22 nt, Homo sapiens
ucaguucauggaggugucugcu

SEQ ID NO: 29256 - RNA, 22 nt, Homo sapiens
ucaguuuguauuucagguugca

SEQ ID NO: 29257 - RNA, 21 nt, Homo sapiens
ucauaagcucaacaucuguag

SEQ ID NO: 29258 - RNA, 22 nt, Homo sapiens
ucauagaucaaguaauaagaca

SEQ ID NO: 29259 - RNA, 20 nt, Homo sapiens
ucauagcuuuuuccacuuua

SEQ ID NO: 29260 - RNA, 22 nt, Homo sapiens
ucauaguacuuuguuuugaaaa

SEQ ID NO: 29261 - RNA, 21 nt, Homo sapiens
ucauauguaucuuugugccuc

SEQ ID NO: 29262 - RNA, 22 nt, Homo sapiens
ucaucaggaaacuuaugcagug

SEQ ID NO: 29263 - RNA, 22 nt, Homo sapiens
ucaucaguuuuuuauaugugau

SEQ ID NO: 29264 - RNA, 22 nt, Homo sapiens
ucaugagacacacuggaaagga

SEQ ID NO: 29265 - RNA, 19 nt, Homo sapiens
ucaugugcauacauuuggg

SEQ ID NO: 29266 - RNA, 22 nt, Homo sapiens
ucauguguugcacugaggaccu

SEQ ID NO: 29267 - RNA, 22 nt, Homo sapiens
ucauucacucccuugaaguuag

SEQ ID NO: 29268 - RNA, 22 nt, Homo sapiens
ucauuggaugagaccccugucc

SEQ ID NO: 29269 - RNA, 22 nt, Homo sapiens
uccaagaugcuggcagcuacag

SEQ ID NO: 29270 - RNA, 22 nt, Homo sapiens
uccacaguggugaggugcagca

SEQ ID NO: 29271 - RNA, 22 nt, Homo sapiens
uccacagugguugaacuaguaa

SEQ ID NO: 29272 - RNA, 18 nt, Homo sapiens
uccacgugcuuuccagau

SEQ ID NO: 29273 - RNA, 22 nt, Homo sapiens
uucuggcuuuuaaagaaauguu

SEQ ID NO: 29274 - RNA, 22 nt, Homo sapiens
uucugugguugaaaggagagau

SEQ ID NO: 29275 - RNA, 22 nt, Homo sapiens
uucuuagucaaguuguauuuca

SEQ ID NO: 29276 - RNA, 22 nt, Homo sapiens
uucuuaguggcaccacuuuuuu

SEQ ID NO: 29277 - RNA, 21 nt, Homo sapiens
uucuucaggcagaaggauuau

SEQ ID NO: 29278 - RNA, 22 nt, Homo sapiens
uucuucaggcauucccagaagc

SEQ ID NO: 29279 - RNA, 22 nt, Homo sapiens
uucuucaggccacaaaaauggu

SEQ ID NO: 29280 - RNA, 22 nt, Homo sapiens
uucuucaguuacaacaaggggg

SEQ ID NO: 29281 - RNA, 22 nt, Homo sapiens
uucuuccagccuugaggggccc

SEQ ID NO: 29282 - RNA, 22 nt, Homo sapiens
uucuugcacuuggcccucauua

SEQ ID NO: 29283 - RNA, 22 nt, Homo sapiens
uucuugguuuaucgcuuuaaaa

SEQ ID NO: 29284 - RNA, 22 nt, Homo sapiens
uugaaagacagaggggcaaguu

SEQ ID NO: 29285 - RNA, 22 nt, Homo sapiens
uugaagacuaaguuaucaggau

SEQ ID NO: 29286 - RNA, 22 nt, Homo sapiens
uugaaggaggugcucacucucg

SEQ ID NO: 29287 - RNA, 19 nt, Homo sapiens
uugaaggccgccuugcaga

SEQ ID NO: 29288 - RNA, 22 nt, Homo sapiens
uugaagguaggaugugcuauca

SEQ ID NO: 29289 - RNA, 22 nt, Homo sapiens
uugaaguagaaagacgaaauuu

SEQ ID NO: 29290 - RNA, 22 nt, Homo sapiens
uugaaguaguacuuuauuauag

SEQ ID NO: 29291 - RNA, 22 nt, Homo sapiens
uugaauagacagccagcuuuaa

SEQ ID NO: 29292 - RNA, 22 nt, Homo sapiens
uugaauagcauguuuagugcau

SEQ ID NO: 29293 - RNA, 22 nt, Homo sapiens
uugaauaggcucaugcuuauca

SEQ ID NO: 29294 - RNA, 22 nt, Homo sapiens
uugaaugaauggaaagaagggu

SEQ ID NO: 29295 - RNA, 22 nt, Homo sapiens
uugaauguaugcuggguuuacu

SEQ ID NO: 29296 - RNA, 22 nt, Homo sapiens
uugacagaccuuggucauaucc

SEQ ID NO: 29297 - RNA, 22 nt, Homo sapiens
uugacauaguuucugaaauaga

SEQ ID NO: 29298 - RNA, 22 nt, Homo sapiens
uugacauauuugugcuuaagaa

SEQ ID NO: 29299 - RNA, 22 nt, Homo sapiens
uugacuuuuaggaggaaaauga

SEQ ID NO: 29300 - RNA, 22 nt, Homo sapiens
uugacuuuuauucacucugcua

SEQ ID NO: 29301 - RNA, 22 nt, Homo sapiens
uugagaagugucuguucauguc

SEQ ID NO: 29302 - RNA, 21 nt, Homo sapiens
uugagacggagucucacucug

SEQ ID NO: 29303 - RNA, 22 nt, Homo sapiens
uugagacggagucuugcucuuu

SEQ ID NO: 29304 - RNA, 22 nt, Homo sapiens
uugagacugaacauuuguguac

SEQ ID NO: 29305 - RNA, 22 nt, Homo sapiens
uugagagagaacauuuguuaca

SEQ ID NO: 29306 - RNA, 22 nt, Homo sapiens
uugagaguggcagagguggaac

SEQ ID NO: 29307 - RNA, 22 nt, Homo sapiens
uugagauaggaacucacuaugc

SEQ ID NO: 29308 - RNA, 22 nt, Homo sapiens
uugagaugaagucuugcucucu

SEQ ID NO: 29309 - RNA, 22 nt, Homo sapiens
uugagaugaaguuuugcucuuu

SEQ ID NO: 29310 - RNA, 22 nt, Homo sapiens
uugagauggagucucacucugu

SEQ ID NO: 29311 - RNA, 22 nt, Homo sapiens
uugagauggagucucacucuug

SEQ ID NO: 29312 - RNA, 22 nt, Homo sapiens
uugagauggagucucgcacugu

SEQ ID NO: 29313 - RNA, 22 nt, Homo sapiens
uugagauggagucucgcucuuu

SEQ ID NO: 29314 - RNA, 22 nt, Homo sapiens
uugagauggagucuuguucucu

SEQ ID NO: 29315 - RNA, 22 nt, Homo sapiens
uugagauggagucuuguucuuu

SEQ ID NO: 29316 - RNA, 22 nt, Homo sapiens
uugagauggaguuucaauauug

SEQ ID NO: 29317 - RNA, 22 nt, Homo sapiens
uugagauggaguuucacucucg

SEQ ID NO: 29318 - RNA, 22 nt, Homo sapiens
uugagauggaguuucacucugu

SEQ ID NO: 29319 - RNA, 22 nt, Homo sapiens
uugagauggaguuucacucuug

SEQ ID NO: 29320 - RNA, 22 nt, Homo sapiens
uugagauggaguuucgcucuuu

SEQ ID NO: 29321 - RNA, 19 nt, Homo sapiens
uugagaugugaacucacac

SEQ ID NO: 29322 - RNA, 22 nt, Homo sapiens
uugagauguggguuggugacuu

SEQ ID NO: 29323 - RNA, 22 nt, Homo sapiens
uugagauuauuguguuccuuua

SEQ ID NO: 29324 - RNA, 22 nt, Homo sapiens
uugagcaacauagugagacugu

SEQ ID NO: 29325 - RNA, 22 nt, Homo sapiens
uugagcaaugucacugaggcuu

SEQ ID NO: 29326 - RNA, 22 nt, Homo sapiens
uugagcacaggaguuugagacc

SEQ ID NO: 29327 - RNA, 22 nt, Homo sapiens
uugagcacauguguuaaggggu

SEQ ID NO: 29328 - RNA, 19 nt, Homo sapiens
uugagcacugccggaguua

SEQ ID NO: 29329 - RNA, 22 nt, Homo sapiens
uugagcacugucugugugcagu

SEQ ID NO: 29330 - RNA, 22 nt, Homo sapiens
uugagcccuggaggcagaggcu

SEQ ID NO: 29331 - RNA, 22 nt, Homo sapiens
uugagcucaucaagauagagaa

SEQ ID NO: 29332 - RNA, 22 nt, Homo sapiens
uugaggacugguugaaagcuuu

SEQ ID NO: 29333 - RNA, 22 nt, Homo sapiens
uugaggccugauaacacacuga

SEQ ID NO: 29334 - RNA, 22 nt, Homo sapiens
uugagggagcacagauucuuau

SEQ ID NO: 29335 - RNA, 22 nt, Homo sapiens
uugagggagcauuuguuuugag

SEQ ID NO: 29336 - RNA, 22 nt, Homo sapiens
uugagggaggccucaguuuaca

SEQ ID NO: 29337 - RNA, 22 nt, Homo sapiens
uugagguauugauaaaacauuu

SEQ ID NO: 29338 - RNA, 22 nt, Homo sapiens
uugaggucagagguucgagacc

SEQ ID NO: 29339 - RNA, 22 nt, Homo sapiens
uugaggucuucaggaucaggcu

SEQ ID NO: 29340 - RNA, 22 nt, Homo sapiens
uugaggucuuugagcaaacgca

SEQ ID NO: 29341 - RNA, 22 nt, Homo sapiens
uugagguuggaggccuugccug

SEQ ID NO: 29342 - RNA, 22 nt, Homo sapiens
uugaguagauaccuaggaauag

SEQ ID NO: 29343 - RNA, 22 nt, Homo sapiens
uugagugaaugaaugauuaaau

SEQ ID NO: 29344 - RNA, 22 nt, Homo sapiens
uugaguuuaucuaaagaccugg

SEQ ID NO: 29345 - RNA, 22 nt, Homo sapiens
uugauagaucagggauuugauu

SEQ ID NO: 29346 - RNA, 22 nt, Homo sapiens
uugauaguccuguaucuauuuu

SEQ ID NO: 29347 - RNA, 22 nt, Homo sapiens
uugauaguuuaauuaaugcuag

SEQ ID NO: 29348 - RNA, 22 nt, Homo sapiens
uugauaugguauaagauuucau

SEQ ID NO: 29349 - RNA, 22 nt, Homo sapiens
uugauauguguauagcaugugg

SEQ ID NO: 29350 - RNA, 22 nt, Homo sapiens
uugauauguuguuggauucacu

SEQ ID NO: 29351 - RNA, 22 nt, Homo sapiens
uugauauuaaguacugaagugg

SEQ ID NO: 29352 - RNA, 22 nt, Homo sapiens
uugauauucuuucuggauccca

SEQ ID NO: 29353 - RNA, 22 nt, Homo sapiens
uugaucaauagaauacaacaga

SEQ ID NO: 29354 - RNA, 22 nt, Homo sapiens
uugauuagauccaguugauuga

SEQ ID NO: 29355 - RNA, 22 nt, Homo sapiens
uugcaacuuagaaaaaucauuu

SEQ ID NO: 29356 - RNA, 22 nt, Homo sapiens
uugcaagauguuaacauuggag

SEQ ID NO: 29357 - RNA, 22 nt, Homo sapiens
uugcaaggugcucgaagggcuc

SEQ ID NO: 29358 - RNA, 22 nt, Homo sapiens
uugcacaauccugugagugagu

SEQ ID NO: 29359 - RNA, 22 nt, Homo sapiens
uugcacauguugaaccagcaaa

SEQ ID NO: 29360 - RNA, 22 nt, Homo sapiens
uugcacauuuuuucuggcagaa

SEQ ID NO: 29361 - RNA, 22 nt, Homo sapiens
uugcaccacugcacuccacccu

SEQ ID NO: 29362 - RNA, 22 nt, Homo sapiens
uugcaccccuacuauuugccaa

SEQ ID NO: 29363 - RNA, 22 nt, Homo sapiens
uugcacuauaggaaaauguguc

SEQ ID NO: 29364 - RNA, 22 nt, Homo sapiens
uugcacuauuaguauagauguc

SEQ ID NO: 29365 - RNA, 22 nt, Homo sapiens
uugcagagaaauuucugguuua

SEQ ID NO: 29366 - RNA, 20 nt, Homo sapiens
uugcagagcccaacccugga

SEQ ID NO: 29367 - RNA, 22 nt, Homo sapiens
uugcagagccccacacugggcu

SEQ ID NO: 29368 - RNA, 22 nt, Homo sapiens
uugcagagucaguuauuuugcc

SEQ ID NO: 29369 - RNA, 22 nt, Homo sapiens
uugcagcaaauaggaaugagga

SEQ ID NO: 29370 - RNA, 22 nt, Homo sapiens
uugcaguaguaacuccuuaccu

SEQ ID NO: 29371 - RNA, 22 nt, Homo sapiens
uugcaguagucugaaagcaaua

SEQ ID NO: 29372 - RNA, 22 nt, Homo sapiens
uugcauaaguugaaccagccuu

SEQ ID NO: 29373 - RNA, 22 nt, Homo sapiens
uugcauagacaauauuaaucuu

SEQ ID NO: 29374 - RNA, 22 nt, Homo sapiens
uuucaagugcugucuuagcugu

SEQ ID NO: 29375 - RNA, 22 nt, Homo sapiens
uuucacagagggcuucuuucua

SEQ ID NO: 29376 - RNA, 22 nt, Homo sapiens
uuucacaguguucucccccaga

SEQ ID NO: 29377 - RNA, 22 nt, Homo sapiens
uuucaccguguuggccaggcug

SEQ ID NO: 29378 - RNA, 22 nt, Homo sapiens
uuucacuagccagcccuuuauu

SEQ ID NO: 29379 - RNA, 21 nt, Homo sapiens
uuucacugugaguuuuucugu

SEQ ID NO: 29380 - RNA, 17 nt, Homo sapiens
uuucagaguggaagugu

SEQ ID NO: 29381 - RNA, 22 nt, Homo sapiens
uuucaggcagggagcuucagug

SEQ ID NO: 29382 - RNA, 18 nt, Homo sapiens
uuucaggguggacaugag

SEQ ID NO: 29383 - RNA, 20 nt, Homo sapiens
uuucaguacuuucuacuggc

SEQ ID NO: 29384 - RNA, 22 nt, Homo sapiens
uuucauagaucaugcuuuugga

SEQ ID NO: 29385 - RNA, 22 nt, Homo sapiens
uuucauagccuucuaaugaguu

SEQ ID NO: 29386 - RNA, 22 nt, Homo sapiens
uuucauggacgcaaugccuuuu

SEQ ID NO: 29387 - RNA, 19 nt, Homo sapiens
uuucauguuuuuggugaga

SEQ ID NO: 29388 - RNA, 18 nt, Homo sapiens
uuucauugagugugauau

SEQ ID NO: 29389 - RNA, 22 nt, Homo sapiens
ccagauguuuucauucagcaag

SEQ ID NO: 29390 - RNA, 22 nt, Homo sapiens
ccagccgggugcaguggcucac

SEQ ID NO: 29391 - RNA, 22 nt, Homo sapiens
ccaggguuccacgccuggcugu

SEQ ID NO: 29392 - RNA, 21 nt, Homo sapiens
ccaguguaaugauagcaggca

SEQ ID NO: 29393 - RNA, 22 nt, Homo sapiens
ccaguguuuuugaauuccagga

SEQ ID NO: 29394 - RNA, 22 nt, Homo sapiens
ccaucccuuucugagcaguucc

SEQ ID NO: 29395 - RNA, 21 nt, Homo sapiens
ccauggcaaugguaaacugac

SEQ ID NO: 29396 - RNA, 22 nt, Homo sapiens
ccauggcaauggucagucuauu

SEQ ID NO: 29397 - RNA, 22 nt, Homo sapiens
ccauggcuucugcauucuguca

SEQ ID NO: 29398 - RNA, 21 nt, Homo sapiens
ccaugggacggaaugaauaca

SEQ ID NO: 29399 - RNA, 22 nt, Homo sapiens
ccauugaacaugaaggaaugug

SEQ ID NO: 29400 - RNA, 22 nt, Homo sapiens
ccauugcacuccagccuaggca

SEQ ID NO: 29401 - RNA, 22 nt, Homo sapiens
ccauugcacucuggccuaggug

SEQ ID NO: 29402 - RNA, 22 nt, Homo sapiens
cccagugaagagaaccuuacga

SEQ ID NO: 29403 - RNA, 18 nt, Homo sapiens
cccagugacuuauggccu

SEQ ID NO: 29404 - RNA, 22 nt, Homo sapiens
cccaguuuugcuucucaugagg

SEQ ID NO: 29405 - RNA, 22 nt, Homo sapiens
ccccaguguguaaaggccuugc

SEQ ID NO: 29406 - RNA, 22 nt, Homo sapiens
ccccauuguugugguuuuaucu

SEQ ID NO: 29407 - RNA, 17 nt, Homo sapiens
ccccugagcgaugcagu

SEQ ID NO: 29408 - RNA, 20 nt, Homo sapiens
ccccuggaguggggcugcuu

SEQ ID NO: 29409 - RNA, 22 nt, Homo sapiens
cccgggcugaaaucagauuugu

SEQ ID NO: 29410 - RNA, 18 nt, Homo sapiens
cccgggugggcuguuccc

SEQ ID NO: 29411 - RNA, 23 nt, Homo sapiens
cccucagaagugcagggagagaa

SEQ ID NO: 29412 - RNA, 22 nt, Homo sapiens
cccugaagaaagccuaggacau

SEQ ID NO: 29413 - RNA, 22 nt, Homo sapiens
cccugaagacuccaccgucaug

SEQ ID NO: 29414 - RNA, 22 nt, Homo sapiens
cccuggacauucaucauuaugu

SEQ ID NO: 29415 - RNA, 22 nt, Homo sapiens
ccggcuguguggagaggccccu

SEQ ID NO: 29416 - RNA, 22 nt, Homo sapiens
ccuaggcacugggguccagccc

SEQ ID NO: 29417 - RNA, 22 nt, Homo sapiens
uaacauagucauauacuugcuu

SEQ ID NO: 29418 - RNA, 23 nt, Homo sapiens
uaacauugcaugauuaccugcau

SEQ ID NO: 29419 - RNA, 22 nt, Homo sapiens
uaacccuuacaacuacacucgu

SEQ ID NO: 29420 - RNA, 22 nt, Homo sapiens
uaacuacuucugcuucagagua

SEQ ID NO: 29421 - RNA, 22 nt, Homo sapiens
uaacuagaaaggagacaguugc

SEQ ID NO: 29422 - RNA, 22 nt, Homo sapiens
uaacuucaucauaagucaagaa

SEQ ID NO: 29423 - RNA, 22 nt, Homo sapiens
uaagaugcagauuugggcgggg

SEQ ID NO: 29424 - RNA, 22 nt, Homo sapiens
uaagcaguaaaugaagucuugc

SEQ ID NO: 29425 - RNA, 22 nt, Homo sapiens
uaagcagugcaagaauggaaua

SEQ ID NO: 29426 - RNA, 22 nt, Homo sapiens
uaagccaccgugccuggccuaa

SEQ ID NO: 29427 - RNA, 22 nt, Homo sapiens
uaagcuauagugaauaaauugc

SEQ ID NO: 29428 - RNA, 22 nt, Homo sapiens
uaaggaacucugauaucuggaa

SEQ ID NO: 29429 - RNA, 22 nt, Homo sapiens
uaaggaguagaauaguaaggca

SEQ ID NO: 29430 - RNA, 22 nt, Homo sapiens
uaaggcaaaccuuggcugcagu

SEQ ID NO: 29431 - RNA, 18 nt, Homo sapiens
uaaggcacuauaggcauu

SEQ ID NO: 29432 - RNA, 22 nt, Homo sapiens
uaaggcccgugaguuucauauc

SEQ ID NO: 29433 - RNA, 22 nt, Homo sapiens
uaaggcuagcaagaugagaaua

SEQ ID NO: 29434 - RNA, 22 nt, Homo sapiens
uaaggcuuugcuggacucaguc

SEQ ID NO: 29435 - RNA, 22 nt, Homo sapiens
uaaguaaaugaaagguugauuu

SEQ ID NO: 29436 - RNA, 22 nt, Homo sapiens
uaaguaauugugguuucugcca

SEQ ID NO: 29437 - RNA, 19 nt, Homo sapiens
uaaguagaugacugaugcu

SEQ ID NO: 29438 - RNA, 22 nt, Homo sapiens
uaaguagugugcauguauguau

SEQ ID NO: 29439 - RNA, 22 nt, Homo sapiens
uaaguaguguugagacaaguuu

SEQ ID NO: 29440 - RNA, 22 nt, Homo sapiens
uaaguauagguaacagaagcaa

SEQ ID NO: 29441 - RNA, 22 nt, Homo sapiens
uaaguauuaugugcugcauuuu

SEQ ID NO: 29442 - RNA, 22 nt, Homo sapiens
uaagugaauuucacuacugagu

SEQ ID NO: 29443 - RNA, 22 nt, Homo sapiens
uaagugaauuugacagguaaug

SEQ ID NO: 29444 - RNA, 20 nt, Homo sapiens
uaagugcuugaugaaugaac

SEQ ID NO: 29445 - RNA, 18 nt, Homo sapiens
uaagugcuuuaaacacau

SEQ ID NO: 29446 - RNA, 22 nt, Homo sapiens
uaagugguguucauucuuuuga

SEQ ID NO: 29447 - RNA, 22 nt, Homo sapiens
uaaguuguagaacguuuucuua

SEQ ID NO: 29448 - RNA, 22 nt, Homo sapiens
uaaguuguugacauuaggggaa

SEQ ID NO: 29449 - RNA, 18 nt, Homo sapiens
uaauaacugugaccuuga

SEQ ID NO: 29450 - RNA, 22 nt, Homo sapiens
uaauaauguuaggcuuacucaa

SEQ ID NO: 29451 - RNA, 22 nt, Homo sapiens
uaauacauucaaggugguaguu

SEQ ID NO: 29452 - RNA, 22 nt, Homo sapiens
uaauagcaguguuacuaggacu

SEQ ID NO: 29453 - RNA, 22 nt, Homo sapiens
uaaucacagagguuuggccuca

SEQ ID NO: 29454 - RNA, 22 nt, Homo sapiens
uaaugcacucgaaucauggaau

SEQ ID NO: 29455 - RNA, 22 nt, Homo sapiens
uaauugaaugcagacaccaggg

SEQ ID NO: 29456 - RNA, 22 nt, Homo sapiens
uacaaagcuuucugcaaaucau

SEQ ID NO: 29457 - RNA, 22 nt, Homo sapiens
uacaaagcuuugaugugucuuu

SEQ ID NO: 29458 - RNA, 22 nt, Homo sapiens
uacaagcuaaaauggaagauca

SEQ ID NO: 29459 - RNA, 22 nt, Homo sapiens
uacacagucaaaaauuuccagg

SEQ ID NO: 29460 - RNA, 20 nt, Homo sapiens
uacacguaugagcacaugug

SEQ ID NO: 29461 - RNA, 22 nt, Homo sapiens
uacagaauauuucugcccugag

SEQ ID NO: 29462 - RNA, 22 nt, Homo sapiens
uacagaguauccauuugaguuc

SEQ ID NO: 29463 - RNA, 19 nt, Homo sapiens
uacaggacugagcugaggu

SEQ ID NO: 29464 - RNA, 22 nt, Homo sapiens
uacaggcaccuggcuaauuuuu

SEQ ID NO: 29465 - RNA, 22 nt, Homo sapiens
uacagguaugugucuauauaca

SEQ ID NO: 29466 - RNA, 22 nt, Homo sapiens
uacaggugcuuauguggacaua

SEQ ID NO: 29467 - RNA, 22 nt, Homo sapiens
uacaguacacagguaccaagcu

SEQ ID NO: 29468 - RNA, 22 nt, Homo sapiens
uacaguagaaugucuuucaaaa

SEQ ID NO: 29469 - RNA, 22 nt, Homo sapiens
uuuccaguuggaagaaggggga

SEQ ID NO: 29470 - RNA, 22 nt, Homo sapiens
uuucccauuguucugcucugug

SEQ ID NO: 29471 - RNA, 22 nt, Homo sapiens
uuucccuuacuuaaacuuacuc

SEQ ID NO: 29472 - RNA, 22 nt, Homo sapiens
uuuccuggagaaucuuaacaaa

SEQ ID NO: 29473 - RNA, 22 nt, Homo sapiens
uuuccuguaggaaggaaauaga

SEQ ID NO: 29474 - RNA, 20 nt, Homo sapiens
uuucuccccuauaaaucuca

SEQ ID NO: 29475 - RNA, 22 nt, Homo sapiens
uuucugguuaauuucuaagagc

SEQ ID NO: 29476 - RNA, 23 nt, Homo sapiens
uuucuugggcaugcuaugucagu

SEQ ID NO: 29477 - RNA, 22 nt, Homo sapiens
uuucuugguuguauuuagacuu

SEQ ID NO: 29478 - RNA, 22 nt, Homo sapiens
uuugaaaguaauuugguuggug

SEQ ID NO: 29479 - RNA, 22 nt, Homo sapiens
uuugaaccauuugaagaaugau

SEQ ID NO: 29480 - RNA, 22 nt, Homo sapiens
uuugacuaccaggaauguucuu

SEQ ID NO: 29481 - RNA, 22 nt, Homo sapiens
uuugagaaugcuaccagagaag

SEQ ID NO: 29482 - RNA, 22 nt, Homo sapiens
uuugagauaucuuccaucagua

SEQ ID NO: 29483 - RNA, 22 nt, Homo sapiens
uuugagcuugacucagcuggag

SEQ ID NO: 29484 - RNA, 22 nt, Homo sapiens
uuugcacuugaaaacacucuca

SEQ ID NO: 29485 - RNA, 22 nt, Homo sapiens
uuugcagugucagcuucugugu

SEQ ID NO: 29486 - RNA, 22 nt, Homo sapiens
uuugcaguuuauuccuggggcu

SEQ ID NO: 29487 - RNA, 22 nt, Homo sapiens
uuugcauaauaagauuagggug

SEQ ID NO: 29488 - RNA, 21 nt, Homo sapiens
uuugcauauguugaaccagcc

SEQ ID NO: 29489 - RNA, 18 nt, Homo sapiens
uuugccacuucccagaaa

SEQ ID NO: 29490 - RNA, 22 nt, Homo sapiens
uuugccuuugugauauggucua

SEQ ID NO: 29491 - RNA, 22 nt, Homo sapiens
uuugcuuaguaaauguagaaaa

SEQ ID NO: 29492 - RNA, 22 nt, Homo sapiens
uuuggaagaugccacuguauca

SEQ ID NO: 29493 - RNA, 22 nt, Homo sapiens
uuuggauagugugguccuuuua

SEQ ID NO: 29494 - RNA, 22 nt, Homo sapiens
uuuggcagaaaacaagaaucug

SEQ ID NO: 29495 - RNA, 22 nt, Homo sapiens
uuuggccauaauuuuaauuggc

SEQ ID NO: 29496 - RNA, 18 nt, Homo sapiens
uuuggcuguucaugacuc

SEQ ID NO: 29497 - RNA, 22 nt, Homo sapiens
uuugggccaugcuucccgguca

SEQ ID NO: 29498 - RNA, 22 nt, Homo sapiens
uuugggccucugauuucuuugg

SEQ ID NO: 29499 - RNA, 22 nt, Homo sapiens
uuuggguuuuauguaacagcua

SEQ ID NO: 29500 - RNA, 22 nt, Homo sapiens
uuugguaguuuguugggaccca

SEQ ID NO: 29501 - RNA, 22 nt, Homo sapiens
uuuggucccaaugugauaaggu

SEQ ID NO: 29502 - RNA, 22 nt, Homo sapiens
uuugguuauuugaaacuagcau

SEQ ID NO: 29503 - RNA, 22 nt, Homo sapiens
uuuguacacuguugguaggauu

SEQ ID NO: 29504 - RNA, 22 nt, Homo sapiens
uuuguacucccuuuagauaaaa

SEQ ID NO: 29505 - RNA, 22 nt, Homo sapiens
uuuguacuccuuggccagcuuc

SEQ ID NO: 29506 - RNA, 22 nt, Homo sapiens
uuuguagcuacaaagugagaug

SEQ ID NO: 29507 - RNA, 21 nt, Homo sapiens
uuuguccaccuguguucacca

SEQ ID NO: 29508 - RNA, 22 nt, Homo sapiens
uuugugacacaaacacauauau

SEQ ID NO: 29509 - RNA, 22 nt, Homo sapiens
uuugugcuccuaugagaaucua

SEQ ID NO: 29510 - RNA, 22 nt, Homo sapiens
uuugugcuccugugagaaucua

SEQ ID NO: 29511 - RNA, 21 nt, Homo sapiens
uuugugguuacugugugagcu

SEQ ID NO: 29512 - RNA, 22 nt, Homo sapiens
uuugugucccucuaaaauuuau

SEQ ID NO: 29513 - RNA, 22 nt, Homo sapiens
uuuguuugaagucgagacaacu

SEQ ID NO: 29514 - RNA, 22 nt, Homo sapiens
uuuuacagaggagguugcugau

SEQ ID NO: 29515 - RNA, 20 nt, Homo sapiens
uuuuagcacuuguuauggug

SEQ ID NO: 29516 - RNA, 20 nt, Homo sapiens
uuuuagcuuuuauugaaagc

SEQ ID NO: 29517 - RNA, 22 nt, Homo sapiens
uuuucaguggccauaguggaga

SEQ ID NO: 29518 - RNA, 22 nt, Homo sapiens
uuuucaguuuuccagguagccg

SEQ ID NO: 29519 - RNA, 22 nt, Homo sapiens
uuuugcaauauguuccugaaua

SEQ ID NO: 29520 - RNA, 22 nt, Homo sapiens
uuuugcacuguuuuaucugaca

SEQ ID NO: 29521 - RNA, 22 nt, Homo sapiens
uuuugcaggcauuggaaguuua

SEQ ID NO: 29522 - RNA, 18 nt, Homo sapiens
uuuugcuuaacugcgcca

SEQ ID NO: 29523 - RNA, 22 nt, Homo sapiens
uuuugcuuuuccucggucccac

SEQ ID NO: 29524 - RNA, 22 nt, Homo sapiens
uuuuggcuuaaagagaauguau

SEQ ID NO: 29525 - RNA, 22 nt, Homo sapiens
uuuugggggugauucacacagu

SEQ ID NO: 29526 - RNA, 22 nt, Homo sapiens
uuuuggucuccaguuucugcug

SEQ ID NO: 29527 - RNA, 22 nt, Homo sapiens
uuuugguguauuguauaaggua

SEQ ID NO: 29528 - RNA, 21 nt, Homo sapiens
uuuugugcaugugcagccugc

SEQ ID NO: 29529 - RNA, 21 nt, Homo sapiens
uuuuugggcuuucauaguguu

SEQ ID NO: 29530 - RNA, 22 nt, Homo sapiens
uuuuuugguaauugaacaauga

SEQ ID NO: 29531 - RNA, 22 nt, Homo sapiens
uugucccauggggucuuccuuu

SEQ ID NO: 29532 - RNA, 22 nt, Homo sapiens
uuguccuccacauuugaucagu

SEQ ID NO: 29533 - RNA, 22 nt, Homo sapiens
uuguccucuccaaaucucaugu

SEQ ID NO: 29534 - RNA, 22 nt, Homo sapiens
uugugaagaugugaagcaagca

SEQ ID NO: 29535 - RNA, 22 nt, Homo sapiens
uugugacacagcugggccuaua

SEQ ID NO: 29536 - RNA, 22 nt, Homo sapiens
uugugagggagcuaagaugagu

SEQ ID NO: 29537 - RNA, 22 nt, Homo sapiens
uugugcaaaguugugguuucug

SEQ ID NO: 29538 - RNA, 22 nt, Homo sapiens
uugugcauaucagagguuugcu

SEQ ID NO: 29539 - RNA, 22 nt, Homo sapiens
uugugcauguauauuaguucac

SEQ ID NO: 29540 - RNA, 21 nt, Homo sapiens
uugugccaaacccuggaggga

SEQ ID NO: 29541 - RNA, 22 nt, Homo sapiens
uugugcuuaaugaguguaaggu

SEQ ID NO: 29542 - RNA, 22 nt, Homo sapiens
uugugcuuuacuuacuaccaga

SEQ ID NO: 29543 - RNA, 22 nt, Homo sapiens
uugugcuuuuuaaauagcuucc

SEQ ID NO: 29544 - RNA, 18 nt, Homo sapiens
uuguggccccuacaaauu

SEQ ID NO: 29545 - RNA, 22 nt, Homo sapiens
uugugggaggugauuagaucau

SEQ ID NO: 29546 - RNA, 22 nt, Homo sapiens
uuguguuuuuaguagggaaggg

SEQ ID NO: 29547 - RNA, 22 nt, Homo sapiens
uuguuaugggguggcuugaaag

SEQ ID NO: 29548 - RNA, 22 nt, Homo sapiens
uuguuauguaucucaagauaaa

SEQ ID NO: 29549 - RNA, 22 nt, Homo sapiens
uuguuauguuggucaguaaugu

SEQ ID NO: 29550 - RNA, 22 nt, Homo sapiens
uuguucaggagguuggggaugc

SEQ ID NO: 29551 - RNA, 22 nt, Homo sapiens
uuuaaagcaugacgagaagaag

SEQ ID NO: 29552 - RNA, 22 nt, Homo sapiens
uuuaaggcaggucuggugguga

SEQ ID NO: 29553 - RNA, 22 nt, Homo sapiens
uuuaaggcaugccuguacaugc

SEQ ID NO: 29554 - RNA, 22 nt, Homo sapiens
uuuaaguguuuguuccugaaaa

SEQ ID NO: 29555 - RNA, 22 nt, Homo sapiens
uuuaaugcugcccagucauggg

SEQ ID NO: 29556 - RNA, 22 nt, Homo sapiens
uuuaauguuacaguauugguau

SEQ ID NO: 29557 - RNA, 18 nt, Homo sapiens
uuuacaguagaaggacuu

SEQ ID NO: 29558 - RNA, 19 nt, Homo sapiens
uuuagaucuuuuaugcagc

SEQ ID NO: 29559 - RNA, 22 nt, Homo sapiens
uuuagcaauggagggugacuuu

SEQ ID NO: 29560 - RNA, 22 nt, Homo sapiens
uuuagcaauucauuuugugucu

SEQ ID NO: 29561 - RNA, 22 nt, Homo sapiens
uuuaggcaauauauucaugucu

SEQ ID NO: 29562 - RNA, 22 nt, Homo sapiens
uuuaggcaugcaguucuauuua

SEQ ID NO: 29563 - RNA, 22 nt, Homo sapiens
uuuagguaauauuaaguagcug

SEQ ID NO: 29564 - RNA, 22 nt, Homo sapiens
uuuauccagccucuagcaaggu

SEQ ID NO: 29565 - RNA, 22 nt, Homo sapiens
uuucaacuaauuuuuuggugag

SEQ ID NO: 29566 - RNA, 19 nt, Homo sapiens
uuucaauguaaggauggag

SEQ ID NO: 29567 - RNA, 23 nt, Homo sapiens
uuucacaguagcuggaucagccu

SEQ ID NO: 29568 - RNA, 22 nt, Homo sapiens
uuucagagucaucugcccaagu

SEQ ID NO: 29569 - RNA, 22 nt, Homo sapiens
uuucaguagagacacgguuuug

SEQ ID NO: 29570 - RNA, 22 nt, Homo sapiens
uuucaguguggcaggcauagcu

SEQ ID NO: 29571 - RNA, 22 nt, Homo sapiens
uuucauagccuuugucgucuga

SEQ ID NO: 29572 - RNA, 22 nt, Homo sapiens
uuuccacauggacuuaccuucg

SEQ ID NO: 29573 - RNA, 22 nt, Homo sapiens
uuuccagguggccaacauuuua

SEQ ID NO: 29574 - RNA, 19 nt, Homo sapiens
uuuccaguaaucuuaugug

SEQ ID NO: 29575 - RNA, 22 nt, Homo sapiens
uuuccaguuggaaagccuguuu

SEQ ID NO: 29576 - RNA, 22 nt, Homo sapiens
uuuccaguuuggaggaugcauu

SEQ ID NO: 29577 - RNA, 22 nt, Homo sapiens
uuucccugaaggcucugaaguc

SEQ ID NO: 29578 - RNA, 19 nt, Homo sapiens
uuucccugcagaccuacua

SEQ ID NO: 29579 - RNA, 16 nt, Homo sapiens
uuucccuuugguguuu

SEQ ID NO: 29580 - RNA, 21 nt, Homo sapiens
uuuccuggagcguauggcuuc

SEQ ID NO: 29581 - RNA, 22 nt, Homo sapiens
uuuccuguagggggcaaggccu

SEQ ID NO: 29582 - RNA, 22 nt, Homo sapiens
uuucgugucuggucugugaugg

SEQ ID NO: 29583 - RNA, 22 nt, Homo sapiens
uuucuacagugaacgauuucua

SEQ ID NO: 29584 - RNA, 22 nt, Homo sapiens
uuucuuggagcucuuagggucg

SEQ ID NO: 29585 - RNA, 22 nt, Homo sapiens
uuugaagcaauugugaauggga

SEQ ID NO: 29586 - RNA, 20 nt, Homo sapiens
uuugaauguaaagcauguca

SEQ ID NO: 29587 - RNA, 22 nt, Homo sapiens
uuugacuuuuagaauaugaguu

SEQ ID NO: 29588 - RNA, 22 nt, Homo sapiens
uuugagcaggcuaaucaauaua

SEQ ID NO: 29589 - RNA, 22 nt, Homo sapiens
uuugagcauggaaauggcauga

SEQ ID NO: 29590 - RNA, 22 nt, Homo sapiens
uuugagcauguaguuuaacccu

SEQ ID NO: 29591 - RNA, 22 nt, Homo sapiens
uuugagcuagagucucacucug

SEQ ID NO: 29592 - RNA, 22 nt, Homo sapiens
uuugaggaaaggcauaaguagg

SEQ ID NO: 29593 - RNA, 22 nt, Homo sapiens
uuugagguguauggcaaguuga

SEQ ID NO: 29594 - RNA, 21 nt, Homo sapiens
uuugaucauuaaaagugaauc

SEQ ID NO: 29595 - RNA, 22 nt, Homo sapiens
uuugcacauauuugggcaaaag

SEQ ID NO: 29596 - RNA, 20 nt, Homo sapiens
uuugcagaaucuaagaagag

SEQ ID NO: 29597 - RNA, 22 nt, Homo sapiens
uuugcagagacuuguuaggaau

SEQ ID NO: 29598 - RNA, 22 nt, Homo sapiens
uuugcauauguugaaccagccu

SEQ ID NO: 29599 - RNA, 22 nt, Homo sapiens
uuugcaucuuagaaaguucucc

SEQ ID NO: 29600 - RNA, 22 nt, Homo sapiens
uuugccaauauuuuauugagga

SEQ ID NO: 29601 - RNA, 22 nt, Homo sapiens
uuugccaaucagaggcaucuug

SEQ ID NO: 29602 - RNA, 22 nt, Homo sapiens
uuugugucccuacccgaaucuc

SEQ ID NO: 29603 - RNA, 22 nt, Homo sapiens
uuuguguggccuuggccuggca

SEQ ID NO: 29604 - RNA, 22 nt, Homo sapiens
uuuguucuucguuccugagcca

SEQ ID NO: 29605 - RNA, 22 nt, Homo sapiens
uuuuaacagccaggggacggcc

SEQ ID NO: 29606 - RNA, 22 nt, Homo sapiens
uuuuacacuucgguugugugca

SEQ ID NO: 29607 - RNA, 22 nt, Homo sapiens
uuuuauguuuguucccugccaa

SEQ ID NO: 29608 - RNA, 22 nt, Homo sapiens
uuuuccagugggacucccauua

SEQ ID NO: 29609 - RNA, 20 nt, Homo sapiens
uuuugaacuuggcaaccugu

SEQ ID NO: 29610 - RNA, 22 nt, Homo sapiens
uuuugcaccauccuaauaguau

SEQ ID NO: 29611 - RNA, 22 nt, Homo sapiens
uuuugcaggucaggggcagaga

SEQ ID NO: 29612 - RNA, 22 nt, Homo sapiens
uuuugcucuucauagguccugu

SEQ ID NO: 29613 - RNA, 19 nt, Homo sapiens
uuuuggaaaugugaacagc

SEQ ID NO: 29614 - RNA, 17 nt, Homo sapiens
uuuuggauuagaaaucc

SEQ ID NO: 29615 - RNA, 22 nt, Homo sapiens
uuuuggcuagaaauauaccucc

SEQ ID NO: 29616 - RNA, 22 nt, Homo sapiens
uuuuggcucuugguaggucaga

SEQ ID NO: 29617 - RNA, 22 nt, Homo sapiens
uuuuggcuuuuccucagcaagc

SEQ ID NO: 29618 - RNA, 22 nt, Homo sapiens
uuuugguaaugaacuuaggaag

SEQ ID NO: 29619 - RNA, 22 nt, Homo sapiens
uuuugguauaugcaggggucuu

SEQ ID NO: 29620 - RNA, 22 nt, Homo sapiens
uuuuggugguuaugugucaaug

SEQ ID NO: 29621 - RNA, 19 nt, Homo sapiens
uuuuguacucugugacuug

SEQ ID NO: 29622 - RNA, 22 nt, Homo sapiens
uuuuucacuuaaguuaggcuca

SEQ ID NO: 29623 - RNA, 22 nt, Homo sapiens
uuuuugagaauuggugaaacac

SEQ ID NO: 29624 - RNA, 18 nt, Homo sapiens
uuuuugaggcacagggga

SEQ ID NO: 29625 - RNA, 22 nt, Homo sapiens
uuuuugaguaaauauaaauugu

SEQ ID NO: 29626 - RNA, 16 nt, Homo sapiens
uuuuugcagaaaugac

SEQ ID NO: 29627 - RNA, 22 nt, Homo sapiens
uuuuuggauaaugguacaugua

SEQ ID NO: 29628 - RNA, 22 nt, Homo sapiens
uuuuugguugguaggcuauuaa

SEQ ID NO: 29629 - RNA, 23 nt, Homo sapiens
uuuuuguguuucauggaaauagg

SEQ ID NO: 29630 - RNA, 22 nt, Homo sapiens
uuuuuuaguuagcugggcauga

SEQ ID NO: 29631 - RNA, 22 nt, Homo sapiens
uuuuuugcuguaugcaaacauc

SEQ ID NO: 29632 - RNA, 22 nt, Homo sapiens
aaauccauuuguucagcuaugc

SEQ ID NO: 29633 - RNA, 22 nt, Homo sapiens
aaaugcccuaaaauggagcauc

SEQ ID NO: 29634 - RNA, 22 nt, Homo sapiens
aaaugcucuguggguaguaaug

SEQ ID NO: 29635 - RNA, 22 nt, Homo sapiens
aaaugcugcuuuggccucuucu

SEQ ID NO: 29636 - RNA, 22 nt, Homo sapiens
aaaugcuguuccaggaccuauc

SEQ ID NO: 29637 - RNA, 22 nt, Homo sapiens
aaauggcuuuuugggcaaggug

SEQ ID NO: 29638 - RNA, 22 nt, Homo sapiens
aaaugggacugggguccuuuga

SEQ ID NO: 29639 - RNA, 22 nt, Homo sapiens
aaaugguguuaguagaucuuua

SEQ ID NO: 29640 - RNA, 22 nt, Homo sapiens
auagugcagugaugaaccuagg

SEQ ID NO: 29641 - RNA, 22 nt, Homo sapiens
auagugcugcaauaaccauggg

SEQ ID NO: 29642 - RNA, 22 nt, Homo sapiens
auagugcugcaauuaacauaca

SEQ ID NO: 29643 - RNA, 22 nt, Homo sapiens
auagugcuguauuaaacauacg

SEQ ID NO: 29644 - RNA, 19 nt, Homo sapiens
auauaacauccaggagcag

SEQ ID NO: 29645 - RNA, 22 nt, Homo sapiens
auauaccuaggcuacaugguuu

SEQ ID NO: 29646 - RNA, 23 nt, Homo sapiens
auauaguagaugugcaguaacau

SEQ ID NO: 29647 - RNA, 22 nt, Homo sapiens
auaucccaguguguaaacacug

SEQ ID NO: 29648 - RNA, 22 nt, Homo sapiens
auaugcaaauccauagagacag

SEQ ID NO: 29649 - RNA, 22 nt, Homo sapiens
auaugccacugaacuguaccca

SEQ ID NO: 29650 - RNA, 22 nt, Homo sapiens
auaugguuuuuggaagcauauc

SEQ ID NO: 29651 - RNA, 22 nt, Homo sapiens
auaugucuauuauuagggcagg

SEQ ID NO: 29652 - RNA, 22 nt, Homo sapiens
auaugucuguuuagucuguaau

SEQ ID NO: 29653 - RNA, 22 nt, Homo sapiens
auauuacuggccauaucgcagg

SEQ ID NO: 29654 - RNA, 22 nt, Homo sapiens
auauugguuaaauauuauguga

SEQ ID NO: 29655 - RNA, 22 nt, Homo sapiens
aucaaagccaugcucaguuuuc

SEQ ID NO: 29656 - RNA, 22 nt, Homo sapiens
aucaaaucuccagaaccugucu

SEQ ID NO: 29657 - RNA, 22 nt, Homo sapiens
aucaagcuggcauauguaguuc

SEQ ID NO: 29658 - RNA, 22 nt, Homo sapiens
aucaagguaggacuugaacccu

SEQ ID NO: 29659 - RNA, 22 nt, Homo sapiens
aucacagcccuccucuuggaug

SEQ ID NO: 29660 - RNA, 22 nt, Homo sapiens
aucacaguggcucacaagagcc

SEQ ID NO: 29661 - RNA, 19 nt, Homo sapiens
aucaccagucuuuccacug

SEQ ID NO: 29662 - RNA, 22 nt, Homo sapiens
aucaccugagcaguauacacug

SEQ ID NO: 29663 - RNA, 22 nt, Homo sapiens
aucacuggccuuuuuaaaugcu

SEQ ID NO: 29664 - RNA, 22 nt, Homo sapiens
aucacuguuuugaugcucggac

SEQ ID NO: 29665 - RNA, 22 nt, Homo sapiens
aucagaaucucuagugggacca

SEQ ID NO: 29666 - RNA, 20 nt, Homo sapiens
aucagagacuaggauugcca

SEQ ID NO: 29667 - RNA, 22 nt, Homo sapiens
aucagaguugucagggagcuuu

SEQ ID NO: 29668 - RNA, 22 nt, Homo sapiens
aucagauaccuguugggaaaug

SEQ ID NO: 29669 - RNA, 22 nt, Homo sapiens
aucagugagugguuagugaaug

SEQ ID NO: 29670 - RNA, 22 nt, Homo sapiens
aucauuaguuguggaauucuug

SEQ ID NO: 29671 - RNA, 18 nt, Homo sapiens
aucauugcacugucuugc

SEQ ID NO: 29672 - RNA, 22 nt, Homo sapiens
auccaagagacugaugacuucc

SEQ ID NO: 29673 - RNA, 22 nt, Homo sapiens
auccaguguuuucuuuugucac

SEQ ID NO: 29674 - RNA, 22 nt, Homo sapiens
auccauugcucaagagaaguca

SEQ ID NO: 29675 - RNA, 22 nt, Homo sapiens
auccauugucuaaugcuaagau

SEQ ID NO: 29676 - RNA, 22 nt, Homo sapiens
aucccugagaacuuuuaauguu

SEQ ID NO: 29677 - RNA, 22 nt, Homo sapiens
aucccugugauccaaucacuuc

SEQ ID NO: 29678 - RNA, 22 nt, Homo sapiens
auccugaagcuuuacugaauuc

SEQ ID NO: 29679 - RNA, 22 nt, Homo sapiens
auccuguacuaagguuuuccca

SEQ ID NO: 29680 - RNA, 22 nt, Homo sapiens
auccuguagucucacagcccca

SEQ ID NO: 29681 - RNA, 21 nt, Homo sapiens
auccuucuuuuucaaccugug

SEQ ID NO: 29682 - RNA, 22 nt, Homo sapiens
auccuugagaaaauaaaugacc

SEQ ID NO: 29683 - RNA, 22 nt, Homo sapiens
aucgcaccauugcacuccagca

SEQ ID NO: 29684 - RNA, 22 nt, Homo sapiens
aucuaaaucucauaugggcaca

SEQ ID NO: 29685 - RNA, 22 nt, Homo sapiens
aucuacuugcugggucucugga

SEQ ID NO: 29686 - RNA, 21 nt, Homo sapiens
aucucacuugaauguaaaagc

SEQ ID NO: 29687 - RNA, 22 nt, Homo sapiens
aucucaguuaaugacccuaugc

SEQ ID NO: 29688 - RNA, 22 nt, Homo sapiens
aucucauuccuucugggcugau

SEQ ID NO: 29689 - RNA, 22 nt, Homo sapiens
aucucugagauguucugauuuu

SEQ ID NO: 29690 - RNA, 22 nt, Homo sapiens
aucugacuuuuaauuugaaaac

SEQ ID NO: 29691 - RNA, 22 nt, Homo sapiens
aucugcauuagggugaagaccu

SEQ ID NO: 29692 - RNA, 22 nt, Homo sapiens
aucugcauucccauguuuauug

SEQ ID NO: 29693 - RNA, 22 nt, Homo sapiens
aucuggcuucuuuuaguccaca

SEQ ID NO: 29694 - RNA, 22 nt, Homo sapiens
aucugguguccucgugggaguc

SEQ ID NO: 29695 - RNA, 22 nt, Homo sapiens
aucugugaaugaaguuauuuug

SEQ ID NO: 29696 - RNA, 22 nt, Homo sapiens
aucugugguuguaugcauauua

SEQ ID NO: 29697 - RNA, 22 nt, Homo sapiens
aucuugcauuugcuaaaaugca

SEQ ID NO: 29698 - RNA, 22 nt, Homo sapiens
aucuugggugggaacugagaau

SEQ ID NO: 29699 - RNA, 22 nt, Homo sapiens
aucuuuggugcaugauacuuug

SEQ ID NO: 29700 - RNA, 22 nt, Homo sapiens
augaaaagcauaaacgcugaag

SEQ ID NO: 29701 - RNA, 22 nt, Homo sapiens
augaaacuggagcgccuggagg

SEQ ID NO: 29702 - RNA, 22 nt, Homo sapiens
augaacagagccuugagaaccu

SEQ ID NO: 29703 - RNA, 18 nt, Homo sapiens
augaacucaucauuuuua

SEQ ID NO: 29704 - RNA, 21 nt, Homo sapiens
augaacucaucauuuuuuaug

SEQ ID NO: 29705 - RNA, 22 nt, Homo sapiens
augaacucaucauuuuuuaugg

SEQ ID NO: 29706 - RNA, 22 nt, Homo sapiens
augaagagaaaguggaucuugg

SEQ ID NO: 29707 - RNA, 22 nt, Homo sapiens
augaagauguugccuuuuuaau

SEQ ID NO: 29708 - RNA, 20 nt, Homo sapiens
augaaggcaggugugaguuu

SEQ ID NO: 29709 - RNA, 22 nt, Homo sapiens
augaaguauuaggacacauuua

SEQ ID NO: 29710 - RNA, 17 nt, Homo sapiens
augaagucaucauuuuu

SEQ ID NO: 29711 - RNA, 22 nt, Homo sapiens
augaagucguuacuaccaauug

SEQ ID NO: 29712 - RNA, 22 nt, Homo sapiens
augaagugcaugauaguugguu

SEQ ID NO: 29713 - RNA, 22 nt, Homo sapiens
augaaguuagcucauuucuuuu

SEQ ID NO: 29714 - RNA, 22 nt, Homo sapiens
augaauacagcuaugcgugcau

SEQ ID NO: 29715 - RNA, 23 nt, Homo sapiens
augacacuccugugcgcacccug

SEQ ID NO: 29716 - RNA, 22 nt, Homo sapiens
augacaguguggauuauuguaa

SEQ ID NO: 29717 - RNA, 22 nt, Homo sapiens
augaccaaugggcagagcuaga

SEQ ID NO: 29718 - RNA, 22 nt, Homo sapiens
augaccagagagugcgcagggu

SEQ ID NO: 29719 - RNA, 22 nt, Homo sapiens
augacuagaggagggauggcca

SEQ ID NO: 29720 - RNA, 22 nt, Homo sapiens
augacucagaucuguuccuggu

SEQ ID NO: 29721 - RNA, 22 nt, Homo sapiens
augacugaguagcauuccauua

SEQ ID NO: 29722 - RNA, 22 nt, Homo sapiens
augacuggauaauggacacaca

SEQ ID NO: 29723 - RNA, 22 nt, Homo sapiens
augagauaaaccaucucuuaag

SEQ ID NO: 29724 - RNA, 22 nt, Homo sapiens
augagauauguuaaaaguuaaa

SEQ ID NO: 29725 - RNA, 22 nt, Homo sapiens
augagauucuuagagaagucug

SEQ ID NO: 29726 - RNA, 22 nt, Homo sapiens
augagcuccucaaggucagaga

SEQ ID NO: 29727 - RNA, 22 nt, Homo sapiens
augagcuguuuggaagacacuu

SEQ ID NO: 29728 - RNA, 22 nt, Homo sapiens
augaggauagguuucuauuagg

SEQ ID NO: 29729 - RNA, 22 nt, Homo sapiens
augaggugaguaaauaaaugaa

SEQ ID NO: 29730 - RNA, 22 nt, Homo sapiens
augaggugauaucuggaaauua

SEQ ID NO: 29731 - RNA, 22 nt, Homo sapiens
augaggugcagaggaaaugagu

SEQ ID NO: 29732 - RNA, 21 nt, Homo sapiens
augagguguacuguggugaaa

SEQ ID NO: 29733 - RNA, 20 nt, Homo sapiens
augagguguaugacacugaa

SEQ ID NO: 29734 - RNA, 18 nt, Homo sapiens
augagucauuguggaaau

SEQ ID NO: 29735 - RNA, 15 nt, Homo sapiens
augaguuuuauggag

SEQ ID NO: 29736 - RNA, 22 nt, Homo sapiens
augauacuggcuucauagaaug

SEQ ID NO: 29737 - RNA, 22 nt, Homo sapiens
augaucuguagaacuaguccuu

SEQ ID NO: 29738 - RNA, 22 nt, Homo sapiens
augaugaaguaagugcuuagga

SEQ ID NO: 29739 - RNA, 22 nt, Homo sapiens
augauuagaacucauuuccagg

SEQ ID NO: 29740 - RNA, 22 nt, Homo sapiens
augauucugaucuagagcuugg

SEQ ID NO: 29741 - RNA, 22 nt, Homo sapiens
augcaaacaucugaagagacau

SEQ ID NO: 29742 - RNA, 22 nt, Homo sapiens
augcaacugcacuccagccugg

SEQ ID NO: 29743 - RNA, 22 nt, Homo sapiens
augcaagacaccgauuagcuuu

SEQ ID NO: 29744 - RNA, 22 nt, Homo sapiens
augcacuuggcaggaugauucc

SEQ ID NO: 29745 - RNA, 22 nt, Homo sapiens
augcauagcaucugcaaauguu

SEQ ID NO: 29746 - RNA, 22 nt, Homo sapiens
augcauauuuuaccuagaagag

SEQ ID NO: 29747 - RNA, 22 nt, Homo sapiens
augccacugcacuccaaccugg

SEQ ID NO: 29748 - RNA, 22 nt, Homo sapiens
augccacugcacuucagccugc

SEQ ID NO: 29749 - RNA, 22 nt, Homo sapiens
augccacuguuuaugucacuua

SEQ ID NO: 29750 - RNA, 22 nt, Homo sapiens
augcccauuuguuuucugaaag

SEQ ID NO: 29751 - RNA, 22 nt, Homo sapiens
augccucugacaauuggauucu

SEQ ID NO: 29752 - RNA, 22 nt, Homo sapiens
augcuacugaccccuacuuaca

SEQ ID NO: 29753 - RNA, 22 nt, Homo sapiens
augcuacuggauuuguauaaau

SEQ ID NO: 29754 - RNA, 19 nt, Homo sapiens
augcugguguugcucaaac

SEQ ID NO: 29755 - RNA, 22 nt, Homo sapiens
augcuguuuuguagcucccucu

SEQ ID NO: 29756 - RNA, 22 nt, Homo sapiens
auggaagaaaguuggguucuug

SEQ ID NO: 29757 - RNA, 22 nt, Homo sapiens
auggaaugguugggucauaagg

SEQ ID NO: 29758 - RNA, 22 nt, Homo sapiens
auggacagacacuggccuucug

SEQ ID NO: 29759 - RNA, 22 nt, Homo sapiens
auggacauuaaagcgauguaga

SEQ ID NO: 29760 - RNA, 22 nt, Homo sapiens
auggaggaggaagcugaaacaa

SEQ ID NO: 29761 - RNA, 22 nt, Homo sapiens
auggagguguggggagugaguu

SEQ ID NO: 29762 - RNA, 22 nt, Homo sapiens
auggaguguggaacugggaauc

SEQ ID NO: 29763 - RNA, 22 nt, Homo sapiens
auggauuuguaguacaugguug

SEQ ID NO: 29764 - RNA, 22 nt, Homo sapiens
auggauuuuaggauacaguuga

SEQ ID NO: 29765 - RNA, 22 nt, Homo sapiens
auggcaaugcgaugaugacuga

SEQ ID NO: 29766 - RNA, 22 nt, Homo sapiens
auggcaccauguuaugauaaua

SEQ ID NO: 29767 - RNA, 22 nt, Homo sapiens
auggcacuacugggaaugucuu

SEQ ID NO: 29768 - RNA, 22 nt, Homo sapiens
auggcagagucagaaagucagg

SEQ ID NO: 29769 - RNA, 22 nt, Homo sapiens
auggcaguuucagcuauaguuu

SEQ ID NO: 29770 - RNA, 22 nt, Homo sapiens
auggcauugaagaguugucccu

SEQ ID NO: 29771 - RNA, 22 nt, Homo sapiens
auggcccaguuugcuaucccua

SEQ ID NO: 29772 - RNA, 22 nt, Homo sapiens
auggcccccuguuugugaacau

SEQ ID NO: 29773 - RNA, 22 nt, Homo sapiens
auggcccugaguucaauauauu

SEQ ID NO: 29774 - RNA, 22 nt, Homo sapiens
auggcccugcuaccacuuuucu

SEQ ID NO: 29775 - RNA, 23 nt, Homo sapiens
auggcccuggugggagugucuuu

SEQ ID NO: 29776 - RNA, 22 nt, Homo sapiens
auggccugaugcaccuguccca

SEQ ID NO: 29777 - RNA, 22 nt, Homo sapiens
auggccuuguauaccuggcaaa

SEQ ID NO: 29778 - RNA, 22 nt, Homo sapiens
auggccuuuacaauuugguaug

SEQ ID NO: 29779 - RNA, 22 nt, Homo sapiens
auggcggugugaucuuggcuca

SEQ ID NO: 29780 - RNA, 22 nt, Homo sapiens
auggcuagaaccuguauauuca

SEQ ID NO: 29781 - RNA, 22 nt, Homo sapiens
auggcuagauuguaugguaguu

SEQ ID NO: 29782 - RNA, 22 nt, Homo sapiens
auggcuauuccauaggcagagc

SEQ ID NO: 29783 - RNA, 22 nt, Homo sapiens
auggcucaguguguaucuauca

SEQ ID NO: 29784 - RNA, 22 nt, Homo sapiens
auggcucuguuuuuuaugcucu

SEQ ID NO: 29785 - RNA, 22 nt, Homo sapiens
auggcuguuucugcaaugucua

SEQ ID NO: 29786 - RNA, 22 nt, Homo sapiens
auggcuuugggcugcucugccc

SEQ ID NO: 29787 - RNA, 22 nt, Homo sapiens
auggcuuuggucucccagugau

SEQ ID NO: 29788 - RNA, 22 nt, Homo sapiens
auggcuuuuccugucuugcaug

SEQ ID NO: 29789 - RNA, 22 nt, Homo sapiens
auggcuuuugaccugguaggau

SEQ ID NO: 29790 - RNA, 22 nt, Homo sapiens
auggcuuuuuaaaucauguugu

SEQ ID NO: 29791 - RNA, 21 nt, Homo sapiens
augggacuaacugaugggucu

SEQ ID NO: 29792 - RNA, 22 nt, Homo sapiens
augggauaguaucaguggaaua

SEQ ID NO: 29793 - RNA, 22 nt, Homo sapiens
augggcaaauguuggaaauucc

SEQ ID NO: 29794 - RNA, 22 nt, Homo sapiens
augguacuccagagaagcagaa

SEQ ID NO: 29795 - RNA, 22 nt, Homo sapiens
augguacuggguaaaagugggg

SEQ ID NO: 29796 - RNA, 22 nt, Homo sapiens
augguuagauguauccuuucca

SEQ ID NO: 29797 - RNA, 22 nt, Homo sapiens
augguuuauuuguaagcagagu

SEQ ID NO: 29798 - RNA, 22 nt, Homo sapiens
auguaguauuaaugagagauaa

SEQ ID NO: 29799 - RNA, 17 nt, Homo sapiens
auguauacauccaugua

SEQ ID NO: 29800 - RNA, 22 nt, Homo sapiens
augucacugcacuccugccugg

SEQ ID NO: 29801 - RNA, 22 nt, Homo sapiens
auguccuaaucuccuguucuua

SEQ ID NO: 29802 - RNA, 22 nt, Homo sapiens
auguccuagagagauggugguc

SEQ ID NO: 29803 - RNA, 22 nt, Homo sapiens
auguccuggacccagacaaagc

SEQ ID NO: 29804 - RNA, 22 nt, Homo sapiens
augucuagagugauacugaagc

SEQ ID NO: 29805 - RNA, 22 nt, Homo sapiens
augucuguuugcugagcccggc

SEQ ID NO: 29806 - RNA, 22 nt, Homo sapiens
augugaacaucauagaaugcac

SEQ ID NO: 29807 - RNA, 22 nt, Homo sapiens
augugaacugaauuaauucaca

SEQ ID NO: 29808 - RNA, 22 nt, Homo sapiens
augugacagcaacccccagccc

SEQ ID NO: 29809 - RNA, 22 nt, Homo sapiens
augugcaaagcacuguucagca

SEQ ID NO: 29810 - RNA, 22 nt, Homo sapiens
augugcaacugcuggaacaguc

SEQ ID NO: 29811 - RNA, 18 nt, Homo sapiens
augugcaauuuuguauuu

SEQ ID NO: 29812 - RNA, 22 nt, Homo sapiens
augugcacaacgugcagguuug

SEQ ID NO: 29813 - RNA, 22 nt, Homo sapiens
augugcuuuuggugagagauuu

SEQ ID NO: 29814 - RNA, 22 nt, Homo sapiens
auguggaaauguauaugugucu

SEQ ID NO: 29815 - RNA, 22 nt, Homo sapiens
auguggcauuucucauucauuu

SEQ ID NO: 29816 - RNA, 22 nt, Homo sapiens
augugguaggcccaugagucau

SEQ ID NO: 29817 - RNA, 22 nt, Homo sapiens
augugucaaaucuaggccaaag

SEQ ID NO: 29818 - RNA, 22 nt, Homo sapiens
augugugcuugauguaaaaagu

SEQ ID NO: 29819 - RNA, 23 nt, Homo sapiens
augugugcuuggagagcaggaug

SEQ ID NO: 29820 - RNA, 22 nt, Homo sapiens
augugugcuugugacacagccu

SEQ ID NO: 29821 - RNA, 22 nt, Homo sapiens
auguugcuugaaggcauuuugu

SEQ ID NO: 29822 - RNA, 22 nt, Homo sapiens
auguuguaguaugagucaaaau

SEQ ID NO: 29823 - RNA, 22 nt, Homo sapiens
auuaaggaguggguucauggug

SEQ ID NO: 29824 - RNA, 22 nt, Homo sapiens
auuaagugcuugccagugcugg

SEQ ID NO: 29825 - RNA, 20 nt, Homo sapiens
auuagagcuacauggcuaca

SEQ ID NO: 29826 - RNA, 22 nt, Homo sapiens
auuagguaauauaaucauggca

SEQ ID NO: 29827 - RNA, 22 nt, Homo sapiens
auuagguuaggcaaacuucugu

SEQ ID NO: 29828 - RNA, 22 nt, Homo sapiens
aaaagagcugagagguauucuu

SEQ ID NO: 29829 - RNA, 22 nt, Homo sapiens
aaaaugcugauauugggcccca

SEQ ID NO: 29830 - RNA, 18 nt, Homo sapiens
aaacagugucucuuucug

SEQ ID NO: 29831 - RNA, 22 nt, Homo sapiens
aaaccacagugugcugcugggg

SEQ ID NO: 29832 - RNA, 22 nt, Homo sapiens
aaacugucuggaugcuugugga

SEQ ID NO: 29833 - RNA, 22 nt, Homo sapiens
aaacugucuucugacaguuucc

SEQ ID NO: 29834 - RNA, 22 nt, Homo sapiens
aaacuugucuaauuauaagcau

SEQ ID NO: 29835 - RNA, 22 nt, Homo sapiens
aaagagaucuaugggcacuaug

SEQ ID NO: 29836 - RNA, 22 nt, Homo sapiens
aaagaguucagguagauuucaa

SEQ ID NO: 29837 - RNA, 22 nt, Homo sapiens
aaagcacugaauaaauuugcuu

SEQ ID NO: 29838 - RNA, 22 nt, Homo sapiens
aaagcaucacuuuuccuacuuu

SEQ ID NO: 29839 - RNA, 22 nt, Homo sapiens
aaagcuaccagauucuguugga

SEQ ID NO: 29840 - RNA, 22 nt, Homo sapiens
aaaggcacacacuccuuguuau

SEQ ID NO: 29841 - RNA, 22 nt, Homo sapiens
aaaggcacugugacuuuauagg

SEQ ID NO: 29842 - RNA, 22 nt, Homo sapiens
aaaggcaucugcucggcucccu

SEQ ID NO: 29843 - RNA, 22 nt, Homo sapiens
aaagggcacugugcuuuggcaa

SEQ ID NO: 29844 - RNA, 22 nt, Homo sapiens
aaagggcuugaauacucuuuuu

SEQ ID NO: 29845 - RNA, 22 nt, Homo sapiens
aaagucacuggagaaggaauau

SEQ ID NO: 29846 - RNA, 22 nt, Homo sapiens
aaagugcaguauuugggcagaa

SEQ ID NO: 29847 - RNA, 22 nt, Homo sapiens
aaagugcaguauuugggcagga

SEQ ID NO: 29848 - RNA, 22 nt, Homo sapiens
aaagugccugacucauaguuag

SEQ ID NO: 29849 - RNA, 22 nt, Homo sapiens
aaagugcugagacagacuggga

SEQ ID NO: 29850 - RNA, 22 nt, Homo sapiens
aaagugcugagaguucuaacuu

SEQ ID NO: 29851 - RNA, 22 nt, Homo sapiens
aaagugcugagucuaggcgggg

SEQ ID NO: 29852 - RNA, 22 nt, Homo sapiens
aaagugcugggaucacacugaa

SEQ ID NO: 29853 - RNA, 22 nt, Homo sapiens
aaagugcugggauuaggccagg

SEQ ID NO: 29854 - RNA, 22 nt, Homo sapiens
aaagugcugggauuggcugggc

SEQ ID NO: 29855 - RNA, 22 nt, Homo sapiens
aaagugcuuccuuuuugagggu

SEQ ID NO: 29856 - RNA, 22 nt, Homo sapiens
aaaguggacuaagugaauauga

SEQ ID NO: 29857 - RNA, 22 nt, Homo sapiens
aaagugguuuuucagacuuuga

SEQ ID NO: 29858 - RNA, 22 nt, Homo sapiens
aaaguguguuuccaaccugugg

SEQ ID NO: 29859 - RNA, 22 nt, Homo sapiens
aaaguucugcguuagggcuaaa

SEQ ID NO: 29860 - RNA, 19 nt, Homo sapiens
aaaguucuucccuuuggag

SEQ ID NO: 29861 - RNA, 22 nt, Homo sapiens
aaauaguagcugaaugagggaa

SEQ ID NO: 29862 - RNA, 22 nt, Homo sapiens
aaaugacuuuuuaugcagagua

SEQ ID NO: 29863 - RNA, 22 nt, Homo sapiens
aaaugcacaaagauuuugcacu

SEQ ID NO: 29864 - RNA, 22 nt, Homo sapiens
aaaugcacagaaaggaugugga

SEQ ID NO: 29865 - RNA, 22 nt, Homo sapiens
aaaugcagcacucaagugggaa

SEQ ID NO: 29866 - RNA, 22 nt, Homo sapiens
aaaugcagucuuuguucugggc

SEQ ID NO: 29867 - RNA, 22 nt, Homo sapiens
aaaugcaguugguggggauaug

SEQ ID NO: 29868 - RNA, 22 nt, Homo sapiens
aaaugcauaucaagauugcccu

SEQ ID NO: 29869 - RNA, 22 nt, Homo sapiens
aaaugcaucauuaggugauuuu

SEQ ID NO: 29870 - RNA, 22 nt, Homo sapiens
aaaugcaugaauaagcucgugu

SEQ ID NO: 29871 - RNA, 22 nt, Homo sapiens
aaaugcucucuacacguuucug

SEQ ID NO: 29872 - RNA, 22 nt, Homo sapiens
aaaugcugucaaauuguguucu

SEQ ID NO: 29873 - RNA, 22 nt, Homo sapiens
aaaugcuuucuuggaccauuug

SEQ ID NO: 29874 - RNA, 22 nt, Homo sapiens
aaauggauuaaguucacuugcu

SEQ ID NO: 29875 - RNA, 22 nt, Homo sapiens
aaauggcacaguaagggcauuu

SEQ ID NO: 29876 - RNA, 21 nt, Homo sapiens
aaaugugcuuuaguacccuca

SEQ ID NO: 29877 - RNA, 22 nt, Homo sapiens
aaauucaucaaaugguuuguau

SEQ ID NO: 29878 - RNA, 22 nt, Homo sapiens
aaauugcacaaguggugauuug

SEQ ID NO: 29879 - RNA, 22 nt, Homo sapiens
aaauugcuuuugaagacuuagu

SEQ ID NO: 29880 - RNA, 22 nt, Homo sapiens
aacaccaucccuuugaugcuuu

SEQ ID NO: 29881 - RNA, 22 nt, Homo sapiens
aacacuaucugccuuacaggga

SEQ ID NO: 29882 - RNA, 22 nt, Homo sapiens
aacagcacacccgcugcuucca

SEQ ID NO: 29883 - RNA, 22 nt, Homo sapiens
aacaggguguuugcaguuucuu

SEQ ID NO: 29884 - RNA, 22 nt, Homo sapiens
aaucugggguuguuuggggagu

SEQ ID NO: 29885 - RNA, 22 nt, Homo sapiens
aaucugucuagacaaggagucu

SEQ ID NO: 29886 - RNA, 22 nt, Homo sapiens
aaugaaguuagauguugagaag

SEQ ID NO: 29887 - RNA, 22 nt, Homo sapiens
aaugcacauauauuuccuuauu

SEQ ID NO: 29888 - RNA, 22 nt, Homo sapiens
aaugcauaauuuguaugaggua

SEQ ID NO: 29889 - RNA, 22 nt, Homo sapiens
aaugcaucuagaaaggugaauu

SEQ ID NO: 29890 - RNA, 22 nt, Homo sapiens
aaugccaucagagaaaacucuu

SEQ ID NO: 29891 - RNA, 22 nt, Homo sapiens
aaugcuguguuauuucaugacc

SEQ ID NO: 29892 - RNA, 22 nt, Homo sapiens
aaugcuguucuuugcuuaaguu

SEQ ID NO: 29893 - RNA, 22 nt, Homo sapiens
aauggagcugaguggccuuggg

SEQ ID NO: 29894 - RNA, 22 nt, Homo sapiens
aauggagcuguuuggaugacuu

SEQ ID NO: 29895 - RNA, 22 nt, Homo sapiens
aauggcaaauguuuucuguuga

SEQ ID NO: 29896 - RNA, 22 nt, Homo sapiens
aauggcacaagaguaaacuguu

SEQ ID NO: 29897 - RNA, 22 nt, Homo sapiens
aauggcacaccuagcccuaacc

SEQ ID NO: 29898 - RNA, 22 nt, Homo sapiens
aauggcacuuuauaaauguuaa

SEQ ID NO: 29899 - RNA, 22 nt, Homo sapiens
aauggcaguagauggaugggua

SEQ ID NO: 29900 - RNA, 22 nt, Homo sapiens
aauggcaucuagaguggugaau

SEQ ID NO: 29901 - RNA, 22 nt, Homo sapiens
aauggcauuugccagggcaaag

SEQ ID NO: 29902 - RNA, 22 nt, Homo sapiens
aauggcucugauguuguuguga

SEQ ID NO: 29903 - RNA, 22 nt, Homo sapiens
aauggcuuucagcuuuucccca

SEQ ID NO: 29904 - RNA, 22 nt, Homo sapiens
aaugucaugaguccaaccagaa

SEQ ID NO: 29905 - RNA, 22 nt, Homo sapiens
aaugugcuguucagaggagucc

SEQ ID NO: 29906 - RNA, 22 nt, Homo sapiens
aaugugcuuucuuucacacagu

SEQ ID NO: 29907 - RNA, 22 nt, Homo sapiens
aaugugcuuugaaaagagcuga

SEQ ID NO: 29908 - RNA, 22 nt, Homo sapiens
aauguguuuugaaaucaggaag

SEQ ID NO: 29909 - RNA, 22 nt, Homo sapiens
aauuaggcuagaauguuauuaa

SEQ ID NO: 29910 - RNA, 22 nt, Homo sapiens
aauuaguuggcugccuaugauu

SEQ ID NO: 29911 - RNA, 22 nt, Homo sapiens
aauugaaugcagaugccaggga

SEQ ID NO: 29912 - RNA, 22 nt, Homo sapiens
aauugcauaugcaguagaucua

SEQ ID NO: 29913 - RNA, 22 nt, Homo sapiens
aauugcauugaauuuguagcuu

SEQ ID NO: 29914 - RNA, 21 nt, Homo sapiens
acaaagcuggagggagacugc

SEQ ID NO: 29915 - RNA, 22 nt, Homo sapiens
acaaaguguuuucugaaggccu

SEQ ID NO: 29916 - RNA, 22 nt, Homo sapiens
acaagcacaaauuuaauccugu

SEQ ID NO: 29917 - RNA, 22 nt, Homo sapiens
acacaguaagcacaguguagau

SEQ ID NO: 29918 - RNA, 22 nt, Homo sapiens
acacaguauaugacaaugcuuu

SEQ ID NO: 29919 - RNA, 22 nt, Homo sapiens
acacagucaaauccacuuggcu

SEQ ID NO: 29920 - RNA, 22 nt, Homo sapiens
acacagugucuguguauuuaaa

SEQ ID NO: 29921 - RNA, 22 nt, Homo sapiens
acugcacuucagccuugugaca

SEQ ID NO: 29922 - RNA, 22 nt, Homo sapiens
acugcauuugucccuuuugaac

SEQ ID NO: 29923 - RNA, 22 nt, Homo sapiens
acugcauuugucugucucaauu

SEQ ID NO: 29924 - RNA, 22 nt, Homo sapiens
acugccuaaugacuuauguuuu

SEQ ID NO: 29925 - RNA, 18 nt, Homo sapiens
acuggaauuaaacuuuuu

SEQ ID NO: 29926 - RNA, 21 nt, Homo sapiens
acuggaccccuuccauacacc

SEQ ID NO: 29927 - RNA, 22 nt, Homo sapiens
acuggaguuuguucaagaaaua

SEQ ID NO: 29928 - RNA, 22 nt, Homo sapiens
acuggcaauggcagaaauaguu

SEQ ID NO: 29929 - RNA, 22 nt, Homo sapiens
acuggcuuaaggaugggccacu

SEQ ID NO: 29930 - RNA, 22 nt, Homo sapiens
acuguacuacagccugggugac

SEQ ID NO: 29931 - RNA, 22 nt, Homo sapiens
acuguacucuacccugggcaac

SEQ ID NO: 29932 - RNA, 22 nt, Homo sapiens
acuucauucucuggaucagaau

SEQ ID NO: 29933 - RNA, 22 nt, Homo sapiens
acuuugcuuagagggcauuaaa

SEQ ID NO: 29934 - RNA, 22 nt, Homo sapiens
acuuugcuuaucccaggcacug

SEQ ID NO: 29935 - RNA, 19 nt, Homo sapiens
acuuuggugauuagaggga

SEQ ID NO: 29936 - RNA, 22 nt, Homo sapiens
acuuugguuaucauacuuucag

SEQ ID NO: 29937 - RNA, 22 nt, Homo sapiens
acuuuguuauggcaacccuaag

SEQ ID NO: 29938 - RNA, 22 nt, Homo sapiens
acuuuuugaugaggucguuugu

SEQ ID NO: 29939 - RNA, 22 nt, Homo sapiens
agaaauguuuauucaaacccgu

SEQ ID NO: 29940 - RNA, 22 nt, Homo sapiens
agaacuguccauucagcaugaa

SEQ ID NO: 29941 - RNA, 22 nt, Homo sapiens
agaagugcuggguucaggcugg

SEQ ID NO: 29942 - RNA, 22 nt, Homo sapiens
agaauacugucuauucauggua

SEQ ID NO: 29943 - RNA, 22 nt, Homo sapiens
agaauguaaacagaauagagga

SEQ ID NO: 29944 - RNA, 22 nt, Homo sapiens
agaauguaacucuaugaaggca

SEQ ID NO: 29945 - RNA, 22 nt, Homo sapiens
agaaugucagcuggauucagcu

SEQ ID NO: 29946 - RNA, 22 nt, Homo sapiens
agaaugugaccuuauuuggaga

SEQ ID NO: 29947 - RNA, 22 nt, Homo sapiens
agaauguuuuagaccaauacaa

SEQ ID NO: 29948 - RNA, 22 nt, Homo sapiens
agacaagauggcuugagguuca

SEQ ID NO: 29949 - RNA, 22 nt, Homo sapiens
agacacuguugaaaaggcccca

SEQ ID NO: 29950 - RNA, 22 nt, Homo sapiens
agacaguguguguauauauggu

SEQ ID NO: 29951 - RNA, 19 nt, Homo sapiens
agagacucauuguagcauu

SEQ ID NO: 29952 - RNA, 22 nt, Homo sapiens
agagagcuuuugguugcccuaa

SEQ ID NO: 29953 - RNA, 22 nt, Homo sapiens
agagauaauuagguuaaaugag

SEQ ID NO: 29954 - RNA, 22 nt, Homo sapiens
agagauaguuuccaacucauac

SEQ ID NO: 29955 - RNA, 22 nt, Homo sapiens
agagaucaauaugaaggaaaug

SEQ ID NO: 29956 - RNA, 20 nt, Homo sapiens
agagaucaguaauucaucaa

SEQ ID NO: 29957 - RNA, 22 nt, Homo sapiens
agagaucauuuuguuucaaauc

SEQ ID NO: 29958 - RNA, 22 nt, Homo sapiens
agagaugaagauggggcucccg

SEQ ID NO: 29959 - RNA, 22 nt, Homo sapiens
agagcaaugggugaauauuaaa

SEQ ID NO: 29960 - RNA, 22 nt, Homo sapiens
agagcuaguauuuacggagcau

SEQ ID NO: 29961 - RNA, 18 nt, Homo sapiens
agagcuaugaacauaugc

SEQ ID NO: 29962 - RNA, 22 nt, Homo sapiens
agaggaguacuacuccaagucu

SEQ ID NO: 29963 - RNA, 22 nt, Homo sapiens
agagguaagaauaguaguugga

SEQ ID NO: 29964 - RNA, 22 nt, Homo sapiens
agagguauacauuugagagcca

SEQ ID NO: 29965 - RNA, 22 nt, Homo sapiens
agagguuuuggggcugagagcu

SEQ ID NO: 29966 - RNA, 22 nt, Homo sapiens
agaguacugacguuugcaaauu

SEQ ID NO: 29967 - RNA, 22 nt, Homo sapiens
agaguaguuucuauauucuuca

SEQ ID NO: 29968 - RNA, 21 nt, Homo sapiens
agagucaucucuaucuguacc

SEQ ID NO: 29969 - RNA, 23 nt, Homo sapiens
agagugcaauggugccaucucgg

SEQ ID NO: 29970 - RNA, 22 nt, Homo sapiens
agauacauuggauaaugguggg

SEQ ID NO: 29971 - RNA, 22 nt, Homo sapiens
agaucauaugcaguaaugaacu

SEQ ID NO: 29972 - RNA, 18 nt, Homo sapiens
agaugcaugcucacuaca

SEQ ID NO: 29973 - RNA, 22 nt, Homo sapiens
agaugcauugguggcauauuca

SEQ ID NO: 29974 - RNA, 22 nt, Homo sapiens
agaugccucauguucuagguuc

SEQ ID NO: 29975 - RNA, 22 nt, Homo sapiens
agaugcuguuaucaacuguagc

SEQ ID NO: 29976 - RNA, 23 nt, Homo sapiens
agauggcauuucaguucuuuagg

SEQ ID NO: 29977 - RNA, 22 nt, Homo sapiens
agauggugugcuaggaaaugua

SEQ ID NO: 29978 - RNA, 18 nt, Homo sapiens
agaugguguugcuucugu

SEQ ID NO: 29979 - RNA, 22 nt, Homo sapiens
agaugguguuuucucaccagau

SEQ ID NO: 29980 - RNA, 22 nt, Homo sapiens
agauguuguucaucugauuguu

SEQ ID NO: 29981 - RNA, 23 nt, Homo sapiens
uuucaggcaggugaaagaccagc

SEQ ID NO: 29982 - RNA, 22 nt, Homo sapiens
uuucauaguuugcauagggcau

SEQ ID NO: 29983 - RNA, 22 nt, Homo sapiens
uuucaucaagcacagaguagau

SEQ ID NO: 29984 - RNA, 22 nt, Homo sapiens
uuucaucagccagggucagucu

SEQ ID NO: 29985 - RNA, 16 nt, Homo sapiens
uuucaucaguuuuaau

SEQ ID NO: 29986 - RNA, 22 nt, Homo sapiens
uuucauggaauauagucauuuu

SEQ ID NO: 29987 - RNA, 22 nt, Homo sapiens
uuucauggaggauuugcuucuu

SEQ ID NO: 29988 - RNA, 22 nt, Homo sapiens
uuuccaagaugcuuacuuucuc

SEQ ID NO: 29989 - RNA, 22 nt, Homo sapiens
uuuccauguuggugaaaugagg

SEQ ID NO: 29990 - RNA, 22 nt, Homo sapiens
uuucccuuuagcuuagugauuu

SEQ ID NO: 29991 - RNA, 22 nt, Homo sapiens
uuucccuuugcuuugucagcca

SEQ ID NO: 29992 - RNA, 22 nt, Homo sapiens
uuucuauguugaccagucuaga

SEQ ID NO: 29993 - RNA, 22 nt, Homo sapiens
uuucugagaccaaaacuuguaa

SEQ ID NO: 29994 - RNA, 22 nt, Homo sapiens
uuucugggggugcugauggaaa

SEQ ID NO: 29995 - RNA, 22 nt, Homo sapiens
uuugaagacuacugggagugaa

SEQ ID NO: 29996 - RNA, 22 nt, Homo sapiens
uuugaaguguggcacugaguuu

SEQ ID NO: 29997 - RNA, 22 nt, Homo sapiens
uuugaaugcaacaaaugcggga

SEQ ID NO: 29998 - RNA, 18 nt, Homo sapiens
uuugacugguguccuuau

SEQ ID NO: 29999 - RNA, 22 nt, Homo sapiens
uuugacuguggagucgaugcuu

SEQ ID NO: 30000 - RNA, 22 nt, Homo sapiens
uuugagcaugcagauugccagg

SEQ ID NO: 30001 - RNA, 22 nt, Homo sapiens
uuugagcauuagggcaaaggca

SEQ ID NO: 30002 - RNA, 22 nt, Homo sapiens
uuugauguugagacuauaaagc

SEQ ID NO: 30003 - RNA, 22 nt, Homo sapiens
uuugcaagaugaaaaaguucua

SEQ ID NO: 30004 - RNA, 22 nt, Homo sapiens
uuugcacuggagauucaauggg

SEQ ID NO: 30005 - RNA, 22 nt, Homo sapiens
uuugcacuuuuguaauaugguu

SEQ ID NO: 30006 - RNA, 22 nt, Homo sapiens
uuugcaguguaguuggccagca

SEQ ID NO: 30007 - RNA, 22 nt, Homo sapiens
uuugcaugcuccuuaugagaau

SEQ ID NO: 30008 - RNA, 22 nt, Homo sapiens
uuugccaaugggaauuuuccua

SEQ ID NO: 30009 - RNA, 22 nt, Homo sapiens
uuugccuguagacacuuacccu

SEQ ID NO: 30010 - RNA, 22 nt, Homo sapiens
uuugcugagucugacuucaugg

SEQ ID NO: 30011 - RNA, 22 nt, Homo sapiens
uuugcuucacuguuuggcaaaa

SEQ ID NO: 30012 - RNA, 22 nt, Homo sapiens
uuugcuugaggucuagcuaccc

SEQ ID NO: 30013 - RNA, 22 nt, Homo sapiens
uuugcuuguguaaaaaucugga

SEQ ID NO: 30014 - RNA, 22 nt, Homo sapiens
uuuggaaugugcacucagauug

SEQ ID NO: 30015 - RNA, 22 nt, Homo sapiens
uuuggcacuauagguaaauuug

SEQ ID NO: 30016 - RNA, 22 nt, Homo sapiens
uuuggcaugggcuauuugcuuu

SEQ ID NO: 30017 - RNA, 22 nt, Homo sapiens
uuuggcauuuuacuacucaaau

SEQ ID NO: 30018 - RNA, 22 nt, Homo sapiens
uuuggcuauguuguaucuuucc

SEQ ID NO: 30019 - RNA, 22 nt, Homo sapiens
uuuggcucugugucccacccaa

SEQ ID NO: 30020 - RNA, 21 nt, Homo sapiens
uuuggcuucucugcugcagcc

SEQ ID NO: 30021 - RNA, 22 nt, Homo sapiens
uuugggaaugguuugucuccca

SEQ ID NO: 30022 - RNA, 22 nt, Homo sapiens
uuugggacuguauuaaaugccu

SEQ ID NO: 30023 - RNA, 22 nt, Homo sapiens
uuugggccaugguuuguguaua

SEQ ID NO: 30024 - RNA, 22 nt, Homo sapiens
uuuggucuuuuguaaguuaucu

SEQ ID NO: 30025 - RNA, 22 nt, Homo sapiens
uuugguguauaaaaaugcuagu

SEQ ID NO: 30026 - RNA, 22 nt, Homo sapiens
uuugguguauauguaaacuaug

SEQ ID NO: 30027 - RNA, 22 nt, Homo sapiens
uuugguuauauauauacacucu

SEQ ID NO: 30028 - RNA, 22 nt, Homo sapiens
uuugguugccucuaugagccug

SEQ ID NO: 30029 - RNA, 22 nt, Homo sapiens
uuugguuuuuguuaucacucau

SEQ ID NO: 30030 - RNA, 22 nt, Homo sapiens
uuuguaagaugcauagauugca

SEQ ID NO: 30031 - RNA, 22 nt, Homo sapiens
uuuguaauccuauuccaaagga

SEQ ID NO: 30032 - RNA, 22 nt, Homo sapiens
uuuguacuaugguuuuucacua

SEQ ID NO: 30033 - RNA, 22 nt, Homo sapiens
uuuguacuucauugguucuacu

SEQ ID NO: 30034 - RNA, 22 nt, Homo sapiens
uuuguacuugaagaaucuuuau

SEQ ID NO: 30035 - RNA, 22 nt, Homo sapiens
uuuguacuugguguucuggaaa

SEQ ID NO: 30036 - RNA, 23 nt, Homo sapiens
uuuguaguagcaugauuuauaau

SEQ ID NO: 30037 - RNA, 22 nt, Homo sapiens
uuugucaauaacuaccaacagg

SEQ ID NO: 30038 - RNA, 19 nt, Homo sapiens
uuuguccugcccuuucuca

SEQ ID NO: 30039 - RNA, 22 nt, Homo sapiens
uuugugaaugucauaagcucca

SEQ ID NO: 30040 - RNA, 22 nt, Homo sapiens
uuugugacuugcuucucagaau

SEQ ID NO: 30041 - RNA, 22 nt, Homo sapiens
uuugugauugcacacucaagau

SEQ ID NO: 30042 - RNA, 22 nt, Homo sapiens
uuugugcaaacuaggauugcga

SEQ ID NO: 30043 - RNA, 23 nt, Homo sapiens
uuugugcuaauuuaugggcucuu

SEQ ID NO: 30044 - RNA, 22 nt, Homo sapiens
uuugugcuauguuauauauucu

SEQ ID NO: 30045 - RNA, 22 nt, Homo sapiens
uuugugcuccucucaguaugug

SEQ ID NO: 30046 - RNA, 22 nt, Homo sapiens
uuuguguccccacccaaacauc

SEQ ID NO: 30047 - RNA, 21 nt, Homo sapiens
uuuguguccccacccaaaucu

SEQ ID NO: 30048 - RNA, 22 nt, Homo sapiens
uuuguucaccucaaggauggga

SEQ ID NO: 30049 - RNA, 22 nt, Homo sapiens
uuuuacacaucaccgcucgugu

SEQ ID NO: 30050 - RNA, 22 nt, Homo sapiens
uuuuacacuguugguuggaaug

SEQ ID NO: 30051 - RNA, 22 nt, Homo sapiens
uuuuagcagccaugacaaagau

SEQ ID NO: 30052 - RNA, 22 nt, Homo sapiens
uuuuaguggaauauuuacaguu

SEQ ID NO: 30053 - RNA, 22 nt, Homo sapiens
uuuuaguggacaaagguauuua

SEQ ID NO: 30054 - RNA, 19 nt, Homo sapiens
uuuuccccuuucuuaagac

SEQ ID NO: 30055 - RNA, 23 nt, Homo sapiens
uuuugcaauaagucacuggaaua

SEQ ID NO: 30056 - RNA, 22 nt, Homo sapiens
uuuugcaguuacagagagugag

SEQ ID NO: 30057 - RNA, 22 nt, Homo sapiens
uuuugcuccuggcaaacucaua

SEQ ID NO: 30058 - RNA, 22 nt, Homo sapiens
uuuugcucuugguaaugaaaga

SEQ ID NO: 30059 - RNA, 22 nt, Homo sapiens
uuuugcuugugaauagccacau

SEQ ID NO: 30060 - RNA, 22 nt, Homo sapiens
uuuuggcacuuugucugauucu

SEQ ID NO: 30061 - RNA, 22 nt, Homo sapiens
uuuugguuaggauggguggcau

SEQ ID NO: 30062 - RNA, 22 nt, Homo sapiens
uuuugguucaauuaauuugcua

SEQ ID NO: 30063 - RNA, 22 nt, Homo sapiens
uuuugguuuuauccagggucuc

SEQ ID NO: 30064 - RNA, 22 nt, Homo sapiens
uuuuguacgccuguguccauca

SEQ ID NO: 30065 - RNA, 22 nt, Homo sapiens
uuuugugcauggcccaguggua

SEQ ID NO: 30066 - RNA, 22 nt, Homo sapiens
uuuuuauggccaauccucagaa

SEQ ID NO: 30067 - RNA, 22 nt, Homo sapiens
uuaacagcacuacguggggauc

SEQ ID NO: 30068 - RNA, 22 nt, Homo sapiens
uuaacagucacuuagcucauuu

SEQ ID NO: 30069 - RNA, 22 nt, Homo sapiens
uuaacagugaccccugguggcc

SEQ ID NO: 30070 - RNA, 22 nt, Homo sapiens
uuaacaguuaauucuuuggcaa

SEQ ID NO: 30071 - RNA, 22 nt, Homo sapiens
uuaacaguugcaugagacugag

SEQ ID NO: 30072 - RNA, 22 nt, Homo sapiens
uuaagagcauggugccagguug

SEQ ID NO: 30073 - RNA, 23 nt, Homo sapiens
uuaagcaacggcugcuuuucaga

SEQ ID NO: 30074 - RNA, 22 nt, Homo sapiens
uuaaggaaagcauuuaauucag

SEQ ID NO: 30075 - RNA, 22 nt, Homo sapiens
uuaaggcuuuaaguaaacacag

SEQ ID NO: 30076 - RNA, 22 nt, Homo sapiens
uuaaggcuuucccuauguaaaa

SEQ ID NO: 30077 - RNA, 22 nt, Homo sapiens
uuaaguaaucagagaagagaac

SEQ ID NO: 30078 - RNA, 20 nt, Homo sapiens
uuaagugcuuucugcuuaga

SEQ ID NO: 30079 - RNA, 22 nt, Homo sapiens
uuaauacugcuuaacuuuagga

SEQ ID NO: 30080 - RNA, 22 nt, Homo sapiens
uuaaucucaggaguuugggacc

SEQ ID NO: 30081 - RNA, 22 nt, Homo sapiens
uuaaucuguucucuguauucua

SEQ ID NO: 30082 - RNA, 22 nt, Homo sapiens
uucauguaauuccauaagguaa

SEQ ID NO: 30083 - RNA, 22 nt, Homo sapiens
uucauugaaugauuuuuagaag

SEQ ID NO: 30084 - RNA, 22 nt, Homo sapiens
uucauuggacuuguguucuuga

SEQ ID NO: 30085 - RNA, 22 nt, Homo sapiens
uuccaagugggaaacaaaaaug

SEQ ID NO: 30086 - RNA, 22 nt, Homo sapiens
uuccacaaugguugaacuaauu

SEQ ID NO: 30087 - RNA, 22 nt, Homo sapiens
uuccacaaugguugaacuagcu

SEQ ID NO: 30088 - RNA, 22 nt, Homo sapiens
uuccacagggauuugcauugau

SEQ ID NO: 30089 - RNA, 22 nt, Homo sapiens
uuccacgugaaguauucuaaag

SEQ ID NO: 30090 - RNA, 22 nt, Homo sapiens
uuccaguggacuacuucauccu

SEQ ID NO: 30091 - RNA, 22 nt, Homo sapiens
uuccaguuauuauaccucuuaa

SEQ ID NO: 30092 - RNA, 22 nt, Homo sapiens
uuccaugugggcuugucaagua

SEQ ID NO: 30093 - RNA, 22 nt, Homo sapiens
uuccauuuguucggugucgcca

SEQ ID NO: 30094 - RNA, 22 nt, Homo sapiens
uucccagugguuagcucugguc

SEQ ID NO: 30095 - RNA, 22 nt, Homo sapiens
uucccugaaguguuacucuaga

SEQ ID NO: 30096 - RNA, 22 nt, Homo sapiens
uucccuugcaggaugaucugga

SEQ ID NO: 30097 - RNA, 22 nt, Homo sapiens
uucccuuucuuaaagaguuagg

SEQ ID NO: 30098 - RNA, 22 nt, Homo sapiens
uuccguguaguugagcaguuuu

SEQ ID NO: 30099 - RNA, 22 nt, Homo sapiens
uuccuagagauuagcaagcugc

SEQ ID NO: 30100 - RNA, 22 nt, Homo sapiens
uuccuaguccugagucucugcg

SEQ ID NO: 30101 - RNA, 19 nt, Homo sapiens
uuccuagugguugggaagu

SEQ ID NO: 30102 - RNA, 22 nt, Homo sapiens
uuccugagaucagaauucaaau

SEQ ID NO: 30103 - RNA, 22 nt, Homo sapiens
uuccugcacuugcuugccuaug

SEQ ID NO: 30104 - RNA, 20 nt, Homo sapiens
uuccuuaggcauuggaagaa

SEQ ID NO: 30105 - RNA, 22 nt, Homo sapiens
uuccuugagagcuugauaucac

SEQ ID NO: 30106 - RNA, 22 nt, Homo sapiens
uucuaaacaucuuacaaugcau

SEQ ID NO: 30107 - RNA, 22 nt, Homo sapiens
uucuaaguaauuuugcaugccu

SEQ ID NO: 30108 - RNA, 20 nt, Homo sapiens
uucuacagucacaggaagau

SEQ ID NO: 30109 - RNA, 22 nt, Homo sapiens
uucuauggucacagaugcuuga

SEQ ID NO: 30110 - RNA, 21 nt, Homo sapiens
uucuauggucagaauucaaua

SEQ ID NO: 30111 - RNA, 22 nt, Homo sapiens
uucucaaggagccuucguaacu

SEQ ID NO: 30112 - RNA, 22 nt, Homo sapiens
uucucagcccccugacagucag

SEQ ID NO: 30113 - RNA, 21 nt, Homo sapiens
uucucaggguguguccuaccc

SEQ ID NO: 30114 - RNA, 19 nt, Homo sapiens
uucucugguuguacuaccc

SEQ ID NO: 30115 - RNA, 22 nt, Homo sapiens
uucugacuggugugagauggua

SEQ ID NO: 30116 - RNA, 22 nt, Homo sapiens
uucugcacaucgaucacaagau

SEQ ID NO: 30117 - RNA, 22 nt, Homo sapiens
uucugcuagucugucagaucuu

SEQ ID NO: 30118 - RNA, 22 nt, Homo sapiens
uucuggccuccauuuuucuccu

SEQ ID NO: 30119 - RNA, 22 nt, Homo sapiens
uucugguuaauacuugcaaaaa

SEQ ID NO: 30120 - RNA, 22 nt, Homo sapiens
uucuguguuuaggucacggcua

SEQ ID NO: 30121 - RNA, 22 nt, Homo sapiens
uucuugcacugaucccauaagc

SEQ ID NO: 30122 - RNA, 22 nt, Homo sapiens
uucuugcuguauccucacaugg

SEQ ID NO: 30123 - RNA, 22 nt, Homo sapiens
uucuugguguaguaguugaaaa

SEQ ID NO: 30124 - RNA, 22 nt, Homo sapiens
uucuuuaguucacuugcuccag

SEQ ID NO: 30125 - RNA, 22 nt, Homo sapiens
uucuuugcaugaucucaaaguc

SEQ ID NO: 30126 - RNA, 22 nt, Homo sapiens
uucuuugguacaagggccgacc

SEQ ID NO: 30127 - RNA, 23 nt, Homo sapiens
uugaaaagucaguagccucugau

SEQ ID NO: 30128 - RNA, 22 nt, Homo sapiens
uugaaagaaaggagacugaguu

SEQ ID NO: 30129 - RNA, 22 nt, Homo sapiens
uugaaagcuaucucaaaucgcu

SEQ ID NO: 30130 - RNA, 22 nt, Homo sapiens
uugaaaguaaacaucacaaaga

SEQ ID NO: 30131 - RNA, 22 nt, Homo sapiens
uugaaauguuuagaaguuugga

SEQ ID NO: 30132 - RNA, 22 nt, Homo sapiens
uugaaggaacgcuguucccuug

SEQ ID NO: 30133 - RNA, 22 nt, Homo sapiens
uugaaguaggaaaggaggaggu

SEQ ID NO: 30134 - RNA, 22 nt, Homo sapiens
uugaagugaagaacaauaucac

SEQ ID NO: 30135 - RNA, 22 nt, Homo sapiens
uugaauagugacuuugauucug

SEQ ID NO: 30136 - RNA, 22 nt, Homo sapiens
uugaauaguggugaaaguuuga

SEQ ID NO: 30137 - RNA, 18 nt, Homo sapiens
uugaaugcgucccagaga

SEQ ID NO: 30138 - RNA, 22 nt, Homo sapiens
uugaaugucuauuaaguuguuu

SEQ ID NO: 30139 - RNA, 22 nt, Homo sapiens
uugacaaggagugggguugaga

SEQ ID NO: 30140 - RNA, 22 nt, Homo sapiens
uugacagagaaaagugugacuu

SEQ ID NO: 30141 - RNA, 20 nt, Homo sapiens
uugacaguggguuguuaaag

SEQ ID NO: 30142 - RNA, 22 nt, Homo sapiens
uugaccaaagaagagucauugc

SEQ ID NO: 30143 - RNA, 22 nt, Homo sapiens
uugacuguaagauggcuauuac

SEQ ID NO: 30144 - RNA, 22 nt, Homo sapiens
uugacuucagagcugauucaag

SEQ ID NO: 30145 - RNA, 22 nt, Homo sapiens
uugagacggaguuuugcucuug

SEQ ID NO: 30146 - RNA, 22 nt, Homo sapiens
uugagauggagcuucacucuug

SEQ ID NO: 30147 - RNA, 22 nt, Homo sapiens
uugagauggagucucacucuuc

SEQ ID NO: 30148 - RNA, 22 nt, Homo sapiens
uugagauggagucucacucuuu

SEQ ID NO: 30149 - RNA, 22 nt, Homo sapiens
uugagauggagucucgcugugu

SEQ ID NO: 30150 - RNA, 22 nt, Homo sapiens
uugagauggagucuugcacugu

SEQ ID NO: 30151 - RNA, 22 nt, Homo sapiens
uugagauggagucuugcucucu

SEQ ID NO: 30152 - RNA, 22 nt, Homo sapiens
uugagauggagucuugcucuug

SEQ ID NO: 30153 - RNA, 22 nt, Homo sapiens
uugagauggaguguugcucugu

SEQ ID NO: 30154 - RNA, 22 nt, Homo sapiens
uugagauggaguucauuuuugu

SEQ ID NO: 30155 - RNA, 22 nt, Homo sapiens
uugagauggaguuucgcucuug

SEQ ID NO: 30156 - RNA, 22 nt, Homo sapiens
uugagauggaguuuugcucuug

SEQ ID NO: 30157 - RNA, 22 nt, Homo sapiens
uugagauggauagacauagcau

SEQ ID NO: 30158 - RNA, 22 nt, Homo sapiens
uugagauguaguuucacuccug

SEQ ID NO: 30159 - RNA, 22 nt, Homo sapiens
uugagcaaaacauuaauauuag

SEQ ID NO: 30160 - RNA, 22 nt, Homo sapiens
uugagcacaggaguuuugagac

SEQ ID NO: 30161 - RNA, 22 nt, Homo sapiens
uugagcaccaugccuggccaug

SEQ ID NO: 30162 - RNA, 22 nt, Homo sapiens
uugagcaucauguuagcacuca

SEQ ID NO: 30163 - RNA, 22 nt, Homo sapiens
uugagcuaugaguuaauaggac

SEQ ID NO: 30164 - RNA, 22 nt, Homo sapiens
uugagcucaucuucagggguga

SEQ ID NO: 30165 - RNA, 21 nt, Homo sapiens
uugagcuuuuaguacagacag

SEQ ID NO: 30166 - RNA, 22 nt, Homo sapiens
uugaggacugagacagaccaag

SEQ ID NO: 30167 - RNA, 22 nt, Homo sapiens
uugaggacugcuaagcauuuga

SEQ ID NO: 30168 - RNA, 22 nt, Homo sapiens
uugaggaggcagucugcccauu

SEQ ID NO: 30169 - RNA, 22 nt, Homo sapiens
uugaggaucauuguuuucggag

SEQ ID NO: 30170 - RNA, 22 nt, Homo sapiens
uugagggaaacauucacaucau

SEQ ID NO: 30171 - RNA, 22 nt, Homo sapiens
uugagggaagccagaggucugc

SEQ ID NO: 30172 - RNA, 22 nt, Homo sapiens
uugagggaggcagggcuugucu

SEQ ID NO: 30173 - RNA, 22 nt, Homo sapiens
uugagggcugaauaccaaucag

SEQ ID NO: 30174 - RNA, 22 nt, Homo sapiens
uugagguaauaaacagccauuc

SEQ ID NO: 30175 - RNA, 22 nt, Homo sapiens
uugagguauaaagguagguugu

SEQ ID NO: 30176 - RNA, 22 nt, Homo sapiens
uugaguagaaguaugucaguau

SEQ ID NO: 30177 - RNA, 22 nt, Homo sapiens
uugaguaguaagaagaugauag

SEQ ID NO: 30178 - RNA, 22 nt, Homo sapiens
uugauaguuuuaaaauuaaucu

SEQ ID NO: 30179 - RNA, 22 nt, Homo sapiens
uugauauguuguuagauucagu

SEQ ID NO: 30180 - RNA, 22 nt, Homo sapiens
uugaucaucagcuuugucaucu

SEQ ID NO: 30181 - RNA, 22 nt, Homo sapiens
uugaucugugucccugcccaau

SEQ ID NO: 30182 - RNA, 22 nt, Homo sapiens
uugaucuguguuagaagcuaag

SEQ ID NO: 30183 - RNA, 22 nt, Homo sapiens
uugauguugaggacauaaaccu

SEQ ID NO: 30184 - RNA, 20 nt, Homo sapiens
uugauucccucuaaacucgc

SEQ ID NO: 30185 - RNA, 22 nt, Homo sapiens
ugagauuguaucugcaaugugu

SEQ ID NO: 30186 - RNA, 22 nt, Homo sapiens
ugagauuguuagaucaaauggu

SEQ ID NO: 30187 - RNA, 22 nt, Homo sapiens
ugagcaaaauuuuggacauaga

SEQ ID NO: 30188 - RNA, 22 nt, Homo sapiens
ugagcagaaagcugcaaggucg

SEQ ID NO: 30189 - RNA, 22 nt, Homo sapiens
uaugggauuucauuaagugucu

SEQ ID NO: 30190 - RNA, 19 nt, Homo sapiens
uaugggauuuuuagggugu

SEQ ID NO: 30191 - RNA, 22 nt, Homo sapiens
uauggguaguacaaaguguaua

SEQ ID NO: 30192 - RNA, 22 nt, Homo sapiens
uauggguauuuuauacauaacc

SEQ ID NO: 30193 - RNA, 22 nt, Homo sapiens
uaugggucuuaaaucacuuagu

SEQ ID NO: 30194 - RNA, 17 nt, Homo sapiens
uauguaguacuuauaaa

SEQ ID NO: 30195 - RNA, 22 nt, Homo sapiens
uaugucuuuugcuugcaaauag

SEQ ID NO: 30196 - RNA, 22 nt, Homo sapiens
uaugugcacaugcccuggugac

SEQ ID NO: 30197 - RNA, 22 nt, Homo sapiens
uauguuaucaaaaagcuaagga

SEQ ID NO: 30198 - RNA, 18 nt, Homo sapiens
uauuaagcuagauauuau

SEQ ID NO: 30199 - RNA, 22 nt, Homo sapiens
uauuacauccauaggcucugcu

SEQ ID NO: 30200 - RNA, 22 nt, Homo sapiens
uauuagugucuuuugguuagaa

SEQ ID NO: 30201 - RNA, 22 nt, Homo sapiens
uauucacaggugugggacaaag

SEQ ID NO: 30202 - RNA, 22 nt, Homo sapiens
uauuccacuuacaugagguauc

SEQ ID NO: 30203 - RNA, 18 nt, Homo sapiens
uauuccucuuccucuauc

SEQ ID NO: 30204 - RNA, 22 nt, Homo sapiens
uauugaacgugggauauugaag

SEQ ID NO: 30205 - RNA, 22 nt, Homo sapiens
uauugaauuugagcugucucuu

SEQ ID NO: 30206 - RNA, 22 nt, Homo sapiens
uauugacuugagaagggauuag

SEQ ID NO: 30207 - RNA, 22 nt, Homo sapiens
uauugcaauuggggaaacuggg

SEQ ID NO: 30208 - RNA, 22 nt, Homo sapiens
uauugcagauacccaggaaguu

SEQ ID NO: 30209 - RNA, 22 nt, Homo sapiens
uauugcauguugagcaguaccu

SEQ ID NO: 30210 - RNA, 22 nt, Homo sapiens
uauugcuaacaucccuuaugua

SEQ ID NO: 30211 - RNA, 22 nt, Homo sapiens
uauugcuccccauaucgcagug

SEQ ID NO: 30212 - RNA, 22 nt, Homo sapiens
uauugcuccuaauaucacggug

SEQ ID NO: 30213 - RNA, 22 nt, Homo sapiens
uauugcuggcucugucuucauu

SEQ ID NO: 30214 - RNA, 22 nt, Homo sapiens
uauugcuuuacucucuuauccu

SEQ ID NO: 30215 - RNA, 22 nt, Homo sapiens
uauuggcucuguuucucugaag

SEQ ID NO: 30216 - RNA, 22 nt, Homo sapiens
uauuguacauguuauagauuuu

SEQ ID NO: 30217 - RNA, 22 nt, Homo sapiens
uauugucacuaaaggaagcugg

SEQ ID NO: 30218 - RNA, 22 nt, Homo sapiens
uauuuggauagucuggaaaaaa

SEQ ID NO: 30219 - RNA, 22 nt, Homo sapiens
ucaaaaccucagagaguagagc

SEQ ID NO: 30220 - RNA, 22 nt, Homo sapiens
ucaaacugucagguugaccaga

SEQ ID NO: 30221 - RNA, 22 nt, Homo sapiens
ucaaaguauucuucugagaacc

SEQ ID NO: 30222 - RNA, 21 nt, Homo sapiens
ucaaaguguucuuuuguugaa

SEQ ID NO: 30223 - RNA, 22 nt, Homo sapiens
ucaaaucaucuuuuccaaagcu

SEQ ID NO: 30224 - RNA, 22 nt, Homo sapiens
ucaaaugcacguagagaaaaua

SEQ ID NO: 30225 - RNA, 22 nt, Homo sapiens
ucaacugcuugagaucacaaau

SEQ ID NO: 30226 - RNA, 22 nt, Homo sapiens
ucaagcaauucgccugucucag

SEQ ID NO: 30227 - RNA, 19 nt, Homo sapiens
ucaagcuauucuccugccu

SEQ ID NO: 30228 - RNA, 20 nt, Homo sapiens
ucaaggcaggaacuguacau

SEQ ID NO: 30229 - RNA, 22 nt, Homo sapiens
ucaaguaauacucccaucuugg

SEQ ID NO: 30230 - RNA, 22 nt, Homo sapiens
ucaaguacuuugcauagugccg

SEQ ID NO: 30231 - RNA, 22 nt, Homo sapiens
ucaaguaguaacuaacugugac

SEQ ID NO: 30232 - RNA, 22 nt, Homo sapiens
ucaaguagugacucgaguuauu

SEQ ID NO: 30233 - RNA, 22 nt, Homo sapiens
ucaagugauucuugugccuuag

SEQ ID NO: 30234 - RNA, 22 nt, Homo sapiens
ucaaugcaaccuccaccucugg

SEQ ID NO: 30235 - RNA, 16 nt, Homo sapiens
ucacaaacucuagcag

SEQ ID NO: 30236 - RNA, 18 nt, Homo sapiens
ucacaaccacagugcugu

SEQ ID NO: 30237 - RNA, 22 nt, Homo sapiens
ucacaagcuccugccuuugcuu

SEQ ID NO: 30238 - RNA, 22 nt, Homo sapiens
ucacaauggagacucgggcgga

SEQ ID NO: 30239 - RNA, 22 nt, Homo sapiens
ucacaauguaaaugaggguugg

SEQ ID NO: 30240 - RNA, 22 nt, Homo sapiens
ucacacucucaccaacauuugg

SEQ ID NO: 30241 - RNA, 22 nt, Homo sapiens
ucacacugaauuugaagcaaug

SEQ ID NO: 30242 - RNA, 23 nt, Homo sapiens
ucacacuuaagagaaaugcagcu

SEQ ID NO: 30243 - RNA, 22 nt, Homo sapiens
ucacagauaaauaaagaugauu

SEQ ID NO: 30244 - RNA, 22 nt, Homo sapiens
ucacaggguguuauuagaauua

SEQ ID NO: 30245 - RNA, 19 nt, Homo sapiens
ucacaggguugacuugagg

SEQ ID NO: 30246 - RNA, 18 nt, Homo sapiens
ucacagguaaaguugaca

SEQ ID NO: 30247 - RNA, 18 nt, Homo sapiens
ucacagguaauuaggauu

SEQ ID NO: 30248 - RNA, 22 nt, Homo sapiens
ucacaguaucaugggggacaga

SEQ ID NO: 30249 - RNA, 22 nt, Homo sapiens
ucacaguauggggggugguuau

SEQ ID NO: 30250 - RNA, 22 nt, Homo sapiens
ucacaguauucaugaacaugga

SEQ ID NO: 30251 - RNA, 22 nt, Homo sapiens
ucacagucaaaguaaucauaga

SEQ ID NO: 30252 - RNA, 22 nt, Homo sapiens
ucacagucacugucacguugaa

SEQ ID NO: 30253 - RNA, 22 nt, Homo sapiens
ucacagugaguggaguggggug

SEQ ID NO: 30254 - RNA, 22 nt, Homo sapiens
ucacaguucagcauggcugagg

SEQ ID NO: 30255 - RNA, 22 nt, Homo sapiens
ucacaguuggccuggccuuuua

SEQ ID NO: 30256 - RNA, 22 nt, Homo sapiens
ucacaucucagguuucuugaca

SEQ ID NO: 30257 - RNA, 22 nt, Homo sapiens
ucacaugaauugucuuguucca

SEQ ID NO: 30258 - RNA, 22 nt, Homo sapiens
ucacauggaggugauaguugaa

SEQ ID NO: 30259 - RNA, 21 nt, Homo sapiens
ucacauggccagaguaggaac

SEQ ID NO: 30260 - RNA, 18 nt, Homo sapiens
ucacauggccgagagaga

SEQ ID NO: 30261 - RNA, 22 nt, Homo sapiens
ucacaugugaagauugggagua

SEQ ID NO: 30262 - RNA, 22 nt, Homo sapiens
ucacaugugcguuuuggcaugu

SEQ ID NO: 30263 - RNA, 22 nt, Homo sapiens
ucacauguguaaauugguguaa

SEQ ID NO: 30264 - RNA, 21 nt, Homo sapiens
ucaccuguagcugcauguucu

SEQ ID NO: 30265 - RNA, 22 nt, Homo sapiens
ucaccuugcacaguuguguggg

SEQ ID NO: 30266 - RNA, 19 nt, Homo sapiens
ucaccuugcccugcacaca

SEQ ID NO: 30267 - RNA, 22 nt, Homo sapiens
ucacuagggagaaacugaggcu

SEQ ID NO: 30268 - RNA, 22 nt, Homo sapiens
ucacuagggaucacuuuacccg

SEQ ID NO: 30269 - RNA, 22 nt, Homo sapiens
ucacugaaaccacugccuccug

SEQ ID NO: 30270 - RNA, 22 nt, Homo sapiens
ucacugaaaccgccuccaccuc

SEQ ID NO: 30271 - RNA, 22 nt, Homo sapiens
ucacugaaaccuccgccuucug

SEQ ID NO: 30272 - RNA, 22 nt, Homo sapiens
ucacugagcacaggagaugugc

SEQ ID NO: 30273 - RNA, 20 nt, Homo sapiens
ucacugaguaucuacgauua

SEQ ID NO: 30274 - RNA, 22 nt, Homo sapiens
ucacugcacuagguaaugccac

SEQ ID NO: 30275 - RNA, 22 nt, Homo sapiens
ucacugcacuccagccuuuaug

SEQ ID NO: 30276 - RNA, 22 nt, Homo sapiens
ucacugcacuucaggcuuucuc

SEQ ID NO: 30277 - RNA, 22 nt, Homo sapiens
ucacuggacucuagccugggug

SEQ ID NO: 30278 - RNA, 20 nt, Homo sapiens
ucacuggagcucauuugauu

SEQ ID NO: 30279 - RNA, 22 nt, Homo sapiens
ucacuggaggagaggaagugga

SEQ ID NO: 30280 - RNA, 22 nt, Homo sapiens
ucacuggagguuccugaaguuc

SEQ ID NO: 30281 - RNA, 22 nt, Homo sapiens
ucacugggagaccaaagccauc

SEQ ID NO: 30282 - RNA, 20 nt, Homo sapiens
ucacuggguucuugaagucu

SEQ ID NO: 30283 - RNA, 22 nt, Homo sapiens
ucacuguguauguauaugcagg

SEQ ID NO: 30284 - RNA, 22 nt, Homo sapiens
ucacuuggccgcagccuucucu

SEQ ID NO: 30285 - RNA, 22 nt, Homo sapiens
ucacuuuggguacuauggaaau

SEQ ID NO: 30286 - RNA, 19 nt, Homo sapiens
ugccaagaaagucagcuua

SEQ ID NO: 30287 - RNA, 20 nt, Homo sapiens
ugccaagaaaugaggguauu

SEQ ID NO: 30288 - RNA, 22 nt, Homo sapiens
uaggcaaaugcaagaguagaac

SEQ ID NO: 30289 - RNA, 22 nt, Homo sapiens
uaggcacugagaauaugaggau

SEQ ID NO: 30290 - RNA, 22 nt, Homo sapiens
uaggcaguguucucacuuguaa

SEQ ID NO: 30291 - RNA, 22 nt, Homo sapiens
uaggccuuuuuaugucaauauc

SEQ ID NO: 30292 - RNA, 22 nt, Homo sapiens
uaggcuuuuggacccugucucu

SEQ ID NO: 30293 - RNA, 22 nt, Homo sapiens
uagggagugucuucauuuugua

SEQ ID NO: 30294 - RNA, 22 nt, Homo sapiens
uagggcuugugaucagguguag

SEQ ID NO: 30295 - RNA, 22 nt, Homo sapiens
uagggcuuuccggccugucaga

SEQ ID NO: 30296 - RNA, 22 nt, Homo sapiens
uagguaagauguuaacagcuga

SEQ ID NO: 30297 - RNA, 22 nt, Homo sapiens
uagguaaguaauauacagauga

SEQ ID NO: 30298 - RNA, 22 nt, Homo sapiens
uagguacuuaagaucucagcua

SEQ ID NO: 30299 - RNA, 22 nt, Homo sapiens
uaggucaguuuuggcuuggcuu

SEQ ID NO: 30300 - RNA, 22 nt, Homo sapiens
uaggucuuuuagcauaggagcu

SEQ ID NO: 30301 - RNA, 22 nt, Homo sapiens
uaggugguuugaaauacucaag

SEQ ID NO: 30302 - RNA, 19 nt, Homo sapiens
uaggugguuuuccccucac

SEQ ID NO: 30303 - RNA, 22 nt, Homo sapiens
uagguuaugauccaucuuggcu

SEQ ID NO: 30304 - RNA, 22 nt, Homo sapiens
uagguugucaucagucuccacu

SEQ ID NO: 30305 - RNA, 22 nt, Homo sapiens
uaguaaacauaguucuuuugcu

SEQ ID NO: 30306 - RNA, 22 nt, Homo sapiens
uaguaacacauugaacgaucgc

SEQ ID NO: 30307 - RNA, 23 nt, Homo sapiens
uaguaccauauuguuggcagcac

SEQ ID NO: 30308 - RNA, 22 nt, Homo sapiens
uaguacccuugaagcagacaua

SEQ ID NO: 30309 - RNA, 22 nt, Homo sapiens
uaguagcauaccuaaguauacu

SEQ ID NO: 30310 - RNA, 22 nt, Homo sapiens
uaguaucacauggucuuaauua

SEQ ID NO: 30311 - RNA, 22 nt, Homo sapiens
uagucagcaauguucauguucu

SEQ ID NO: 30312 - RNA, 22 nt, Homo sapiens
uagugacauugcugggaaugcu

SEQ ID NO: 30313 - RNA, 20 nt, Homo sapiens
uaguggaaaucagguccucu

SEQ ID NO: 30314 - RNA, 20 nt, Homo sapiens
uaguggcaugcaccuguagc

SEQ ID NO: 30315 - RNA, 22 nt, Homo sapiens
uaguggucccccagucccagcu

SEQ ID NO: 30316 - RNA, 22 nt, Homo sapiens
uaguuaguagacucugauuauu

SEQ ID NO: 30317 - RNA, 22 nt, Homo sapiens
uaguugcaucuuaggucuguga

SEQ ID NO: 30318 - RNA, 22 nt, Homo sapiens
uauaaaguaauuucuaggggcu

SEQ ID NO: 30319 - RNA, 22 nt, Homo sapiens
uauacaugugccauguuggugu

SEQ ID NO: 30320 - RNA, 22 nt, Homo sapiens
uauacuguuuucuauaguggcu

SEQ ID NO: 30321 - RNA, 22 nt, Homo sapiens
uauagagguagguuaauuggaa

SEQ ID NO: 30322 - RNA, 22 nt, Homo sapiens
uauagcaaugccccacuccuga

SEQ ID NO: 30323 - RNA, 22 nt, Homo sapiens
uauaguguuuucaaaaguaugu

SEQ ID NO: 30324 - RNA, 22 nt, Homo sapiens
uauauaagcugaugagccacaa

SEQ ID NO: 30325 - RNA, 22 nt, Homo sapiens
uauaugcaacauaguguaugug

SEQ ID NO: 30326 - RNA, 22 nt, Homo sapiens
uauaugcauugugggguacuga

SEQ ID NO: 30327 - RNA, 23 nt, Homo sapiens
uaucacacuuucucugugccaca

SEQ ID NO: 30328 - RNA, 20 nt, Homo sapiens
uaucacaggucagaaacccu

SEQ ID NO: 30329 - RNA, 20 nt, Homo sapiens
uaucacauggggagaaaccu

SEQ ID NO: 30330 - RNA, 22 nt, Homo sapiens
uaucacuuugauaguuuaaaug

SEQ ID NO: 30331 - RNA, 21 nt, Homo sapiens
uaucagagacauugagaggca

SEQ ID NO: 30332 - RNA, 22 nt, Homo sapiens
uaucagcacaguggguucaugg

SEQ ID NO: 30333 - RNA, 22 nt, Homo sapiens
uaucagcagagucauacuucaa

SEQ ID NO: 30334 - RNA, 22 nt, Homo sapiens
uaucagcagcaggggcugcaga

SEQ ID NO: 30335 - RNA, 22 nt, Homo sapiens
uaucauaguuuggacuuucauu

SEQ ID NO: 30336 - RNA, 22 nt, Homo sapiens
uaucauggaaagauguugaaau

SEQ ID NO: 30337 - RNA, 21 nt, Homo sapiens
uaucauggugaaacccugucu

SEQ ID NO: 30338 - RNA, 22 nt, Homo sapiens
uaucccuuagagcggggugguu

SEQ ID NO: 30339 - RNA, 22 nt, Homo sapiens
uaucucagaguguacaagauua

SEQ ID NO: 30340 - RNA, 22 nt, Homo sapiens
uaucucauccuccuugauccca

SEQ ID NO: 30341 - RNA, 22 nt, Homo sapiens
uaucucuuuucauguguaaaug

SEQ ID NO: 30342 - RNA, 22 nt, Homo sapiens
uaucugcaucccauuuuuauca

SEQ ID NO: 30343 - RNA, 22 nt, Homo sapiens
uaucugguuauugcugcugauu

SEQ ID NO: 30344 - RNA, 22 nt, Homo sapiens
uaugaaagcuacuucucacaau

SEQ ID NO: 30345 - RNA, 22 nt, Homo sapiens
uaugaaccuguuaucuagguuu

SEQ ID NO: 30346 - RNA, 20 nt, Homo sapiens
uaugacacugucauaaaaau

SEQ ID NO: 30347 - RNA, 22 nt, Homo sapiens
uaugaccuuggacaaguuacuu

SEQ ID NO: 30348 - RNA, 22 nt, Homo sapiens
uaugaccuuguccccucucgcc

SEQ ID NO: 30349 - RNA, 22 nt, Homo sapiens
uaugacugagacuuaaauugug

SEQ ID NO: 30350 - RNA, 22 nt, Homo sapiens
uaugacuuguuuucuggucugc

SEQ ID NO: 30351 - RNA, 22 nt, Homo sapiens
uaugacuuuggaaaaauuacuu

SEQ ID NO: 30352 - RNA, 20 nt, Homo sapiens
uaugagacugggagaaguuc

SEQ ID NO: 30353 - RNA, 22 nt, Homo sapiens
uaugagacugugagugagaaau

SEQ ID NO: 30354 - RNA, 22 nt, Homo sapiens
uaugagagcugguagguagaga

SEQ ID NO: 30355 - RNA, 21 nt, Homo sapiens
uaugagucugcaagaaccaca

SEQ ID NO: 30356 - RNA, 22 nt, Homo sapiens
uaugaucacuacagcagggaug

SEQ ID NO: 30357 - RNA, 22 nt, Homo sapiens
uaugaugcuguuuagaaucucu

SEQ ID NO: 30358 - RNA, 19 nt, Homo sapiens
uaugcaacuuauagugcug

SEQ ID NO: 30359 - RNA, 22 nt, Homo sapiens
uaugcacacacguguuuaugug

SEQ ID NO: 30360 - RNA, 22 nt, Homo sapiens
uaugcacaugugccugggugug

SEQ ID NO: 30361 - RNA, 22 nt, Homo sapiens
uaugcacuauagcauauguggu

SEQ ID NO: 30362 - RNA, 22 nt, Homo sapiens
uaugcccauuuaaauugaacaa

SEQ ID NO: 30363 - RNA, 22 nt, Homo sapiens
uaugccuuuugguucaagcaac

SEQ ID NO: 30364 - RNA, 22 nt, Homo sapiens
uaugcuuauaaacauuugucag

SEQ ID NO: 30365 - RNA, 22 nt, Homo sapiens
uaugcuuguuuauuuaagaaac

SEQ ID NO: 30366 - RNA, 22 nt, Homo sapiens
uauggauuuucagauucuuauc

SEQ ID NO: 30367 - RNA, 22 nt, Homo sapiens
uauggcuuuuauuauguuguag

SEQ ID NO: 30368 - RNA, 22 nt, Homo sapiens
uauggguuucagagggugauag

SEQ ID NO: 30369 - RNA, 22 nt, Homo sapiens
uaugguuuucucuuacguguug

SEQ ID NO: 30370 - RNA, 19 nt, Homo sapiens
uauguaguuuucucaauau

SEQ ID NO: 30371 - RNA, 22 nt, Homo sapiens
uaugucacuggacauaaguucu

SEQ ID NO: 30372 - RNA, 22 nt, Homo sapiens
uaugucaugggguuuuugagau

SEQ ID NO: 30373 - RNA, 22 nt, Homo sapiens
uaugucuggaguuacugagcug

SEQ ID NO: 30374 - RNA, 22 nt, Homo sapiens
uaugucuucuuuagagaaaugu

SEQ ID NO: 30375 - RNA, 22 nt, Homo sapiens
uaugugcuuuguuaaacagaug

SEQ ID NO: 30376 - RNA, 22 nt, Homo sapiens
uaugugguuaauaggaauuugu

SEQ ID NO: 30377 - RNA, 22 nt, Homo sapiens
uauuacugucaauaucacagaa

SEQ ID NO: 30378 - RNA, 22 nt, Homo sapiens
uauuacuguuauuccuaucaaa

SEQ ID NO: 30379 - RNA, 22 nt, Homo sapiens
uauuagguuggugcaaaaguaa

SEQ ID NO: 30380 - RNA, 22 nt, Homo sapiens
uauuagguuggugcaaaaguua

SEQ ID NO: 30381 - RNA, 22 nt, Homo sapiens
uauuccacuauuaguccagaug

SEQ ID NO: 30382 - RNA, 22 nt, Homo sapiens
uauuccacucuguuggagguaa

SEQ ID NO: 30383 - RNA, 22 nt, Homo sapiens
uauugaacuggaucagaaggcc

SEQ ID NO: 30384 - RNA, 22 nt, Homo sapiens
uauugacauuacagugggucuu

SEQ ID NO: 30385 - RNA, 22 nt, Homo sapiens
uauugacuuuuuuguuaggagg

SEQ ID NO: 30386 - RNA, 22 nt, Homo sapiens
uauugcacaugaggagacauug

SEQ ID NO: 30387 - RNA, 22 nt, Homo sapiens
uuagguauuuuguuaugucagc

SEQ ID NO: 30388 - RNA, 22 nt, Homo sapiens
uuaguaguuugauaggaauagc

SEQ ID NO: 30389 - RNA, 20 nt, Homo sapiens
uuagucuccucugcccuguc

SEQ ID NO: 30390 - RNA, 22 nt, Homo sapiens
uuagugcaaacucuucaaugcu

SEQ ID NO: 30391 - RNA, 22 nt, Homo sapiens
uuagugcugaguggaauguucu

SEQ ID NO: 30392 - RNA, 22 nt, Homo sapiens
uuagugcuuacgaugagcuaag

SEQ ID NO: 30393 - RNA, 22 nt, Homo sapiens
uuaguucccucauucuugacuu

SEQ ID NO: 30394 - RNA, 22 nt, Homo sapiens
uuaguuuaucagugguuucuga

SEQ ID NO: 30395 - RNA, 20 nt, Homo sapiens
uuauaacuuuuguucugggg

SEQ ID NO: 30396 - RNA, 22 nt, Homo sapiens
uuauagacacguuguaacaaac

SEQ ID NO: 30397 - RNA, 22 nt, Homo sapiens
uuauagcacuaagaagguaaua

SEQ ID NO: 30398 - RNA, 22 nt, Homo sapiens
uuauauguuagacauggugggu

SEQ ID NO: 30399 - RNA, 22 nt, Homo sapiens
uuauauguuucuuagggacaga

SEQ ID NO: 30400 - RNA, 22 nt, Homo sapiens
uuaugaaguagguuaagagcag

SEQ ID NO: 30401 - RNA, 22 nt, Homo sapiens
uuauggcucuuggggaaguaga

SEQ ID NO: 30402 - RNA, 22 nt, Homo sapiens
uuaugguuuucucucacgcagg

SEQ ID NO: 30403 - RNA, 22 nt, Homo sapiens
uuaugguuuuucugugagaugg

SEQ ID NO: 30404 - RNA, 22 nt, Homo sapiens
uuaugucacuguucagucuccc

SEQ ID NO: 30405 - RNA, 22 nt, Homo sapiens
uuaugucuuuuguguucagcua

SEQ ID NO: 30406 - RNA, 22 nt, Homo sapiens
uuauguguuuaauguuucugaa

SEQ ID NO: 30407 - RNA, 22 nt, Homo sapiens
uuauuacuccuauuuuguagau

SEQ ID NO: 30408 - RNA, 22 nt, Homo sapiens
uuauuagguugguggaaaagua

SEQ ID NO: 30409 - RNA, 22 nt, Homo sapiens
uuauucauuaauugcuaagguu

SEQ ID NO: 30410 - RNA, 22 nt, Homo sapiens
uuauucugucuuuggucucaau

SEQ ID NO: 30411 - RNA, 16 nt, Homo sapiens
uuauugcauucuucuc

SEQ ID NO: 30412 - RNA, 22 nt, Homo sapiens
uuauuugguugcugacuuggaa

SEQ ID NO: 30413 - RNA, 23 nt, Homo sapiens
uucaaaggaugcuuuauggaauu

SEQ ID NO: 30414 - RNA, 22 nt, Homo sapiens
uucaaauguucuuucaccaccc

SEQ ID NO: 30415 - RNA, 22 nt, Homo sapiens
uucaacagugauggccuuugua

SEQ ID NO: 30416 - RNA, 22 nt, Homo sapiens
uucaagcuauggugaucuuuuc

SEQ ID NO: 30417 - RNA, 22 nt, Homo sapiens
uucaagugguucagaagucuga

SEQ ID NO: 30418 - RNA, 22 nt, Homo sapiens
uucacaaugccuuguugauggu

SEQ ID NO: 30419 - RNA, 22 nt, Homo sapiens
uucacaauuaaaugugguuauu

SEQ ID NO: 30420 - RNA, 22 nt, Homo sapiens
uucacagagagaacucaaacca

SEQ ID NO: 30421 - RNA, 22 nt, Homo sapiens
uucacagaguuauuuuuaugcu

SEQ ID NO: 30422 - RNA, 20 nt, Homo sapiens
uucacaggcagcuucuuucu

SEQ ID NO: 30423 - RNA, 22 nt, Homo sapiens
uucacaguacucccuggaauua

SEQ ID NO: 30424 - RNA, 22 nt, Homo sapiens
uucacaguguguacaccagggg

SEQ ID NO: 30425 - RNA, 22 nt, Homo sapiens
uucacaugacagggugaagcau

SEQ ID NO: 30426 - RNA, 22 nt, Homo sapiens
uucacaugguugccuuuugauc

SEQ ID NO: 30427 - RNA, 22 nt, Homo sapiens
uucaccuggguuggccaucauu

SEQ ID NO: 30428 - RNA, 22 nt, Homo sapiens
uucaccuguagcaugcccuugg

SEQ ID NO: 30429 - RNA, 22 nt, Homo sapiens
uucacugggugugguggcucac

SEQ ID NO: 30430 - RNA, 22 nt, Homo sapiens
uucacuguagccucagccucuu

SEQ ID NO: 30431 - RNA, 22 nt, Homo sapiens
uucagcuaccugggaugcugaa

SEQ ID NO: 30432 - RNA, 22 nt, Homo sapiens
uucagcuacuuggaaacagcaa

SEQ ID NO: 30433 - RNA, 22 nt, Homo sapiens
uucaggcuccugugagaaucua

SEQ ID NO: 30434 - RNA, 22 nt, Homo sapiens
uucaggcuuuuauuuacugaua

SEQ ID NO: 30435 - RNA, 22 nt, Homo sapiens
uucagggcauuggaguuucuga

SEQ ID NO: 30436 - RNA, 22 nt, Homo sapiens
uucagguacuauaggcuguugg

SEQ ID NO: 30437 - RNA, 22 nt, Homo sapiens
uucagguaucccuugucuauag

SEQ ID NO: 30438 - RNA, 22 nt, Homo sapiens
uucagguucauuugcugcuauu

SEQ ID NO: 30439 - RNA, 22 nt, Homo sapiens
uucaguaaauguucuuacuaua

SEQ ID NO: 30440 - RNA, 20 nt, Homo sapiens
uucagugcagguaacaaucc

SEQ ID NO: 30441 - RNA, 22 nt, Homo sapiens
uucaguggacuuaguagugcuu

SEQ ID NO: 30442 - RNA, 22 nt, Homo sapiens
uucaguggguggaugaauauga

SEQ ID NO: 30443 - RNA, 22 nt, Homo sapiens
uucaguucugcacugaucuuag

SEQ ID NO: 30444 - RNA, 22 nt, Homo sapiens
uucaguugcaucaguugaccag

SEQ ID NO: 30445 - RNA, 22 nt, Homo sapiens
uucauagucuaugcaaguaaga

SEQ ID NO: 30446 - RNA, 22 nt, Homo sapiens
uucaucagggagaaauaauuuc

SEQ ID NO: 30447 - RNA, 22 nt, Homo sapiens
uucaucagggguauuggccaau

SEQ ID NO: 30448 - RNA, 18 nt, Homo sapiens
uucaucaguccucagcug

SEQ ID NO: 30449 - RNA, 22 nt, Homo sapiens
uucaucuggcaauucagagauu

SEQ ID NO: 30450 - RNA, 22 nt, Homo sapiens
uucauggagccauccuuugauc

SEQ ID NO: 30451 - RNA, 20 nt, Homo sapiens
uucaugggagcaaagaggcc

SEQ ID NO: 30452 - RNA, 22 nt, Homo sapiens
uucaugucuuggcuguuagagu

SEQ ID NO: 30453 - RNA, 22 nt, Homo sapiens
uuccacaggguugaacuaguuu

SEQ ID NO: 30454 - RNA, 22 nt, Homo sapiens
uuccacuuuuuccuugugcucc

SEQ ID NO: 30455 - RNA, 22 nt, Homo sapiens
uuccagaugggaguucuauucu

SEQ ID NO: 30456 - RNA, 22 nt, Homo sapiens
uuccagcugggggcaacucugc

SEQ ID NO: 30457 - RNA, 22 nt, Homo sapiens
uuccaguaauagcacagcauug

SEQ ID NO: 30458 - RNA, 22 nt, Homo sapiens
uuccaguguuugacucaccuuu

SEQ ID NO: 30459 - RNA, 22 nt, Homo sapiens
uuccauguaguugaacgguuuu

SEQ ID NO: 30460 - RNA, 22 nt, Homo sapiens
uuccauguaguugagcaguuuu

SEQ ID NO: 30461 - RNA, 22 nt, Homo sapiens
uucccaguggaacauguaguca

SEQ ID NO: 30462 - RNA, 22 nt, Homo sapiens
uucccaguuggggaaagcgacc

SEQ ID NO: 30463 - RNA, 22 nt, Homo sapiens
uucccgggguggaaugcaguga

SEQ ID NO: 30464 - RNA, 22 nt, Homo sapiens
uucccugaguaucuuaccaugg

SEQ ID NO: 30465 - RNA, 22 nt, Homo sapiens
uucccugugguauagaagccgu

SEQ ID NO: 30466 - RNA, 22 nt, Homo sapiens
uucccugugugcagaugggugu

SEQ ID NO: 30467 - RNA, 22 nt, Homo sapiens
uucccuuucugccuugaaucuu

SEQ ID NO: 30468 - RNA, 22 nt, Homo sapiens
uucccuuugaaacuaaacuugc

SEQ ID NO: 30469 - RNA, 22 nt, Homo sapiens
uucccuuugaauuggaaaggug

SEQ ID NO: 30470 - RNA, 22 nt, Homo sapiens
uuccuacugcccauuaaaaugg

SEQ ID NO: 30471 - RNA, 22 nt, Homo sapiens
uuccuacugugcaaaguugcaa

SEQ ID NO: 30472 - RNA, 22 nt, Homo sapiens
uuccugaggccuccccagaagc

SEQ ID NO: 30473 - RNA, 22 nt, Homo sapiens
uucgucaugagacagaugcuga

SEQ ID NO: 30474 - RNA, 22 nt, Homo sapiens
uucuacaggcuguucaagaagc

SEQ ID NO: 30475 - RNA, 21 nt, Homo sapiens
uucuacuccggcguuguuuuu

SEQ ID NO: 30476 - RNA, 22 nt, Homo sapiens
uucuagagagaagacuuaagcu

SEQ ID NO: 30477 - RNA, 22 nt, Homo sapiens
uucucaauggcaacuuguugcu

SEQ ID NO: 30478 - RNA, 22 nt, Homo sapiens
uucucagugcuaucuuuuaugc

SEQ ID NO: 30479 - RNA, 22 nt, Homo sapiens
uucucaguuccuacuuugguga

SEQ ID NO: 30480 - RNA, 22 nt, Homo sapiens
ugaguguccaaguaaggugaaa

SEQ ID NO: 30481 - RNA, 22 nt, Homo sapiens
ugagugugacuuagcagaagga

SEQ ID NO: 30482 - RNA, 22 nt, Homo sapiens
ugaguuaggagaguguggcucu

SEQ ID NO: 30483 - RNA, 22 nt, Homo sapiens
ugaguuagguaauaauaaauau

SEQ ID NO: 30484 - RNA, 22 nt, Homo sapiens
ugaguuauuaguagaggcuaug

SEQ ID NO: 30485 - RNA, 22 nt, Homo sapiens
ugaguucaauguuaaugaagca

SEQ ID NO: 30486 - RNA, 22 nt, Homo sapiens
ugaguuccuuucccaguccagu

SEQ ID NO: 30487 - RNA, 22 nt, Homo sapiens
ugaguucuuuuacauuuugaau

SEQ ID NO: 30488 - RNA, 22 nt, Homo sapiens
uggacaagugcccuccaccuca

SEQ ID NO: 30489 - RNA, 22 nt, Homo sapiens
uggacagacaagguuauagauc

SEQ ID NO: 30490 - RNA, 22 nt, Homo sapiens
uggacauguacauauguguaug

SEQ ID NO: 30491 - RNA, 21 nt, Homo sapiens
uggaccccuuccuugcaccau

SEQ ID NO: 30492 - RNA, 21 nt, Homo sapiens
uggaccccuuucuuacaccgu

SEQ ID NO: 30493 - RNA, 22 nt, Homo sapiens
uggacuagagggugggcgaggu

SEQ ID NO: 30494 - RNA, 22 nt, Homo sapiens
uggacuguaauagagaacagaa

SEQ ID NO: 30495 - RNA, 22 nt, Homo sapiens
uggagaacugaugucuccaaga

SEQ ID NO: 30496 - RNA, 22 nt, Homo sapiens
uggagagcaaagaauuuguuag

SEQ ID NO: 30497 - RNA, 22 nt, Homo sapiens
uggagagugagggccuccuuaa

SEQ ID NO: 30498 - RNA, 22 nt, Homo sapiens
uggagauguuuaaaauccacug

SEQ ID NO: 30499 - RNA, 23 nt, Homo sapiens
uggaggacaagcauggauaguga

SEQ ID NO: 30500 - RNA, 22 nt, Homo sapiens
uggaggacugcagaacugaggc

SEQ ID NO: 30501 - RNA, 22 nt, Homo sapiens
uggagguagggccuaggaaucu

SEQ ID NO: 30502 - RNA, 19 nt, Homo sapiens
uggagucaucaugcugcua

SEQ ID NO: 30503 - RNA, 22 nt, Homo sapiens
uggagucuugcucuguugccca

SEQ ID NO: 30504 - RNA, 20 nt, Homo sapiens
uggagugaagguucuggacc

SEQ ID NO: 30505 - RNA, 22 nt, Homo sapiens
uggagugagaacuucaaugaug

SEQ ID NO: 30506 - RNA, 22 nt, Homo sapiens
uggagugcgugucugaguuuuu

SEQ ID NO: 30507 - RNA, 20 nt, Homo sapiens
uggagugcuguguugagaag

SEQ ID NO: 30508 - RNA, 22 nt, Homo sapiens
uggaguguuggggcaggaucuc

SEQ ID NO: 30509 - RNA, 20 nt, Homo sapiens
uggaguuguggcaguuugga

SEQ ID NO: 30510 - RNA, 22 nt, Homo sapiens
uggauaguuuacugaagagugg

SEQ ID NO: 30511 - RNA, 18 nt, Homo sapiens
uggauuggaaaaguuccu

SEQ ID NO: 30512 - RNA, 20 nt, Homo sapiens
uggauugugaugggauuugc

SEQ ID NO: 30513 - RNA, 22 nt, Homo sapiens
uggcaaaaaaacgcaauuacgu

SEQ ID NO: 30514 - RNA, 22 nt, Homo sapiens
uggcaaaucagaggcauggaca

SEQ ID NO: 30515 - RNA, 22 nt, Homo sapiens
uggcaagaacgaaauguagggu

SEQ ID NO: 30516 - RNA, 22 nt, Homo sapiens
uggcaagaacugcaauugcuuu

SEQ ID NO: 30517 - RNA, 22 nt, Homo sapiens
uggcaagagauaugugucuaua

SEQ ID NO: 30518 - RNA, 20 nt, Homo sapiens
uggcaagauggcagaauaga

SEQ ID NO: 30519 - RNA, 23 nt, Homo sapiens
uggcaagauuuguauugccugga

SEQ ID NO: 30520 - RNA, 22 nt, Homo sapiens
uggcaauaaaaugcaguuacuu

SEQ ID NO: 30521 - RNA, 22 nt, Homo sapiens
uggcaauauccacaauuacuuu

SEQ ID NO: 30522 - RNA, 22 nt, Homo sapiens
uggcagaugagccgcgcuccaa

SEQ ID NO: 30523 - RNA, 22 nt, Homo sapiens
uggcaguuuacagcuuuaggag

SEQ ID NO: 30524 - RNA, 22 nt, Homo sapiens
uggcaguuuuugccuucaauac

SEQ ID NO: 30525 - RNA, 22 nt, Homo sapiens
uggcauauaauauagaagacua

SEQ ID NO: 30526 - RNA, 20 nt, Homo sapiens
uggcaugaaauuuuccaagc

SEQ ID NO: 30527 - RNA, 22 nt, Homo sapiens
uggcaugauauauauucguuug

SEQ ID NO: 30528 - RNA, 22 nt, Homo sapiens
uggcaugauccuagauucaaca

SEQ ID NO: 30529 - RNA, 22 nt, Homo sapiens
uggcaugucagguuucuggguu

SEQ ID NO: 30530 - RNA, 23 nt, Homo sapiens
uggcauuuuaguuagcuucagug

SEQ ID NO: 30531 - RNA, 23 nt, Homo sapiens
uggccagaaacuucuuuucaucc

SEQ ID NO: 30532 - RNA, 22 nt, Homo sapiens
uggcccccucccaaaucucaua

SEQ ID NO: 30533 - RNA, 22 nt, Homo sapiens
uggcggagacauggacuucaga

SEQ ID NO: 30534 - RNA, 20 nt, Homo sapiens
uggcucuuugcugcuaaagu

SEQ ID NO: 30535 - RNA, 22 nt, Homo sapiens
uggcuguguccucucccaaauc

SEQ ID NO: 30536 - RNA, 22 nt, Homo sapiens
uggcuguuuauuucaccuggau

SEQ ID NO: 30537 - RNA, 22 nt, Homo sapiens
uggcuguuuauuucaccugggc

SEQ ID NO: 30538 - RNA, 22 nt, Homo sapiens
uggcuuuguaagguuucauuuu

SEQ ID NO: 30539 - RNA, 22 nt, Homo sapiens
uggcuuuucauccugggacauu

SEQ ID NO: 30540 - RNA, 22 nt, Homo sapiens
uggcuuuuccaggcauuacgau

SEQ ID NO: 30541 - RNA, 22 nt, Homo sapiens
uggcuuuuccuugaaucugccu

SEQ ID NO: 30542 - RNA, 22 nt, Homo sapiens
ugggaacaugaagguuaaagag

SEQ ID NO: 30543 - RNA, 22 nt, Homo sapiens
ugggaacugaggugaaaagaca

SEQ ID NO: 30544 - RNA, 22 nt, Homo sapiens
ugggaagauucuguguuuuucc

SEQ ID NO: 30545 - RNA, 22 nt, Homo sapiens
ugggaagcugcugaacuacagu

SEQ ID NO: 30546 - RNA, 22 nt, Homo sapiens
ugggaaugaaauuacauagcuu

SEQ ID NO: 30547 - RNA, 19 nt, Homo sapiens
ugggaauguaaauuaguuc

SEQ ID NO: 30548 - RNA, 22 nt, Homo sapiens
ugggaucagcugggcucucugu

SEQ ID NO: 30549 - RNA, 22 nt, Homo sapiens
ugggaucgucaagugaggcucg

SEQ ID NO: 30550 - RNA, 22 nt, Homo sapiens
ugggaugaaaauagcuucuucc

SEQ ID NO: 30551 - RNA, 22 nt, Homo sapiens
ugggcaagagagcaugacccug

SEQ ID NO: 30552 - RNA, 22 nt, Homo sapiens
ugggcauggaguggccuuaugu

SEQ ID NO: 30553 - RNA, 22 nt, Homo sapiens
ugggcggagacgugcagccgcc

SEQ ID NO: 30554 - RNA, 22 nt, Homo sapiens
ugggcuagaugcuuugggguca

SEQ ID NO: 30555 - RNA, 22 nt, Homo sapiens
ugggguaggcuguauacucugu

SEQ ID NO: 30556 - RNA, 22 nt, Homo sapiens
uggggucguaggugcccgccag

SEQ ID NO: 30557 - RNA, 22 nt, Homo sapiens
uggguaguguaaagcacuccag

SEQ ID NO: 30558 - RNA, 22 nt, Homo sapiens
ugguaagaaaaccauuauuagc

SEQ ID NO: 30559 - RNA, 22 nt, Homo sapiens
ugguaagaucagaacuggaguc

SEQ ID NO: 30560 - RNA, 22 nt, Homo sapiens
ugguaagaucugugagccaggc

SEQ ID NO: 30561 - RNA, 22 nt, Homo sapiens
ugguaaguuuaacaugcauccc

SEQ ID NO: 30562 - RNA, 22 nt, Homo sapiens
ugguauuuaauauaugagaguu

SEQ ID NO: 30563 - RNA, 22 nt, Homo sapiens
uggucagaaaauuacuugauau

SEQ ID NO: 30564 - RNA, 22 nt, Homo sapiens
uggucagaugcugaguggaucu

SEQ ID NO: 30565 - RNA, 22 nt, Homo sapiens
uggucauggggcagcugacacu

SEQ ID NO: 30566 - RNA, 22 nt, Homo sapiens
ugguccaguucugugauauugc

SEQ ID NO: 30567 - RNA, 22 nt, Homo sapiens
uggucccaugaacuuuagguca

SEQ ID NO: 30568 - RNA, 22 nt, Homo sapiens
uggucguggagucccuggcuuc

SEQ ID NO: 30569 - RNA, 22 nt, Homo sapiens
uggucuccuuuguacccugggc

SEQ ID NO: 30570 - RNA, 22 nt, Homo sapiens
uggucuggagagucccgcccag

SEQ ID NO: 30571 - RNA, 22 nt, Homo sapiens
uggugagaaaugagaugcuuuu

SEQ ID NO: 30572 - RNA, 22 nt, Homo sapiens
ugguggcuuuucguagguucac

SEQ ID NO: 30573 - RNA, 22 nt, Homo sapiens
ugguguccugucucugcgcuug

SEQ ID NO: 30574 - RNA, 20 nt, Homo sapiens
ugguguuugaacagugaaug

SEQ ID NO: 30575 - RNA, 21 nt, Homo sapiens
ugguucaguucguuacgugug

SEQ ID NO: 30576 - RNA, 22 nt, Homo sapiens
ugguuccauauuaauuuuagga

SEQ ID NO: 30577 - RNA, 21 nt, Homo sapiens
ugguugauccuccuagugccu

SEQ ID NO: 30578 - RNA, 22 nt, Homo sapiens
ugaguagucuagaguggaaugu

SEQ ID NO: 30579 - RNA, 22 nt, Homo sapiens
ugaguagugccacaauaagcau

SEQ ID NO: 30580 - RNA, 22 nt, Homo sapiens
ugaguagugcugcaauaaacau

SEQ ID NO: 30581 - RNA, 22 nt, Homo sapiens
ugaguauagaucaguucaagug

SEQ ID NO: 30582 - RNA, 22 nt, Homo sapiens
ugaguaugaguucaggaaaggc

SEQ ID NO: 30583 - RNA, 22 nt, Homo sapiens
ugagucauuuccuuaugcuacu

SEQ ID NO: 30584 - RNA, 22 nt, Homo sapiens
ugagucuguuccaaagaaauaa

SEQ ID NO: 30585 - RNA, 22 nt, Homo sapiens
ugagugaaggggcucuguugug

SEQ ID NO: 30586 - RNA, 22 nt, Homo sapiens
ugagugaggcugggcagucccu

SEQ ID NO: 30587 - RNA, 22 nt, Homo sapiens
ugaguguguaugugcauacaca

SEQ ID NO: 30588 - RNA, 17 nt, Homo sapiens
ugaguuaaucuuugugc

SEQ ID NO: 30589 - RNA, 22 nt, Homo sapiens
agcaucauguuuucgagguuca

SEQ ID NO: 30590 - RNA, 22 nt, Homo sapiens
agccaguauuuuauugaggauu

SEQ ID NO: 30591 - RNA, 22 nt, Homo sapiens
agcccauguggcugaggcuucu

SEQ ID NO: 30592 - RNA, 20 nt, Homo sapiens
agccccauguaaaccacaug

SEQ ID NO: 30593 - RNA, 22 nt, Homo sapiens
agcccugugauuacuuuuauaa

SEQ ID NO: 30594 - RNA, 22 nt, Homo sapiens
agccuucauucugacaguagga

SEQ ID NO: 30595 - RNA, 23 nt, Homo sapiens
agcuagagaggcuggggauacag

SEQ ID NO: 30596 - RNA, 20 nt, Homo sapiens
agcuaguauuuccaugguua

SEQ ID NO: 30597 - RNA, 22 nt, Homo sapiens
agcuauauugaggaugccauuc

SEQ ID NO: 30598 - RNA, 22 nt, Homo sapiens
agcucauugcaaccuccgccuc

SEQ ID NO: 30599 - RNA, 22 nt, Homo sapiens
agcuccaugauaguaugucugu

SEQ ID NO: 30600 - RNA, 22 nt, Homo sapiens
agcugcacgugguaaauguaaa

SEQ ID NO: 30601 - RNA, 20 nt, Homo sapiens
agcugcagauauaaauccgc

SEQ ID NO: 30602 - RNA, 22 nt, Homo sapiens
agcuggaauuuaagguagauag

SEQ ID NO: 30603 - RNA, 22 nt, Homo sapiens
agcuggauguauguuaagugaa

SEQ ID NO: 30604 - RNA, 22 nt, Homo sapiens
agcuggcuguagcugcaagucu

SEQ ID NO: 30605 - RNA, 22 nt, Homo sapiens
agcuggcuguggagaaaccccu

SEQ ID NO: 30606 - RNA, 23 nt, Homo sapiens
agcugguacuagaggcuugcgcc

SEQ ID NO: 30607 - RNA, 22 nt, Homo sapiens
agcugguauuuugucgaggacu

SEQ ID NO: 30608 - RNA, 22 nt, Homo sapiens
agcugguccugugacuugcuuc

SEQ ID NO: 30609 - RNA, 22 nt, Homo sapiens
agcuggucugauacuuaccucc

SEQ ID NO: 30610 - RNA, 20 nt, Homo sapiens
agcugguuuuaugaaucuuu

SEQ ID NO: 30611 - RNA, 22 nt, Homo sapiens
agcuguuguuaauuaacucauu

SEQ ID NO: 30612 - RNA, 22 nt, Homo sapiens
agcuguuguuuuaagauacuaa

SEQ ID NO: 30613 - RNA, 22 nt, Homo sapiens
agcuuguggugaauacugcuag

SEQ ID NO: 30614 - RNA, 22 nt, Homo sapiens
agcuuguuuucccauaacuaga

SEQ ID NO: 30615 - RNA, 22 nt, Homo sapiens
agcuuguuuuccugcaacuaga

SEQ ID NO: 30616 - RNA, 22 nt, Homo sapiens
agcuuuuugggaggccuuagga

SEQ ID NO: 30617 - RNA, 22 nt, Homo sapiens
aggaacuguaacuaugucucug

SEQ ID NO: 30618 - RNA, 22 nt, Homo sapiens
aggaaucuaagguaucagguua

SEQ ID NO: 30619 - RNA, 22 nt, Homo sapiens
aggaauuuaauguaugauaaua

SEQ ID NO: 30620 - RNA, 22 nt, Homo sapiens
aggacacugagcaugggagguu

SEQ ID NO: 30621 - RNA, 22 nt, Homo sapiens
aggacacugauguaugcugugg

SEQ ID NO: 30622 - RNA, 22 nt, Homo sapiens
aggaccccucaucagcaccagu

SEQ ID NO: 30623 - RNA, 19 nt, Homo sapiens
aggacuaaagacuagaagu

SEQ ID NO: 30624 - RNA, 22 nt, Homo sapiens
aggagaucagccucccugcaac

SEQ ID NO: 30625 - RNA, 21 nt, Homo sapiens
aggagauguuuguccuuuuag

SEQ ID NO: 30626 - RNA, 20 nt, Homo sapiens
aggagcauuuacauuggcuc

SEQ ID NO: 30627 - RNA, 23 nt, Homo sapiens
aggagcuuagaaguugccauugc

SEQ ID NO: 30628 - RNA, 22 nt, Homo sapiens
aggagcuuuggggaaaacagau

SEQ ID NO: 30629 - RNA, 22 nt, Homo sapiens
aggagguagaacauugccauuu

SEQ ID NO: 30630 - RNA, 21 nt, Homo sapiens
aggauaguagauuaaauauuu

SEQ ID NO: 30631 - RNA, 22 nt, Homo sapiens
aggcaagaaugcuuguuucacc

SEQ ID NO: 30632 - RNA, 22 nt, Homo sapiens
aggcaagagugacuacgugaaa

SEQ ID NO: 30633 - RNA, 22 nt, Homo sapiens
aggcaagcaucuugcucccuuc

SEQ ID NO: 30634 - RNA, 22 nt, Homo sapiens
aggcaugaaauacaugcauuga

SEQ ID NO: 30635 - RNA, 22 nt, Homo sapiens
aggcaugauuguauuuugcucu

SEQ ID NO: 30636 - RNA, 22 nt, Homo sapiens
aggcauguggcucuguucugac

SEQ ID NO: 30637 - RNA, 22 nt, Homo sapiens
aggcauguugcuucgggcuuug

SEQ ID NO: 30638 - RNA, 23 nt, Homo sapiens
aggcauuguacaguaauggaaaa

SEQ ID NO: 30639 - RNA, 22 nt, Homo sapiens
aggcuagaaucuuccaucuugg

SEQ ID NO: 30640 - RNA, 22 nt, Homo sapiens
aggcugguauuuacaaaagcuc

SEQ ID NO: 30641 - RNA, 21 nt, Homo sapiens
aggcuguuguuuugggaugga

SEQ ID NO: 30642 - RNA, 22 nt, Homo sapiens
aggcuuguuuuacuaacuggua

SEQ ID NO: 30643 - RNA, 22 nt, Homo sapiens
agggcacuguagguccugccuc

SEQ ID NO: 30644 - RNA, 22 nt, Homo sapiens
agggcuuaucuguguagaguuc

SEQ ID NO: 30645 - RNA, 22 nt, Homo sapiens
agggcuuguuuaacuaucauua

SEQ ID NO: 30646 - RNA, 22 nt, Homo sapiens
aggguuuuuauuuauguggcau

SEQ ID NO: 30647 - RNA, 22 nt, Homo sapiens
agguaaacauggggacugcuac

SEQ ID NO: 30648 - RNA, 22 nt, Homo sapiens
agguagaguguuuuguucuucu

SEQ ID NO: 30649 - RNA, 22 nt, Homo sapiens
aggugaaugcucacauucuaau

SEQ ID NO: 30650 - RNA, 22 nt, Homo sapiens
aggugaauggauaaacuguggg

SEQ ID NO: 30651 - RNA, 22 nt, Homo sapiens
aggugcacucagaaaacagaua

SEQ ID NO: 30652 - RNA, 18 nt, Homo sapiens
acagugucauggcucaau

SEQ ID NO: 30653 - RNA, 22 nt, Homo sapiens
acauagaguagcuaccuguaga

SEQ ID NO: 30654 - RNA, 22 nt, Homo sapiens
acauagaguaguggugaggaug

SEQ ID NO: 30655 - RNA, 22 nt, Homo sapiens
acauaugaguacaugugccaug

SEQ ID NO: 30656 - RNA, 17 nt, Homo sapiens
acaugagacuggauucu

SEQ ID NO: 30657 - RNA, 22 nt, Homo sapiens
acaugcaucauuaggugguuua

SEQ ID NO: 30658 - RNA, 18 nt, Homo sapiens
acauucagcuugaagaua

SEQ ID NO: 30659 - RNA, 22 nt, Homo sapiens
acauugcagauguguuuaaugu

SEQ ID NO: 30660 - RNA, 22 nt, Homo sapiens
acauugcauauggcacccucuu

SEQ ID NO: 30661 - RNA, 22 nt, Homo sapiens
accaccacucccgcauucuaaa

SEQ ID NO: 30662 - RNA, 19 nt, Homo sapiens
accagauugcauucuugga

SEQ ID NO: 30663 - RNA, 17 nt, Homo sapiens
accagugcaugugcuuu

SEQ ID NO: 30664 - RNA, 22 nt, Homo sapiens
accaugcaguccaauaugcaca

SEQ ID NO: 30665 - RNA, 22 nt, Homo sapiens
accauugcacuccagccugggc

SEQ ID NO: 30666 - RNA, 22 nt, Homo sapiens
acccaguagccagauguagcug

SEQ ID NO: 30667 - RNA, 21 nt, Homo sapiens
acccccacaccuccuuaguuc

SEQ ID NO: 30668 - RNA, 22 nt, Homo sapiens
acccgggaggcaggagucauag

SEQ ID NO: 30669 - RNA, 22 nt, Homo sapiens
acccuauagaggcaauaggcac

SEQ ID NO: 30670 - RNA, 22 nt, Homo sapiens
acccucaagggacugacagaau

SEQ ID NO: 30671 - RNA, 22 nt, Homo sapiens
acccugaagccaugaguggaac

SEQ ID NO: 30672 - RNA, 22 nt, Homo sapiens
acccuguaggacuauucuaauc

SEQ ID NO: 30673 - RNA, 22 nt, Homo sapiens
acccugucaaaacggaccaauc

SEQ ID NO: 30674 - RNA, 22 nt, Homo sapiens
acccugucaaaauagaccaauc

SEQ ID NO: 30675 - RNA, 22 nt, Homo sapiens
acccugugagagaguuaauauu

SEQ ID NO: 30676 - RNA, 22 nt, Homo sapiens
acccuuaagcacuaguucagcu

SEQ ID NO: 30677 - RNA, 22 nt, Homo sapiens
acccuuuagguuggaugaggau

SEQ ID NO: 30678 - RNA, 22 nt, Homo sapiens
accugagauuacaggugcuggc

SEQ ID NO: 30679 - RNA, 22 nt, Homo sapiens
accuguagcagacuuaauauuu

SEQ ID NO: 30680 - RNA, 22 nt, Homo sapiens
accuuguagcaaaccuaacaua

SEQ ID NO: 30681 - RNA, 22 nt, Homo sapiens
acgaagacuauucaaaagguua

SEQ ID NO: 30682 - RNA, 22 nt, Homo sapiens
acgugcaugcacacacaugcgc

SEQ ID NO: 30683 - RNA, 22 nt, Homo sapiens
acuacauaugacaucuucuuua

SEQ ID NO: 30684 - RNA, 22 nt, Homo sapiens
acuacugucagacugccacuga

SEQ ID NO: 30685 - RNA, 22 nt, Homo sapiens
acuagaugauuauguuccauug

SEQ ID NO: 30686 - RNA, 22 nt, Homo sapiens
acuaugcuuuucuuagaauuaa

SEQ ID NO: 30687 - RNA, 22 nt, Homo sapiens
acucagagauuagcacauguuu

SEQ ID NO: 30688 - RNA, 22 nt, Homo sapiens
acuccauuucauuuuagcucuu

SEQ ID NO: 30689 - RNA, 22 nt, Homo sapiens
acugacaugaucaggcauguuc

SEQ ID NO: 30690 - RNA, 21 nt, Homo sapiens
acugagagaucuggggcacau

SEQ ID NO: 30691 - RNA, 22 nt, Homo sapiens
acugagucauugaggcccucuc

SEQ ID NO: 30692 - RNA, 22 nt, Homo sapiens
acugcacuccaaccuguugggc

SEQ ID NO: 30693 - RNA, 22 nt, Homo sapiens
acugcacuccacccuuggcagc

SEQ ID NO: 30694 - RNA, 22 nt, Homo sapiens
acugcacuccaccuugggcaac

SEQ ID NO: 30695 - RNA, 22 nt, Homo sapiens
acugcacuccagacucugucuc

SEQ ID NO: 30696 - RNA, 22 nt, Homo sapiens
acugcacuccagcccgggugac

SEQ ID NO: 30697 - RNA, 22 nt, Homo sapiens
acugcacuccagccucaugaca

SEQ ID NO: 30698 - RNA, 22 nt, Homo sapiens
acugcacuccagccucgcaaca

SEQ ID NO: 30699 - RNA, 22 nt, Homo sapiens
acugcacuccagccucggugac

SEQ ID NO: 30700 - RNA, 22 nt, Homo sapiens
acugcacuccagccuggaccac

SEQ ID NO: 30701 - RNA, 20 nt, Homo sapiens
acugcacuccagccuuccag

SEQ ID NO: 30702 - RNA, 22 nt, Homo sapiens
acugcacuccagccuuggcaac

SEQ ID NO: 30703 - RNA, 22 nt, Homo sapiens
acugcacuccagccuuggccac

SEQ ID NO: 30704 - RNA, 20 nt, Homo sapiens
acugcacuccaggcugccca

SEQ ID NO: 30705 - RNA, 22 nt, Homo sapiens
acugcacuccggccuggcaaca

SEQ ID NO: 30706 - RNA, 22 nt, Homo sapiens
acugcacucuagcauggguaau

SEQ ID NO: 30707 - RNA, 22 nt, Homo sapiens
acugcacucuagccuuggcaac

SEQ ID NO: 30708 - RNA, 22 nt, Homo sapiens
acugcacugucaaccuccuggg

SEQ ID NO: 30709 - RNA, 19 nt, Homo sapiens
augaacucauucuuuuuau

SEQ ID NO: 30710 - RNA, 18 nt, Homo sapiens
augaagucaucacuuuua

SEQ ID NO: 30711 - RNA, 22 nt, Homo sapiens
augaauacugcugcaaugaaca

SEQ ID NO: 30712 - RNA, 22 nt, Homo sapiens
augaauccauuccugccacaga

SEQ ID NO: 30713 - RNA, 23 nt, Homo sapiens
augaauguaaagaaugugggaag

SEQ ID NO: 30714 - RNA, 20 nt, Homo sapiens
augaauguccuugauggcau

SEQ ID NO: 30715 - RNA, 22 nt, Homo sapiens
augacagagauaugugaauuuu

SEQ ID NO: 30716 - RNA, 22 nt, Homo sapiens
augacauguauuuccaggauuu

SEQ ID NO: 30717 - RNA, 22 nt, Homo sapiens
augacccugaccuaagccaauc

SEQ ID NO: 30718 - RNA, 18 nt, Homo sapiens
augaccugcggguuauau

SEQ ID NO: 30719 - RNA, 22 nt, Homo sapiens
augaccuuggggaaccaugucu

SEQ ID NO: 30720 - RNA, 22 nt, Homo sapiens
augacuauugcacuuuccuggu

SEQ ID NO: 30721 - RNA, 22 nt, Homo sapiens
augacuggaacggcacuuuaca

SEQ ID NO: 30722 - RNA, 22 nt, Homo sapiens
augacuuuucugaaaaccacca

SEQ ID NO: 30723 - RNA, 19 nt, Homo sapiens
augagaacagacuccauuu

SEQ ID NO: 30724 - RNA, 22 nt, Homo sapiens
augagaaucauuucagcuugua

SEQ ID NO: 30725 - RNA, 22 nt, Homo sapiens
augagauacuacaaaugaguuu

SEQ ID NO: 30726 - RNA, 22 nt, Homo sapiens
augagauauuuuauaagaucau

SEQ ID NO: 30727 - RNA, 22 nt, Homo sapiens
augagaugaggaauggcccucc

SEQ ID NO: 30728 - RNA, 19 nt, Homo sapiens
augagcaauaguuuuaauc

SEQ ID NO: 30729 - RNA, 22 nt, Homo sapiens
augagcugauuuccuuaccaua

SEQ ID NO: 30730 - RNA, 22 nt, Homo sapiens
augaggaagucaggcccagggg

SEQ ID NO: 30731 - RNA, 22 nt, Homo sapiens
augaggcaggaaaggcguaucu

SEQ ID NO: 30732 - RNA, 22 nt, Homo sapiens
augagggagggcaccugaccuu

SEQ ID NO: 30733 - RNA, 22 nt, Homo sapiens
augagggcggacgcccuggaga

SEQ ID NO: 30734 - RNA, 22 nt, Homo sapiens
augaggugaggucaguaaggua

SEQ ID NO: 30735 - RNA, 22 nt, Homo sapiens
augaguauguucuguauuuuca

SEQ ID NO: 30736 - RNA, 22 nt, Homo sapiens
augagucacuuauuauuggggu

SEQ ID NO: 30737 - RNA, 22 nt, Homo sapiens
augagugugaccugccaagaga

SEQ ID NO: 30738 - RNA, 22 nt, Homo sapiens
augauacuguucuaagauuuuu

SEQ ID NO: 30739 - RNA, 22 nt, Homo sapiens
augauauggguugucaguugua

SEQ ID NO: 30740 - RNA, 22 nt, Homo sapiens
augauauuauucuagcccagag

SEQ ID NO: 30741 - RNA, 22 nt, Homo sapiens
augaucacaccacugcacucca

SEQ ID NO: 30742 - RNA, 22 nt, Homo sapiens
augaucauggaaguuuuccugu

SEQ ID NO: 30743 - RNA, 22 nt, Homo sapiens
augaucuagaguaggaaacaga

SEQ ID NO: 30744 - RNA, 22 nt, Homo sapiens
augaugcugcaguuguugccaa

SEQ ID NO: 30745 - RNA, 22 nt, Homo sapiens
augauggagguagauuguccau

SEQ ID NO: 30746 - RNA, 20 nt, Homo sapiens
augcaaacccugcuuugugg

SEQ ID NO: 30747 - RNA, 22 nt, Homo sapiens
augcaaggaugguuagauauau

SEQ ID NO: 30748 - RNA, 22 nt, Homo sapiens
augcacuguuuucuugaugaga

SEQ ID NO: 30749 - RNA, 22 nt, Homo sapiens
augcagagaaaucuaaaauaug

SEQ ID NO: 30750 - RNA, 22 nt, Homo sapiens
augcagauauuuuugugguugc

SEQ ID NO: 30751 - RNA, 22 nt, Homo sapiens
augcagaucacauuuuucuguc

SEQ ID NO: 30752 - RNA, 22 nt, Homo sapiens
augcauaugucuuuauaguggc

SEQ ID NO: 30753 - RNA, 22 nt, Homo sapiens
auagugcuauggcagaccuuga

SEQ ID NO: 30754 - RNA, 22 nt, Homo sapiens
auagugcugcaacaaauauacg

SEQ ID NO: 30755 - RNA, 22 nt, Homo sapiens
auagugcugcaauaaacauacg

SEQ ID NO: 30756 - RNA, 22 nt, Homo sapiens
auagugcugcacuaaacauaca

SEQ ID NO: 30757 - RNA, 22 nt, Homo sapiens
auagugcuuuugaaucuuguug

SEQ ID NO: 30758 - RNA, 22 nt, Homo sapiens
auauagcaaugaaagagaugaa

SEQ ID NO: 30759 - RNA, 22 nt, Homo sapiens
auauagcucuggcuggaugacu

SEQ ID NO: 30760 - RNA, 22 nt, Homo sapiens
auaucaacaucgugucauuagu

SEQ ID NO: 30761 - RNA, 22 nt, Homo sapiens
auaucacucccaauaucgcagg

SEQ ID NO: 30762 - RNA, 22 nt, Homo sapiens
auaucccagugaugauugauag

SEQ ID NO: 30763 - RNA, 22 nt, Homo sapiens
auaugacugccagggcccaguc

SEQ ID NO: 30764 - RNA, 22 nt, Homo sapiens
auaugacuuuccucuacuuccu

SEQ ID NO: 30765 - RNA, 22 nt, Homo sapiens
auaugcacaguggaguacuauu

SEQ ID NO: 30766 - RNA, 22 nt, Homo sapiens
auaugcacgugcauacacacuu

SEQ ID NO: 30767 - RNA, 22 nt, Homo sapiens
auaugcauguacccacacaggc

SEQ ID NO: 30768 - RNA, 22 nt, Homo sapiens
auauggcauucagaacuguaua

SEQ ID NO: 30769 - RNA, 22 nt, Homo sapiens
auaugguacuuaugcucaaacu

SEQ ID NO: 30770 - RNA, 21 nt, Homo sapiens
auaugugcuguggaagucagc

SEQ ID NO: 30771 - RNA, 22 nt, Homo sapiens
auauguucucauucauaugugg

SEQ ID NO: 30772 - RNA, 22 nt, Homo sapiens
auauuacagagaggaccuggga

SEQ ID NO: 30773 - RNA, 22 nt, Homo sapiens
auauuagguuggugccaaagua

SEQ ID NO: 30774 - RNA, 22 nt, Homo sapiens
auauucaagugaggauggcuaa

SEQ ID NO: 30775 - RNA, 18 nt, Homo sapiens
auauugcauuggauggau

SEQ ID NO: 30776 - RNA, 18 nt, Homo sapiens
auauugccuucagacuag

SEQ ID NO: 30777 - RNA, 22 nt, Homo sapiens
auauugcuccuaauaccacggu

SEQ ID NO: 30778 - RNA, 22 nt, Homo sapiens
auauugcuuagugaugaagucu

SEQ ID NO: 30779 - RNA, 22 nt, Homo sapiens
auauuggucuucaagaccugug

SEQ ID NO: 30780 - RNA, 19 nt, Homo sapiens
aucaaacugcucuuugagg

SEQ ID NO: 30781 - RNA, 22 nt, Homo sapiens
aucaaagugaauuaaugagaau

SEQ ID NO: 30782 - RNA, 22 nt, Homo sapiens
aucaagcuacacccuuuggaaa

SEQ ID NO: 30783 - RNA, 22 nt, Homo sapiens
aucaaguaaucugaguaagagu

SEQ ID NO: 30784 - RNA, 22 nt, Homo sapiens
aucaaguacuguacugaaagug

SEQ ID NO: 30785 - RNA, 22 nt, Homo sapiens
aucacacuguuauuuuaguuaa

SEQ ID NO: 30786 - RNA, 22 nt, Homo sapiens
aucacagauauggguuuaaauc

SEQ ID NO: 30787 - RNA, 22 nt, Homo sapiens
aucacagcuacuccucugucuu

SEQ ID NO: 30788 - RNA, 22 nt, Homo sapiens
aucaccagaugcuucaagcaga

SEQ ID NO: 30789 - RNA, 22 nt, Homo sapiens
aucaccuggaguagcccguccc

SEQ ID NO: 30790 - RNA, 22 nt, Homo sapiens
aucacugggagcagccauuaau

SEQ ID NO: 30791 - RNA, 22 nt, Homo sapiens
aucacugggauggaacugcuga

SEQ ID NO: 30792 - RNA, 22 nt, Homo sapiens
aucacuggucaugagagaagua

SEQ ID NO: 30793 - RNA, 22 nt, Homo sapiens
aucacuuucuauuucugugcca

SEQ ID NO: 30794 - RNA, 22 nt, Homo sapiens
aucacuuugcucuccagugugg

SEQ ID NO: 30795 - RNA, 20 nt, Homo sapiens
aucagagccggugaaagggc

SEQ ID NO: 30796 - RNA, 22 nt, Homo sapiens
aucagauggcuaaaacagaaga

SEQ ID NO: 30797 - RNA, 19 nt, Homo sapiens
aucagcacaagugugcuuu

SEQ ID NO: 30798 - RNA, 22 nt, Homo sapiens
aucaucacaguuguguguaaug

SEQ ID NO: 30799 - RNA, 22 nt, Homo sapiens
aucauggaguauuugcaagucu

SEQ ID NO: 30800 - RNA, 22 nt, Homo sapiens
aucauguuuauguguaggauau

SEQ ID NO: 30801 - RNA, 23 nt, Homo sapiens
auccacauucuaguccuuuaugc

SEQ ID NO: 30802 - RNA, 22 nt, Homo sapiens
auccauguggauaaauguguau

SEQ ID NO: 30803 - RNA, 22 nt, Homo sapiens
aucccuagaaaaaucagcacau

SEQ ID NO: 30804 - RNA, 21 nt, Homo sapiens
auguaacugggaaugugagag

SEQ ID NO: 30805 - RNA, 22 nt, Homo sapiens
auguaagugugcucaaauguua

SEQ ID NO: 30806 - RNA, 22 nt, Homo sapiens
auguauggcagguuugggguuu

SEQ ID NO: 30807 - RNA, 22 nt, Homo sapiens
augucaaggugaagaaagauca

SEQ ID NO: 30808 - RNA, 20 nt, Homo sapiens
augucaggaagggagucagg

SEQ ID NO: 30809 - RNA, 22 nt, Homo sapiens
augucauagauaaggaagugga

SEQ ID NO: 30810 - RNA, 17 nt, Homo sapiens
augugaauguucaaaua

SEQ ID NO: 30811 - RNA, 22 nt, Homo sapiens
augugacuuuuuccugugccuu

SEQ ID NO: 30812 - RNA, 22 nt, Homo sapiens
augugcaaauuuccaaacucuu

SEQ ID NO: 30813 - RNA, 22 nt, Homo sapiens
augugcaagaucauuaaagcuc

SEQ ID NO: 30814 - RNA, 22 nt, Homo sapiens
augugcacaugcuuacauguga

SEQ ID NO: 30815 - RNA, 22 nt, Homo sapiens
augugcacauucugguaaauau

SEQ ID NO: 30816 - RNA, 22 nt, Homo sapiens
augugcagauguuacaaauugu

SEQ ID NO: 30817 - RNA, 22 nt, Homo sapiens
augugcaugcuguucugccaga

SEQ ID NO: 30818 - RNA, 22 nt, Homo sapiens
augugcuagguacuguuuagca

SEQ ID NO: 30819 - RNA, 22 nt, Homo sapiens
augugcuuauagguguauguuu

SEQ ID NO: 30820 - RNA, 22 nt, Homo sapiens
auguggaaagcagcaugauaug

SEQ ID NO: 30821 - RNA, 19 nt, Homo sapiens
augugguuagcaugacugc

SEQ ID NO: 30822 - RNA, 22 nt, Homo sapiens
auguguaaagcuuuucuuuguu

SEQ ID NO: 30823 - RNA, 22 nt, Homo sapiens
auguuauguuaaugauaaugga

SEQ ID NO: 30824 - RNA, 22 nt, Homo sapiens
auguuugguagugaauauggua

SEQ ID NO: 30825 - RNA, 22 nt, Homo sapiens
auuaaauguuggacguauacau

SEQ ID NO: 30826 - RNA, 22 nt, Homo sapiens
auuaacaucuagaguuuuggug

SEQ ID NO: 30827 - RNA, 22 nt, Homo sapiens
auuaagagcacauguucugggu

SEQ ID NO: 30828 - RNA, 22 nt, Homo sapiens
auuaaguaaugguuccaauaau

SEQ ID NO: 30829 - RNA, 22 nt, Homo sapiens
auuaagugcuugcagaagucca

SEQ ID NO: 30830 - RNA, 22 nt, Homo sapiens
auuaaguugugccugaaaacuu

SEQ ID NO: 30831 - RNA, 22 nt, Homo sapiens
auuaaucaggcaaugcuugcua

SEQ ID NO: 30832 - RNA, 22 nt, Homo sapiens
auuacaugucuauccaugaaca

SEQ ID NO: 30833 - RNA, 20 nt, Homo sapiens
auuagacuugccuuauccuu

SEQ ID NO: 30834 - RNA, 22 nt, Homo sapiens
auuauguuguauuuccuugcag

SEQ ID NO: 30835 - RNA, 22 nt, Homo sapiens
auuauuagucggccagcuguua

SEQ ID NO: 30836 - RNA, 22 nt, Homo sapiens
auuauuaguuguugaaugaagu

SEQ ID NO: 30837 - RNA, 22 nt, Homo sapiens
auucaaagugcauguucccacu

SEQ ID NO: 30838 - RNA, 22 nt, Homo sapiens
auucaagucaucucuccgcauu

SEQ ID NO: 30839 - RNA, 22 nt, Homo sapiens
auucaagugaugcagcuguuuu

SEQ ID NO: 30840 - RNA, 22 nt, Homo sapiens
auucaagugaugugauucuucu

SEQ ID NO: 30841 - RNA, 22 nt, Homo sapiens
auucacagggggagaaggguau

SEQ ID NO: 30842 - RNA, 22 nt, Homo sapiens
auucaccauggaccaggggccu

SEQ ID NO: 30843 - RNA, 22 nt, Homo sapiens
auucacugugcuuggccaaauu

SEQ ID NO: 30844 - RNA, 22 nt, Homo sapiens
auucacuguggcuuucucugau

SEQ ID NO: 30845 - RNA, 22 nt, Homo sapiens
auuccacuuacaugaaguaccu

SEQ ID NO: 30846 - RNA, 22 nt, Homo sapiens
auuccacuuccacuaguuucuc

SEQ ID NO: 30847 - RNA, 20 nt, Homo sapiens
auuccacuuguuugagguac

SEQ ID NO: 30848 - RNA, 22 nt, Homo sapiens
auuccagguggcgccauucaca

SEQ ID NO: 30849 - RNA, 22 nt, Homo sapiens
auuccauagugucuguggcaga

SEQ ID NO: 30850 - RNA, 22 nt, Homo sapiens
auuccauuuguguggaauggcu

SEQ ID NO: 30851 - RNA, 22 nt, Homo sapiens
auucccuuagcugccucagccu

SEQ ID NO: 30852 - RNA, 22 nt, Homo sapiens
auucccuuggucaacggaugca

SEQ ID NO: 30853 - RNA, 20 nt, Homo sapiens
auugaacucaguauucugaa

SEQ ID NO: 30854 - RNA, 22 nt, Homo sapiens
cugcuggucuuuaaggucuagg

SEQ ID NO: 30855 - RNA, 22 nt, Homo sapiens
cuggaaacaucuuaggaaugca

SEQ ID NO: 30856 - RNA, 22 nt, Homo sapiens
cuggaaagaaacccuuaauucu

SEQ ID NO: 30857 - RNA, 22 nt, Homo sapiens
cuggaaaguagacaaucuaaaa

SEQ ID NO: 30858 - RNA, 18 nt, Homo sapiens
cuggaaggcuacuacagu

SEQ ID NO: 30859 - RNA, 22 nt, Homo sapiens
cuggaauauuagcuggucuuaa

SEQ ID NO: 30860 - RNA, 22 nt, Homo sapiens
cuggaaucuagaaaagguaagg

SEQ ID NO: 30861 - RNA, 22 nt, Homo sapiens
cuggaaugugagccccaaaaag

SEQ ID NO: 30862 - RNA, 22 nt, Homo sapiens
cuggaauucaaaaucugaauuu

SEQ ID NO: 30863 - RNA, 22 nt, Homo sapiens
cuggagauauuggaagaaagaa

SEQ ID NO: 30864 - RNA, 22 nt, Homo sapiens
cuggaggccugaacauaaaugg

SEQ ID NO: 30865 - RNA, 18 nt, Homo sapiens
cuggaugucgaguguguu

SEQ ID NO: 30866 - RNA, 22 nt, Homo sapiens
cuggcaaauaguagagccagga

SEQ ID NO: 30867 - RNA, 22 nt, Homo sapiens
cuggcaagaggauaaaguccua

SEQ ID NO: 30868 - RNA, 22 nt, Homo sapiens
cuggccagagacauucauuaaa

SEQ ID NO: 30869 - RNA, 22 nt, Homo sapiens
cuggcucugagguguuuagggc

SEQ ID NO: 30870 - RNA, 22 nt, Homo sapiens
cugggaugauguaaauaggcua

SEQ ID NO: 30871 - RNA, 22 nt, Homo sapiens
cugguaguguuuauaaggguau

SEQ ID NO: 30872 - RNA, 21 nt, Homo sapiens
cugguccccuuuauguaugug

SEQ ID NO: 30873 - RNA, 19 nt, Homo sapiens
cugucacugaggaagacug

SEQ ID NO: 30874 - RNA, 22 nt, Homo sapiens
cugucagugggaguucaggcuu

SEQ ID NO: 30875 - RNA, 22 nt, Homo sapiens
cugucuagagggcacaugaugc

SEQ ID NO: 30876 - RNA, 22 nt, Homo sapiens
cugucucagugaauugguuuua

SEQ ID NO: 30877 - RNA, 17 nt, Homo sapiens
cugugaugaucuugucu

SEQ ID NO: 30878 - RNA, 22 nt, Homo sapiens
cugugauuauauaguuaaggua

SEQ ID NO: 30879 - RNA, 22 nt, Homo sapiens
cugugcauaucuuggacugugu

SEQ ID NO: 30880 - RNA, 22 nt, Homo sapiens
cugugcauggauuuuaagauug

SEQ ID NO: 30881 - RNA, 22 nt, Homo sapiens
cugugcauuggaugucucccug

SEQ ID NO: 30882 - RNA, 22 nt, Homo sapiens
cuguggguuuuacuguuuuacu

SEQ ID NO: 30883 - RNA, 22 nt, Homo sapiens
cugugguuacguucuuugugcu

SEQ ID NO: 30884 - RNA, 22 nt, Homo sapiens
cuguguaguacuagauugagca

SEQ ID NO: 30885 - RNA, 22 nt, Homo sapiens
cuguuagguuaaggaauggcaa

SEQ ID NO: 30886 - RNA, 22 nt, Homo sapiens
cuguuauguuugauggaugaau

SEQ ID NO: 30887 - RNA, 22 nt, Homo sapiens
cuguugguguuuaaucacugca

SEQ ID NO: 30888 - RNA, 22 nt, Homo sapiens
cuguuugaggguuugcuuucag

SEQ ID NO: 30889 - RNA, 22 nt, Homo sapiens
cuguuugauuaagugguggaaa

SEQ ID NO: 30890 - RNA, 21 nt, Homo sapiens
cuuaagccacuaaguuuugga

SEQ ID NO: 30891 - RNA, 22 nt, Homo sapiens
cuuaaguaguuguggaaugaau

SEQ ID NO: 30892 - RNA, 22 nt, Homo sapiens
auugcacuccagccugagcaaa

SEQ ID NO: 30893 - RNA, 22 nt, Homo sapiens
auugcacuccagccugggcagc

SEQ ID NO: 30894 - RNA, 22 nt, Homo sapiens
auugcacuccagccugggcgac

SEQ ID NO: 30895 - RNA, 22 nt, Homo sapiens
auugcacuccauccuaggugac

SEQ ID NO: 30896 - RNA, 18 nt, Homo sapiens
auugcacuccugccuggg

SEQ ID NO: 30897 - RNA, 22 nt, Homo sapiens
auugcacucuaaccuaggugac

SEQ ID NO: 30898 - RNA, 23 nt, Homo sapiens
auugcagucuugaacuccugggc

SEQ ID NO: 30899 - RNA, 22 nt, Homo sapiens
auugcaguuagaacagaagucu

SEQ ID NO: 30900 - RNA, 22 nt, Homo sapiens
auugccacaucucagaggcaga

SEQ ID NO: 30901 - RNA, 21 nt, Homo sapiens
auugcccaaaguggaggggaa

SEQ ID NO: 30902 - RNA, 22 nt, Homo sapiens
auugcccauaaggauauuguca

SEQ ID NO: 30903 - RNA, 22 nt, Homo sapiens
auugcucuuagaaauauuucuu

SEQ ID NO: 30904 - RNA, 22 nt, Homo sapiens
auugcugagacauugcuaaucu

SEQ ID NO: 30905 - RNA, 22 nt, Homo sapiens
auugcuuacuaaucaucuucag

SEQ ID NO: 30906 - RNA, 22 nt, Homo sapiens
auugcuucugauuuuaaaugag

SEQ ID NO: 30907 - RNA, 22 nt, Homo sapiens
auuggauagucuuuaucuguug

SEQ ID NO: 30908 - RNA, 22 nt, Homo sapiens
auuggccaaugggacgucagca

SEQ ID NO: 30909 - RNA, 22 nt, Homo sapiens
auuggguuaaaggauaugaaca

SEQ ID NO: 30910 - RNA, 22 nt, Homo sapiens
auuggucuugaaaccagagaga

SEQ ID NO: 30911 - RNA, 22 nt, Homo sapiens
auuguacuccagccugggcaag

SEQ ID NO: 30912 - RNA, 22 nt, Homo sapiens
auuguacuccagccugggcagc

SEQ ID NO: 30913 - RNA, 22 nt, Homo sapiens
auuguacuccagccuguggagc

SEQ ID NO: 30914 - RNA, 22 nt, Homo sapiens
auuguacugccccccuguugcu

SEQ ID NO: 30915 - RNA, 22 nt, Homo sapiens
auuguaguuugcuauggcaaua

SEQ ID NO: 30916 - RNA, 21 nt, Homo sapiens
auuguauguaaaccaaaugag

SEQ ID NO: 30917 - RNA, 22 nt, Homo sapiens
auugucacugugcuccaccagu

SEQ ID NO: 30918 - RNA, 22 nt, Homo sapiens
auugugcuaaaguaauaaguca

SEQ ID NO: 30919 - RNA, 22 nt, Homo sapiens
auuguucuuacaugcugucauc

SEQ ID NO: 30920 - RNA, 22 nt, Homo sapiens
auuuaacuggucuaggggccca

SEQ ID NO: 30921 - RNA, 19 nt, Homo sapiens
auuuccuggagcuggucuc

SEQ ID NO: 30922 - RNA, 22 nt, Homo sapiens
auuucuacuccuguguccagaa

SEQ ID NO: 30923 - RNA, 22 nt, Homo sapiens
auuugacacugagagccucagu

SEQ ID NO: 30924 - RNA, 19 nt, Homo sapiens
auuugaucaucaggcacag

SEQ ID NO: 30925 - RNA, 22 nt, Homo sapiens
auuuggcaacguagggaggcau

SEQ ID NO: 30926 - RNA, 22 nt, Homo sapiens
auuuggcaauuuugaagaugcc

SEQ ID NO: 30927 - RNA, 22 nt, Homo sapiens
auuugguaauauuuaaggacuu

SEQ ID NO: 30928 - RNA, 22 nt, Homo sapiens
auuugguugggugcgguggcuu

SEQ ID NO: 30929 - RNA, 22 nt, Homo sapiens
auuugucacuuaacagccauua

SEQ ID NO: 30930 - RNA, 22 nt, Homo sapiens
auuuugguuacauaguugagcu

SEQ ID NO: 30931 - RNA, 22 nt, Homo sapiens
auuuuugguugucagcacuagg

SEQ ID NO: 30932 - RNA, 22 nt, Homo sapiens
caaaccuguaggggccaagagg

SEQ ID NO: 30933 - RNA, 22 nt, Homo sapiens
caaaggcuuccacugcauccuu

SEQ ID NO: 30934 - RNA, 22 nt, Homo sapiens
caaagucuauucuacccuuacc

SEQ ID NO: 30935 - RNA, 22 nt, Homo sapiens
caaagugcugaaagaggccagg

SEQ ID NO: 30936 - RNA, 22 nt, Homo sapiens
caaagugcuggaauuggccggg

SEQ ID NO: 30937 - RNA, 22 nt, Homo sapiens
caaaugcuucuauggacugucu

SEQ ID NO: 30938 - RNA, 22 nt, Homo sapiens
caaauugcuuguggaggauaau

SEQ ID NO: 30939 - RNA, 22 nt, Homo sapiens
caacaguaaagcauuuuuaagu

SEQ ID NO: 30940 - RNA, 22 nt, Homo sapiens
caacucuguaggauccaggugg

SEQ ID NO: 30941 - RNA, 22 nt, Homo sapiens
caaguacugggcuauggauauu

SEQ ID NO: 30942 - RNA, 22 nt, Homo sapiens
caagugcucuaggauccugagu

SEQ ID NO: 30943 - RNA, 22 nt, Homo sapiens
caaguguuggcuuguauacaaa

SEQ ID NO: 30944 - RNA, 23 nt, Homo sapiens
caauacugaccucacguuaauag

SEQ ID NO: 30945 - RNA, 22 nt, Homo sapiens
caauacuguuaccugaaauagg

SEQ ID NO: 30946 - RNA, 22 nt, Homo sapiens
caaugguuuuuuaguauaagua

SEQ ID NO: 30947 - RNA, 22 nt, Homo sapiens
caaugugcuuggggcacaugag

SEQ ID NO: 30948 - RNA, 22 nt, Homo sapiens
cacaaccuccgccuccuggguu

SEQ ID NO: 30949 - RNA, 22 nt, Homo sapiens
cacaaugucugguaggccacuu

SEQ ID NO: 30950 - RNA, 22 nt, Homo sapiens
cacaccuacuagggccgugggc

SEQ ID NO: 30951 - RNA, 22 nt, Homo sapiens
cacagaauucauuggauuaccu

SEQ ID NO: 30952 - RNA, 22 nt, Homo sapiens
cacagcacaggcaugaguguca

SEQ ID NO: 30953 - RNA, 22 nt, Homo sapiens
cacagggcuaacauuuuugccc

SEQ ID NO: 30954 - RNA, 22 nt, Homo sapiens
cacauagcuagucaguagugaa

SEQ ID NO: 30955 - RNA, 22 nt, Homo sapiens
ccagcaccauuuguugaauagg

SEQ ID NO: 30956 - RNA, 22 nt, Homo sapiens
ccaggguugagacccacugacu

SEQ ID NO: 30957 - RNA, 22 nt, Homo sapiens
ccagguuucuagaauaauuccu

SEQ ID NO: 30958 - RNA, 22 nt, Homo sapiens
ccagugaacugcaagguuuuuc

SEQ ID NO: 30959 - RNA, 18 nt, Homo sapiens
ccagugcaaggaaagccc

SEQ ID NO: 30960 - RNA, 22 nt, Homo sapiens
ccagugguucccuguggccuga

SEQ ID NO: 30961 - RNA, 19 nt, Homo sapiens
ccaguguucugauugcacu

SEQ ID NO: 30962 - RNA, 22 nt, Homo sapiens
ccaguuuucaagauaaugguuu

SEQ ID NO: 30963 - RNA, 22 nt, Homo sapiens
ccaguuuucccagcaccauuaa

SEQ ID NO: 30964 - RNA, 22 nt, Homo sapiens
ccauugcacuccagccucggca

SEQ ID NO: 30965 - RNA, 22 nt, Homo sapiens
ccauuugguuauguaucgaaac

SEQ ID NO: 30966 - RNA, 22 nt, Homo sapiens
ccccauguucucucugcagcuc

SEQ ID NO: 30967 - RNA, 22 nt, Homo sapiens
ccccggguggauguacauguga

SEQ ID NO: 30968 - RNA, 22 nt, Homo sapiens
ccccugaaacucacucauuauc

SEQ ID NO: 30969 - RNA, 22 nt, Homo sapiens
cccgugucuuggucuagggccu

SEQ ID NO: 30970 - RNA, 17 nt, Homo sapiens
cccuaguagcugggacu

SEQ ID NO: 30971 - RNA, 22 nt, Homo sapiens
cccucauucauucauccuaugu

SEQ ID NO: 30972 - RNA, 22 nt, Homo sapiens
cccugaagauacagaguuuggg

SEQ ID NO: 30973 - RNA, 22 nt, Homo sapiens
cccugacauucggagauguagu

SEQ ID NO: 30974 - RNA, 22 nt, Homo sapiens
cccugagcagccugaguuuccc

SEQ ID NO: 30975 - RNA, 22 nt, Homo sapiens
cccuguagcagcauucuuaaau

SEQ ID NO: 30976 - RNA, 22 nt, Homo sapiens
cccuucauucaaggguugugag

SEQ ID NO: 30977 - RNA, 22 nt, Homo sapiens
ccucacaaccuuuauugaagag

SEQ ID NO: 30978 - RNA, 22 nt, Homo sapiens
ccucauugcuaucccaggcuga

SEQ ID NO: 30979 - RNA, 22 nt, Homo sapiens
ccucuguaguccugcaagagga

SEQ ID NO: 30980 - RNA, 22 nt, Homo sapiens
ccucuuuguugagacuucacca

SEQ ID NO: 30981 - RNA, 22 nt, Homo sapiens
ccugagaucauacuguuaguaa

SEQ ID NO: 30982 - RNA, 22 nt, Homo sapiens
ccuggguuacaggugugagcca

SEQ ID NO: 30983 - RNA, 22 nt, Homo sapiens
ccugguguuuugauggucgggu

SEQ ID NO: 30984 - RNA, 22 nt, Homo sapiens
ccuguguuaugguuucuaaugu

SEQ ID NO: 30985 - RNA, 22 nt, Homo sapiens
ccuucacaggcacugguucaga

SEQ ID NO: 30986 - RNA, 22 nt, Homo sapiens
ccuucauucauuaauuuagccc

SEQ ID NO: 30987 - RNA, 22 nt, Homo sapiens
ccuucauugcaucuuuaagaga

SEQ ID NO: 30988 - RNA, 22 nt, Homo sapiens
ccuugguaauguguuuuauucu

SEQ ID NO: 30989 - RNA, 22 nt, Homo sapiens
ccuugucacugaguggaaugaa

SEQ ID NO: 30990 - RNA, 22 nt, Homo sapiens
cuuacagucuaucagccacaac

SEQ ID NO: 30991 - RNA, 22 nt, Homo sapiens
cuucaaaguuggcuaggagaca

SEQ ID NO: 30992 - RNA, 22 nt, Homo sapiens
cuucaaguaauucugauggcua

SEQ ID NO: 30993 - RNA, 22 nt, Homo sapiens
cuucaagucuuuggauaauuag

SEQ ID NO: 30994 - RNA, 20 nt, Homo sapiens
cuucacagaaguggaaucau

SEQ ID NO: 30995 - RNA, 22 nt, Homo sapiens
cuucacggugccuacuuguguc

SEQ ID NO: 30996 - RNA, 22 nt, Homo sapiens
cuucacuggagucccuggauuc

SEQ ID NO: 30997 - RNA, 18 nt, Homo sapiens
cuucauugcuguuuugcu

SEQ ID NO: 30998 - RNA, 22 nt, Homo sapiens
cuuccaaguggggcacgugcca

SEQ ID NO: 30999 - RNA, 22 nt, Homo sapiens
cuucggugaguagauggguuaa

SEQ ID NO: 31000 - RNA, 22 nt, Homo sapiens
cuucucagugcucaucuuauuu

SEQ ID NO: 31001 - RNA, 22 nt, Homo sapiens
cuugaucaaugugguacuugau

SEQ ID NO: 31002 - RNA, 22 nt, Homo sapiens
cuugcacuguuguaagggacuu

SEQ ID NO: 31003 - RNA, 22 nt, Homo sapiens
cuugcauagaguuauugcccuu

SEQ ID NO: 31004 - RNA, 22 nt, Homo sapiens
cuuggcacugcucacccuccuu

SEQ ID NO: 31005 - RNA, 22 nt, Homo sapiens
cuuggcauugccccuggaauuu

SEQ ID NO: 31006 - RNA, 22 nt, Homo sapiens
cuugggcagugugcauguguau

SEQ ID NO: 31007 - RNA, 22 nt, Homo sapiens
cuuggguaagucauuaaaauua

SEQ ID NO: 31008 - RNA, 22 nt, Homo sapiens
cuugugcaugaccccagguggg

SEQ ID NO: 31009 - RNA, 19 nt, Homo sapiens
cuugugccugaagcuuggg

SEQ ID NO: 31010 - RNA, 22 nt, Homo sapiens
cuuguuguggaggggagugcag

SEQ ID NO: 31011 - RNA, 17 nt, Homo sapiens
cuuguugugguaguuug

SEQ ID NO: 31012 - RNA, 22 nt, Homo sapiens
cuuuaguugucuccucaagggu

SEQ ID NO: 31013 - RNA, 22 nt, Homo sapiens
cuuuaugagguuggauggaucu

SEQ ID NO: 31014 - RNA, 20 nt, Homo sapiens
cuuuggcaaugagaacaggg

SEQ ID NO: 31015 - RNA, 22 nt, Homo sapiens
cuuuggcacuuccuaagugcca

SEQ ID NO: 31016 - RNA, 22 nt, Homo sapiens
cuuuggcauuagccuguauaga

SEQ ID NO: 31017 - RNA, 22 nt, Homo sapiens
cuuuggccauagcuaaaugauu

SEQ ID NO: 31018 - RNA, 22 nt, Homo sapiens
cuuugggaccgcgguuuauacu

SEQ ID NO: 31019 - RNA, 23 nt, Homo sapiens
cuuugguaggaaauuugaauuau

SEQ ID NO: 31020 - RNA, 20 nt, Homo sapiens
cuuuggugagucaacuccuu

SEQ ID NO: 31021 - RNA, 21 nt, Homo sapiens
cuuugguuucugacuugcaua

SEQ ID NO: 31022 - RNA, 23 nt, Homo sapiens
cuuuguccccacccaaaucucau

SEQ ID NO: 31023 - RNA, 22 nt, Homo sapiens
cuuuuggugguucugaugcagg

SEQ ID NO: 31024 - RNA, 22 nt, Homo sapiens
cuuuuggugugaagaagcucuu

SEQ ID NO: 31025 - RNA, 22 nt, Homo sapiens
cuuuuugcugcagcaauacugg

SEQ ID NO: 31026 - RNA, 22 nt, Homo sapiens
cuuuuugguagagcaggugugc

SEQ ID NO: 31027 - RNA, 22 nt, Homo sapiens
gaaaacugcuucucuggguuuc

SEQ ID NO: 31028 - RNA, 22 nt, Homo sapiens
gaaaauccauccccagggagua

SEQ ID NO: 31029 - RNA, 22 nt, Homo sapiens
gaaagauuuccugagcuagaaa

SEQ ID NO: 31030 - RNA, 22 nt, Homo sapiens
gaaagauuuuaacugggagacu

SEQ ID NO: 31031 - RNA, 22 nt, Homo sapiens
gaaaguaauuaacgauuguugc

SEQ ID NO: 31032 - RNA, 22 nt, Homo sapiens
gaaaucucuacuauuuugaucu

SEQ ID NO: 31033 - RNA, 22 nt, Homo sapiens
gaaaugcucagggguuuuccag

SEQ ID NO: 31034 - RNA, 23 nt, Homo sapiens
gaaauguaagugaugccccacag

SEQ ID NO: 31035 - RNA, 22 nt, Homo sapiens
gaaccagcagacuuugacaggu

SEQ ID NO: 31036 - RNA, 22 nt, Homo sapiens
gaacuguuucuggugaaagagu

SEQ ID NO: 31037 - RNA, 22 nt, Homo sapiens
gaacuuguguugcuucacaugu

SEQ ID NO: 31038 - RNA, 22 nt, Homo sapiens
gaagacauuugcugcacguccu

SEQ ID NO: 31039 - RNA, 22 nt, Homo sapiens
gaaggagcuuaucugccauuuc

SEQ ID NO: 31040 - RNA, 22 nt, Homo sapiens
gaaggcaugcugcauggccaga

SEQ ID NO: 31041 - RNA, 23 nt, Homo sapiens
gaaguaauaaauggauucuuaac

SEQ ID NO: 31042 - RNA, 22 nt, Homo sapiens
gaaguaggugcuguuauuaucu

SEQ ID NO: 31043 - RNA, 17 nt, Homo sapiens
gaaguguuucuucauga

SEQ ID NO: 31044 - RNA, 22 nt, Homo sapiens
gaauagugcugcaauaaacaua

SEQ ID NO: 31045 - RNA, 22 nt, Homo sapiens
gaauagugcugcaaugaacaua

SEQ ID NO: 31046 - RNA, 22 nt, Homo sapiens
gaaucauuggguugauucaaga

SEQ ID NO: 31047 - RNA, 22 nt, Homo sapiens
gaauggaacugacuauagcuga

SEQ ID NO: 31048 - RNA, 22 nt, Homo sapiens
gaaugugcuguuggcugggcgu

SEQ ID NO: 31049 - RNA, 22 nt, Homo sapiens
gacagguuuucuguuucugaaa

SEQ ID NO: 31050 - RNA, 22 nt, Homo sapiens
gacaguguggcgauuccucaag

SEQ ID NO: 31051 - RNA, 22 nt, Homo sapiens
gacauagcuagauaaccucaug

SEQ ID NO: 31052 - RNA, 17 nt, Homo sapiens
gacauaggaaaaggaga

SEQ ID NO: 31053 - RNA, 20 nt, Homo sapiens
gacaugacuaggagauagcc

SEQ ID NO: 31054 - RNA, 22 nt, Homo sapiens
gaccacagacuggaaagagggc

SEQ ID NO: 31055 - RNA, 17 nt, Homo sapiens
gacgaucaucaggaggc

SEQ ID NO: 31056 - RNA, 22 nt, Homo sapiens
guuaaugcuggaauaaguuaag

SEQ ID NO: 31057 - RNA, 22 nt, Homo sapiens
guuaggcagugugguauagcag

SEQ ID NO: 31058 - RNA, 22 nt, Homo sapiens
guuauccugucuuuacauacaa

SEQ ID NO: 31059 - RNA, 22 nt, Homo sapiens
guuaugcagcaauugauaaucu

SEQ ID NO: 31060 - RNA, 22 nt, Homo sapiens
guuauguaucuugauugggugg

SEQ ID NO: 31061 - RNA, 22 nt, Homo sapiens
guuauguuaaauuguuguaugc

SEQ ID NO: 31062 - RNA, 22 nt, Homo sapiens
guuauguuaguuacaaggcuag

SEQ ID NO: 31063 - RNA, 22 nt, Homo sapiens
guuauuaguugauauuaaguuc

SEQ ID NO: 31064 - RNA, 22 nt, Homo sapiens
guucaagugauucuacugccuc

SEQ ID NO: 31065 - RNA, 22 nt, Homo sapiens
guucaaguuuucucuugugggu

SEQ ID NO: 31066 - RNA, 20 nt, Homo sapiens
guucacagagguuaugauua

SEQ ID NO: 31067 - RNA, 22 nt, Homo sapiens
guucaguaguucauucauuuau

SEQ ID NO: 31068 - RNA, 22 nt, Homo sapiens
guucaucagggacacugguuug

SEQ ID NO: 31069 - RNA, 22 nt, Homo sapiens
guucaucagggauauuggccug

SEQ ID NO: 31070 - RNA, 22 nt, Homo sapiens
guucucacuggacugugaaaau

SEQ ID NO: 31071 - RNA, 22 nt, Homo sapiens
guugaaauccuaacccccuagu

SEQ ID NO: 31072 - RNA, 22 nt, Homo sapiens
guugagcaagcuuuggagccua

SEQ ID NO: 31073 - RNA, 22 nt, Homo sapiens
guugcagcacacaggcugucag

SEQ ID NO: 31074 - RNA, 22 nt, Homo sapiens
guugcucaggccggagugcagu

SEQ ID NO: 31075 - RNA, 22 nt, Homo sapiens
guuuaacugguacuucaagucu

SEQ ID NO: 31076 - RNA, 22 nt, Homo sapiens
guuugcacuccuaugagaaucu

SEQ ID NO: 31077 - RNA, 20 nt, Homo sapiens
cuuccaguggccccaucuuu

SEQ ID NO: 31078 - RNA, 22 nt, Homo sapiens
cuuccugaguccugggcucaca

SEQ ID NO: 31079 - RNA, 22 nt, Homo sapiens
cuucuguuaguucugauaacuu

SEQ ID NO: 31080 - RNA, 22 nt, Homo sapiens
cuucuugagacuuaggcuuugg

SEQ ID NO: 31081 - RNA, 22 nt, Homo sapiens
cuugagacauuguuuuccaagu

SEQ ID NO: 31082 - RNA, 22 nt, Homo sapiens
cuugcacuccacuguucuccug

SEQ ID NO: 31083 - RNA, 22 nt, Homo sapiens
cuugcagagcccauggauguca

SEQ ID NO: 31084 - RNA, 20 nt, Homo sapiens
cuugccuagcccuuugccuc

SEQ ID NO: 31085 - RNA, 22 nt, Homo sapiens
cuuggcauuguguugauagaag

SEQ ID NO: 31086 - RNA, 22 nt, Homo sapiens
cuuggcuucuuuauguggcuau

SEQ ID NO: 31087 - RNA, 22 nt, Homo sapiens
cuuggcuuguuguccccugcuc

SEQ ID NO: 31088 - RNA, 22 nt, Homo sapiens
cuugucacuguuggcuuuagaa

SEQ ID NO: 31089 - RNA, 22 nt, Homo sapiens
cuugugccugaucuuagggggc

SEQ ID NO: 31090 - RNA, 22 nt, Homo sapiens
cuuuacacauccuaaccagugu

SEQ ID NO: 31091 - RNA, 22 nt, Homo sapiens
cuuuagcaauugauuaugccau

SEQ ID NO: 31092 - RNA, 22 nt, Homo sapiens
cuuuaguuaaaauugggguugu

SEQ ID NO: 31093 - RNA, 22 nt, Homo sapiens
cuuugauuauaaaaggguguuu

SEQ ID NO: 31094 - RNA, 22 nt, Homo sapiens
cuuuggauggaaccucucuuuc

SEQ ID NO: 31095 - RNA, 22 nt, Homo sapiens
cuuuggucaaaauaaguaaguu

SEQ ID NO: 31096 - RNA, 22 nt, Homo sapiens
cuuuggucaauugcugugggga

SEQ ID NO: 31097 - RNA, 22 nt, Homo sapiens
cuuugguucuguuuauaugcug

SEQ ID NO: 31098 - RNA, 19 nt, Homo sapiens
cuuugguugagcguguugg

SEQ ID NO: 31099 - RNA, 22 nt, Homo sapiens
cuuugguuuacuuggugcuagu

SEQ ID NO: 31100 - RNA, 22 nt, Homo sapiens
cuuugugcccuucugcccauca

SEQ ID NO: 31101 - RNA, 22 nt, Homo sapiens
cuuuguguggacauuucaggca

SEQ ID NO: 31102 - RNA, 22 nt, Homo sapiens
cuuuuacacuguuggugggaau

SEQ ID NO: 31103 - RNA, 23 nt, Homo sapiens
cuuuugcaaugugaucuugccac

SEQ ID NO: 31104 - RNA, 22 nt, Homo sapiens
cuuuugugauuccucaguuacu

SEQ ID NO: 31105 - RNA, 22 nt, Homo sapiens
cuuuugugauucuucaguugcu

SEQ ID NO: 31106 - RNA, 22 nt, Homo sapiens
cuuuuguggaucuucuguugcu

SEQ ID NO: 31107 - RNA, 20 nt, Homo sapiens
gaaacaucuauccucuccuu

SEQ ID NO: 31108 - RNA, 22 nt, Homo sapiens
gaaagcuaaugacuuuggguga

SEQ ID NO: 31109 - RNA, 22 nt, Homo sapiens
gaaagcugguauagauacauua

SEQ ID NO: 31110 - RNA, 22 nt, Homo sapiens
gaaagguaggaacagggugcag

SEQ ID NO: 31111 - RNA, 21 nt, Homo sapiens
gaaauacugccuuaggagcug

SEQ ID NO: 31112 - RNA, 22 nt, Homo sapiens
gaaaugcucauuuuggauccuu

SEQ ID NO: 31113 - RNA, 22 nt, Homo sapiens
gaacccuggaggcggagguugc

SEQ ID NO: 31114 - RNA, 22 nt, Homo sapiens
gaacugggguuggguugcgaua

SEQ ID NO: 31115 - RNA, 22 nt, Homo sapiens
gaacuguaaagaaauucuaagg

SEQ ID NO: 31116 - RNA, 22 nt, Homo sapiens
gaagaacuaggugagaucuaga

SEQ ID NO: 31117 - RNA, 22 nt, Homo sapiens
gaagguauauucuguuaaugcu

SEQ ID NO: 31118 - RNA, 22 nt, Homo sapiens
gaaguaauaaauggauucuuaa

SEQ ID NO: 31119 - RNA, 23 nt, Homo sapiens
gaaguauagcaugcacauggaaa

SEQ ID NO: 31120 - RNA, 22 nt, Homo sapiens
gaagugguaggauugcuuuuga

SEQ ID NO: 31121 - RNA, 19 nt, Homo sapiens
gaaguguuguccuccagua

SEQ ID NO: 31122 - RNA, 17 nt, Homo sapiens
gaaguguuucagcagcu

SEQ ID NO: 31123 - RNA, 22 nt, Homo sapiens
gaauaaacuagagaggacugag

SEQ ID NO: 31124 - RNA, 22 nt, Homo sapiens
gaaucaauugaucuaugugucu

SEQ ID NO: 31125 - RNA, 22 nt, Homo sapiens
gaaucccuugcauuaucccuuu

SEQ ID NO: 31126 - RNA, 22 nt, Homo sapiens
gaaugauacuguuaacgaaaga

SEQ ID NO: 31127 - RNA, 22 nt, Homo sapiens
gaaugcuaagcaugugggaauu

SEQ ID NO: 31128 - RNA, 21 nt, Homo sapiens
gaauggcaccauuagcauaua

SEQ ID NO: 31129 - RNA, 20 nt, Homo sapiens
gaaugguuucgggguucuug

SEQ ID NO: 31130 - RNA, 22 nt, Homo sapiens
gacaagagaacacugcuauauu

SEQ ID NO: 31131 - RNA, 22 nt, Homo sapiens
gacaccauuucaguacuagguu

SEQ ID NO: 31132 - RNA, 22 nt, Homo sapiens
gacaccugguguggaacuggag

SEQ ID NO: 31133 - RNA, 22 nt, Homo sapiens
gacagacacaauugauccauga

SEQ ID NO: 31134 - RNA, 18 nt, Homo sapiens
gacagugugaagauuccu

SEQ ID NO: 31135 - RNA, 22 nt, Homo sapiens
gacagugugauacuuagucuca

SEQ ID NO: 31136 - RNA, 20 nt, Homo sapiens
gacauagagacucucaaaaa

SEQ ID NO: 31137 - RNA, 22 nt, Homo sapiens
gacaucauuaugagauuuaaac

SEQ ID NO: 31138 - RNA, 20 nt, Homo sapiens
gacauggaggaggauuauua

SEQ ID NO: 31139 - RNA, 20 nt, Homo sapiens
gacauguuuuguggccuaac

SEQ ID NO: 31140 - RNA, 22 nt, Homo sapiens
gacauuaucagguuuguuuucu

SEQ ID NO: 31141 - RNA, 21 nt, Homo sapiens
gaccacagcagggaaugucag

SEQ ID NO: 31142 - RNA, 22 nt, Homo sapiens
gaccccuagagauaggaggaac

SEQ ID NO: 31143 - RNA, 22 nt, Homo sapiens
gacccuuagaaugugaucuuau

SEQ ID NO: 31144 - RNA, 22 nt, Homo sapiens
gaccuaggaggauugcuugagc

SEQ ID NO: 31145 - RNA, 22 nt, Homo sapiens
gaccugagagguacauguauuu

SEQ ID NO: 31146 - RNA, 22 nt, Homo sapiens
gacuaaugaaagagugugauau

SEQ ID NO: 31147 - RNA, 22 nt, Homo sapiens
gacuagagcugaucauguuacu

SEQ ID NO: 31148 - RNA, 22 nt, Homo sapiens
gacuagggaccaugagcaaucc

SEQ ID NO: 31149 - RNA, 22 nt, Homo sapiens
gacuauaucaggaauggggauu

SEQ ID NO: 31150 - RNA, 18 nt, Homo sapiens
gacucaguuucuaaggca

SEQ ID NO: 31151 - RNA, 18 nt, Homo sapiens
gacuccauuucagccaga

SEQ ID NO: 31152 - RNA, 22 nt, Homo sapiens
gacugcagugcagcuguuaggc

SEQ ID NO: 31153 - RNA, 22 nt, Homo sapiens
gacuggguuaguuugaaagacu

SEQ ID NO: 31154 - RNA, 22 nt, Homo sapiens
gacuuagagauguuguauuugg

SEQ ID NO: 31155 - RNA, 22 nt, Homo sapiens
gagaacagaagcauuccuaauu

SEQ ID NO: 31156 - RNA, 22 nt, Homo sapiens
gagaacauuaauaguuaauuuu

SEQ ID NO: 31157 - RNA, 22 nt, Homo sapiens
gcacacuuacacgaaccuagau

SEQ ID NO: 31158 - RNA, 22 nt, Homo sapiens
gcacauuacaaguauuagcuca

SEQ ID NO: 31159 - RNA, 22 nt, Homo sapiens
gcaccacugcacucucagcuug

SEQ ID NO: 31160 - RNA, 22 nt, Homo sapiens
gcaccaugguagaauaauggua

SEQ ID NO: 31161 - RNA, 22 nt, Homo sapiens
gcaccguggaguauggggagga

SEQ ID NO: 31162 - RNA, 22 nt, Homo sapiens
gcagaauugguuucuucuaagg

SEQ ID NO: 31163 - RNA, 19 nt, Homo sapiens
gcagagaugugguagcuug

SEQ ID NO: 31164 - RNA, 22 nt, Homo sapiens
gcagaucucuucauuucucuua

SEQ ID NO: 31165 - RNA, 22 nt, Homo sapiens
gcagcaguggcaguuaauauuu

SEQ ID NO: 31166 - RNA, 22 nt, Homo sapiens
gcagguaguuucugacuuuuac

SEQ ID NO: 31167 - RNA, 22 nt, Homo sapiens
gcagguguuaugcaaacaacug

SEQ ID NO: 31168 - RNA, 22 nt, Homo sapiens
gcagugugaucacagcuuacug

SEQ ID NO: 31169 - RNA, 17 nt, Homo sapiens
gcauaugucgaaccagc

SEQ ID NO: 31170 - RNA, 17 nt, Homo sapiens
gcauauguugaaccagu

SEQ ID NO: 31171 - RNA, 22 nt, Homo sapiens
gcauauuuuaaaguguaaccug

SEQ ID NO: 31172 - RNA, 22 nt, Homo sapiens
gcaucacagcuccugugcuggc

SEQ ID NO: 31173 - RNA, 22 nt, Homo sapiens
gcaugcacuguauuuaaguauc

SEQ ID NO: 31174 - RNA, 22 nt, Homo sapiens
ggacugagaggacuacagugua

SEQ ID NO: 31175 - RNA, 22 nt, Homo sapiens
ggagaguaauuagacugaaaga

SEQ ID NO: 31176 - RNA, 22 nt, Homo sapiens
ggagaugaaaugagcuacuuaa

SEQ ID NO: 31177 - RNA, 22 nt, Homo sapiens
ggagauuauugaaucaugaggg

SEQ ID NO: 31178 - RNA, 22 nt, Homo sapiens
ggagcugugauuugaguccaga

SEQ ID NO: 31179 - RNA, 22 nt, Homo sapiens
ggagggugagaucaauuuggga

SEQ ID NO: 31180 - RNA, 20 nt, Homo sapiens
ggagguguuggauuucuagu

SEQ ID NO: 31181 - RNA, 22 nt, Homo sapiens
ggagucugacuuauaggaaccu

SEQ ID NO: 31182 - RNA, 23 nt, Homo sapiens
ggaguguaaugacucgaucucgg

SEQ ID NO: 31183 - RNA, 22 nt, Homo sapiens
ggagugugauuguucucuguua

SEQ ID NO: 31184 - RNA, 22 nt, Homo sapiens
ggauuagagauguuauuaagag

SEQ ID NO: 31185 - RNA, 23 nt, Homo sapiens
ggauucaucuguuuguucgcugu

SEQ ID NO: 31186 - RNA, 22 nt, Homo sapiens
ggcaaagagacaugcaucgggg

SEQ ID NO: 31187 - RNA, 22 nt, Homo sapiens
ggcaacaauuccuacuucuuuu

SEQ ID NO: 31188 - RNA, 22 nt, Homo sapiens
ggcaagaaccucaauuaccuuu

SEQ ID NO: 31189 - RNA, 22 nt, Homo sapiens
ggcaagaacuucacucacuuuu

SEQ ID NO: 31190 - RNA, 21 nt, Homo sapiens
ggcaagagaauacaacauaaa

SEQ ID NO: 31191 - RNA, 23 nt, Homo sapiens
ggcaagaucucagcucacugcaa

SEQ ID NO: 31192 - RNA, 22 nt, Homo sapiens
ggcaaggauguuuuucuggcaa

SEQ ID NO: 31193 - RNA, 22 nt, Homo sapiens
ggcaaggugcuacagacaguga

SEQ ID NO: 31194 - RNA, 22 nt, Homo sapiens
ggcaaguucuaaugauuagaau

SEQ ID NO: 31195 - RNA, 22 nt, Homo sapiens
ggcacaaugucagcucacugca

SEQ ID NO: 31196 - RNA, 22 nt, Homo sapiens
ggcaccauuuuacuccuucccu

SEQ ID NO: 31197 - RNA, 22 nt, Homo sapiens
ggcacgguggcucacaccugua

SEQ ID NO: 31198 - RNA, 22 nt, Homo sapiens
ggcacuguggcucaagccugua

SEQ ID NO: 31199 - RNA, 22 nt, Homo sapiens
ggcagaauugcugaggaugcua

SEQ ID NO: 31200 - RNA, 22 nt, Homo sapiens
ggcagcauugccuuugcaguga

SEQ ID NO: 31201 - RNA, 22 nt, Homo sapiens
ggcaguguuauuauauuuuugg

SEQ ID NO: 31202 - RNA, 22 nt, Homo sapiens
ggcaguuuguuugugaggucca

SEQ ID NO: 31203 - RNA, 22 nt, Homo sapiens
ggcaugcauuguacuaguaugc

SEQ ID NO: 31204 - RNA, 22 nt, Homo sapiens
ggcauguuuaguagaauguggu

SEQ ID NO: 31205 - RNA, 22 nt, Homo sapiens
ggccagaugcgguggcucacac

SEQ ID NO: 31206 - RNA, 22 nt, Homo sapiens
ggcccaguugcgggugguaccg

SEQ ID NO: 31207 - RNA, 22 nt, Homo sapiens
ggccggguggccauggcugccc

SEQ ID NO: 31208 - RNA, 18 nt, Homo sapiens
ggcggguguuuuauucac

SEQ ID NO: 31209 - RNA, 22 nt, Homo sapiens
ggcuagaauagggauagaccuu

SEQ ID NO: 31210 - RNA, 22 nt, Homo sapiens
ggcuagagagcucagggauaug

SEQ ID NO: 31211 - RNA, 22 nt, Homo sapiens
ggcucaguuuccuccgucugcu

SEQ ID NO: 31212 - RNA, 22 nt, Homo sapiens
ggcucguguuuucuguccaguu

SEQ ID NO: 31213 - RNA, 18 nt, Homo sapiens
ggcugguguuuuaguaua

SEQ ID NO: 31214 - RNA, 22 nt, Homo sapiens
ggcuguguguuaaaauaggcuu

SEQ ID NO: 31215 - RNA, 22 nt, Homo sapiens
ggcuuuggucacacaggggcaa

SEQ ID NO: 31216 - RNA, 22 nt, Homo sapiens
gggaagugugcagaguucucuu

SEQ ID NO: 31217 - RNA, 20 nt, Homo sapiens
gggaaucguaauagaauauu

SEQ ID NO: 31218 - RNA, 22 nt, Homo sapiens
gggaaugaagagaaccuuccca

SEQ ID NO: 31219 - RNA, 20 nt, Homo sapiens
gggaaugcaaauucucaucc

SEQ ID NO: 31220 - RNA, 22 nt, Homo sapiens
gggagcacaagaaauguuucau

SEQ ID NO: 31221 - RNA, 22 nt, Homo sapiens
gggagugucuaaccuguuaaca

SEQ ID NO: 31222 - RNA, 22 nt, Homo sapiens
gggaguguguaggacccagugu

SEQ ID NO: 31223 - RNA, 22 nt, Homo sapiens
gggaugaagaagaauaguucgu

SEQ ID NO: 31224 - RNA, 22 nt, Homo sapiens
gggaugaagcccuaggguuggu

SEQ ID NO: 31225 - RNA, 23 nt, Homo sapiens
gggauuguaaaauaugagggcag

SEQ ID NO: 31226 - RNA, 22 nt, Homo sapiens
gggcaacauugaguacccugaa

SEQ ID NO: 31227 - RNA, 22 nt, Homo sapiens
gggcagaugucuggacaccuca

SEQ ID NO: 31228 - RNA, 22 nt, Homo sapiens
gggcaugugugugcacacacau

SEQ ID NO: 31229 - RNA, 22 nt, Homo sapiens
gggcauugugggcagagggcag

SEQ ID NO: 31230 - RNA, 22 nt, Homo sapiens
ggggaguguggacaucacccug

SEQ ID NO: 31231 - RNA, 22 nt, Homo sapiens
ggguaaaucucuuuucauggcu

SEQ ID NO: 31232 - RNA, 22 nt, Homo sapiens
ggguucaaaucuuggcucuuac

SEQ ID NO: 31233 - RNA, 22 nt, Homo sapiens
gguagacaucgugcucugugau

SEQ ID NO: 31234 - RNA, 22 nt, Homo sapiens
gguaggcacuggugggaagaga

SEQ ID NO: 31235 - RNA, 22 nt, Homo sapiens
ggucagaaagacaggcauucag

SEQ ID NO: 31236 - RNA, 22 nt, Homo sapiens
ggucagugcauucuaaaggcaa

SEQ ID NO: 31237 - RNA, 22 nt, Homo sapiens
ggucaguguuaucaccgaagga

SEQ ID NO: 31238 - RNA, 19 nt, Homo sapiens
ggucccucucaagucauuc

SEQ ID NO: 31239 - RNA, 22 nt, Homo sapiens
ggucugguguugaaauucuuca

SEQ ID NO: 31240 - RNA, 22 nt, Homo sapiens
ggugagaaagggauuccuguuc

SEQ ID NO: 31241 - RNA, 22 nt, Homo sapiens
ggugaggaaaguugaguuucua

SEQ ID NO: 31242 - RNA, 18 nt, Homo sapiens
guaaauguaucuauugcc

SEQ ID NO: 31243 - RNA, 22 nt, Homo sapiens
guaacacucuaaagggaugcac

SEQ ID NO: 31244 - RNA, 22 nt, Homo sapiens
guaagugguagagcugggcuau

SEQ ID NO: 31245 - RNA, 22 nt, Homo sapiens
guaauacuggacaggguaucag

SEQ ID NO: 31246 - RNA, 22 nt, Homo sapiens
guaauagucucaaacuccugga

SEQ ID NO: 31247 - RNA, 22 nt, Homo sapiens
guaaucucagcuacucgggagg

SEQ ID NO: 31248 - RNA, 22 nt, Homo sapiens
guaaucucagcuacuugggagg

SEQ ID NO: 31249 - RNA, 22 nt, Homo sapiens
guaaucucagcuucuugggagg

SEQ ID NO: 31250 - RNA, 22 nt, Homo sapiens
guaaucuguaguaaagcaccau

SEQ ID NO: 31251 - RNA, 22 nt, Homo sapiens
guacacauacauauaugugugu

SEQ ID NO: 31252 - RNA, 22 nt, Homo sapiens
guacaggcagcaaacaccauaa

SEQ ID NO: 31253 - RNA, 22 nt, Homo sapiens
guacaguacugaaugaauguau

SEQ ID NO: 31254 - RNA, 22 nt, Homo sapiens
guacaguuuucaguguucacug

SEQ ID NO: 31255 - RNA, 22 nt, Homo sapiens
guacaugcauaguuuauuucug

SEQ ID NO: 31256 - RNA, 22 nt, Homo sapiens
guacuguuucauuggagauuaa

SEQ ID NO: 31257 - RNA, 22 nt, Homo sapiens
guacuuuguuauaacccacagg

SEQ ID NO: 31258 - RNA, 22 nt, Homo sapiens
uauugcagugagauccaucugg

SEQ ID NO: 31259 - RNA, 22 nt, Homo sapiens
uauugcauauuauucuaguggc

SEQ ID NO: 31260 - RNA, 22 nt, Homo sapiens
uauugccucuuuuguaaaagug

SEQ ID NO: 31261 - RNA, 22 nt, Homo sapiens
uauugccugucuccaaaaauca

SEQ ID NO: 31262 - RNA, 22 nt, Homo sapiens
uauugcugaaaaugcuaaugau

SEQ ID NO: 31263 - RNA, 22 nt, Homo sapiens
uauugucaccaucccuguuuua

SEQ ID NO: 31264 - RNA, 22 nt, Homo sapiens
uauuucaguugugcagguaguu

SEQ ID NO: 31265 - RNA, 22 nt, Homo sapiens
uauuugauuaacaagagccuaa

SEQ ID NO: 31266 - RNA, 22 nt, Homo sapiens
uauuugauugacuuuagcagga

SEQ ID NO: 31267 - RNA, 22 nt, Homo sapiens
uauuugguuggugcaaaaguaa

SEQ ID NO: 31268 - RNA, 22 nt, Homo sapiens
ucaaacauccccaccagggacu

SEQ ID NO: 31269 - RNA, 22 nt, Homo sapiens
ucaaacugcuugaggccauuua

SEQ ID NO: 31270 - RNA, 22 nt, Homo sapiens
ucaaagugcuauggcucagguu

SEQ ID NO: 31271 - RNA, 22 nt, Homo sapiens
ucaaaugcucuuugcagagagg

SEQ ID NO: 31272 - RNA, 22 nt, Homo sapiens
ucaaaugguccacgugaacauu

SEQ ID NO: 31273 - RNA, 22 nt, Homo sapiens
ucaacagugggcacuguaaaug

SEQ ID NO: 31274 - RNA, 22 nt, Homo sapiens
ucaacguauuuauauagcagag

SEQ ID NO: 31275 - RNA, 22 nt, Homo sapiens
ucaagcaauucugcugccucag

SEQ ID NO: 31276 - RNA, 20 nt, Homo sapiens
ucaaggcacgaauaaaaguu

SEQ ID NO: 31277 - RNA, 22 nt, Homo sapiens
ucaaguaagaagugggcauaaa

SEQ ID NO: 31278 - RNA, 22 nt, Homo sapiens
ucaagugcauugauucaguauu

SEQ ID NO: 31279 - RNA, 22 nt, Homo sapiens
ucaauguaucuccaagaauuga

SEQ ID NO: 31280 - RNA, 18 nt, Homo sapiens
ucaauguggauguucuuu

SEQ ID NO: 31281 - RNA, 19 nt, Homo sapiens
ucaauucugucaauggcuu

SEQ ID NO: 31282 - RNA, 22 nt, Homo sapiens
ucacaaagcuuggccugcuucu

SEQ ID NO: 31283 - RNA, 22 nt, Homo sapiens
ucacaagugagaggaauuagau

SEQ ID NO: 31284 - RNA, 22 nt, Homo sapiens
ucacacugcaucuguuggaauu

SEQ ID NO: 31285 - RNA, 19 nt, Homo sapiens
ucacacuguggcuucuuua

SEQ ID NO: 31286 - RNA, 22 nt, Homo sapiens
ucacagacugagccaaauagag

SEQ ID NO: 31287 - RNA, 22 nt, Homo sapiens
ucacagccuaguuuuauacauu

SEQ ID NO: 31288 - RNA, 22 nt, Homo sapiens
ucacaguaaauccagaagaaau

SEQ ID NO: 31289 - RNA, 22 nt, Homo sapiens
ucacaguaacuuuguugcuuuu

SEQ ID NO: 31290 - RNA, 22 nt, Homo sapiens
ucacaguagagcuucuuucaga

SEQ ID NO: 31291 - RNA, 22 nt, Homo sapiens
ucacaguagccccucccaucau

SEQ ID NO: 31292 - RNA, 22 nt, Homo sapiens
ucacaguagggaacugacaaag

SEQ ID NO: 31293 - RNA, 22 nt, Homo sapiens
ucacagucggugacuucuugcu

SEQ ID NO: 31294 - RNA, 22 nt, Homo sapiens
ucacagucuccucuagggaggg

SEQ ID NO: 31295 - RNA, 17 nt, Homo sapiens
ucacaguguuaggauga

SEQ ID NO: 31296 - RNA, 22 nt, Homo sapiens
ucacaguugauugaaacacagc

SEQ ID NO: 31297 - RNA, 22 nt, Homo sapiens
ucacauggggaagggacuagcu

SEQ ID NO: 31298 - RNA, 22 nt, Homo sapiens
ucacauuaagcuguuauuucuu

SEQ ID NO: 31299 - RNA, 22 nt, Homo sapiens
ucacauucaauuguaauccccg

SEQ ID NO: 31300 - RNA, 22 nt, Homo sapiens
ucacauuguguagccugcucac

SEQ ID NO: 31301 - RNA, 22 nt, Homo sapiens
ucaccagugucagggaacugcu

SEQ ID NO: 31302 - RNA, 22 nt, Homo sapiens
ucacccacacaggagacaggga

SEQ ID NO: 31303 - RNA, 22 nt, Homo sapiens
ucacccugacaugcggccgaac

SEQ ID NO: 31304 - RNA, 22 nt, Homo sapiens
ucaccuggagacaugaagacug

SEQ ID NO: 31305 - RNA, 22 nt, Homo sapiens
ucaccuggagagcuugcuaaua

SEQ ID NO: 31306 - RNA, 22 nt, Homo sapiens
ucaccuggagccuucacauucu

SEQ ID NO: 31307 - RNA, 22 nt, Homo sapiens
ucaccuuacuugcuucugaacu

SEQ ID NO: 31308 - RNA, 22 nt, Homo sapiens
ucacgugguucauaaggcagaa

SEQ ID NO: 31309 - RNA, 22 nt, Homo sapiens
ucacuagaucaagggagagaaa

SEQ ID NO: 31310 - RNA, 20 nt, Homo sapiens
ucacugagugguccacagua

SEQ ID NO: 31311 - RNA, 22 nt, Homo sapiens
ucacugcgaccuccaccucccg

SEQ ID NO: 31312 - RNA, 22 nt, Homo sapiens
ucacugcgaccuccaccuccug

SEQ ID NO: 31313 - RNA, 22 nt, Homo sapiens
ucacugcgaccuccgccucccg

SEQ ID NO: 31314 - RNA, 22 nt, Homo sapiens
ucacuggagauagcaaucuggu

SEQ ID NO: 31315 - RNA, 22 nt, Homo sapiens
ucacuggucuaaguggaggggg

SEQ ID NO: 31316 - RNA, 22 nt, Homo sapiens
ucacugugagaguuuauccugu

SEQ ID NO: 31317 - RNA, 22 nt, Homo sapiens
ucacugugcacauaugauaggu

SEQ ID NO: 31318 - RNA, 22 nt, Homo sapiens
ucacugugguuggaaggcuuaa

SEQ ID NO: 31319 - RNA, 22 nt, Homo sapiens
ucacugugugucucuguaucug

SEQ ID NO: 31320 - RNA, 18 nt, Homo sapiens
ucacugugugucuugggu

SEQ ID NO: 31321 - RNA, 22 nt, Homo sapiens
ucacuguugaugggcaugcagg

SEQ ID NO: 31322 - RNA, 22 nt, Homo sapiens
ucacuuuguauagcgacuggcu

SEQ ID NO: 31323 - RNA, 22 nt, Homo sapiens
ucagaacugaacaaaccagucu

SEQ ID NO: 31324 - RNA, 22 nt, Homo sapiens
ucagaacugauacuagaacuuu

SEQ ID NO: 31325 - RNA, 22 nt, Homo sapiens
ucagacacugcccuccaccugu

SEQ ID NO: 31326 - RNA, 22 nt, Homo sapiens
ucagagcaaagacacuuuauca

SEQ ID NO: 31327 - RNA, 22 nt, Homo sapiens
ucagaguagcugucugaggugc

SEQ ID NO: 31328 - RNA, 18 nt, Homo sapiens
ucagagugcagacuauac

SEQ ID NO: 31329 - RNA, 22 nt, Homo sapiens
ucagaucaguuccacaagaacu

SEQ ID NO: 31330 - RNA, 22 nt, Homo sapiens
ucagauugaugcauacuuaaau

SEQ ID NO: 31331 - RNA, 22 nt, Homo sapiens
ucagcagugccccacucuacug

SEQ ID NO: 31332 - RNA, 22 nt, Homo sapiens
ucaggcacucagcuuagagucu

SEQ ID NO: 31333 - RNA, 22 nt, Homo sapiens
ucaggcuuuucccagagugaug

SEQ ID NO: 31334 - RNA, 21 nt, Homo sapiens
ucaggcuuuuugagugccaau

SEQ ID NO: 31335 - RNA, 22 nt, Homo sapiens
ucagggacuuacaaaccagaag

SEQ ID NO: 31336 - RNA, 22 nt, Homo sapiens
ucagguaguuugugggagauga

SEQ ID NO: 31337 - RNA, 22 nt, Homo sapiens
ucaggugccuuggcuaauuguu

SEQ ID NO: 31338 - RNA, 22 nt, Homo sapiens
ucaguaaaugcuguucucuuuu

SEQ ID NO: 31339 - RNA, 22 nt, Homo sapiens
ucaguacuuuggagcucacaua

SEQ ID NO: 31340 - RNA, 22 nt, Homo sapiens
ucaguaguuccaguggguauuu

SEQ ID NO: 31341 - RNA, 22 nt, Homo sapiens
ucagugaacgaggaggagggug

SEQ ID NO: 31342 - RNA, 22 nt, Homo sapiens
ucagugaauacauguacucaug

SEQ ID NO: 31343 - RNA, 22 nt, Homo sapiens
ucagugaauauauaacagcgau

SEQ ID NO: 31344 - RNA, 22 nt, Homo sapiens
ucagugauugguuauuuuaggc

SEQ ID NO: 31345 - RNA, 21 nt, Homo sapiens
ucagugcaauucuauggggaa

SEQ ID NO: 31346 - RNA, 17 nt, Homo sapiens
ucagugcauuuaagaga

SEQ ID NO: 31347 - RNA, 22 nt, Homo sapiens
ucagugcuguaccaucuaagga

SEQ ID NO: 31348 - RNA, 21 nt, Homo sapiens
ucagugcugugggcaaggugc

SEQ ID NO: 31349 - RNA, 22 nt, Homo sapiens
ucagugcuguuugcccucguuu

SEQ ID NO: 31350 - RNA, 22 nt, Homo sapiens
ucagugcuuuuuguugucauca

SEQ ID NO: 31351 - RNA, 22 nt, Homo sapiens
ucaguggagccucacucugugg

SEQ ID NO: 31352 - RNA, 22 nt, Homo sapiens
ucaguggagcuacaauucuggg

SEQ ID NO: 31353 - RNA, 22 nt, Homo sapiens
ucagugucugcauucuuauugu

SEQ ID NO: 31354 - RNA, 22 nt, Homo sapiens
ucaguuaaugcugccugcugga

SEQ ID NO: 31355 - RNA, 22 nt, Homo sapiens
ucauacaggccaccagggaagu

SEQ ID NO: 31356 - RNA, 20 nt, Homo sapiens
ucauacuguggaguaccagg

SEQ ID NO: 31357 - RNA, 22 nt, Homo sapiens
uggcagauaggauacaggacua

SEQ ID NO: 31358 - RNA, 22 nt, Homo sapiens
uggcagcgugaauguggcugaa

SEQ ID NO: 31359 - RNA, 22 nt, Homo sapiens
ugucucaguucccuucucugga

SEQ ID NO: 31360 - RNA, 21 nt, Homo sapiens
ugucuuggagccagacgccag

SEQ ID NO: 31361 - RNA, 22 nt, Homo sapiens
ugugaaauguuaucccgucgug

SEQ ID NO: 31362 - RNA, 22 nt, Homo sapiens
ugugaacaaaauuuguugcaua

SEQ ID NO: 31363 - RNA, 22 nt, Homo sapiens
ugugaagaaagucauugguagc

SEQ ID NO: 31364 - RNA, 19 nt, Homo sapiens
ugugaagaaaugcugcaag

SEQ ID NO: 31365 - RNA, 22 nt, Homo sapiens
ugugacagguauccuguguucu

SEQ ID NO: 31366 - RNA, 22 nt, Homo sapiens
ugugaccaaaaucaacauaccu

SEQ ID NO: 31367 - RNA, 19 nt, Homo sapiens
ugugacugggccagccuag

SEQ ID NO: 31368 - RNA, 19 nt, Homo sapiens
ugugacugguugucucgcu

SEQ ID NO: 31369 - RNA, 22 nt, Homo sapiens
ugugauaguuggcuaaagcagu

SEQ ID NO: 31370 - RNA, 22 nt, Homo sapiens
ugugaucaaccugcagggcugg

SEQ ID NO: 31371 - RNA, 22 nt, Homo sapiens
ugugaucauugcuguuaaagug

SEQ ID NO: 31372 - RNA, 16 nt, Homo sapiens
ugugaucuuuuuucuu

SEQ ID NO: 31373 - RNA, 22 nt, Homo sapiens
ugugaugcagggccugggccuc

SEQ ID NO: 31374 - RNA, 18 nt, Homo sapiens
ugugauggauauguuaau

SEQ ID NO: 31375 - RNA, 22 nt, Homo sapiens
ugugauuauuuaaauaggacag

SEQ ID NO: 31376 - RNA, 17 nt, Homo sapiens
ugugauugaagucaucc

SEQ ID NO: 31377 - RNA, 22 nt, Homo sapiens
ugugcaaauguuaaacuaacuu

SEQ ID NO: 31378 - RNA, 22 nt, Homo sapiens
ugugcaaggcucucaaccugug

SEQ ID NO: 31379 - RNA, 22 nt, Homo sapiens
ugugcaaucuuccauuuuuagg

SEQ ID NO: 31380 - RNA, 22 nt, Homo sapiens
ugugcacaaugugcagguuugu

SEQ ID NO: 31381 - RNA, 22 nt, Homo sapiens
ugugcaccucuucacacaggga

SEQ ID NO: 31382 - RNA, 22 nt, Homo sapiens
ugugccaaucauagggcuuggu

SEQ ID NO: 31383 - RNA, 22 nt, Homo sapiens
ugugcuugcuucuucuccuagu

SEQ ID NO: 31384 - RNA, 22 nt, Homo sapiens
uguggaaauuguuguauuuaau

SEQ ID NO: 31385 - RNA, 21 nt, Homo sapiens
uguggcaauggccucacagau

SEQ ID NO: 31386 - RNA, 22 nt, Homo sapiens
uguggcagugcuuuaugaaacc

SEQ ID NO: 31387 - RNA, 22 nt, Homo sapiens
uguggcauuuucagaaaggaug

SEQ ID NO: 31388 - RNA, 22 nt, Homo sapiens
uguggccuuuguuucaguuggg

SEQ ID NO: 31389 - RNA, 18 nt, Homo sapiens
uguggcuguuuuccaaua

SEQ ID NO: 31390 - RNA, 22 nt, Homo sapiens
uguguaaauauauacacacgug

SEQ ID NO: 31391 - RNA, 22 nt, Homo sapiens
uguguaauaccuuugacuauau

SEQ ID NO: 31392 - RNA, 22 nt, Homo sapiens
uguguacugcagaguauucugu

SEQ ID NO: 31393 - RNA, 22 nt, Homo sapiens
ugugucuuguuuuuucccaggc

SEQ ID NO: 31394 - RNA, 22 nt, Homo sapiens
uguuaagaugucaauuuuccac

SEQ ID NO: 31395 - RNA, 22 nt, Homo sapiens
uguuacagugacuaauguuuua

SEQ ID NO: 31396 - RNA, 22 nt, Homo sapiens
uguuaguuguucauguuaagag

SEQ ID NO: 31397 - RNA, 16 nt, Homo sapiens
uguuauggagacagcu

SEQ ID NO: 31398 - RNA, 22 nt, Homo sapiens
uguuauguauggagugauccca

SEQ ID NO: 31399 - RNA, 22 nt, Homo sapiens
uguuauguuguuugagaaaguc

SEQ ID NO: 31400 - RNA, 19 nt, Homo sapiens
uguugcacauaucaauaug

SEQ ID NO: 31401 - RNA, 22 nt, Homo sapiens
uguugcacuccagccuggguga

SEQ ID NO: 31402 - RNA, 18 nt, Homo sapiens
uguugguguucacucacu

SEQ ID NO: 31403 - RNA, 22 nt, Homo sapiens
uguuugcuguuuucuccaauga

SEQ ID NO: 31404 - RNA, 22 nt, Homo sapiens
uguuuguuugagauggagucuc

SEQ ID NO: 31405 - RNA, 22 nt, Homo sapiens
uguuuguuugauaugggauaaa

SEQ ID NO: 31406 - RNA, 22 nt, Homo sapiens
uuaaaaguauaggccuggcaua

SEQ ID NO: 31407 - RNA, 22 nt, Homo sapiens
uuaaagccauaccugagagagu

SEQ ID NO: 31408 - RNA, 22 nt, Homo sapiens
uuaaaggcauguacacuagagu

SEQ ID NO: 31409 - RNA, 22 nt, Homo sapiens
uuaaaguguuugcagacaggug

SEQ ID NO: 31410 - RNA, 20 nt, Homo sapiens
uuaaaucuagugcagacuca

SEQ ID NO: 31411 - RNA, 22 nt, Homo sapiens
uuaaaugcacauacuugagaaa

SEQ ID NO: 31412 - RNA, 22 nt, Homo sapiens
uuaaaugcauagaauguguagu

SEQ ID NO: 31413 - RNA, 21 nt, Homo sapiens
uuaacagacaagugucuuccc

SEQ ID NO: 31414 - RNA, 22 nt, Homo sapiens
uuaacagugucaaucuguagua

SEQ ID NO: 31415 - RNA, 22 nt, Homo sapiens
uuaagaagugauuuuccucauu

SEQ ID NO: 31416 - RNA, 22 nt, Homo sapiens
uuaagagugggaguuggccaca

SEQ ID NO: 31417 - RNA, 22 nt, Homo sapiens
uuaagaucagugcaaacuggag

SEQ ID NO: 31418 - RNA, 22 nt, Homo sapiens
uuaagcaaagguaacaugagaa

SEQ ID NO: 31419 - RNA, 21 nt, Homo sapiens
uuaaguaauuacccaacucuc

SEQ ID NO: 31420 - RNA, 22 nt, Homo sapiens
uuaaguagaugaaugugaaugu

SEQ ID NO: 31421 - RNA, 19 nt, Homo sapiens
uuaaguaguuagagggucu

SEQ ID NO: 31422 - RNA, 22 nt, Homo sapiens
uuaagucacacuagacaacuga

SEQ ID NO: 31423 - RNA, 22 nt, Homo sapiens
uuaagugcucaguuacucaguu

SEQ ID NO: 31424 - RNA, 21 nt, Homo sapiens
uuaagugcuuuguaugcacua

SEQ ID NO: 31425 - RNA, 19 nt, Homo sapiens
uuaagugugauaucucagu

SEQ ID NO: 31426 - RNA, 22 nt, Homo sapiens
uuaaguuaggcuucagcagucu

SEQ ID NO: 31427 - RNA, 22 nt, Homo sapiens
uuaauacucuucuaaguagucc

SEQ ID NO: 31428 - RNA, 22 nt, Homo sapiens
uuaauagcaaagaguuuagacu

SEQ ID NO: 31429 - RNA, 22 nt, Homo sapiens
uuaaugaacuuuauuuuguaga

SEQ ID NO: 31430 - RNA, 22 nt, Homo sapiens
uuaaugacaucauaggugaagu

SEQ ID NO: 31431 - RNA, 22 nt, Homo sapiens
uuaauucugucugcccucaucc

SEQ ID NO: 31432 - RNA, 22 nt, Homo sapiens
uuacaaccucagcagugcaaag

SEQ ID NO: 31433 - RNA, 22 nt, Homo sapiens
uuacaacugucuuacugguuau

SEQ ID NO: 31434 - RNA, 22 nt, Homo sapiens
uuacacguaauaucacggugug

SEQ ID NO: 31435 - RNA, 22 nt, Homo sapiens
uuacagauggcacacucaaggg

SEQ ID NO: 31436 - RNA, 22 nt, Homo sapiens
uuacagcugcuccccaucacuc

SEQ ID NO: 31437 - RNA, 22 nt, Homo sapiens
uuacagcugggugugucuggua

SEQ ID NO: 31438 - RNA, 22 nt, Homo sapiens
uuacaguauugcaaggacuagg

SEQ ID NO: 31439 - RNA, 20 nt, Homo sapiens
uuacagugggaccuuccuga

SEQ ID NO: 31440 - RNA, 22 nt, Homo sapiens
uuacaguguuuguucuguuacu

SEQ ID NO: 31441 - RNA, 22 nt, Homo sapiens
uuacaugagacugucgcuaguu

SEQ ID NO: 31442 - RNA, 22 nt, Homo sapiens
uuaccagagaagacgaggggga

SEQ ID NO: 31443 - RNA, 22 nt, Homo sapiens
uuaccagucuagggcucaguuu

SEQ ID NO: 31444 - RNA, 22 nt, Homo sapiens
uuaccaguggugcuguaaacuu

SEQ ID NO: 31445 - RNA, 20 nt, Homo sapiens
uuacuauguaguauuggcuc

SEQ ID NO: 31446 - RNA, 22 nt, Homo sapiens
uuacuggcuuucacugguguua

SEQ ID NO: 31447 - RNA, 22 nt, Homo sapiens
uuagagcacugaucugcucuuu

SEQ ID NO: 31448 - RNA, 17 nt, Homo sapiens
uuagagguagacucauu

SEQ ID NO: 31449 - RNA, 22 nt, Homo sapiens
uuagauaguacuuagggaaaua

SEQ ID NO: 31450 - RNA, 22 nt, Homo sapiens
uuagauguuugacugggccuua

SEQ ID NO: 31451 - RNA, 22 nt, Homo sapiens
uuagauuauugagcauccacug

SEQ ID NO: 31452 - RNA, 22 nt, Homo sapiens
uuagcaauagccugcaucugca

SEQ ID NO: 31453 - RNA, 22 nt, Homo sapiens
uuagcacuugggaguauuuauu

SEQ ID NO: 31454 - RNA, 19 nt, Homo sapiens
ccuuugguuuccaugacau

SEQ ID NO: 31455 - RNA, 22 nt, Homo sapiens
ccuuuuuguaguggaaguagga

SEQ ID NO: 31456 - RNA, 22 nt, Homo sapiens
cgcccuguagcuagcuagaggu

SEQ ID NO: 31457 - RNA, 22 nt, Homo sapiens
cgccugagcugaggaagcugca

SEQ ID NO: 31458 - RNA, 22 nt, Homo sapiens
cggugcaaauguaauugcaguu

SEQ ID NO: 31459 - RNA, 22 nt, Homo sapiens
cguugcacuccagccugggcaa

SEQ ID NO: 31460 - RNA, 22 nt, Homo sapiens
cuaaaacuuucugagugcagca

SEQ ID NO: 31461 - RNA, 16 nt, Homo sapiens
cuaaaaugucuacuug

SEQ ID NO: 31462 - RNA, 22 nt, Homo sapiens
cuaaaguagccaggacugcagg

SEQ ID NO: 31463 - RNA, 23 nt, Homo sapiens
cuaaagucugucacugaggacuu

SEQ ID NO: 31464 - RNA, 19 nt, Homo sapiens
cuaaaugggucccuagugg

SEQ ID NO: 31465 - RNA, 22 nt, Homo sapiens
cuaacacagagguuuauuucuc

SEQ ID NO: 31466 - RNA, 22 nt, Homo sapiens
cuaagugaacugucacugagaa

SEQ ID NO: 31467 - RNA, 22 nt, Homo sapiens
cuaauccugugguagcacucaa

SEQ ID NO: 31468 - RNA, 21 nt, Homo sapiens
cuaaucucacccuuuucuggg

SEQ ID NO: 31469 - RNA, 22 nt, Homo sapiens
cuaauucuggccaaagggauaa

SEQ ID NO: 31470 - RNA, 22 nt, Homo sapiens
cuacagaguaucuaaagaggua

SEQ ID NO: 31471 - RNA, 22 nt, Homo sapiens
cuacagcagcccaguccccgaa

SEQ ID NO: 31472 - RNA, 23 nt, Homo sapiens
cuacuagucaagucuuuuccagu

SEQ ID NO: 31473 - RNA, 22 nt, Homo sapiens
cuacugauuaaaagaacagguc

SEQ ID NO: 31474 - RNA, 22 nt, Homo sapiens
cuagaauguauaaaaccaagcu

SEQ ID NO: 31475 - RNA, 22 nt, Homo sapiens
cuagaggcacagccuaggcacu

SEQ ID NO: 31476 - RNA, 22 nt, Homo sapiens
cuagcagacaggcugggagcag

SEQ ID NO: 31477 - RNA, 22 nt, Homo sapiens
cuagcagcaugagaauggacca

SEQ ID NO: 31478 - RNA, 22 nt, Homo sapiens
cuagcccagugcuccuggauca

SEQ ID NO: 31479 - RNA, 22 nt, Homo sapiens
cuagcuccauauaaagcaggau

SEQ ID NO: 31480 - RNA, 22 nt, Homo sapiens
cuagcugcacuuccugcuacug

SEQ ID NO: 31481 - RNA, 22 nt, Homo sapiens
cuaucucaggcccaggcccuug

SEQ ID NO: 31482 - RNA, 22 nt, Homo sapiens
cuaugcauuuuggaggagggaa

SEQ ID NO: 31483 - RNA, 22 nt, Homo sapiens
cuauggguuauaauucauuagu

SEQ ID NO: 31484 - RNA, 22 nt, Homo sapiens
cuauuacuuuuauugaacucag

SEQ ID NO: 31485 - RNA, 22 nt, Homo sapiens
cuauucacaggcaauauguaca

SEQ ID NO: 31486 - RNA, 22 nt, Homo sapiens
cuauuugguuggugaaaaaagu

SEQ ID NO: 31487 - RNA, 22 nt, Homo sapiens
cucaaagugcugggacuggcug

SEQ ID NO: 31488 - RNA, 22 nt, Homo sapiens
cucaaagugcugggauuggcca

SEQ ID NO: 31489 - RNA, 22 nt, Homo sapiens
cucacagugacacgaaccccca

SEQ ID NO: 31490 - RNA, 22 nt, Homo sapiens
cucacaguucuaaaggcaagaa

SEQ ID NO: 31491 - RNA, 22 nt, Homo sapiens
cucacuaguaaggcuguuuagu

SEQ ID NO: 31492 - RNA, 22 nt, Homo sapiens
cucagcaguggauuuaccacca

SEQ ID NO: 31493 - RNA, 22 nt, Homo sapiens
cucagcuacuugggaagcugag

SEQ ID NO: 31494 - RNA, 22 nt, Homo sapiens
cucaggcacucugauuccagug

SEQ ID NO: 31495 - RNA, 22 nt, Homo sapiens
auggaaacauaagaguauagau

SEQ ID NO: 31496 - RNA, 21 nt, Homo sapiens
auggaaagacugccucuucaa

SEQ ID NO: 31497 - RNA, 19 nt, Homo sapiens
auggaacugcuggagccac

SEQ ID NO: 31498 - RNA, 22 nt, Homo sapiens
auggaagcauaguauucuauug

SEQ ID NO: 31499 - RNA, 22 nt, Homo sapiens
auggaaggagaauggucuuuga

SEQ ID NO: 31500 - RNA, 22 nt, Homo sapiens
auggaaggagaggaaugaauga

SEQ ID NO: 31501 - RNA, 22 nt, Homo sapiens
auggaaugccauuuauaaugga

SEQ ID NO: 31502 - RNA, 22 nt, Homo sapiens
auggaauggcacuuugaagauu

SEQ ID NO: 31503 - RNA, 22 nt, Homo sapiens
auggacagaaaaaaauagaugu

SEQ ID NO: 31504 - RNA, 22 nt, Homo sapiens
auggagaugugcgaacugagua

SEQ ID NO: 31505 - RNA, 22 nt, Homo sapiens
auggagcuugacaguuguagag

SEQ ID NO: 31506 - RNA, 22 nt, Homo sapiens
auggagugagaauggagguucc

SEQ ID NO: 31507 - RNA, 22 nt, Homo sapiens
auggaguguaauauugagagcu

SEQ ID NO: 31508 - RNA, 22 nt, Homo sapiens
auggauagucucacucacauac

SEQ ID NO: 31509 - RNA, 22 nt, Homo sapiens
auggauguucuagggaugugau

SEQ ID NO: 31510 - RNA, 22 nt, Homo sapiens
auggauuuugaacuugagaguu

SEQ ID NO: 31511 - RNA, 22 nt, Homo sapiens
auggcaaaauguuccuaguggu

SEQ ID NO: 31512 - RNA, 22 nt, Homo sapiens
auggcaagaagagcaauuauuu

SEQ ID NO: 31513 - RNA, 22 nt, Homo sapiens
auggcaauaauagcuaccauuu

SEQ ID NO: 31514 - RNA, 22 nt, Homo sapiens
auggcaauguaagucagaaaaa

SEQ ID NO: 31515 - RNA, 22 nt, Homo sapiens
auggcacagacucuuggucaag

SEQ ID NO: 31516 - RNA, 22 nt, Homo sapiens
auggcacagaguagaugcucaa

SEQ ID NO: 31517 - RNA, 22 nt, Homo sapiens
auggcacuaaugggaguuuacu

SEQ ID NO: 31518 - RNA, 22 nt, Homo sapiens
auggcacugccuggcuucaugg

SEQ ID NO: 31519 - RNA, 22 nt, Homo sapiens
auggcacuuuggacugcuagau

SEQ ID NO: 31520 - RNA, 22 nt, Homo sapiens
auggcagcugguuuuacccuag

SEQ ID NO: 31521 - RNA, 22 nt, Homo sapiens
auggcagugagucucuaguauu

SEQ ID NO: 31522 - RNA, 22 nt, Homo sapiens
auggcaguuucacucugggauu

SEQ ID NO: 31523 - RNA, 22 nt, Homo sapiens
auggcaucgucaccuuuucagu

SEQ ID NO: 31524 - RNA, 22 nt, Homo sapiens
auggccauuacuaagaauguuu

SEQ ID NO: 31525 - RNA, 20 nt, Homo sapiens
auggcccugcugggaguguc

SEQ ID NO: 31526 - RNA, 22 nt, Homo sapiens
auggccgggugcgguggcucac

SEQ ID NO: 31527 - RNA, 22 nt, Homo sapiens
auggcguguggcuuggaggcug

SEQ ID NO: 31528 - RNA, 22 nt, Homo sapiens
auggcucuuauuauuuugaggu

SEQ ID NO: 31529 - RNA, 22 nt, Homo sapiens
auggcuuaagacaaccuuucau

SEQ ID NO: 31530 - RNA, 22 nt, Homo sapiens
auggcuuuuuucuugggcacuc

SEQ ID NO: 31531 - RNA, 22 nt, Homo sapiens
augggaaaaucagaaggccugg

SEQ ID NO: 31532 - RNA, 22 nt, Homo sapiens
augggagugugguuagagaccu

SEQ ID NO: 31533 - RNA, 21 nt, Homo sapiens
augggguagaagagaaggcuu

SEQ ID NO: 31534 - RNA, 22 nt, Homo sapiens
augggguaggcuuugcugcagu

SEQ ID NO: 31535 - RNA, 22 nt, Homo sapiens
augggugaguaugaguugacuu

SEQ ID NO: 31536 - RNA, 22 nt, Homo sapiens
augguacuggggucccggaguu

SEQ ID NO: 31537 - RNA, 22 nt, Homo sapiens
auggucccuguuccaugcuccu

SEQ ID NO: 31538 - RNA, 22 nt, Homo sapiens
auggugugugaauuaaauguua

SEQ ID NO: 31539 - RNA, 22 nt, Homo sapiens
auguaaacuacagauuuugggu

SEQ ID NO: 31540 - RNA, 22 nt, Homo sapiens
auguaacuaucugagccauggg

SEQ ID NO: 31541 - RNA, 17 nt, Homo sapiens
auguaauccucaucucu

SEQ ID NO: 31542 - RNA, 22 nt, Homo sapiens
auguaauguuaaauugcuaauu

SEQ ID NO: 31543 - RNA, 22 nt, Homo sapiens
auguaguaugaagaagaugcuu

SEQ ID NO: 31544 - RNA, 22 nt, Homo sapiens
auguauacaugcaggucacagg

SEQ ID NO: 31545 - RNA, 22 nt, Homo sapiens
auguaugagaguuccagcugau

SEQ ID NO: 31546 - RNA, 22 nt, Homo sapiens
augucaaggugggugauaguuu

SEQ ID NO: 31547 - RNA, 22 nt, Homo sapiens
auguccaugagcacauguauca

SEQ ID NO: 31548 - RNA, 22 nt, Homo sapiens
auguccauggaaucuguagcaa

SEQ ID NO: 31549 - RNA, 22 nt, Homo sapiens
augucuagagcaagagaugcug

SEQ ID NO: 31550 - RNA, 22 nt, Homo sapiens
augugacagugguuuuaagcgu

SEQ ID NO: 31551 - RNA, 22 nt, Homo sapiens
augugacugauguaaucagaca

SEQ ID NO: 31552 - RNA, 22 nt, Homo sapiens
augugaugguuaauuuuaugug

SEQ ID NO: 31553 - RNA, 22 nt, Homo sapiens
augugcauaugaagcacagaca

SEQ ID NO: 31554 - RNA, 22 nt, Homo sapiens
augugcuaguaucaaacgagac

SEQ ID NO: 31555 - RNA, 22 nt, Homo sapiens
augcacaucagcuccagggacc

SEQ ID NO: 31556 - RNA, 22 nt, Homo sapiens
augcacaugcgaaaacuugugu

SEQ ID NO: 31557 - RNA, 22 nt, Homo sapiens
augcacuguauaggaucuugcg

SEQ ID NO: 31558 - RNA, 22 nt, Homo sapiens
augcacuguuguuauuggauaa

SEQ ID NO: 31559 - RNA, 22 nt, Homo sapiens
augcagagucccagccccuagc

SEQ ID NO: 31560 - RNA, 22 nt, Homo sapiens
augcagcugaggguaguggagc

SEQ ID NO: 31561 - RNA, 22 nt, Homo sapiens
augcagugugcaacagauuaag

SEQ ID NO: 31562 - RNA, 22 nt, Homo sapiens
augcauauuccugggccucacu

SEQ ID NO: 31563 - RNA, 18 nt, Homo sapiens
augcauauuuuaaguugu

SEQ ID NO: 31564 - RNA, 22 nt, Homo sapiens
augcauggucugaagucaaccu

SEQ ID NO: 31565 - RNA, 22 nt, Homo sapiens
augcaugucaaauuuguagguu

SEQ ID NO: 31566 - RNA, 22 nt, Homo sapiens
augccaagagacaaagggaauc

SEQ ID NO: 31567 - RNA, 22 nt, Homo sapiens
augccacugcacuucagcuugg

SEQ ID NO: 31568 - RNA, 22 nt, Homo sapiens
augccacugcgcucuagccugg

SEQ ID NO: 31569 - RNA, 22 nt, Homo sapiens
augccacuguacucuagccuag

SEQ ID NO: 31570 - RNA, 22 nt, Homo sapiens
augccacuguccuccugccuag

SEQ ID NO: 31571 - RNA, 22 nt, Homo sapiens
augccacuucucuaagucaugu

SEQ ID NO: 31572 - RNA, 22 nt, Homo sapiens
augccagggagaauuguucaag

SEQ ID NO: 31573 - RNA, 22 nt, Homo sapiens
augccaguguccagaguggguu

SEQ ID NO: 31574 - RNA, 19 nt, Homo sapiens
augccuggagaugguuaua

SEQ ID NO: 31575 - RNA, 22 nt, Homo sapiens
augcuguuuugaauucucuaga

SEQ ID NO: 31576 - RNA, 22 nt, Homo sapiens
auggaaagcuguuccuacacaa

SEQ ID NO: 31577 - RNA, 20 nt, Homo sapiens
auggaacugugagccaauua

SEQ ID NO: 31578 - RNA, 22 nt, Homo sapiens
auggaagaaacgauuuucugga

SEQ ID NO: 31579 - RNA, 22 nt, Homo sapiens
auggaagacuccucuuugggua

SEQ ID NO: 31580 - RNA, 22 nt, Homo sapiens
auggaagucucuguuaaguuuc

SEQ ID NO: 31581 - RNA, 22 nt, Homo sapiens
auggaauguauagucauguagg

SEQ ID NO: 31582 - RNA, 21 nt, Homo sapiens
auggacugugugacccugcac

SEQ ID NO: 31583 - RNA, 22 nt, Homo sapiens
auggagagaauuauucucucag

SEQ ID NO: 31584 - RNA, 22 nt, Homo sapiens
auggagaugaauaucaucuguu

SEQ ID NO: 31585 - RNA, 22 nt, Homo sapiens
auggaggacaaugucaccuuca

SEQ ID NO: 31586 - RNA, 22 nt, Homo sapiens
auggaguuuacuuaguguaaua

SEQ ID NO: 31587 - RNA, 22 nt, Homo sapiens
auggaguuugaacaauuuccug

SEQ ID NO: 31588 - RNA, 22 nt, Homo sapiens
auggauauugccuaggguagua

SEQ ID NO: 31589 - RNA, 22 nt, Homo sapiens
auggauuuuggggccagaggca

SEQ ID NO: 31590 - RNA, 22 nt, Homo sapiens
auggcaauaugaugcacuguuu

SEQ ID NO: 31591 - RNA, 22 nt, Homo sapiens
auggcaaugcgauggugacuga

SEQ ID NO: 31592 - RNA, 22 nt, Homo sapiens
auggcacuaaguucaacacuua

SEQ ID NO: 31593 - RNA, 22 nt, Homo sapiens
auggcacuguguccugggguca

SEQ ID NO: 31594 - RNA, 22 nt, Homo sapiens
cucaguacuugcacagaagaac

SEQ ID NO: 31595 - RNA, 20 nt, Homo sapiens
cucagugcacccccauaaaa

SEQ ID NO: 31596 - RNA, 22 nt, Homo sapiens
cucaguggauuagauaaugcac

SEQ ID NO: 31597 - RNA, 22 nt, Homo sapiens
cucaguguuucagcugcucaga

SEQ ID NO: 31598 - RNA, 22 nt, Homo sapiens
cuccaguuucagaaucccaugu

SEQ ID NO: 31599 - RNA, 22 nt, Homo sapiens
cuccaugagauuguugaaguag

SEQ ID NO: 31600 - RNA, 23 nt, Homo sapiens
cuccaugagccguccagggccug

SEQ ID NO: 31601 - RNA, 22 nt, Homo sapiens
cuccauuuggaacagauguccu

SEQ ID NO: 31602 - RNA, 22 nt, Homo sapiens
cucccacccucauuuuuaggca

SEQ ID NO: 31603 - RNA, 22 nt, Homo sapiens
cuccuaaccagggcuguuaguc

SEQ ID NO: 31604 - RNA, 22 nt, Homo sapiens
cuccuguagccccaucaucuuu

SEQ ID NO: 31605 - RNA, 22 nt, Homo sapiens
cucgcuccauuucggugaucaa

SEQ ID NO: 31606 - RNA, 22 nt, Homo sapiens
cucucugagccauggcugcccu

SEQ ID NO: 31607 - RNA, 17 nt, Homo sapiens
cucucugguuuaaagca

SEQ ID NO: 31608 - RNA, 22 nt, Homo sapiens
cucugagccugagguuccuacu

SEQ ID NO: 31609 - RNA, 22 nt, Homo sapiens
cucugguggaagcagggggcaa

SEQ ID NO: 31610 - RNA, 22 nt, Homo sapiens
cucugguuaaggcugaacuaua

SEQ ID NO: 31611 - RNA, 21 nt, Homo sapiens
cucugguuugcauuggauuau

SEQ ID NO: 31612 - RNA, 15 nt, Homo sapiens
cucugguuuuucuuc

SEQ ID NO: 31613 - RNA, 22 nt, Homo sapiens
cucuuacaguguguggugaaag

SEQ ID NO: 31614 - RNA, 22 nt, Homo sapiens
cucuuugaggugagcugcccau

SEQ ID NO: 31615 - RNA, 22 nt, Homo sapiens
cugaaaguuauucaggggcaag

SEQ ID NO: 31616 - RNA, 22 nt, Homo sapiens
cugaaaugaauuauuuucuuuc

SEQ ID NO: 31617 - RNA, 22 nt, Homo sapiens
cugaaggcagguagaauagaga

SEQ ID NO: 31618 - RNA, 22 nt, Homo sapiens
cugaaucauugcauuaucaagg

SEQ ID NO: 31619 - RNA, 22 nt, Homo sapiens
cugaaucauugguuaugaguac

SEQ ID NO: 31620 - RNA, 22 nt, Homo sapiens
cugaauguucuauagaagccgc

SEQ ID NO: 31621 - RNA, 22 nt, Homo sapiens
cugaauguucuggauggaagag

SEQ ID NO: 31622 - RNA, 22 nt, Homo sapiens
cugacucagacacauguauaug

SEQ ID NO: 31623 - RNA, 22 nt, Homo sapiens
cugacuuauguggacuauuuca

SEQ ID NO: 31624 - RNA, 22 nt, Homo sapiens
cugagaagaaacagguaaggac

SEQ ID NO: 31625 - RNA, 22 nt, Homo sapiens
cugagaaugaugauuuccaguu

SEQ ID NO: 31626 - RNA, 22 nt, Homo sapiens
cugagacacucuuaucugcaua

SEQ ID NO: 31627 - RNA, 22 nt, Homo sapiens
cugagacuggguaauguauaaa

SEQ ID NO: 31628 - RNA, 22 nt, Homo sapiens
cugagacuggugauuuaugaag

SEQ ID NO: 31629 - RNA, 22 nt, Homo sapiens
cugagagaugagaccucucacu

SEQ ID NO: 31630 - RNA, 22 nt, Homo sapiens
cugagagugguauguuuaagug

SEQ ID NO: 31631 - RNA, 22 nt, Homo sapiens
cugagauggagucucgcauugu

SEQ ID NO: 31632 - RNA, 22 nt, Homo sapiens
cugagcaagucauuuuguuaaa

SEQ ID NO: 31633 - RNA, 22 nt, Homo sapiens
cugagcaucauggcagaaucuu

SEQ ID NO: 31634 - RNA, 22 nt, Homo sapiens
cugagcaugacaucaugugacu

SEQ ID NO: 31635 - RNA, 22 nt, Homo sapiens
cugagcucauuucuuuugcuac

SEQ ID NO: 31636 - RNA, 22 nt, Homo sapiens
cugaggacaucagggaagcauc

SEQ ID NO: 31637 - RNA, 22 nt, Homo sapiens
cugagguacccacuucaucuca

SEQ ID NO: 31638 - RNA, 22 nt, Homo sapiens
cugagguauaucccauuagaag

SEQ ID NO: 31639 - RNA, 20 nt, Homo sapiens
cugaggugggagaaucgcuu

SEQ ID NO: 31640 - RNA, 22 nt, Homo sapiens
cugaggugggaggauuggcuug

SEQ ID NO: 31641 - RNA, 22 nt, Homo sapiens
cugaggugggaguuuuucucau

SEQ ID NO: 31642 - RNA, 22 nt, Homo sapiens
cugagguuguucuucucagugg

SEQ ID NO: 31643 - RNA, 22 nt, Homo sapiens
cugaguauaacugaccuuauga

SEQ ID NO: 31644 - RNA, 22 nt, Homo sapiens
cugauauuuuaaaauuggcugg

SEQ ID NO: 31645 - RNA, 22 nt, Homo sapiens
cugauauuuuucuggcuugugu

SEQ ID NO: 31646 - RNA, 22 nt, Homo sapiens
cugaucuggaggugucugggga

SEQ ID NO: 31647 - RNA, 22 nt, Homo sapiens
cugauuuguccccagccucaug

SEQ ID NO: 31648 - RNA, 22 nt, Homo sapiens
cugcaagaugcauaggaauuuu

SEQ ID NO: 31649 - RNA, 22 nt, Homo sapiens
cugcaauggagaaagugagacu

SEQ ID NO: 31650 - RNA, 19 nt, Homo sapiens
cugcacugagaaaaggagg

SEQ ID NO: 31651 - RNA, 22 nt, Homo sapiens
cugcagguaggggcagcuuugg

SEQ ID NO: 31652 - RNA, 22 nt, Homo sapiens
cugcaguaaccacuguaggugu

SEQ ID NO: 31653 - RNA, 21 nt, Homo sapiens
cugcauccauuucugagugau

SEQ ID NO: 31654 - RNA, 22 nt, Homo sapiens
cugcauuggguuaugcauuuuu

SEQ ID NO: 31655 - RNA, 22 nt, Homo sapiens
cugccuagaucugaaccuggcu

SEQ ID NO: 31656 - RNA, 17 nt, Homo sapiens
acccagucuuuuugcac

SEQ ID NO: 31657 - RNA, 22 nt, Homo sapiens
acccaguguucaacauucacau

SEQ ID NO: 31658 - RNA, 22 nt, Homo sapiens
acccauacacacauauuuaugu

SEQ ID NO: 31659 - RNA, 20 nt, Homo sapiens
acccucuaggaugauuucuu

SEQ ID NO: 31660 - RNA, 21 nt, Homo sapiens
acccucuaguuuucaacaggc

SEQ ID NO: 31661 - RNA, 22 nt, Homo sapiens
acccugucacucccaucaauuu

SEQ ID NO: 31662 - RNA, 22 nt, Homo sapiens
acccugucagcuggccugggca

SEQ ID NO: 31663 - RNA, 22 nt, Homo sapiens
acccugucauccacauggugcu

SEQ ID NO: 31664 - RNA, 22 nt, Homo sapiens
acccuugaguguguuucaggca

SEQ ID NO: 31665 - RNA, 22 nt, Homo sapiens
accugcacagccgaacauagac

SEQ ID NO: 31666 - RNA, 22 nt, Homo sapiens
accuggacacuuugggcuccuc

SEQ ID NO: 31667 - RNA, 22 nt, Homo sapiens
accugggugcugaugggcuuua

SEQ ID NO: 31668 - RNA, 19 nt, Homo sapiens
accuguagaaaguacaaca

SEQ ID NO: 31669 - RNA, 22 nt, Homo sapiens
acgcagcacauucacagcuaug

SEQ ID NO: 31670 - RNA, 22 nt, Homo sapiens
acggcacugguggaaguguagc

SEQ ID NO: 31671 - RNA, 22 nt, Homo sapiens
acggcaguguggugcggucagg

SEQ ID NO: 31672 - RNA, 22 nt, Homo sapiens
acuaaggcacaauuuucucaua

SEQ ID NO: 31673 - RNA, 22 nt, Homo sapiens
acuacuucuaaguuuuggaaga

SEQ ID NO: 31674 - RNA, 22 nt, Homo sapiens
acuccacuuucaccacagcgga

SEQ ID NO: 31675 - RNA, 22 nt, Homo sapiens
acugagaucuuuaaauaaauaa

SEQ ID NO: 31676 - RNA, 23 nt, Homo sapiens
acugagcaauguuuacauacuug

SEQ ID NO: 31677 - RNA, 22 nt, Homo sapiens
acugcaaugucgaauagagaug

SEQ ID NO: 31678 - RNA, 22 nt, Homo sapiens
acugcacuccaaccuuggugac

SEQ ID NO: 31679 - RNA, 20 nt, Homo sapiens
acugcacuccaaccuuugug

SEQ ID NO: 31680 - RNA, 22 nt, Homo sapiens
acugcacuccagccucccgucu

SEQ ID NO: 31681 - RNA, 22 nt, Homo sapiens
acugcacuccagccucggggac

SEQ ID NO: 31682 - RNA, 22 nt, Homo sapiens
acugcacuccagccucgugaca

SEQ ID NO: 31683 - RNA, 22 nt, Homo sapiens
acugcacuccagccugcccaac

SEQ ID NO: 31684 - RNA, 22 nt, Homo sapiens
acugcacuccagccugcuggau

SEQ ID NO: 31685 - RNA, 22 nt, Homo sapiens
acugcacuccagccuggacgac

SEQ ID NO: 31686 - RNA, 22 nt, Homo sapiens
acugcacuccagccugugagac

SEQ ID NO: 31687 - RNA, 22 nt, Homo sapiens
acugcacuccagccuuagugac

SEQ ID NO: 31688 - RNA, 22 nt, Homo sapiens
acugcacuccaguuccgggcaa

SEQ ID NO: 31689 - RNA, 22 nt, Homo sapiens
acugcacuccggccucgugaca

SEQ ID NO: 31690 - RNA, 22 nt, Homo sapiens
acugcacucuagccccugcgac

SEQ ID NO: 31691 - RNA, 22 nt, Homo sapiens
acugcacucuagcuugggugac

SEQ ID NO: 31692 - RNA, 22 nt, Homo sapiens
acugcacugcagccuggccaac

SEQ ID NO: 31693 - RNA, 22 nt, Homo sapiens
acugcacuucaaccucauugac

SEQ ID NO: 31694 - RNA, 22 nt, Homo sapiens
acugcacuucagccuuggggac

SEQ ID NO: 31695 - RNA, 22 nt, Homo sapiens
acuggcauagggcgggcacagu

SEQ ID NO: 31696 - RNA, 22 nt, Homo sapiens
acuguguguuugucuagcacag

SEQ ID NO: 31697 - RNA, 22 nt, Homo sapiens
acuuauuguggcugacccaaac

SEQ ID NO: 31698 - RNA, 22 nt, Homo sapiens
acuugacacuuauauuacucac

SEQ ID NO: 31699 - RNA, 22 nt, Homo sapiens
acuuugguuuauagaauuuagg

SEQ ID NO: 31700 - RNA, 22 nt, Homo sapiens
acuuuguguuacccagcaagga

SEQ ID NO: 31701 - RNA, 22 nt, Homo sapiens
acuuuuugcaaccauuuggacc

SEQ ID NO: 31702 - RNA, 21 nt, Homo sapiens
agaaaaucuuaugggaaacau

SEQ ID NO: 31703 - RNA, 22 nt, Homo sapiens
agaaaugcagcaugaggcggca

SEQ ID NO: 31704 - RNA, 23 nt, Homo sapiens
agaaaugucuauucagggucccu

SEQ ID NO: 31705 - RNA, 22 nt, Homo sapiens
agaaauguuuacucacccccuu

SEQ ID NO: 31706 - RNA, 20 nt, Homo sapiens
agaagcauugcucucuucag

SEQ ID NO: 31707 - RNA, 22 nt, Homo sapiens
agaaugauccuucucagaggca

SEQ ID NO: 31708 - RNA, 22 nt, Homo sapiens
agacagcugggaaauggagugu

SEQ ID NO: 31709 - RNA, 22 nt, Homo sapiens
agacagcugguagcacuuccug

SEQ ID NO: 31710 - RNA, 20 nt, Homo sapiens
agacaguguggagauuccuu

SEQ ID NO: 31711 - RNA, 22 nt, Homo sapiens
agacaucauuugauggugggag

SEQ ID NO: 31712 - RNA, 22 nt, Homo sapiens
agaccacuuuagagauuguuca

SEQ ID NO: 31713 - RNA, 22 nt, Homo sapiens
agacuagacagaugaacagcac

SEQ ID NO: 31714 - RNA, 22 nt, Homo sapiens
agacuagagggaaaugaguugg

SEQ ID NO: 31715 - RNA, 19 nt, Homo sapiens
agacuggcccaggcgggug

SEQ ID NO: 31716 - RNA, 22 nt, Homo sapiens
agacuuagagagucuauucuau

SEQ ID NO: 31717 - RNA, 21 nt, Homo sapiens
agagaacugaaacaugugacu

SEQ ID NO: 31718 - RNA, 22 nt, Homo sapiens
agagacauugcuccaacucacc

SEQ ID NO: 31719 - RNA, 22 nt, Homo sapiens
agagauacauucugagaagugc

SEQ ID NO: 31720 - RNA, 22 nt, Homo sapiens
agagaucaacugaauuacugga

SEQ ID NO: 31721 - RNA, 22 nt, Homo sapiens
aaccuacauucuuaacuguugc

SEQ ID NO: 31722 - RNA, 22 nt, Homo sapiens
aaccuauaguauugaaaucaag

SEQ ID NO: 31723 - RNA, 22 nt, Homo sapiens
aaccuguaaccauaugaucagu

SEQ ID NO: 31724 - RNA, 22 nt, Homo sapiens
aaccuuuagucagcucuuagga

SEQ ID NO: 31725 - RNA, 22 nt, Homo sapiens
aacuacaucucuuugaggcagg

SEQ ID NO: 31726 - RNA, 22 nt, Homo sapiens
aacuaugucaaauaaaaugagg

SEQ ID NO: 31727 - RNA, 22 nt, Homo sapiens
aacugcucuaauguggugggag

SEQ ID NO: 31728 - RNA, 22 nt, Homo sapiens
aacuggcauaugaacuuguucu

SEQ ID NO: 31729 - RNA, 19 nt, Homo sapiens
aacuggugugagaugauau

SEQ ID NO: 31730 - RNA, 21 nt, Homo sapiens
aacuggugugagaugguaugu

SEQ ID NO: 31731 - RNA, 22 nt, Homo sapiens
aacuugcacuugauugagagcu

SEQ ID NO: 31732 - RNA, 22 nt, Homo sapiens
aagacuguaauccaucuugagu

SEQ ID NO: 31733 - RNA, 22 nt, Homo sapiens
aagagaugaagguccugacugu

SEQ ID NO: 31734 - RNA, 22 nt, Homo sapiens
aagagcauuggauggggagauu

SEQ ID NO: 31735 - RNA, 22 nt, Homo sapiens
aagaggcuguaggauaaugccu

SEQ ID NO: 31736 - RNA, 22 nt, Homo sapiens
aagagguagcagucacaaaaga

SEQ ID NO: 31737 - RNA, 23 nt, Homo sapiens
aagagguaugacuaugaagugga

SEQ ID NO: 31738 - RNA, 22 nt, Homo sapiens
aagagguuauagaguguauacu

SEQ ID NO: 31739 - RNA, 22 nt, Homo sapiens
aagaguuaguaaaauuuccucu

SEQ ID NO: 31740 - RNA, 22 nt, Homo sapiens
aagaucaucauagagggcauga

SEQ ID NO: 31741 - RNA, 22 nt, Homo sapiens
aagaucauucagggaaggcuga

SEQ ID NO: 31742 - RNA, 22 nt, Homo sapiens
aagaugauguuguguuuucacu

SEQ ID NO: 31743 - RNA, 22 nt, Homo sapiens
aagcaccaauaggagauuuguc

SEQ ID NO: 31744 - RNA, 22 nt, Homo sapiens
aagcacccagccucacgccugc

SEQ ID NO: 31745 - RNA, 22 nt, Homo sapiens
aagcacccuuugucuggacaug

SEQ ID NO: 31746 - RNA, 22 nt, Homo sapiens
aagcagacauguucauuuugaa

SEQ ID NO: 31747 - RNA, 20 nt, Homo sapiens
aagcagacauuuggaugaaa

SEQ ID NO: 31748 - RNA, 22 nt, Homo sapiens
aagcaguguggacuaaugggaa

SEQ ID NO: 31749 - RNA, 22 nt, Homo sapiens
aagcaucacauaauggaucaug

SEQ ID NO: 31750 - RNA, 22 nt, Homo sapiens
aagcaucacuggaggcagccau

SEQ ID NO: 31751 - RNA, 22 nt, Homo sapiens
aagcaucauuuggaauuugaga

SEQ ID NO: 31752 - RNA, 22 nt, Homo sapiens
aagcucuuguugaaucuuguca

SEQ ID NO: 31753 - RNA, 20 nt, Homo sapiens
aagcugaguguuuuuuuaau

SEQ ID NO: 31754 - RNA, 22 nt, Homo sapiens
aagcugccaggcaugguggcug

SEQ ID NO: 31755 - RNA, 22 nt, Homo sapiens
aagcuggcauucaugagauuac

SEQ ID NO: 31756 - RNA, 22 nt, Homo sapiens
aagcuggcauucauucguucuu

SEQ ID NO: 31757 - RNA, 22 nt, Homo sapiens
auauuguacugcuacugguucu

SEQ ID NO: 31758 - RNA, 22 nt, Homo sapiens
aucaaaguaggcauauguuuuu

SEQ ID NO: 31759 - RNA, 22 nt, Homo sapiens
aucaaaguaucucaauauggua

SEQ ID NO: 31760 - RNA, 22 nt, Homo sapiens
aucaaaugcuggcagagugccu

SEQ ID NO: 31761 - RNA, 22 nt, Homo sapiens
aucaaauugucauuuuaaggau

SEQ ID NO: 31762 - RNA, 22 nt, Homo sapiens
aucaagccaaagaaaguccuug

SEQ ID NO: 31763 - RNA, 22 nt, Homo sapiens
aucaagcuugacuccuuaaagg

SEQ ID NO: 31764 - RNA, 22 nt, Homo sapiens
aucaaguaguuauacguaaagg

SEQ ID NO: 31765 - RNA, 22 nt, Homo sapiens
aucacagaacuuugagcagaga

SEQ ID NO: 31766 - RNA, 22 nt, Homo sapiens
aucacaggcaaaauuccuucuc

SEQ ID NO: 31767 - RNA, 22 nt, Homo sapiens
aucacagugaaaacagucaauu

SEQ ID NO: 31768 - RNA, 22 nt, Homo sapiens
aucacaguuaagaggugaugaa

SEQ ID NO: 31769 - RNA, 22 nt, Homo sapiens
aucacauggccagguaguaauc

SEQ ID NO: 31770 - RNA, 22 nt, Homo sapiens
aucacauuuauaguggcacgca

SEQ ID NO: 31771 - RNA, 20 nt, Homo sapiens
aucacuggagaaggaaaccu

SEQ ID NO: 31772 - RNA, 22 nt, Homo sapiens
aucacuguccacucaucuuucu

SEQ ID NO: 31773 - RNA, 22 nt, Homo sapiens
aucagagccugugugcccugaa

SEQ ID NO: 31774 - RNA, 23 nt, Homo sapiens
aucagauaguuguagguaugugg

SEQ ID NO: 31775 - RNA, 22 nt, Homo sapiens
aucagauuccacauuuuaucag

SEQ ID NO: 31776 - RNA, 22 nt, Homo sapiens
aucagauuccagaggcagcacc

SEQ ID NO: 31777 - RNA, 22 nt, Homo sapiens
aucagcagcaugaaaacaggcu

SEQ ID NO: 31778 - RNA, 22 nt, Homo sapiens
aucagcaguguaaaaacggacu

SEQ ID NO: 31779 - RNA, 22 nt, Homo sapiens
aucagcauucccaaaugaugug

SEQ ID NO: 31780 - RNA, 22 nt, Homo sapiens
aucaggaaccuuuuuggugugu

SEQ ID NO: 31781 - RNA, 22 nt, Homo sapiens
aucaggcacacauuggaguuug

SEQ ID NO: 31782 - RNA, 22 nt, Homo sapiens
aucagugauugauuuaaagacg

SEQ ID NO: 31783 - RNA, 22 nt, Homo sapiens
aucauaucaucugcaaacaaag

SEQ ID NO: 31784 - RNA, 22 nt, Homo sapiens
aucauccagccccagaagggag

SEQ ID NO: 31785 - RNA, 22 nt, Homo sapiens
aucauccugucaggagcuguga

SEQ ID NO: 31786 - RNA, 22 nt, Homo sapiens
aucauguaguaagacacauuua

SEQ ID NO: 31787 - RNA, 22 nt, Homo sapiens
auccacagugucaauguuguga

SEQ ID NO: 31788 - RNA, 22 nt, Homo sapiens
auccagaugggcuuaauguaau

SEQ ID NO: 31789 - RNA, 22 nt, Homo sapiens
auccaucagacggcaggcguug

SEQ ID NO: 31790 - RNA, 22 nt, Homo sapiens
aucccaguaaaaauggcuucua

SEQ ID NO: 31791 - RNA, 22 nt, Homo sapiens
aucccaguucagccucugacac

SEQ ID NO: 31792 - RNA, 22 nt, Homo sapiens
auccccugcacggggugucauu

SEQ ID NO: 31793 - RNA, 22 nt, Homo sapiens
aucccugaggaauuucugcacu

SEQ ID NO: 31794 - RNA, 22 nt, Homo sapiens
aucccuugacguggagucucug

SEQ ID NO: 31795 - RNA, 22 nt, Homo sapiens
auccugaugacacagugcugca

SEQ ID NO: 31796 - RNA, 21 nt, Homo sapiens
aucgcacaauauaccccugua

SEQ ID NO: 31797 - RNA, 22 nt, Homo sapiens
aucuaaucaucgcaaccuucaa

SEQ ID NO: 31798 - RNA, 16 nt, Homo sapiens
aucucagaccugcuga

SEQ ID NO: 31799 - RNA, 22 nt, Homo sapiens
aucucagagaaaauuacuaaga

SEQ ID NO: 31800 - RNA, 22 nt, Homo sapiens
aucugauggagagcguguggcu

SEQ ID NO: 31801 - RNA, 22 nt, Homo sapiens
aucugcacaucuguguuuuugu

SEQ ID NO: 31802 - RNA, 22 nt, Homo sapiens
acacgugcguauauguacguau

SEQ ID NO: 31803 - RNA, 22 nt, Homo sapiens
acacugcugaguaaauaauuuu

SEQ ID NO: 31804 - RNA, 20 nt, Homo sapiens
acacuggaguaucaaggccc

SEQ ID NO: 31805 - RNA, 20 nt, Homo sapiens
acacuggcuuugagauuuag

SEQ ID NO: 31806 - RNA, 22 nt, Homo sapiens
acacuggguaacauaucuguua

SEQ ID NO: 31807 - RNA, 22 nt, Homo sapiens
acacugucaugucucacaggca

SEQ ID NO: 31808 - RNA, 22 nt, Homo sapiens
acacuuucuagacaagggaaua

SEQ ID NO: 31809 - RNA, 22 nt, Homo sapiens
acagaacugggcuugcuuuugg

SEQ ID NO: 31810 - RNA, 22 nt, Homo sapiens
acagaucagagauauuuagguu

SEQ ID NO: 31811 - RNA, 22 nt, Homo sapiens
acagcacugccaagugacccau

SEQ ID NO: 31812 - RNA, 22 nt, Homo sapiens
acagcagugccccacucuacug

SEQ ID NO: 31813 - RNA, 22 nt, Homo sapiens
acagguacaagggauuaggaug

SEQ ID NO: 31814 - RNA, 22 nt, Homo sapiens
acaguacaugauaaauaaggua

SEQ ID NO: 31815 - RNA, 19 nt, Homo sapiens
acaguaccuggcaugaggu

SEQ ID NO: 31816 - RNA, 21 nt, Homo sapiens
acaguacuugagaucuuuuga

SEQ ID NO: 31817 - RNA, 22 nt, Homo sapiens
acaguacuuuuggauuugugaa

SEQ ID NO: 31818 - RNA, 22 nt, Homo sapiens
acaguagaaaacaauggauuug

SEQ ID NO: 31819 - RNA, 22 nt, Homo sapiens
acagugcuguuguguuuucacg

SEQ ID NO: 31820 - RNA, 22 nt, Homo sapiens
acagugcuuuuguuccucuccu

SEQ ID NO: 31821 - RNA, 22 nt, Homo sapiens
acaguguagugacugccaacuu

SEQ ID NO: 31822 - RNA, 22 nt, Homo sapiens
acagugucaugucguguucccc

SEQ ID NO: 31823 - RNA, 19 nt, Homo sapiens
acagugucucuauaaugau

SEQ ID NO: 31824 - RNA, 22 nt, Homo sapiens
acauacacuagggauguggugu

SEQ ID NO: 31825 - RNA, 22 nt, Homo sapiens
acaucacuguuugauugauuga

SEQ ID NO: 31826 - RNA, 22 nt, Homo sapiens
acaucccaugccuggguacucc

SEQ ID NO: 31827 - RNA, 22 nt, Homo sapiens
acaugcauccaugugaagagac

SEQ ID NO: 31828 - RNA, 22 nt, Homo sapiens
acauggcuuaugaauuuggaga

SEQ ID NO: 31829 - RNA, 23 nt, Homo sapiens
acauguauagacuuuuuuuccuu

SEQ ID NO: 31830 - RNA, 22 nt, Homo sapiens
acauugcucuuaccaaguuugu

SEQ ID NO: 31831 - RNA, 22 nt, Homo sapiens
accacaggguaaaguuagauau

SEQ ID NO: 31832 - RNA, 22 nt, Homo sapiens
accaguagaaucaguggauucu

SEQ ID NO: 31833 - RNA, 22 nt, Homo sapiens
accauugcacuccagcccaggc

SEQ ID NO: 31834 - RNA, 22 nt, Homo sapiens
acccacuagaugccaguggcac

SEQ ID NO: 31835 - RNA, 22 nt, Homo sapiens
acccagaauucagucuuaggcc

SEQ ID NO: 31836 - RNA, 22 nt, Homo sapiens
acccaguaacauaugggaggga

SEQ ID NO: 31837 - RNA, 22 nt, Homo sapiens
augagacuguucuuccucauug

SEQ ID NO: 31838 - RNA, 22 nt, Homo sapiens
augagagcaacaccuucacuug

SEQ ID NO: 31839 - RNA, 22 nt, Homo sapiens
augagauaggaacaaacuuaca

SEQ ID NO: 31840 - RNA, 22 nt, Homo sapiens
augagaugauaggcguucuaac

SEQ ID NO: 31841 - RNA, 22 nt, Homo sapiens
augagaugcaagauuagauggg

SEQ ID NO: 31842 - RNA, 21 nt, Homo sapiens
augagauguuagacuuuagac

SEQ ID NO: 31843 - RNA, 22 nt, Homo sapiens
augagcaaagagaugagacccu

SEQ ID NO: 31844 - RNA, 22 nt, Homo sapiens
augagcacuuguuuugggcaca

SEQ ID NO: 31845 - RNA, 22 nt, Homo sapiens
augagcagaagagauacacugu

SEQ ID NO: 31846 - RNA, 22 nt, Homo sapiens
augagcagaugcuccugccucu

SEQ ID NO: 31847 - RNA, 17 nt, Homo sapiens
augagcucaucauuuuu

SEQ ID NO: 31848 - RNA, 22 nt, Homo sapiens
augagcucauugggugacuggg

SEQ ID NO: 31849 - RNA, 22 nt, Homo sapiens
augaggagauauuaaauaccau

SEQ ID NO: 31850 - RNA, 22 nt, Homo sapiens
augaggcuauaauuuuuaugua

SEQ ID NO: 31851 - RNA, 22 nt, Homo sapiens
augagggaagcucacgugucca

SEQ ID NO: 31852 - RNA, 22 nt, Homo sapiens
augagggagggguggugccgca

SEQ ID NO: 31853 - RNA, 22 nt, Homo sapiens
augaggugggcggcuuggaaga

SEQ ID NO: 31854 - RNA, 22 nt, Homo sapiens
augagguguuuauuguauccug

SEQ ID NO: 31855 - RNA, 22 nt, Homo sapiens
augaguaguugcuaaauauuga

SEQ ID NO: 31856 - RNA, 19 nt, Homo sapiens
augagucugcaagaaccag

SEQ ID NO: 31857 - RNA, 19 nt, Homo sapiens
augaguuaggggaaauuuc

SEQ ID NO: 31858 - RNA, 22 nt, Homo sapiens
augaguuccuuccuugccuagg

SEQ ID NO: 31859 - RNA, 22 nt, Homo sapiens
augaguugaagcuacaagaggc

SEQ ID NO: 31860 - RNA, 22 nt, Homo sapiens
augauagucuugagaagcauuu

SEQ ID NO: 31861 - RNA, 22 nt, Homo sapiens
augauauguuuguagcuaucuc

SEQ ID NO: 31862 - RNA, 22 nt, Homo sapiens
augaucacuguggaaauucagc

SEQ ID NO: 31863 - RNA, 22 nt, Homo sapiens
augaugcaguacuuugggaaca

SEQ ID NO: 31864 - RNA, 22 nt, Homo sapiens
augauuguucucacucaagaga

SEQ ID NO: 31865 - RNA, 22 nt, Homo sapiens
augauuuuuguaucgccugaug

SEQ ID NO: 31866 - RNA, 22 nt, Homo sapiens
augcaaacaucauagaguguac

SEQ ID NO: 31867 - RNA, 22 nt, Homo sapiens
augcaaaucuuaaguaugugug

SEQ ID NO: 31868 - RNA, 19 nt, Homo sapiens
augcaaugucacaggcugc

SEQ ID NO: 31869 - RNA, 22 nt, Homo sapiens
augcaauucuagauugauagua

SEQ ID NO: 31870 - RNA, 22 nt, Homo sapiens
augcacaguccagcccaugugg

SEQ ID NO: 31871 - RNA, 22 nt, Homo sapiens
augcacauggcuaacuuuuuuc

SEQ ID NO: 31872 - RNA, 22 nt, Homo sapiens
augcagacacaaguuauaguaa

SEQ ID NO: 31873 - RNA, 22 nt, Homo sapiens
augcauggagucuuucacaagu

SEQ ID NO: 31874 - RNA, 22 nt, Homo sapiens
augccacagaaauaaccaaaau

SEQ ID NO: 31875 - RNA, 20 nt, Homo sapiens
augccacugagcagugguga

SEQ ID NO: 31876 - RNA, 22 nt, Homo sapiens
augccacugcacucuagccugg

SEQ ID NO: 31877 - RNA, 22 nt, Homo sapiens
augccacugcacuucagccugg

SEQ ID NO: 31878 - RNA, 22 nt, Homo sapiens
augccacugcauaagguuuuca

SEQ ID NO: 31879 - RNA, 22 nt, Homo sapiens
augccauugcacuccagccugg

SEQ ID NO: 31880 - RNA, 22 nt, Homo sapiens
augcuacuggacaauggugacu

SEQ ID NO: 31881 - RNA, 22 nt, Homo sapiens
augcuggugcuagaaacuggaa

SEQ ID NO: 31882 - RNA, 22 nt, Homo sapiens
augcuggugguucacaugcgca

SEQ ID NO: 31883 - RNA, 22 nt, Homo sapiens
auaauaccugccacauuugaau

SEQ ID NO: 31884 - RNA, 22 nt, Homo sapiens
auaauagcugaucauuuagaag

SEQ ID NO: 31885 - RNA, 22 nt, Homo sapiens
auacacuggagcaaaccuggag

SEQ ID NO: 31886 - RNA, 22 nt, Homo sapiens
auacagugaauaucuggggcag

SEQ ID NO: 31887 - RNA, 22 nt, Homo sapiens
auacaguugccauuucuugugc

SEQ ID NO: 31888 - RNA, 22 nt, Homo sapiens
auacaugugcaggucagguuac

SEQ ID NO: 31889 - RNA, 16 nt, Homo sapiens
auaccacagugacaca

SEQ ID NO: 31890 - RNA, 22 nt, Homo sapiens
auacccucugggugguuaguug

SEQ ID NO: 31891 - RNA, 22 nt, Homo sapiens
auacccugucgugagucagaga

SEQ ID NO: 31892 - RNA, 22 nt, Homo sapiens
auacuaugagauaauaaagacu

SEQ ID NO: 31893 - RNA, 22 nt, Homo sapiens
auacuccugucucagcugagau

SEQ ID NO: 31894 - RNA, 22 nt, Homo sapiens
auacuguuuuacaucauugccu

SEQ ID NO: 31895 - RNA, 21 nt, Homo sapiens
auacuugcauccuuggagaga

SEQ ID NO: 31896 - RNA, 22 nt, Homo sapiens
auagaagcugccaacguuucag

SEQ ID NO: 31897 - RNA, 22 nt, Homo sapiens
auagaauguauuaguaaauuug

SEQ ID NO: 31898 - RNA, 22 nt, Homo sapiens
auagacugaguggcuuaaacca

SEQ ID NO: 31899 - RNA, 22 nt, Homo sapiens
auagaucauugucauuuuagau

SEQ ID NO: 31900 - RNA, 22 nt, Homo sapiens
auagcaauuugggaaucagacu

SEQ ID NO: 31901 - RNA, 21 nt, Homo sapiens
auagcacaucagauuuuauua

SEQ ID NO: 31902 - RNA, 22 nt, Homo sapiens
auagcacuuaccacaggcugca

SEQ ID NO: 31903 - RNA, 22 nt, Homo sapiens
auagcagaccaccucucccacu

SEQ ID NO: 31904 - RNA, 22 nt, Homo sapiens
auagcagugugaaaauguacua

SEQ ID NO: 31905 - RNA, 22 nt, Homo sapiens
auagcagugugaaaauugacug

SEQ ID NO: 31906 - RNA, 22 nt, Homo sapiens
auaggacuauugugaggauuaa

SEQ ID NO: 31907 - RNA, 22 nt, Homo sapiens
auaggagcacaaacuauuguga

SEQ ID NO: 31908 - RNA, 22 nt, Homo sapiens
auaggagcacgaacucuagugu

SEQ ID NO: 31909 - RNA, 22 nt, Homo sapiens
auaggcacauuaggaacuuuug

SEQ ID NO: 31910 - RNA, 22 nt, Homo sapiens
auagggcacgagaugugagccu

SEQ ID NO: 31911 - RNA, 19 nt, Homo sapiens
auagggcuagcauauacug

SEQ ID NO: 31912 - RNA, 22 nt, Homo sapiens
auaguauaguugaggauggcau

SEQ ID NO: 31913 - RNA, 21 nt, Homo sapiens
auagugcuagagaguagcagg

SEQ ID NO: 31914 - RNA, 22 nt, Homo sapiens
auagugcugcaagaaacauacg

SEQ ID NO: 31915 - RNA, 22 nt, Homo sapiens
auagugcugcaauaaacauaca

SEQ ID NO: 31916 - RNA, 22 nt, Homo sapiens
auagugcugcagucaauguacg

SEQ ID NO: 31917 - RNA, 22 nt, Homo sapiens
auagugcugccauaaacauacg

SEQ ID NO: 31918 - RNA, 15 nt, Homo sapiens
auauaugcaaugugu

SEQ ID NO: 31919 - RNA, 22 nt, Homo sapiens
auauauguuuucugggaagaaa

SEQ ID NO: 31920 - RNA, 22 nt, Homo sapiens
auaucaacaugguaggguuggu

SEQ ID NO: 31921 - RNA, 22 nt, Homo sapiens
auaucacaaacaagucuguacu

SEQ ID NO: 31922 - RNA, 22 nt, Homo sapiens
auaucacaggaaaggaagauac

SEQ ID NO: 31923 - RNA, 22 nt, Homo sapiens
auaucacagguguuuaccugau

SEQ ID NO: 31924 - RNA, 22 nt, Homo sapiens
auaucagugucuuacuguuuuu

SEQ ID NO: 31925 - RNA, 22 nt, Homo sapiens
auaucugcauugccauuuaugu

SEQ ID NO: 31926 - RNA, 16 nt, Homo sapiens
auaugacuuuaggagg

SEQ ID NO: 31927 - RNA, 22 nt, Homo sapiens
auaugcacuauacacacguaua

SEQ ID NO: 31928 - RNA, 20 nt, Homo sapiens
auaugcauguguuuucacuu

SEQ ID NO: 31929 - RNA, 21 nt, Homo sapiens
auauggaacuggugacguguu

SEQ ID NO: 31930 - RNA, 22 nt, Homo sapiens
auauguauuuuaacguguaagg

SEQ ID NO: 31931 - RNA, 22 nt, Homo sapiens
auaugucuuaguuaccuugggc

SEQ ID NO: 31932 - RNA, 22 nt, Homo sapiens
auauuacuggcuauaucgcaag

SEQ ID NO: 31933 - RNA, 22 nt, Homo sapiens
auauucacagguaucagagauu

SEQ ID NO: 31934 - RNA, 22 nt, Homo sapiens
auauucacuauaugcagaacca

SEQ ID NO: 31935 - RNA, 22 nt, Homo sapiens
auauugacuuucucuuagauca

SEQ ID NO: 31936 - RNA, 22 nt, Homo sapiens
auauugcuugaggccaggaggu

SEQ ID NO: 31937 - RNA, 22 nt, Homo sapiens
auauuggccuaaaauucucuuu

SEQ ID NO: 31938 - RNA, 22 nt, Homo sapiens
cagucacugggauuauggucau

SEQ ID NO: 31939 - RNA, 22 nt, Homo sapiens
cagugcaaagccucugcccaga

SEQ ID NO: 31940 - RNA, 18 nt, Homo sapiens
cagugcaauacaggagag

SEQ ID NO: 31941 - RNA, 23 nt, Homo sapiens
cagugcaugacuguauaugcaaa

SEQ ID NO: 31942 - RNA, 22 nt, Homo sapiens
cagugcaugacuguauauuauc

SEQ ID NO: 31943 - RNA, 22 nt, Homo sapiens
cagugguuuuuagcuugcuggg

SEQ ID NO: 31944 - RNA, 22 nt, Homo sapiens
caguucaugguaggcaccauag

SEQ ID NO: 31945 - RNA, 22 nt, Homo sapiens
cauacaagcuacaaucacaaag

SEQ ID NO: 31946 - RNA, 22 nt, Homo sapiens
cauacagcuaguaaguguaaga

SEQ ID NO: 31947 - RNA, 22 nt, Homo sapiens
cauagcacacguauaccuaugu

SEQ ID NO: 31948 - RNA, 18 nt, Homo sapiens
cauagcacuucagcacau

SEQ ID NO: 31949 - RNA, 22 nt, Homo sapiens
cauauaguaguacuguuagguu

SEQ ID NO: 31950 - RNA, 23 nt, Homo sapiens
caucacagagccuuccuugacuc

SEQ ID NO: 31951 - RNA, 22 nt, Homo sapiens
caucccugucgucaagucucug

SEQ ID NO: 31952 - RNA, 22 nt, Homo sapiens
caugaaagugagaaacuccugg

SEQ ID NO: 31953 - RNA, 22 nt, Homo sapiens
caugaacacugugcggcuuccu

SEQ ID NO: 31954 - RNA, 22 nt, Homo sapiens
caugaugcuagguauggaugaa

SEQ ID NO: 31955 - RNA, 22 nt, Homo sapiens
caugcauuggucuauuauguga

SEQ ID NO: 31956 - RNA, 22 nt, Homo sapiens
caugccacugcacuccaaccug

SEQ ID NO: 31957 - RNA, 22 nt, Homo sapiens
caugccauugcucuccugggug

SEQ ID NO: 31958 - RNA, 22 nt, Homo sapiens
cauggcacauauauaucuaggu

SEQ ID NO: 31959 - RNA, 22 nt, Homo sapiens
cauggcacugagcagguaugca

SEQ ID NO: 31960 - RNA, 23 nt, Homo sapiens
cauggcuguuaacacuguuugag

SEQ ID NO: 31961 - RNA, 22 nt, Homo sapiens
caugguguuaggcacugggaau

SEQ ID NO: 31962 - RNA, 22 nt, Homo sapiens
cauguauagauuccauaguggu

SEQ ID NO: 31963 - RNA, 21 nt, Homo sapiens
caugucacugcacucuagccu

SEQ ID NO: 31964 - RNA, 22 nt, Homo sapiens
cauuccacuggauaaacaaggu

SEQ ID NO: 31965 - RNA, 22 nt, Homo sapiens
cauugcaaugaggucuugcagu

SEQ ID NO: 31966 - RNA, 22 nt, Homo sapiens
cauugcacuccacuccugaaca

SEQ ID NO: 31967 - RNA, 22 nt, Homo sapiens
cauugcacuccagccuaggcaa

SEQ ID NO: 31968 - RNA, 22 nt, Homo sapiens
cauugcacuccagccugccugg

SEQ ID NO: 31969 - RNA, 22 nt, Homo sapiens
cauugcacuccagcuugggcaa

SEQ ID NO: 31970 - RNA, 22 nt, Homo sapiens
cauugcacuccagcuugggcga

SEQ ID NO: 31971 - RNA, 22 nt, Homo sapiens
cauugcacucuagucuggguga

SEQ ID NO: 31972 - RNA, 22 nt, Homo sapiens
cauugcacugcauucugggcaa

SEQ ID NO: 31973 - RNA, 22 nt, Homo sapiens
cauugcaguaagagugggcucu

SEQ ID NO: 31974 - RNA, 22 nt, Homo sapiens
cauugcaguuuuugguguaucu

SEQ ID NO: 31975 - RNA, 20 nt, Homo sapiens
cauugcccuccagccugggc

SEQ ID NO: 31976 - RNA, 22 nt, Homo sapiens
cauugcuaaaagucauauauaa

SEQ ID NO: 31977 - RNA, 22 nt, Homo sapiens
cauuugcacugagacucagcuu

SEQ ID NO: 31978 - RNA, 22 nt, Homo sapiens
cauuugguggcuacagaguaac

SEQ ID NO: 31979 - RNA, 22 nt, Homo sapiens
cauuuuacuuuccagacgugga

SEQ ID NO: 31980 - RNA, 22 nt, Homo sapiens
ccaaauccauccaaaucauaga

SEQ ID NO: 31981 - RNA, 22 nt, Homo sapiens
ccaaggcacugauucuguacuc

SEQ ID NO: 31982 - RNA, 22 nt, Homo sapiens
ccaagugcuuaaaauuucauuu

SEQ ID NO: 31983 - RNA, 22 nt, Homo sapiens
ccacaaccucaacagcaucuau

SEQ ID NO: 31984 - RNA, 19 nt, Homo sapiens
ccacaaugguugaacuaga

SEQ ID NO: 31985 - RNA, 22 nt, Homo sapiens
ccacaguagucuugggaugggc

SEQ ID NO: 31986 - RNA, 22 nt, Homo sapiens
ccacaguggauuaaaguuacug

SEQ ID NO: 31987 - RNA, 22 nt, Homo sapiens
ccacaguugaaauuuugacugu

SEQ ID NO: 31988 - RNA, 22 nt, Homo sapiens
ccacccuuccauucuuccucuu

SEQ ID NO: 31989 - RNA, 22 nt, Homo sapiens
ccaccgggucccagcucugcuc

SEQ ID NO: 31990 - RNA, 22 nt, Homo sapiens
ccacugggcuagguguuuugga

SEQ ID NO: 31991 - RNA, 22 nt, Homo sapiens
ccagaguggagccuuugcgagg

SEQ ID NO: 31992 - RNA, 22 nt, Homo sapiens
ccaggguugcuuuagauucuga

SEQ ID NO: 31993 - RNA, 22 nt, Homo sapiens
ccagucuuggugucuguagcac

SEQ ID NO: 31994 - RNA, 22 nt, Homo sapiens
ccagugcugugcaguguaugag

SEQ ID NO: 31995 - RNA, 21 nt, Homo sapiens
ccagugguuggaaacuauggg

SEQ ID NO: 31996 - RNA, 22 nt, Homo sapiens
ccagugguugggccggagacgg

SEQ ID NO: 31997 - RNA, 22 nt, Homo sapiens
ccagugucugacagacacggcg

SEQ ID NO: 31998 - RNA, 22 nt, Homo sapiens
ccaguguucuggaaggcugagu

SEQ ID NO: 31999 - RNA, 19 nt, Homo sapiens
ccaguguugccagagcuga

SEQ ID NO: 32000 - RNA, 22 nt, Homo sapiens
ccaguguuuggauuagggaugc

SEQ ID NO: 32001 - RNA, 22 nt, Homo sapiens
ccaguuuucucacuguugcagu

SEQ ID NO: 32002 - RNA, 22 nt, Homo sapiens
ccaguuuuucauuuauacuagu

SEQ ID NO: 32003 - RNA, 22 nt, Homo sapiens
ccaucacacugugauuauuauc

SEQ ID NO: 32004 - RNA, 22 nt, Homo sapiens
ccaucacaggccucagugggaa

SEQ ID NO: 32005 - RNA, 22 nt, Homo sapiens
ccaucacgugcaguggccccac

SEQ ID NO: 32006 - RNA, 19 nt, Homo sapiens
ccauggcaaugaucugaug

SEQ ID NO: 32007 - RNA, 22 nt, Homo sapiens
ccauggcuauucuguaaggguu

SEQ ID NO: 32008 - RNA, 22 nt, Homo sapiens
cccagaguucuuaaauacugag

SEQ ID NO: 32009 - RNA, 21 nt, Homo sapiens
cccagguucucugaggguaga

SEQ ID NO: 32010 - RNA, 22 nt, Homo sapiens
cccaguaaucuugccaguuuuc

SEQ ID NO: 32011 - RNA, 19 nt, Homo sapiens
cccagugucagagaagggu

SEQ ID NO: 32012 - RNA, 22 nt, Homo sapiens
cccaguuuugccacuuacuagc

SEQ ID NO: 32013 - RNA, 22 nt, Homo sapiens
ccccagugguugcaacagcaga

SEQ ID NO: 32014 - RNA, 22 nt, Homo sapiens
ccccauuugaacuccuucaacu

SEQ ID NO: 32015 - RNA, 19 nt, Homo sapiens
ccccuguggauaccgaggg

SEQ ID NO: 32016 - RNA, 22 nt, Homo sapiens
cccuaagacagugaggggugca

SEQ ID NO: 32017 - RNA, 22 nt, Homo sapiens
cccuagaucucagcgccuucau

SEQ ID NO: 32018 - RNA, 22 nt, Homo sapiens
cccugagagcagggucuuucuc

SEQ ID NO: 32019 - RNA, 22 nt, Homo sapiens
cccugagaugugaauuucagag

SEQ ID NO: 32020 - RNA, 22 nt, Homo sapiens
cccuguguuuagcugaagguuu

SEQ ID NO: 32021 - RNA, 22 nt, Homo sapiens
cccuugcacuucagagcugcau

SEQ ID NO: 32022 - RNA, 22 nt, Homo sapiens
ccggguguuuuguucucucaga

SEQ ID NO: 32023 - RNA, 22 nt, Homo sapiens
ccucauggagaacuucugcuag

SEQ ID NO: 32024 - RNA, 21 nt, Homo sapiens
ccugaagaagugaccucugag

SEQ ID NO: 32025 - RNA, 22 nt, Homo sapiens
ccugagacugauugacucacaa

SEQ ID NO: 32026 - RNA, 22 nt, Homo sapiens
ccugagacuugagggggcuucu

SEQ ID NO: 32027 - RNA, 22 nt, Homo sapiens
ccugcauaguucaccgcugaua

SEQ ID NO: 32028 - RNA, 19 nt, Homo sapiens
ccugcuguucuuuugcacc

SEQ ID NO: 32029 - RNA, 22 nt, Homo sapiens
ccuggaagaaaggugcuaaaua

SEQ ID NO: 32030 - RNA, 22 nt, Homo sapiens
ccuggaucauugucauucccaa

SEQ ID NO: 32031 - RNA, 22 nt, Homo sapiens
ccuggcacugagcaguguucua

SEQ ID NO: 32032 - RNA, 22 nt, Homo sapiens
ccugucuugaagagauccuccu

SEQ ID NO: 32033 - RNA, 22 nt, Homo sapiens
ccugucuugauuaaauuacuua

SEQ ID NO: 32034 - RNA, 22 nt, Homo sapiens
ccuucauccuccagcaggcuag

SEQ ID NO: 32035 - RNA, 22 nt, Homo sapiens
ccuucuuuuguaaggcugaaua

SEQ ID NO: 32036 - RNA, 22 nt, Homo sapiens
ccuuggcacuuugccacagugc

SEQ ID NO: 32037 - RNA, 22 nt, Homo sapiens
ccuugguggccacaagacauug

SEQ ID NO: 32038 - RNA, 21 nt, Homo sapiens
ccuugguuaucuucccauuca

SEQ ID NO: 32039 - RNA, 22 nt, Homo sapiens
augugcuuaaaaaugcagagaa

SEQ ID NO: 32040 - RNA, 22 nt, Homo sapiens
augugcuugagggaaaucaguu

SEQ ID NO: 32041 - RNA, 22 nt, Homo sapiens
augugcuuuuuaaacagaugcu

SEQ ID NO: 32042 - RNA, 22 nt, Homo sapiens
auguggcuuuccuagaucuuag

SEQ ID NO: 32043 - RNA, 22 nt, Homo sapiens
augugggaggacuuggcuguug

SEQ ID NO: 32044 - RNA, 22 nt, Homo sapiens
auguguauuaccucgauuguga

SEQ ID NO: 32045 - RNA, 22 nt, Homo sapiens
augugugaaucccagaaccugu

SEQ ID NO: 32046 - RNA, 22 nt, Homo sapiens
auguguucaucacagcacaauu

SEQ ID NO: 32047 - RNA, 22 nt, Homo sapiens
auguuagcaucuggcacuaugg

SEQ ID NO: 32048 - RNA, 22 nt, Homo sapiens
auguuauguucuucucuguaua

SEQ ID NO: 32049 - RNA, 22 nt, Homo sapiens
auuaaguuaggauuuugagaua

SEQ ID NO: 32050 - RNA, 22 nt, Homo sapiens
auuaauguaauuaguaaaguug

SEQ ID NO: 32051 - RNA, 22 nt, Homo sapiens
auuacacuuucuauucaaugag

SEQ ID NO: 32052 - RNA, 22 nt, Homo sapiens
auuagguauuuucuggacaggg

SEQ ID NO: 32053 - RNA, 22 nt, Homo sapiens
auuagguuggugcaaaacuuuc

SEQ ID NO: 32054 - RNA, 22 nt, Homo sapiens
auuagguuguugcaaaaguaau

SEQ ID NO: 32055 - RNA, 22 nt, Homo sapiens
auuauaugucaucacagacacc

SEQ ID NO: 32056 - RNA, 22 nt, Homo sapiens
auuauugacucauagaaaggau

SEQ ID NO: 32057 - RNA, 22 nt, Homo sapiens
auucaaggacuggauugcggga

SEQ ID NO: 32058 - RNA, 22 nt, Homo sapiens
auucacuguggguccuuuggau

SEQ ID NO: 32059 - RNA, 20 nt, Homo sapiens
auucauggaggagcaauugg

SEQ ID NO: 32060 - RNA, 21 nt, Homo sapiens
auuccacuuuuccuucaggga

SEQ ID NO: 32061 - RNA, 22 nt, Homo sapiens
auuccagauggaguugaggguu

SEQ ID NO: 32062 - RNA, 23 nt, Homo sapiens
auuccaguggcaauuggagaaac

SEQ ID NO: 32063 - RNA, 22 nt, Homo sapiens
auuccaguuguaagguuuuuca

SEQ ID NO: 32064 - RNA, 22 nt, Homo sapiens
auuccauaguacagugaugagu

SEQ ID NO: 32065 - RNA, 22 nt, Homo sapiens
auuccauuuguuaucacacccg

SEQ ID NO: 32066 - RNA, 22 nt, Homo sapiens
auuccuuaggcccuuugguuag

SEQ ID NO: 32067 - RNA, 22 nt, Homo sapiens
auugaacaugccauauguacca

SEQ ID NO: 32068 - RNA, 22 nt, Homo sapiens
auugaacuguuggagagguuuu

SEQ ID NO: 32069 - RNA, 22 nt, Homo sapiens
auugaacuuacuaucuaaacua

SEQ ID NO: 32070 - RNA, 22 nt, Homo sapiens
auugaaugaaauggcagacacu

SEQ ID NO: 32071 - RNA, 16 nt, Homo sapiens
auugacaguggguguu

SEQ ID NO: 32072 - RNA, 22 nt, Homo sapiens
auugacuugauauauagcugau

SEQ ID NO: 32073 - RNA, 22 nt, Homo sapiens
auugagcacugacucugugcca

SEQ ID NO: 32074 - RNA, 22 nt, Homo sapiens
auugauaguuuaauaggaauug

SEQ ID NO: 32075 - RNA, 22 nt, Homo sapiens
auugcaacuuccgccuccuggg

SEQ ID NO: 32076 - RNA, 22 nt, Homo sapiens
auugcacacagaaucaggguaa

SEQ ID NO: 32077 - RNA, 22 nt, Homo sapiens
auugcacuccagccccggggac

SEQ ID NO: 32078 - RNA, 23 nt, Homo sapiens
auugcacuccagccuaccugggc

SEQ ID NO: 32079 - RNA, 22 nt, Homo sapiens
aucugggguuggcaaaguuugg

SEQ ID NO: 32080 - RNA, 22 nt, Homo sapiens
aucuguguuuaaggucccagaa

SEQ ID NO: 32081 - RNA, 21 nt, Homo sapiens
aucuugguauagucuuauugg

SEQ ID NO: 32082 - RNA, 22 nt, Homo sapiens
aucuuguguugaauggugcaga

SEQ ID NO: 32083 - RNA, 22 nt, Homo sapiens
aucuuuggauacuugauauagu

SEQ ID NO: 32084 - RNA, 22 nt, Homo sapiens
aucuuuggucaucacagcuaga

SEQ ID NO: 32085 - RNA, 22 nt, Homo sapiens
augaaagguugucuuaagccau

SEQ ID NO: 32086 - RNA, 22 nt, Homo sapiens
augaaagucaauccccaagugu

SEQ ID NO: 32087 - RNA, 22 nt, Homo sapiens
augaaaguguguggaaacuuga

SEQ ID NO: 32088 - RNA, 22 nt, Homo sapiens
augaaaucuuuccugugaggau

SEQ ID NO: 32089 - RNA, 22 nt, Homo sapiens
augaacuaugugggauguuuua

SEQ ID NO: 32090 - RNA, 17 nt, Homo sapiens
augaacucaucauuuuu

SEQ ID NO: 32091 - RNA, 22 nt, Homo sapiens
augaagacaucgucugggauua

SEQ ID NO: 32092 - RNA, 22 nt, Homo sapiens
augaagcuagcugauugcugau

SEQ ID NO: 32093 - RNA, 22 nt, Homo sapiens
augaaugcagcacuguuuuucu

SEQ ID NO: 32094 - RNA, 23 nt, Homo sapiens
augaauguaaggaguguaagaaa

SEQ ID NO: 32095 - RNA, 22 nt, Homo sapiens
augacaagaguguucagggaga

SEQ ID NO: 32096 - RNA, 22 nt, Homo sapiens
augacaaugaaucccuguuuca

SEQ ID NO: 32097 - RNA, 23 nt, Homo sapiens
augacacuguccuugaccauuuc

SEQ ID NO: 32098 - RNA, 22 nt, Homo sapiens
augacaguaugacuccaaaagu

SEQ ID NO: 32099 - RNA, 22 nt, Homo sapiens
augacagugagugagcucucac

SEQ ID NO: 32100 - RNA, 22 nt, Homo sapiens
augacauugaugcucuggcugg

SEQ ID NO: 32101 - RNA, 22 nt, Homo sapiens
augaccagagguaugauguuug

SEQ ID NO: 32102 - RNA, 22 nt, Homo sapiens
augaccauuucaauugauaugg

SEQ ID NO: 32103 - RNA, 21 nt, Homo sapiens
augacccuggguguccuuucc

SEQ ID NO: 32104 - RNA, 22 nt, Homo sapiens
augaccuuguccucagugucau

SEQ ID NO: 32105 - RNA, 22 nt, Homo sapiens
augacuaaaggguuuauguuga

SEQ ID NO: 32106 - RNA, 18 nt, Homo sapiens
augacucuggguguuccu

SEQ ID NO: 32107 - RNA, 22 nt, Homo sapiens
augacugagacuaacuuacuuu

SEQ ID NO: 32108 - RNA, 22 nt, Homo sapiens
augacuggaacagcaauuuaca

SEQ ID NO: 32109 - RNA, 22 nt, Homo sapiens
augacugucagggcagucauug

SEQ ID NO: 32110 - RNA, 17 nt, Homo sapiens
augacuucuucagugug

SEQ ID NO: 32111 - RNA, 22 nt, Homo sapiens
augagaauguaaguuaaugaaa

SEQ ID NO: 32112 - RNA, 22 nt, Homo sapiens
augagacauuaaaguguguuug

SEQ ID NO: 32113 - RNA, 22 nt, Homo sapiens
augagaccagcagaaaaccugu

SEQ ID NO: 32114 - RNA, 22 nt, Homo sapiens
augagagcuaacuguggguaca

SEQ ID NO: 32115 - RNA, 22 nt, Homo sapiens
augagaucaaauuuaagcuguu

SEQ ID NO: 32116 - RNA, 22 nt, Homo sapiens
augagaucugugaacaccuguc

SEQ ID NO: 32117 - RNA, 22 nt, Homo sapiens
augagaugaauaccgacgaugu

SEQ ID NO: 32118 - RNA, 22 nt, Homo sapiens
augagauuauguaaagagacca

SEQ ID NO: 32119 - RNA, 22 nt, Homo sapiens
augagauuguuuguacuccaca

SEQ ID NO: 32120 - RNA, 22 nt, Homo sapiens
augagauuguuugugugaaaua

SEQ ID NO: 32121 - RNA, 22 nt, Homo sapiens
augaggaaggagccuuugucug

SEQ ID NO: 32122 - RNA, 22 nt, Homo sapiens
augaggcacugcgcccuacuga

SEQ ID NO: 32123 - RNA, 22 nt, Homo sapiens
augagguaauaaguccuuggaa

SEQ ID NO: 32124 - RNA, 22 nt, Homo sapiens
augagguaguagaaagucaggu

SEQ ID NO: 32125 - RNA, 22 nt, Homo sapiens
augagguauccaagcccagaaa

SEQ ID NO: 32126 - RNA, 22 nt, Homo sapiens
augaggugauuucuguucgggu

SEQ ID NO: 32127 - RNA, 22 nt, Homo sapiens
augaggugggagaaucacuuga

SEQ ID NO: 32128 - RNA, 22 nt, Homo sapiens
augaguaugagaauacauuaag

SEQ ID NO: 32129 - RNA, 22 nt, Homo sapiens
augauaucuuguuuuucaugca

SEQ ID NO: 32130 - RNA, 22 nt, Homo sapiens
augauaugagaaaggaucaaca

SEQ ID NO: 32131 - RNA, 22 nt, Homo sapiens
augaucaucugaaagcuuuuac

SEQ ID NO: 32132 - RNA, 22 nt, Homo sapiens
augaucauggaagugcacccau

SEQ ID NO: 32133 - RNA, 22 nt, Homo sapiens
augaucuguuuggugaucuugu

SEQ ID NO: 32134 - RNA, 22 nt, Homo sapiens
augauggaggccgugauggacg

SEQ ID NO: 32135 - RNA, 19 nt, Homo sapiens
augauugucuauggaggaa

SEQ ID NO: 32136 - RNA, 22 nt, Homo sapiens
augcaaacagcuaucuggcugg

SEQ ID NO: 32137 - RNA, 22 nt, Homo sapiens
augcaagcacacaagaggaaau

SEQ ID NO: 32138 - RNA, 22 nt, Homo sapiens
augcaauggaaaggacaauuac

SEQ ID NO: 32139 - RNA, 22 nt, Homo sapiens
augcacauauguacugcccuau

SEQ ID NO: 32140 - RNA, 18 nt, Homo sapiens
aaaaagugcucaggccua

SEQ ID NO: 32141 - RNA, 22 nt, Homo sapiens
aaaagcuuagaugggcuuguau

SEQ ID NO: 32142 - RNA, 22 nt, Homo sapiens
aaaaggcuagcuaguaacagaa

SEQ ID NO: 32143 - RNA, 22 nt, Homo sapiens
aaaaguucuuugagccuugaca

SEQ ID NO: 32144 - RNA, 22 nt, Homo sapiens
aaacaccacgcggucccucgga

SEQ ID NO: 32145 - RNA, 22 nt, Homo sapiens
aaacccauauaccagcugugcu

SEQ ID NO: 32146 - RNA, 15 nt, Homo sapiens
aaacccugucucaag

SEQ ID NO: 32147 - RNA, 22 nt, Homo sapiens
aaacugccuuccuuguaggugc

SEQ ID NO: 32148 - RNA, 18 nt, Homo sapiens
aaacugcuuccuuggccu

SEQ ID NO: 32149 - RNA, 21 nt, Homo sapiens
aaacuggcccaauuguuccau

SEQ ID NO: 32150 - RNA, 22 nt, Homo sapiens
aaaggcacugaucuuauccagu

SEQ ID NO: 32151 - RNA, 22 nt, Homo sapiens
aaaguacucaguucaguuccgu

SEQ ID NO: 32152 - RNA, 20 nt, Homo sapiens
aaaguaggcuaauaccaaaa

SEQ ID NO: 32153 - RNA, 22 nt, Homo sapiens
aaaguaguagcaguuucugcca

SEQ ID NO: 32154 - RNA, 22 nt, Homo sapiens
aaagucuagaggaucaugugug

SEQ ID NO: 32155 - RNA, 18 nt, Homo sapiens
aaagugaugucauucuuu

SEQ ID NO: 32156 - RNA, 22 nt, Homo sapiens
aaagugcacuuggaagagggcc

SEQ ID NO: 32157 - RNA, 22 nt, Homo sapiens
aaagugcuaggauuaccugggg

SEQ ID NO: 32158 - RNA, 22 nt, Homo sapiens
aaagugcugagauuguaggcau

SEQ ID NO: 32159 - RNA, 22 nt, Homo sapiens
aaagugcugggauuuuaggcau

SEQ ID NO: 32160 - RNA, 22 nt, Homo sapiens
aaagugcuguagacugggcgca

SEQ ID NO: 32161 - RNA, 22 nt, Homo sapiens
aaaguucuugcugaaggauuau

SEQ ID NO: 32162 - RNA, 22 nt, Homo sapiens
aaaucccuugcucucucagacc

SEQ ID NO: 32163 - RNA, 21 nt, Homo sapiens
aaaugcacauuacugcuggug

SEQ ID NO: 32164 - RNA, 22 nt, Homo sapiens
aaaugcaugaggugggaagaaa

SEQ ID NO: 32165 - RNA, 22 nt, Homo sapiens
aaaugcauggacagcuggucuu

SEQ ID NO: 32166 - RNA, 22 nt, Homo sapiens
aaaugcauugagggaaaaggca

SEQ ID NO: 32167 - RNA, 18 nt, Homo sapiens
aaaugcucuucuggaaua

SEQ ID NO: 32168 - RNA, 22 nt, Homo sapiens
aaaugcugucugugagccucau

SEQ ID NO: 32169 - RNA, 22 nt, Homo sapiens
aaauggcaccggcucuucccuc

SEQ ID NO: 32170 - RNA, 22 nt, Homo sapiens
aaauggcuuugaggguaggaca

SEQ ID NO: 32171 - RNA, 22 nt, Homo sapiens
aaauucaugucaccucuaggua

SEQ ID NO: 32172 - RNA, 22 nt, Homo sapiens
aaauugcaaugcgaggcagagg

SEQ ID NO: 32173 - RNA, 22 nt, Homo sapiens
aaauugcaguuaggaugauggu

SEQ ID NO: 32174 - RNA, 22 nt, Homo sapiens
aaauuguccuacugguuugagu

SEQ ID NO: 32175 - RNA, 22 nt, Homo sapiens
aacaccauuuuucugcagccuu

SEQ ID NO: 32176 - RNA, 22 nt, Homo sapiens
aacaccuugcagggauuaugac

SEQ ID NO: 32177 - RNA, 22 nt, Homo sapiens
aacacggcccgcagagcaagcu

SEQ ID NO: 32178 - RNA, 22 nt, Homo sapiens
aacacuggcugcucgaguucuc

SEQ ID NO: 32179 - RNA, 22 nt, Homo sapiens
aacacuguuuccagucaugauc

SEQ ID NO: 32180 - RNA, 22 nt, Homo sapiens
aacagaauccucuuuuccuggg

SEQ ID NO: 32181 - RNA, 22 nt, Homo sapiens
aacagucaauugcugaugaccu

SEQ ID NO: 32182 - RNA, 22 nt, Homo sapiens
aacauugaacuuggcacaccca

SEQ ID NO: 32183 - RNA, 22 nt, Homo sapiens
aacccugagucaugagucuaga

SEQ ID NO: 32184 - RNA, 22 nt, Homo sapiens
aaccuucauuccuuucccugcc

SEQ ID NO: 32185 - RNA, 22 nt, Homo sapiens
aacuaggccuagaaguugagua

SEQ ID NO: 32186 - RNA, 22 nt, Homo sapiens
aacugcacauauuuguaugggu

SEQ ID NO: 32187 - RNA, 22 nt, Homo sapiens
aacuggcauguuuuaaggcuua

SEQ ID NO: 32188 - RNA, 22 nt, Homo sapiens
aacuggccuggcgugcagaggg

SEQ ID NO: 32189 - RNA, 22 nt, Homo sapiens
aacuggucuuuggaggaggagg

SEQ ID NO: 32190 - RNA, 19 nt, Homo sapiens
aacuggugugagaugguau

SEQ ID NO: 32191 - RNA, 21 nt, Homo sapiens
aagaaagcuggacuugccgcu

SEQ ID NO: 32192 - RNA, 20 nt, Homo sapiens
aagacacuguccccacugga

SEQ ID NO: 32193 - RNA, 22 nt, Homo sapiens
aagaccuaugcaggaagaaaug

SEQ ID NO: 32194 - RNA, 22 nt, Homo sapiens
gagugcaauggcagaucuccgc

SEQ ID NO: 32195 - RNA, 22 nt, Homo sapiens
gagugcaauggcgcgaucuggg

SEQ ID NO: 32196 - RNA, 22 nt, Homo sapiens
gagugcaauggugcuaucucgg

SEQ ID NO: 32197 - RNA, 22 nt, Homo sapiens
gagugcauaugggccuguguca

SEQ ID NO: 32198 - RNA, 22 nt, Homo sapiens
gagugcuguuagcccuggguuu

SEQ ID NO: 32199 - RNA, 22 nt, Homo sapiens
gaguucaauuuccagcuguucu

SEQ ID NO: 32200 - RNA, 22 nt, Homo sapiens
gaguucauuuugaaaccuugau

SEQ ID NO: 32201 - RNA, 19 nt, Homo sapiens
gaguugggguuuacuguaa

SEQ ID NO: 32202 - RNA, 22 nt, Homo sapiens
gaguuuguacuaauuuguugua

SEQ ID NO: 32203 - RNA, 22 nt, Homo sapiens
gauacaguaugcaugugguauu

SEQ ID NO: 32204 - RNA, 19 nt, Homo sapiens
gauagacaucacagugcca

SEQ ID NO: 32205 - RNA, 22 nt, Homo sapiens
gauaucuuuuguauggugagcu

SEQ ID NO: 32206 - RNA, 22 nt, Homo sapiens
gauaugaguagucgcauugaug

SEQ ID NO: 32207 - RNA, 22 nt, Homo sapiens
gauauguacagcucucuaggau

SEQ ID NO: 32208 - RNA, 22 nt, Homo sapiens
gauaugugauaagaguuaucuu

SEQ ID NO: 32209 - RNA, 22 nt, Homo sapiens
gauauguuagggggagaaguua

SEQ ID NO: 32210 - RNA, 22 nt, Homo sapiens
gauauguucuuucacguuggug

SEQ ID NO: 32211 - RNA, 22 nt, Homo sapiens
gauauguugaguagaguuuuug

SEQ ID NO: 32212 - RNA, 22 nt, Homo sapiens
gaucacaugggagaaugagagu

SEQ ID NO: 32213 - RNA, 22 nt, Homo sapiens
gaucacuuugaugccaggaacu

SEQ ID NO: 32214 - RNA, 22 nt, Homo sapiens
gaucagagugaaccuuguuaug

SEQ ID NO: 32215 - RNA, 22 nt, Homo sapiens
gaucugugugauuggaugcauu

SEQ ID NO: 32216 - RNA, 22 nt, Homo sapiens
gugagauacuagagauauagug

SEQ ID NO: 32217 - RNA, 22 nt, Homo sapiens
gugagauccucucuuauauggg

SEQ ID NO: 32218 - RNA, 22 nt, Homo sapiens
gugagaugguaucucauugugg

SEQ ID NO: 32219 - RNA, 22 nt, Homo sapiens
gugagauuagcugagauccuug

SEQ ID NO: 32220 - RNA, 22 nt, Homo sapiens
gugagcaauugauacuugaagu

SEQ ID NO: 32221 - RNA, 22 nt, Homo sapiens
gugagcauaacaacagaguuua

SEQ ID NO: 32222 - RNA, 22 nt, Homo sapiens
gugaggcugguccugccuccca

SEQ ID NO: 32223 - RNA, 22 nt, Homo sapiens
gugagggaugugaaaaagguca

SEQ ID NO: 32224 - RNA, 17 nt, Homo sapiens
gugagguggguaguauc

SEQ ID NO: 32225 - RNA, 22 nt, Homo sapiens
gugaggugguacaauauuaacu

SEQ ID NO: 32226 - RNA, 22 nt, Homo sapiens
gugagucaugucccaucugauu

SEQ ID NO: 32227 - RNA, 22 nt, Homo sapiens
gugaguuauuauuuauguaaac

SEQ ID NO: 32228 - RNA, 21 nt, Homo sapiens
gugaucaugucacugcacucc

SEQ ID NO: 32229 - RNA, 22 nt, Homo sapiens
gugaucucagcucacuggaacc

SEQ ID NO: 32230 - RNA, 22 nt, Homo sapiens
gugauguguuuguucuaucucu

SEQ ID NO: 32231 - RNA, 20 nt, Homo sapiens
gugauuggucacugguuguu

SEQ ID NO: 32232 - RNA, 22 nt, Homo sapiens
gugauuguuaaacugccucucu

SEQ ID NO: 32233 - RNA, 22 nt, Homo sapiens
gugcaaacuccaggucucuuca

SEQ ID NO: 32234 - RNA, 18 nt, Homo sapiens
gugcaaugaauagcagag

SEQ ID NO: 32235 - RNA, 22 nt, Homo sapiens
gugcacaacaugcagguuuguu

SEQ ID NO: 32236 - RNA, 22 nt, Homo sapiens
gugcacauauggugcauaagug

SEQ ID NO: 32237 - RNA, 22 nt, Homo sapiens
gugcacaugguagguauugagu

SEQ ID NO: 32238 - RNA, 22 nt, Homo sapiens
gugcacgucuuaggaggucacg

SEQ ID NO: 32239 - RNA, 22 nt, Homo sapiens
gugcagaugucuuuauaguagc

SEQ ID NO: 32240 - RNA, 23 nt, Homo sapiens
gugcaguggcgagauuucggcuc

SEQ ID NO: 32241 - RNA, 19 nt, Homo sapiens
gugcauaguuauuaaagag

SEQ ID NO: 32242 - RNA, 22 nt, Homo sapiens
gugcauaucugugguuggcuga

SEQ ID NO: 32243 - RNA, 22 nt, Homo sapiens
gugcaugcaucuuuauaguagc

SEQ ID NO: 32244 - RNA, 22 nt, Homo sapiens
gugccacugcaccuggccuaag

SEQ ID NO: 32245 - RNA, 22 nt, Homo sapiens
gugccacugcacuccggccugg

SEQ ID NO: 32246 - RNA, 23 nt, Homo sapiens
gugccuucugagccuagucucca

SEQ ID NO: 32247 - RNA, 22 nt, Homo sapiens
gugcuauguuauccagcaagau

SEQ ID NO: 32248 - RNA, 22 nt, Homo sapiens
gugcucauuuagagagaagcac

SEQ ID NO: 32249 - RNA, 22 nt, Homo sapiens
gugcuuuguuguggcaguggca

SEQ ID NO: 32250 - RNA, 22 nt, Homo sapiens
guggaaaacauaugcuuguuga

SEQ ID NO: 32251 - RNA, 20 nt, Homo sapiens
guggaagauaaguagccuga

SEQ ID NO: 32252 - RNA, 22 nt, Homo sapiens
guggaagugucuggggccaggg

SEQ ID NO: 32253 - RNA, 22 nt, Homo sapiens
guggaauacuaugaugguggau

SEQ ID NO: 32254 - RNA, 22 nt, Homo sapiens
guggaauggaaugauuguguau

SEQ ID NO: 32255 - RNA, 22 nt, Homo sapiens
guggagcuguguggccuugggc

SEQ ID NO: 32256 - RNA, 22 nt, Homo sapiens
guggaggacuggauaaagaaaa

SEQ ID NO: 32257 - RNA, 18 nt, Homo sapiens
guggagugucuuccugga

SEQ ID NO: 32258 - RNA, 22 nt, Homo sapiens
guggaucacuugagguuagaag

SEQ ID NO: 32259 - RNA, 22 nt, Homo sapiens
guggcaaagaugccuucuccaa

SEQ ID NO: 32260 - RNA, 22 nt, Homo sapiens
guggcaaggaaaugcugcucac

SEQ ID NO: 32261 - RNA, 22 nt, Homo sapiens
guggcagaaaagagaagcaaug

SEQ ID NO: 32262 - RNA, 22 nt, Homo sapiens
guggcagaacagguaggguucu

SEQ ID NO: 32263 - RNA, 22 nt, Homo sapiens
guggcagcacauauagguuguu

SEQ ID NO: 32264 - RNA, 22 nt, Homo sapiens
guggcaugaaagcagauaccac

SEQ ID NO: 32265 - RNA, 23 nt, Homo sapiens
guggccuuuggccaguccgaguc

SEQ ID NO: 32266 - RNA, 20 nt, Homo sapiens
gugggcaaauccuuuccucu

SEQ ID NO: 32267 - RNA, 22 nt, Homo sapiens
gugggguaggguaggacucaac

SEQ ID NO: 32268 - RNA, 22 nt, Homo sapiens
gugguagaaauguagaugcuag

SEQ ID NO: 32269 - RNA, 22 nt, Homo sapiens
gugguauaaguaccuccuuuca

SEQ ID NO: 32270 - RNA, 19 nt, Homo sapiens
gugguauuaccuuuugauu

SEQ ID NO: 32271 - RNA, 22 nt, Homo sapiens
guggucagaaaucucaguggca

SEQ ID NO: 32272 - RNA, 22 nt, Homo sapiens
gugguguuugagcugccaggga

SEQ ID NO: 32273 - RNA, 21 nt, Homo sapiens
gugguucuagagaaacagaau

SEQ ID NO: 32274 - RNA, 22 nt, Homo sapiens
gugguuuuaauauucagucuag

SEQ ID NO: 32275 - RNA, 22 nt, Homo sapiens
gugguuuuuuucugccuuauag

SEQ ID NO: 32276 - RNA, 22 nt, Homo sapiens
guguaaaacaauuagaggauuu

SEQ ID NO: 32277 - RNA, 22 nt, Homo sapiens
guguaaaugagugcugaaggag

SEQ ID NO: 32278 - RNA, 22 nt, Homo sapiens
guguaauacauuagcaaaccaa

SEQ ID NO: 32279 - RNA, 22 nt, Homo sapiens
guguagagaaauagccugaagg

SEQ ID NO: 32280 - RNA, 22 nt, Homo sapiens
guguauucaucuggcugaggua

SEQ ID NO: 32281 - RNA, 22 nt, Homo sapiens
gugucacagcuuccaucucggu

SEQ ID NO: 32282 - RNA, 22 nt, Homo sapiens
gugucacugugaggauauugua

SEQ ID NO: 32283 - RNA, 22 nt, Homo sapiens
gugucaugagggggacaggaag

SEQ ID NO: 32284 - RNA, 22 nt, Homo sapiens
gugugauggcgcacacagggug

SEQ ID NO: 32285 - RNA, 22 nt, Homo sapiens
gugugauuguuaauuuuaggug

SEQ ID NO: 32286 - RNA, 22 nt, Homo sapiens
gugugcaacuuucauuaauauu

SEQ ID NO: 32287 - RNA, 22 nt, Homo sapiens
gugugcaauuuugugggaggca

SEQ ID NO: 32288 - RNA, 21 nt, Homo sapiens
gugugcuugagugaugggauu

SEQ ID NO: 32289 - RNA, 22 nt, Homo sapiens
guguggaacucaauacaacgca

SEQ ID NO: 32290 - RNA, 22 nt, Homo sapiens
guguguaaauggcagugagcuc

SEQ ID NO: 32291 - RNA, 22 nt, Homo sapiens
guguuauggagccaaacuacua

SEQ ID NO: 32292 - RNA, 22 nt, Homo sapiens
guguuauugagaaauagggugu

SEQ ID NO: 32293 - RNA, 22 nt, Homo sapiens
guuaagaaguguaacuuaaguu

SEQ ID NO: 32294 - RNA, 22 nt, Homo sapiens
guuaagggaagccuggguaaga

SEQ ID NO: 32295 - RNA, 22 nt, Homo sapiens
gugcaaugaguguggcaaagcc

SEQ ID NO: 32296 - RNA, 22 nt, Homo sapiens
gugcaaugucaggagaugcagc

SEQ ID NO: 32297 - RNA, 22 nt, Homo sapiens
gugcaauguuaauuacuugacu

SEQ ID NO: 32298 - RNA, 22 nt, Homo sapiens
gugcacaacgugcaaguuuguu

SEQ ID NO: 32299 - RNA, 22 nt, Homo sapiens
gugcacaugcgugcgcacauau

SEQ ID NO: 32300 - RNA, 22 nt, Homo sapiens
gugcacuguagaacccuuuguu

SEQ ID NO: 32301 - RNA, 22 nt, Homo sapiens
gugcaguguuugcauggaauca

SEQ ID NO: 32302 - RNA, 23 nt, Homo sapiens
gugcaugagucuuuauaguagca

SEQ ID NO: 32303 - RNA, 22 nt, Homo sapiens
gugcaugucuaugcgagucuaa

SEQ ID NO: 32304 - RNA, 22 nt, Homo sapiens
gugccuuuucugagcaaugagc

SEQ ID NO: 32305 - RNA, 16 nt, Homo sapiens
gugcuguguuguuagg

SEQ ID NO: 32306 - RNA, 22 nt, Homo sapiens
gugcuuauccccauucuggagg

SEQ ID NO: 32307 - RNA, 22 nt, Homo sapiens
gugcuuguauuuaaaucaugug

SEQ ID NO: 32308 - RNA, 22 nt, Homo sapiens
uaugaaucuggcuacuccaggg

SEQ ID NO: 32309 - RNA, 20 nt, Homo sapiens
uaugacaaagccuagugagu

SEQ ID NO: 32310 - RNA, 22 nt, Homo sapiens
uaugacuuuugaauacagaugg

SEQ ID NO: 32311 - RNA, 22 nt, Homo sapiens
uaugagaugaggccacugggua

SEQ ID NO: 32312 - RNA, 22 nt, Homo sapiens
uaugagcaaaaugaggguuagu

SEQ ID NO: 32313 - RNA, 22 nt, Homo sapiens
uaugagguagguaugacuauca

SEQ ID NO: 32314 - RNA, 22 nt, Homo sapiens
uaugcagacauuguuccaacca

SEQ ID NO: 32315 - RNA, 22 nt, Homo sapiens
uaugccuuuuggcucaagaaac

SEQ ID NO: 32316 - RNA, 22 nt, Homo sapiens
uaugcuuauuaaaacagugugu

SEQ ID NO: 32317 - RNA, 22 nt, Homo sapiens
uauggcacacguuuaccuaugu

SEQ ID NO: 32318 - RNA, 22 nt, Homo sapiens
uauggcccuuaaguauugguug

SEQ ID NO: 32319 - RNA, 22 nt, Homo sapiens
uauggccugaauuagaaaagug

SEQ ID NO: 32320 - RNA, 22 nt, Homo sapiens
uauggcucuauuuccuugucua

SEQ ID NO: 32321 - RNA, 22 nt, Homo sapiens
uauggcuucuauaaggaagcuu

SEQ ID NO: 32322 - RNA, 22 nt, Homo sapiens
uauggcuuucuacuugaguucu

SEQ ID NO: 32323 - RNA, 22 nt, Homo sapiens
uauggcuuuuaacugucguaug

SEQ ID NO: 32324 - RNA, 22 nt, Homo sapiens
uauggguuuuucauaaauaggu

SEQ ID NO: 32325 - RNA, 21 nt, Homo sapiens
uaugguuucuaauucugcagg

SEQ ID NO: 32326 - RNA, 22 nt, Homo sapiens
uaugucauggguaaagugcccu

SEQ ID NO: 32327 - RNA, 22 nt, Homo sapiens
uaugucuauuauguagcaggaa

SEQ ID NO: 32328 - RNA, 22 nt, Homo sapiens
uaugugcaaauuaauugcuaga

SEQ ID NO: 32329 - RNA, 22 nt, Homo sapiens
uauuaagcuaguugucagugcu

SEQ ID NO: 32330 - RNA, 22 nt, Homo sapiens
uauuacagaccauaucgccggg

SEQ ID NO: 32331 - RNA, 22 nt, Homo sapiens
uauuacuugucugugucucaau

SEQ ID NO: 32332 - RNA, 22 nt, Homo sapiens
uauuagguuggggcaaaaguaa

SEQ ID NO: 32333 - RNA, 22 nt, Homo sapiens
uauuagguugguggaaaaguaa

SEQ ID NO: 32334 - RNA, 22 nt, Homo sapiens
uauuaguuuucuguggauuaca

SEQ ID NO: 32335 - RNA, 22 nt, Homo sapiens
uauuauagugauaggucuacug

SEQ ID NO: 32336 - RNA, 22 nt, Homo sapiens
uauucaucuuaagcuuuggcuu

SEQ ID NO: 32337 - RNA, 22 nt, Homo sapiens
uauuccuuuugcauuuccacau

SEQ ID NO: 32338 - RNA, 22 nt, Homo sapiens
uauugauuuucaguguucagcu

SEQ ID NO: 32339 - RNA, 22 nt, Homo sapiens
uauugcaaauggugaucccagg

SEQ ID NO: 32340 - RNA, 22 nt, Homo sapiens
uauugcacuuuuccauaggagu

SEQ ID NO: 32341 - RNA, 22 nt, Homo sapiens
uauugcuacuuugccuuccaaa

SEQ ID NO: 32342 - RNA, 22 nt, Homo sapiens
uauugcuggcacauaguagguc

SEQ ID NO: 32343 - RNA, 22 nt, Homo sapiens
uauugcuugaggaaaugguaau

SEQ ID NO: 32344 - RNA, 18 nt, Homo sapiens
uauugcuugguuuggaga

SEQ ID NO: 32345 - RNA, 22 nt, Homo sapiens
uauuguuaaagauguuaaugau

SEQ ID NO: 32346 - RNA, 22 nt, Homo sapiens
uauuugcacucccaucauggug

SEQ ID NO: 32347 - RNA, 22 nt, Homo sapiens
uauuugguuacuugaauagcua

SEQ ID NO: 32348 - RNA, 22 nt, Homo sapiens
ucaaaaucucuuagcugugucu

SEQ ID NO: 32349 - RNA, 22 nt, Homo sapiens
ucaaacacuccauaucgcgauu

SEQ ID NO: 32350 - RNA, 22 nt, Homo sapiens
ucaaaguaaagccucaggaugg

SEQ ID NO: 32351 - RNA, 22 nt, Homo sapiens
ucaaagugacaaaguugcagca

SEQ ID NO: 32352 - RNA, 22 nt, Homo sapiens
ucaaaugauucagaagccaccu

SEQ ID NO: 32353 - RNA, 22 nt, Homo sapiens
ucaaauguuuguuuaaggcuua

SEQ ID NO: 32354 - RNA, 20 nt, Homo sapiens
ucaaauucuuggccuccagc

SEQ ID NO: 32355 - RNA, 22 nt, Homo sapiens
ucaacacaguuaaauggggaaa

SEQ ID NO: 32356 - RNA, 22 nt, Homo sapiens
ucaacaggucaauugcauagaa

SEQ ID NO: 32357 - RNA, 22 nt, Homo sapiens
ucaagcaauucuccucucagcc

SEQ ID NO: 32358 - RNA, 18 nt, Homo sapiens
ucaagcaauugucaugcc

SEQ ID NO: 32359 - RNA, 22 nt, Homo sapiens
ucaaggcacuagcugagcugca

SEQ ID NO: 32360 - RNA, 22 nt, Homo sapiens
ucaaggcaguggccuuccuucu

SEQ ID NO: 32361 - RNA, 22 nt, Homo sapiens
ucaaguacuuauuugauaauua

SEQ ID NO: 32362 - RNA, 23 nt, Homo sapiens
ucaagugaugguggccacaaggg

SEQ ID NO: 32363 - RNA, 22 nt, Homo sapiens
ucaagugcauaugcuaacgguu

SEQ ID NO: 32364 - RNA, 22 nt, Homo sapiens
ucaaugaaugaugguugguaug

SEQ ID NO: 32365 - RNA, 22 nt, Homo sapiens
ucacaauggcugaacuaauuua

SEQ ID NO: 32366 - RNA, 22 nt, Homo sapiens
ucacaauucucaauuugugaaa

SEQ ID NO: 32367 - RNA, 22 nt, Homo sapiens
ucacacugaaacuaggguguga

SEQ ID NO: 32368 - RNA, 22 nt, Homo sapiens
ucacacuguuuugauuauuaua

SEQ ID NO: 32369 - RNA, 22 nt, Homo sapiens
ucacagacauugaggggaccuu

SEQ ID NO: 32370 - RNA, 22 nt, Homo sapiens
ucacagaggagaagaccuuuaa

SEQ ID NO: 32371 - RNA, 22 nt, Homo sapiens
ucacagaugaggcgagaggcag

SEQ ID NO: 32372 - RNA, 21 nt, Homo sapiens
ucacagccuaggaccugaaga

SEQ ID NO: 32373 - RNA, 22 nt, Homo sapiens
ucacagucugcgugaugagaca

SEQ ID NO: 32374 - RNA, 22 nt, Homo sapiens
ucacagugcaggaucaguuaau

SEQ ID NO: 32375 - RNA, 23 nt, Homo sapiens
ucacaguggcugcuuaauuguga

SEQ ID NO: 32376 - RNA, 22 nt, Homo sapiens
ucacaguguuaaaccuuucuuu

SEQ ID NO: 32377 - RNA, 23 nt, Homo sapiens
ucacaguuacuuuugcaucaacc

SEQ ID NO: 32378 - RNA, 22 nt, Homo sapiens
ucacauagcauaaugucugcaa

SEQ ID NO: 32379 - RNA, 22 nt, Homo sapiens
ucacauaguuuucgggaccuug

SEQ ID NO: 32380 - RNA, 22 nt, Homo sapiens
ucacauggaaaaguccaguaaa

SEQ ID NO: 32381 - RNA, 22 nt, Homo sapiens
ucacauggcagagaagaagcuc

SEQ ID NO: 32382 - RNA, 22 nt, Homo sapiens
ucacaugucagccguggggaag

SEQ ID NO: 32383 - RNA, 22 nt, Homo sapiens
ucacauguguaugagcuuugau

SEQ ID NO: 32384 - RNA, 22 nt, Homo sapiens
ucacauuguacaaacagguaag

SEQ ID NO: 32385 - RNA, 22 nt, Homo sapiens
ucacauuguuauguaaauguuu

SEQ ID NO: 32386 - RNA, 22 nt, Homo sapiens
ucaccaguaauaaagagccugc

SEQ ID NO: 32387 - RNA, 22 nt, Homo sapiens
ucaccucgugaucugcccacuu

SEQ ID NO: 32388 - RNA, 22 nt, Homo sapiens
ucaccuguagcuaagaccuaau

SEQ ID NO: 32389 - RNA, 23 nt, Homo sapiens
ucacggagaccugcaagaccaau

SEQ ID NO: 32390 - RNA, 21 nt, Homo sapiens
ucacuaguaaaaggugaacug

SEQ ID NO: 32391 - RNA, 22 nt, Homo sapiens
ucacuauagaaaacagugugga

SEQ ID NO: 32392 - RNA, 22 nt, Homo sapiens
ucacugaggucugagcuuuaug

SEQ ID NO: 32393 - RNA, 22 nt, Homo sapiens
ucacugcacucuccgccuugcg

SEQ ID NO: 32394 - RNA, 22 nt, Homo sapiens
ucacugcgaccucugccucccg

SEQ ID NO: 32395 - RNA, 19 nt, Homo sapiens
ucacuggacagcacacuca

SEQ ID NO: 32396 - RNA, 22 nt, Homo sapiens
ucacuggcaaauauauccguug

SEQ ID NO: 32397 - RNA, 20 nt, Homo sapiens
ucacugugaacuucuugagg

SEQ ID NO: 32398 - RNA, 22 nt, Homo sapiens
ucacuguggaacucaaaaagcu

SEQ ID NO: 32399 - RNA, 22 nt, Homo sapiens
ucacugugguuuugaugugcau

SEQ ID NO: 32400 - RNA, 22 nt, Homo sapiens
ucacuuuguuuuuggauaaguu

SEQ ID NO: 32401 - RNA, 22 nt, Homo sapiens
ucagaaccuccuagcaguguuc

SEQ ID NO: 32402 - RNA, 22 nt, Homo sapiens
ucagaccauuucauuacagacu

SEQ ID NO: 32403 - RNA, 22 nt, Homo sapiens
ucagagucuagaucacucacug

SEQ ID NO: 32404 - RNA, 22 nt, Homo sapiens
ucagagugcagggaguagcagc

SEQ ID NO: 32405 - RNA, 22 nt, Homo sapiens
ucagaguggccucucuugaaga

SEQ ID NO: 32406 - RNA, 22 nt, Homo sapiens
ucagagugguuguaccauuuga

SEQ ID NO: 32407 - RNA, 22 nt, Homo sapiens
ucagaucacuggcgcuggcgga

SEQ ID NO: 32408 - RNA, 22 nt, Homo sapiens
ggcucaguugcaaaucaguuca

SEQ ID NO: 32409 - RNA, 21 nt, Homo sapiens
ggcucuguggucucagguuuc

SEQ ID NO: 32410 - RNA, 22 nt, Homo sapiens
gggaaaaugucuauugaaugaa

SEQ ID NO: 32411 - RNA, 22 nt, Homo sapiens
gggaagauauaggcugggcacc

SEQ ID NO: 32412 - RNA, 22 nt, Homo sapiens
gggaagugugguuucuuuacag

SEQ ID NO: 32413 - RNA, 18 nt, Homo sapiens
gggaauauggggaguuga

SEQ ID NO: 32414 - RNA, 22 nt, Homo sapiens
gggaauggaagacauuaugaug

SEQ ID NO: 32415 - RNA, 22 nt, Homo sapiens
gggaauguagcaaaucugcaau

SEQ ID NO: 32416 - RNA, 22 nt, Homo sapiens
gggagguaggaguuauuauuuu

SEQ ID NO: 32417 - RNA, 22 nt, Homo sapiens
gggaggucauuguaaggucuua

SEQ ID NO: 32418 - RNA, 22 nt, Homo sapiens
gggaguagagaguuucucugac

SEQ ID NO: 32419 - RNA, 22 nt, Homo sapiens
gggaugaaguugauguagaaag

SEQ ID NO: 32420 - RNA, 22 nt, Homo sapiens
gggauguaaaagugggcacauu

SEQ ID NO: 32421 - RNA, 22 nt, Homo sapiens
gggauguuuuauacugagccug

SEQ ID NO: 32422 - RNA, 22 nt, Homo sapiens
gggcaaauuauguaucucucag

SEQ ID NO: 32423 - RNA, 20 nt, Homo sapiens
gggcaaguaugugggaaguc

SEQ ID NO: 32424 - RNA, 18 nt, Homo sapiens
gggcaaguugccuggcuu

SEQ ID NO: 32425 - RNA, 22 nt, Homo sapiens
gggcaugauggugcacacaugu

SEQ ID NO: 32426 - RNA, 22 nt, Homo sapiens
gggcauguggacuuguauguuu

SEQ ID NO: 32427 - RNA, 22 nt, Homo sapiens
gggguauguaagugagugagug

SEQ ID NO: 32428 - RNA, 22 nt, Homo sapiens
ggggucauuaaauuccgcuggu

SEQ ID NO: 32429 - RNA, 17 nt, Homo sapiens
gggucaccuugcaggua

SEQ ID NO: 32430 - RNA, 15 nt, Homo sapiens
ggguccucucccaaa

SEQ ID NO: 32431 - RNA, 22 nt, Homo sapiens
gguaaguuuggggcuaauuugu

SEQ ID NO: 32432 - RNA, 22 nt, Homo sapiens
gguauguaggucuacgguacaa

SEQ ID NO: 32433 - RNA, 22 nt, Homo sapiens
gguauuuaaaguaccugucugc

SEQ ID NO: 32434 - RNA, 22 nt, Homo sapiens
ggucaacaucaucaugguaagu

SEQ ID NO: 32435 - RNA, 19 nt, Homo sapiens
ggucacagggguuacaagg

SEQ ID NO: 32436 - RNA, 22 nt, Homo sapiens
ggucaggagaaugguaacugag

SEQ ID NO: 32437 - RNA, 22 nt, Homo sapiens
ggucauggauaagauccagaag

SEQ ID NO: 32438 - RNA, 22 nt, Homo sapiens
ggucauggauguuuauaguaca

SEQ ID NO: 32439 - RNA, 22 nt, Homo sapiens
ggucuagagagagggguggacu

SEQ ID NO: 32440 - RNA, 22 nt, Homo sapiens
ggugacagugguuaaaauuugu

SEQ ID NO: 32441 - RNA, 22 nt, Homo sapiens
ggugagaaaaacauagucucag

SEQ ID NO: 32442 - RNA, 21 nt, Homo sapiens
ggugagaaaggagacauagac

SEQ ID NO: 32443 - RNA, 22 nt, Homo sapiens
ggugagauguucagacgaacug

SEQ ID NO: 32444 - RNA, 23 nt, Homo sapiens
ggugaggaguacagagucuucau

SEQ ID NO: 32445 - RNA, 22 nt, Homo sapiens
ggugaguggugcuuaaguucag

SEQ ID NO: 32446 - RNA, 22 nt, Homo sapiens
ggugaucauugucucuaguaug

SEQ ID NO: 32447 - RNA, 22 nt, Homo sapiens
gguggcaaaucugaguggcgcu

SEQ ID NO: 32448 - RNA, 22 nt, Homo sapiens
gguggcuuuuugugauggcuga

SEQ ID NO: 32449 - RNA, 22 nt, Homo sapiens
gguggucuuccccuggaguucg

SEQ ID NO: 32450 - RNA, 22 nt, Homo sapiens
gguguuccccuuaccucuuggc

SEQ ID NO: 32451 - RNA, 22 nt, Homo sapiens
guaaacuuccccucaugaauga

SEQ ID NO: 32452 - RNA, 22 nt, Homo sapiens
guaaaguaaagcacaucaaggu

SEQ ID NO: 32453 - RNA, 22 nt, Homo sapiens
guaaauguccugcuacagagug

SEQ ID NO: 32454 - RNA, 22 nt, Homo sapiens
guaacacaugcugcucucuggu

SEQ ID NO: 32455 - RNA, 22 nt, Homo sapiens
guaacaccaguuauaucaguuc

SEQ ID NO: 32456 - RNA, 22 nt, Homo sapiens
guaacccuguaggccuaaagua

SEQ ID NO: 32457 - RNA, 22 nt, Homo sapiens
guaacucugucacuuacuaguu

SEQ ID NO: 32458 - RNA, 22 nt, Homo sapiens
guaagagcauguaguggcucua

SEQ ID NO: 32459 - RNA, 22 nt, Homo sapiens
guaaggaguaguguaacagugc

SEQ ID NO: 32460 - RNA, 22 nt, Homo sapiens
guaaggcuucuggucaacagca

SEQ ID NO: 32461 - RNA, 22 nt, Homo sapiens
guaaucucaccuacuugggagg

SEQ ID NO: 32462 - RNA, 22 nt, Homo sapiens
guaaucucagcuacucaggagg

SEQ ID NO: 32463 - RNA, 22 nt, Homo sapiens
guacaguaguaaaagugaauga

SEQ ID NO: 32464 - RNA, 22 nt, Homo sapiens
guacaguggguguagggaccag

SEQ ID NO: 32465 - RNA, 22 nt, Homo sapiens
guacaugcauacaugcacaucu

SEQ ID NO: 32466 - RNA, 22 nt, Homo sapiens
guacauguaugcaugcaugcau

SEQ ID NO: 32467 - RNA, 22 nt, Homo sapiens
guagaagcacaggugaguuggu

SEQ ID NO: 32468 - RNA, 22 nt, Homo sapiens
guagaauguauguauaacgcaa

SEQ ID NO: 32469 - RNA, 22 nt, Homo sapiens
guagagugcugggcacuggcuc

SEQ ID NO: 32470 - RNA, 22 nt, Homo sapiens
guagaucucaacacuggaagua

SEQ ID NO: 32471 - RNA, 22 nt, Homo sapiens
guagcagaacauguuccuugua

SEQ ID NO: 32472 - RNA, 22 nt, Homo sapiens
guagcagucacauagcagauug

SEQ ID NO: 32473 - RNA, 22 nt, Homo sapiens
guagguaaguacuucuggugag

SEQ ID NO: 32474 - RNA, 22 nt, Homo sapiens
guagugcaguuugagaaucagu

SEQ ID NO: 32475 - RNA, 22 nt, Homo sapiens
guaguggcaugaucuuggcuca

SEQ ID NO: 32476 - RNA, 22 nt, Homo sapiens
guaguuuaucagaaagaauagg

SEQ ID NO: 32477 - RNA, 22 nt, Homo sapiens
guauccugaaguucucagcacu

SEQ ID NO: 32478 - RNA, 22 nt, Homo sapiens
guauuaguuaucuacugcugug

SEQ ID NO: 32479 - RNA, 22 nt, Homo sapiens
guauugacuaucaaucaugugc

SEQ ID NO: 32480 - RNA, 19 nt, Homo sapiens
guauuugacuuucuuguuu

SEQ ID NO: 32481 - RNA, 22 nt, Homo sapiens
guauuuggugaugccuccaaac

SEQ ID NO: 32482 - RNA, 22 nt, Homo sapiens
gucaaagugauuguaauuaggu

SEQ ID NO: 32483 - RNA, 22 nt, Homo sapiens
gucacagcuggcauugucugca

SEQ ID NO: 32484 - RNA, 22 nt, Homo sapiens
gucacaguguuuguucauccca

SEQ ID NO: 32485 - RNA, 22 nt, Homo sapiens
gucaccagcuguguuagccccu

SEQ ID NO: 32486 - RNA, 22 nt, Homo sapiens
gucacuggcugucuuguaugau

SEQ ID NO: 32487 - RNA, 21 nt, Homo sapiens
gucacuggggcuggauaauuc

SEQ ID NO: 32488 - RNA, 22 nt, Homo sapiens
gucacugggugcugcgccuguc

SEQ ID NO: 32489 - RNA, 22 nt, Homo sapiens
gucaggaugauuuggggaggug

SEQ ID NO: 32490 - RNA, 22 nt, Homo sapiens
gucagggagggauagaugauua

SEQ ID NO: 32491 - RNA, 22 nt, Homo sapiens
gucagguaccugaaagcagcca

SEQ ID NO: 32492 - RNA, 22 nt, Homo sapiens
gucaggugcuuacgcggagauc

SEQ ID NO: 32493 - RNA, 22 nt, Homo sapiens
gucagucugucccugccuggcg

SEQ ID NO: 32494 - RNA, 22 nt, Homo sapiens
gucagugugauaucugcagggg

SEQ ID NO: 32495 - RNA, 22 nt, Homo sapiens
gucauauaggguuuaccuguau

SEQ ID NO: 32496 - RNA, 21 nt, Homo sapiens
gucauaugucucugauuagug

SEQ ID NO: 32497 - RNA, 22 nt, Homo sapiens
uaacccugaggggcuuggggac

SEQ ID NO: 32498 - RNA, 22 nt, Homo sapiens
uaacccuuaguaucuguggguu

SEQ ID NO: 32499 - RNA, 22 nt, Homo sapiens
uaacuaguggaauuugauuuca

SEQ ID NO: 32500 - RNA, 22 nt, Homo sapiens
uaacuauagagaauguugagua

SEQ ID NO: 32501 - RNA, 22 nt, Homo sapiens
uaacugcaaccucugccugcug

SEQ ID NO: 32502 - RNA, 18 nt, Homo sapiens
uaacuggugugagauggu

SEQ ID NO: 32503 - RNA, 22 nt, Homo sapiens
uaacuguggaaaugacuuuaaa

SEQ ID NO: 32504 - RNA, 18 nt, Homo sapiens
uaacugugggaacuaacu

SEQ ID NO: 32505 - RNA, 22 nt, Homo sapiens
uaagacacauguguucccaggc

SEQ ID NO: 32506 - RNA, 22 nt, Homo sapiens
uaagacuguguaauuuaugaag

SEQ ID NO: 32507 - RNA, 19 nt, Homo sapiens
ucagaucagcccaagggau

SEQ ID NO: 32508 - RNA, 22 nt, Homo sapiens
ucagaucaugcuuaugauggga

SEQ ID NO: 32509 - RNA, 22 nt, Homo sapiens
ucagaugaugucccuguucuaa

SEQ ID NO: 32510 - RNA, 22 nt, Homo sapiens
ucagaugauuccguugacgaga

SEQ ID NO: 32511 - RNA, 22 nt, Homo sapiens
ucagauguuuuguuuaucugcu

SEQ ID NO: 32512 - RNA, 22 nt, Homo sapiens
ucagcacauucaaggccugccu

SEQ ID NO: 32513 - RNA, 19 nt, Homo sapiens
ucagcaguaaucaacuuca

SEQ ID NO: 32514 - RNA, 20 nt, Homo sapiens
ucagcagucuggagcagagg

SEQ ID NO: 32515 - RNA, 22 nt, Homo sapiens
ucagcaucacgugggcucccgu

SEQ ID NO: 32516 - RNA, 21 nt, Homo sapiens
ucagcucaucacugccuggag

SEQ ID NO: 32517 - RNA, 21 nt, Homo sapiens
ucaggaccucuaguuagccag

SEQ ID NO: 32518 - RNA, 21 nt, Homo sapiens
ucagggaccugcuguacugau

SEQ ID NO: 32519 - RNA, 22 nt, Homo sapiens
ucagguaaucuauuugucuuuu

SEQ ID NO: 32520 - RNA, 20 nt, Homo sapiens
ucagguagaucuuugagguc

SEQ ID NO: 32521 - RNA, 22 nt, Homo sapiens
ucagguagcauuuuggaaacag

SEQ ID NO: 32522 - RNA, 22 nt, Homo sapiens
ucagguagugccaugauugauu

SEQ ID NO: 32523 - RNA, 22 nt, Homo sapiens
ucagguugcuaaguauaauauu

SEQ ID NO: 32524 - RNA, 22 nt, Homo sapiens
ucaguaaauguuaggacauuuc

SEQ ID NO: 32525 - RNA, 23 nt, Homo sapiens
ucaguacuccacuuucaauagug

SEQ ID NO: 32526 - RNA, 22 nt, Homo sapiens
ucaguagcauugcuuauacagu

SEQ ID NO: 32527 - RNA, 23 nt, Homo sapiens
ucaguagucauugggaaagugug

SEQ ID NO: 32528 - RNA, 20 nt, Homo sapiens
ucaguauauuguuuccacag

SEQ ID NO: 32529 - RNA, 18 nt, Homo sapiens
ucagucacugccuggcuu

SEQ ID NO: 32530 - RNA, 22 nt, Homo sapiens
ucagugauugcuuucauggaaa

SEQ ID NO: 32531 - RNA, 20 nt, Homo sapiens
ucagugauugguuuaguuau

SEQ ID NO: 32532 - RNA, 19 nt, Homo sapiens
ucagugcuauguaauguag

SEQ ID NO: 32533 - RNA, 22 nt, Homo sapiens
ucaguggauuauuaaagucacc

SEQ ID NO: 32534 - RNA, 22 nt, Homo sapiens
ucagugguuaaaagauucuaga

SEQ ID NO: 32535 - RNA, 22 nt, Homo sapiens
ucagugucaucuggguuguuug

SEQ ID NO: 32536 - RNA, 22 nt, Homo sapiens
ucagugucugugauggagaggu

SEQ ID NO: 32537 - RNA, 22 nt, Homo sapiens
ucagugucugugcaccgcugga

SEQ ID NO: 32538 - RNA, 22 nt, Homo sapiens
ucauacuguccaauucuagugg

SEQ ID NO: 32539 - RNA, 18 nt, Homo sapiens
ucauagaucaugacagug

SEQ ID NO: 32540 - RNA, 22 nt, Homo sapiens
ucauagucuaagguucuuuugc

SEQ ID NO: 32541 - RNA, 22 nt, Homo sapiens
ucauaugucauaguaugaucuu

SEQ ID NO: 32542 - RNA, 22 nt, Homo sapiens
ucauauugcgguucauugacuu

SEQ ID NO: 32543 - RNA, 21 nt, Homo sapiens
ucaucaagcuguagacaugau

SEQ ID NO: 32544 - RNA, 23 nt, Homo sapiens
ucaucacagcauuuccugguauu

SEQ ID NO: 32545 - RNA, 22 nt, Homo sapiens
ucaucagaaucccuuagggaug

SEQ ID NO: 32546 - RNA, 22 nt, Homo sapiens
ucaucagaguuuacaagcucag

SEQ ID NO: 32547 - RNA, 22 nt, Homo sapiens
ucaucagugcuugcaaauuauu

SEQ ID NO: 32548 - RNA, 22 nt, Homo sapiens
ucaugaaguaguuaacugguug

SEQ ID NO: 32549 - RNA, 20 nt, Homo sapiens
ucaugccacugcgcuccagc

SEQ ID NO: 32550 - RNA, 22 nt, Homo sapiens
ucauggcacugaugagaguuuc

SEQ ID NO: 32551 - RNA, 22 nt, Homo sapiens
ucauggggugagcuacaggcac

SEQ ID NO: 32552 - RNA, 22 nt, Homo sapiens
ucauggggugcuuugcuagauu

SEQ ID NO: 32553 - RNA, 23 nt, Homo sapiens
ucauguauucccuguaaugggua

SEQ ID NO: 32554 - RNA, 22 nt, Homo sapiens
ucauuagagacagggugucacu

SEQ ID NO: 32555 - RNA, 22 nt, Homo sapiens
ucauugagacuuguuuuguggc

SEQ ID NO: 32556 - RNA, 22 nt, Homo sapiens
ucauugcacucccagacacccu

SEQ ID NO: 32557 - RNA, 22 nt, Homo sapiens
ucauugcauguuaauuaaacag

SEQ ID NO: 32558 - RNA, 18 nt, Homo sapiens
ucauuggugagcaccucc

SEQ ID NO: 32559 - RNA, 22 nt, Homo sapiens
ucauugguucuggguguuguug

SEQ ID NO: 32560 - RNA, 22 nt, Homo sapiens
uccacaauggcugaacuagauu

SEQ ID NO: 32561 - RNA, 19 nt, Homo sapiens
uccaccgcgugcaccucua

SEQ ID NO: 32562 - RNA, 22 nt, Homo sapiens
uccacguggucuaucuguccuu

SEQ ID NO: 32563 - RNA, 22 nt, Homo sapiens
uccacugagcuagaccacuugg

SEQ ID NO: 32564 - RNA, 22 nt, Homo sapiens
uccagguuucaugcucuuuauu

SEQ ID NO: 32565 - RNA, 22 nt, Homo sapiens
uccaguggacagacauaccaug

SEQ ID NO: 32566 - RNA, 22 nt, Homo sapiens
uccaguguuccucagucacccc

SEQ ID NO: 32567 - RNA, 22 nt, Homo sapiens
uccaguuguuauuuuuauaaag

SEQ ID NO: 32568 - RNA, 22 nt, Homo sapiens
uccaguuuuguuaacauauggu

SEQ ID NO: 32569 - RNA, 19 nt, Homo sapiens
uccaugagcccacagugau

SEQ ID NO: 32570 - RNA, 22 nt, Homo sapiens
uccauggagacacauuuuauau

SEQ ID NO: 32571 - RNA, 22 nt, Homo sapiens
uccauguagaugcuauguuguc

SEQ ID NO: 32572 - RNA, 19 nt, Homo sapiens
ucccaauguuuccaggcag

SEQ ID NO: 32573 - RNA, 22 nt, Homo sapiens
ucccaguauucauuuacagaag

SEQ ID NO: 32574 - RNA, 22 nt, Homo sapiens
ucccagugaaaccccaccuuca

SEQ ID NO: 32575 - RNA, 22 nt, Homo sapiens
uccccggaugacggccgcuuca

SEQ ID NO: 32576 - RNA, 19 nt, Homo sapiens
uccccgggucuagugcagc

SEQ ID NO: 32577 - RNA, 22 nt, Homo sapiens
uccccugauaccaaccaccaug

SEQ ID NO: 32578 - RNA, 22 nt, Homo sapiens
uccccuuuguaagauggaaacg

SEQ ID NO: 32579 - RNA, 22 nt, Homo sapiens
ucccuacuggggcacugccuag

SEQ ID NO: 32580 - RNA, 20 nt, Homo sapiens
ucccucaaacuuuuccacug

SEQ ID NO: 32581 - RNA, 22 nt, Homo sapiens
ucccugagcaaaguuuucugua

SEQ ID NO: 32582 - RNA, 22 nt, Homo sapiens
ucccugaguaucuaauguguuu

SEQ ID NO: 32583 - RNA, 22 nt, Homo sapiens
ucccugguguuaguuuguucuu

SEQ ID NO: 32584 - RNA, 22 nt, Homo sapiens
ucccuguagugccuagaucaga

SEQ ID NO: 32585 - RNA, 22 nt, Homo sapiens
ucccuuucuggaguuucccaag

SEQ ID NO: 32586 - RNA, 22 nt, Homo sapiens
uccugagaauagaguugcaugu

SEQ ID NO: 32587 - RNA, 22 nt, Homo sapiens
uccuugagccugggaguuauag

SEQ ID NO: 32588 - RNA, 22 nt, Homo sapiens
uccuuuaguuaauaaagacaag

SEQ ID NO: 32589 - RNA, 22 nt, Homo sapiens
uccuuuggguagcuguucagau

SEQ ID NO: 32590 - RNA, 22 nt, Homo sapiens
uccuuugguuauaggcaccucu

SEQ ID NO: 32591 - RNA, 22 nt, Homo sapiens
uccuuugguucuugucacccca

SEQ ID NO: 32592 - RNA, 22 nt, Homo sapiens
uccuuuguuacaguuggcucug

SEQ ID NO: 32593 - RNA, 20 nt, Homo sapiens
ucgcaccacuauacuccagc

SEQ ID NO: 32594 - RNA, 22 nt, Homo sapiens
ucgcugggaaccagagguaaag

SEQ ID NO: 32595 - RNA, 22 nt, Homo sapiens
ucgcugggaagacugaaguguc

SEQ ID NO: 32596 - RNA, 23 nt, Homo sapiens
ucgguccccuuggcugcccucgg

SEQ ID NO: 32597 - RNA, 22 nt, Homo sapiens
ucuaaaguacuacuacuguugg

SEQ ID NO: 32598 - RNA, 22 nt, Homo sapiens
gugucucagcccagaccuauuu

SEQ ID NO: 32599 - RNA, 22 nt, Homo sapiens
gugucuccugccuucaugcagc

SEQ ID NO: 32600 - RNA, 22 nt, Homo sapiens
gugugacugcucuauuagggcg

SEQ ID NO: 32601 - RNA, 22 nt, Homo sapiens
gugugcauaugucuuuauagua

SEQ ID NO: 32602 - RNA, 22 nt, Homo sapiens
gugugcauggagggggcaguga

SEQ ID NO: 32603 - RNA, 22 nt, Homo sapiens
guguggcaggugggggcucaga

SEQ ID NO: 32604 - RNA, 22 nt, Homo sapiens
guguuauuuugcugggaaugau

SEQ ID NO: 32605 - RNA, 22 nt, Homo sapiens
guguugcacauucuguggaugu

SEQ ID NO: 32606 - RNA, 22 nt, Homo sapiens
guguuugauugcaaauaaucua

SEQ ID NO: 32607 - RNA, 22 nt, Homo sapiens
uaagacuguuggcaauuuuugc

SEQ ID NO: 32608 - RNA, 20 nt, Homo sapiens
uaagccacacagucuaaggu

SEQ ID NO: 32609 - RNA, 22 nt, Homo sapiens
uaagcuaauguguuuucucuua

SEQ ID NO: 32610 - RNA, 22 nt, Homo sapiens
uaaggcaaguuuuuaguggaca

SEQ ID NO: 32611 - RNA, 22 nt, Homo sapiens
uaaggcccauucuaugaagcag

SEQ ID NO: 32612 - RNA, 22 nt, Homo sapiens
uaaggcuuaugguaaaguccug

SEQ ID NO: 32613 - RNA, 22 nt, Homo sapiens
uaaggcuuugucuuaggacuuu

SEQ ID NO: 32614 - RNA, 22 nt, Homo sapiens
uaaggcuuuuguucagcguggg

SEQ ID NO: 32615 - RNA, 22 nt, Homo sapiens
uaagggcaugcugcaugagagu

SEQ ID NO: 32616 - RNA, 22 nt, Homo sapiens
uaaguaauugcagcaauuugcc

SEQ ID NO: 32617 - RNA, 22 nt, Homo sapiens
uaaguaauugugguuuuugcca

SEQ ID NO: 32618 - RNA, 22 nt, Homo sapiens
uaaguagaggaaucauuuugug

SEQ ID NO: 32619 - RNA, 22 nt, Homo sapiens
uaaguagcugggaguacaggca

SEQ ID NO: 32620 - RNA, 22 nt, Homo sapiens
uaaguaguuucuggauauucuc

SEQ ID NO: 32621 - RNA, 23 nt, Homo sapiens
uaagucacacagauuaauuuauu

SEQ ID NO: 32622 - RNA, 22 nt, Homo sapiens
uaagucguggaugauucuucgg

SEQ ID NO: 32623 - RNA, 22 nt, Homo sapiens
uaagugaaggaaguguguuuac

SEQ ID NO: 32624 - RNA, 22 nt, Homo sapiens
uaagugaauguuggcuacugaa

SEQ ID NO: 32625 - RNA, 22 nt, Homo sapiens
uaagugcuugacuuugauguuu

SEQ ID NO: 32626 - RNA, 22 nt, Homo sapiens
uaaguggugcauuguuaaaugg

SEQ ID NO: 32627 - RNA, 22 nt, Homo sapiens
uaaguguaaugucugaaguuug

SEQ ID NO: 32628 - RNA, 23 nt, Homo sapiens
uaaguucaucucuaauaggugga

SEQ ID NO: 32629 - RNA, 22 nt, Homo sapiens
uaauacugcugugcuugaguug

SEQ ID NO: 32630 - RNA, 22 nt, Homo sapiens
uaauaguuggcacuggagaaag

SEQ ID NO: 32631 - RNA, 22 nt, Homo sapiens
uaauccuagcacuuuggaagac

SEQ ID NO: 32632 - RNA, 22 nt, Homo sapiens
uaauccugucuugaccaucagg

SEQ ID NO: 32633 - RNA, 22 nt, Homo sapiens
uaaugcaucagugguaguucuu

SEQ ID NO: 32634 - RNA, 19 nt, Homo sapiens
uaaugccacugccuggcau

SEQ ID NO: 32635 - RNA, 22 nt, Homo sapiens
uaaugcuguggucugguuuaaa

SEQ ID NO: 32636 - RNA, 22 nt, Homo sapiens
uaaugguuuugcaccaucccuc

SEQ ID NO: 32637 - RNA, 22 nt, Homo sapiens
uaauucugacaacaguggcguu

SEQ ID NO: 32638 - RNA, 22 nt, Homo sapiens
uacaaaguaacaguuccuguau

SEQ ID NO: 32639 - RNA, 21 nt, Homo sapiens
uacaagcuguagcacaugcca

SEQ ID NO: 32640 - RNA, 22 nt, Homo sapiens
uacaauagugacaaaucagcau

SEQ ID NO: 32641 - RNA, 22 nt, Homo sapiens
uacacacguguguauauauaca

SEQ ID NO: 32642 - RNA, 22 nt, Homo sapiens
uacaccugcacucuagccuggg

SEQ ID NO: 32643 - RNA, 18 nt, Homo sapiens
uacagaacuggaguagaa

SEQ ID NO: 32644 - RNA, 22 nt, Homo sapiens
uacagaucaguuauuuuguaga

SEQ ID NO: 32645 - RNA, 22 nt, Homo sapiens
uacagcacaggugcagguguug

SEQ ID NO: 32646 - RNA, 22 nt, Homo sapiens
uacagccacauaauguaugauu

SEQ ID NO: 32647 - RNA, 23 nt, Homo sapiens
uacagcugcagaaucaggcuaag

SEQ ID NO: 32648 - RNA, 22 nt, Homo sapiens
uacagguauagauguguguucu

SEQ ID NO: 32649 - RNA, 22 nt, Homo sapiens
uacaguaauguuaaucuuugug

SEQ ID NO: 32650 - RNA, 22 nt, Homo sapiens
uacagucauaaugccuagugac

SEQ ID NO: 32651 - RNA, 22 nt, Homo sapiens
uacagucuggaggccuguguug

SEQ ID NO: 32652 - RNA, 22 nt, Homo sapiens
uacagugcuugguaucuaguaa

SEQ ID NO: 32653 - RNA, 22 nt, Homo sapiens
uacaguggcaugucaggugcuu

SEQ ID NO: 32654 - RNA, 22 nt, Homo sapiens
uacauacuguaugguucuguuu

SEQ ID NO: 32655 - RNA, 22 nt, Homo sapiens
uacaugcaugggcaugugugca

SEQ ID NO: 32656 - RNA, 22 nt, Homo sapiens
uacaugugccauguugguuugc

SEQ ID NO: 32657 - RNA, 22 nt, Homo sapiens
uacauugucauauucucucucu

SEQ ID NO: 32658 - RNA, 22 nt, Homo sapiens
uaccaaguauuuucacaugaac

SEQ ID NO: 32659 - RNA, 22 nt, Homo sapiens
uaccacagucauuacacuugua

SEQ ID NO: 32660 - RNA, 19 nt, Homo sapiens
uaccagcacaguguuugag

SEQ ID NO: 32661 - RNA, 22 nt, Homo sapiens
uaccaguaaugggucaaaggca

SEQ ID NO: 32662 - RNA, 22 nt, Homo sapiens
uaccaugaagguggagagagaa

SEQ ID NO: 32663 - RNA, 22 nt, Homo sapiens
uaccauguaucugggaugcuuu

SEQ ID NO: 32664 - RNA, 22 nt, Homo sapiens
uaccauguauguuucuccauug

SEQ ID NO: 32665 - RNA, 19 nt, Homo sapiens
uacccuaguauauacagaa

SEQ ID NO: 32666 - RNA, 22 nt, Homo sapiens
uacccuuuaguauaaaaucaga

SEQ ID NO: 32667 - RNA, 22 nt, Homo sapiens
uaccuaguguugacuucucuuc

SEQ ID NO: 32668 - RNA, 22 nt, Homo sapiens
uaccucagccaaugcccagaag

SEQ ID NO: 32669 - RNA, 22 nt, Homo sapiens
uaccuguagcucuucuaggcug

SEQ ID NO: 32670 - RNA, 22 nt, Homo sapiens
uacuacuuucugacaucuuuaa

SEQ ID NO: 32671 - RNA, 22 nt, Homo sapiens
uacuagaggaauugcuauaacu

SEQ ID NO: 32672 - RNA, 22 nt, Homo sapiens
uacucaauugcagucaccuggc

SEQ ID NO: 32673 - RNA, 22 nt, Homo sapiens
uacucaguaagugcuggcugcu

SEQ ID NO: 32674 - RNA, 22 nt, Homo sapiens
uacucaguagacacucauaugu

SEQ ID NO: 32675 - RNA, 22 nt, Homo sapiens
uacucagugacugguggaucaa

SEQ ID NO: 32676 - RNA, 22 nt, Homo sapiens
uacuccccuuguucugugagcu

SEQ ID NO: 32677 - RNA, 22 nt, Homo sapiens
uacugcacuccagccucgguga

SEQ ID NO: 32678 - RNA, 22 nt, Homo sapiens
uacugcacuccaggcucaccug

SEQ ID NO: 32679 - RNA, 22 nt, Homo sapiens
uacugcagucagacuccugggc

SEQ ID NO: 32680 - RNA, 22 nt, Homo sapiens
uacugcaucgaaaugcuuuuau

SEQ ID NO: 32681 - RNA, 21 nt, Homo sapiens
uacuggagauacagucugcaa

SEQ ID NO: 32682 - RNA, 22 nt, Homo sapiens
uacuggccuugaacucuggugu

SEQ ID NO: 32683 - RNA, 22 nt, Homo sapiens
uacugguuuuggugggcaggug

SEQ ID NO: 32684 - RNA, 22 nt, Homo sapiens
uagaaaguagggaagguaggau

SEQ ID NO: 32685 - RNA, 22 nt, Homo sapiens
uagaacauuccaggugauguug

SEQ ID NO: 32686 - RNA, 22 nt, Homo sapiens
uagaagcacuaucccuccuagu

SEQ ID NO: 32687 - RNA, 22 nt, Homo sapiens
uagaaugaaacaagcugugccu

SEQ ID NO: 32688 - RNA, 22 nt, Homo sapiens
uagacacuagauaugugacuga

SEQ ID NO: 32689 - RNA, 22 nt, Homo sapiens
uagagccauugcagauguuuga

SEQ ID NO: 32690 - RNA, 22 nt, Homo sapiens
uagagcucaucuucuuuaaacu

SEQ ID NO: 32691 - RNA, 22 nt, Homo sapiens
uagagcuugacacuuuccaugg

SEQ ID NO: 32692 - RNA, 22 nt, Homo sapiens
uagagguucuaagauucucaga

SEQ ID NO: 32693 - RNA, 19 nt, Homo sapiens
uagagguuuaagaaaagaa

SEQ ID NO: 32694 - RNA, 22 nt, Homo sapiens
uagaguguuuuguuaggcagca

SEQ ID NO: 32695 - RNA, 20 nt, Homo sapiens
uagaugcauuuagauucauu

SEQ ID NO: 32696 - RNA, 21 nt, Homo sapiens
uagaugguguucuagagagaa

SEQ ID NO: 32697 - RNA, 22 nt, Homo sapiens
uagauuaucuguaugugcucuu

SEQ ID NO: 32698 - RNA, 22 nt, Homo sapiens
uagcaaaucaauggaauugaag

SEQ ID NO: 32699 - RNA, 22 nt, Homo sapiens
ugaauacagcacacccaugggu

SEQ ID NO: 32700 - RNA, 22 nt, Homo sapiens
ugaauacugugcaaaggauuug

SEQ ID NO: 32701 - RNA, 22 nt, Homo sapiens
ugaauagacagucacugccucc

SEQ ID NO: 32702 - RNA, 22 nt, Homo sapiens
ugaauaggcaguuaaguuuaug

SEQ ID NO: 32703 - RNA, 22 nt, Homo sapiens
ugaauagugucacaauaaacau

SEQ ID NO: 32704 - RNA, 22 nt, Homo sapiens
ugaaucauuucuugucuucagu

SEQ ID NO: 32705 - RNA, 22 nt, Homo sapiens
ugaaugcuaaaggaaaacagua

SEQ ID NO: 32706 - RNA, 22 nt, Homo sapiens
guuacugucuuccugauugcuu

SEQ ID NO: 32707 - RNA, 22 nt, Homo sapiens
guuagaucauguuuggauaucu

SEQ ID NO: 32708 - RNA, 22 nt, Homo sapiens
guuagguagaaguuuacuuuga

SEQ ID NO: 32709 - RNA, 22 nt, Homo sapiens
guuauuguccauuuauuuagca

SEQ ID NO: 32710 - RNA, 22 nt, Homo sapiens
guucaagcaauucugcugccuc

SEQ ID NO: 32711 - RNA, 22 nt, Homo sapiens
guucaaggaauguuggcuucuc

SEQ ID NO: 32712 - RNA, 21 nt, Homo sapiens
guucaagugauccuccugucu

SEQ ID NO: 32713 - RNA, 20 nt, Homo sapiens
guucacaggcuuccuuucag

SEQ ID NO: 32714 - RNA, 22 nt, Homo sapiens
guucacucuggagaauauugac

SEQ ID NO: 32715 - RNA, 22 nt, Homo sapiens
guucaguuugcugaugcguuga

SEQ ID NO: 32716 - RNA, 22 nt, Homo sapiens
guucaucaggcuuucucuagag

SEQ ID NO: 32717 - RNA, 22 nt, Homo sapiens
guucaucagggauacuggccuu

SEQ ID NO: 32718 - RNA, 22 nt, Homo sapiens
guucaucagggauauuggcuua

SEQ ID NO: 32719 - RNA, 17 nt, Homo sapiens
guucccaguggcauuug

SEQ ID NO: 32720 - RNA, 22 nt, Homo sapiens
guuccuuguagaugcuggauau

SEQ ID NO: 32721 - RNA, 22 nt, Homo sapiens
guucuggagauaaagccaaggu

SEQ ID NO: 32722 - RNA, 20 nt, Homo sapiens
guucuugcucguguaucuuc

SEQ ID NO: 32723 - RNA, 22 nt, Homo sapiens
guugaaaucaucacuuggcaug

SEQ ID NO: 32724 - RNA, 22 nt, Homo sapiens
guugaacaauagauucauauca

SEQ ID NO: 32725 - RNA, 18 nt, Homo sapiens
guugagcuuuuccuuuag

SEQ ID NO: 32726 - RNA, 22 nt, Homo sapiens
guugaucuauguugcuggcagu

SEQ ID NO: 32727 - RNA, 22 nt, Homo sapiens
guugcagaguucuuccuccuga

SEQ ID NO: 32728 - RNA, 22 nt, Homo sapiens
guugcaugucugggaggccagc

SEQ ID NO: 32729 - RNA, 22 nt, Homo sapiens
guugcucaggcugaagugcagu

SEQ ID NO: 32730 - RNA, 22 nt, Homo sapiens
guuggaauguauugcuacuucu

SEQ ID NO: 32731 - RNA, 22 nt, Homo sapiens
guuggaguuaagcaguaaugaa

SEQ ID NO: 32732 - RNA, 22 nt, Homo sapiens
guuggcuguuucccccaaguga

SEQ ID NO: 32733 - RNA, 22 nt, Homo sapiens
guuggcuuuuuaaggaaauugc

SEQ ID NO: 32734 - RNA, 22 nt, Homo sapiens
guugggcccauagacugccagu

SEQ ID NO: 32735 - RNA, 22 nt, Homo sapiens
guugguauuacagaaauuaguu

SEQ ID NO: 32736 - RNA, 22 nt, Homo sapiens
guuuggcuuucucucuauccug

SEQ ID NO: 32737 - RNA, 22 nt, Homo sapiens
guuuuuggggucacuauuaccg

SEQ ID NO: 32738 - RNA, 22 nt, Homo sapiens
uaaaagucaucacaacuggagu

SEQ ID NO: 32739 - RNA, 22 nt, Homo sapiens
uaaaccuagcauuuugcauaug

SEQ ID NO: 32740 - RNA, 22 nt, Homo sapiens
uaaacugucuugcaguuacaug

SEQ ID NO: 32741 - RNA, 22 nt, Homo sapiens
uaaacugucuuuggagcuuugc

SEQ ID NO: 32742 - RNA, 16 nt, Homo sapiens
uaaagcuaaucacuuu

SEQ ID NO: 32743 - RNA, 22 nt, Homo sapiens
uaaagcuagaauuguuccagca

SEQ ID NO: 32744 - RNA, 22 nt, Homo sapiens
uaaagcuauuauaguuauguuu

SEQ ID NO: 32745 - RNA, 18 nt, Homo sapiens
uaaaggcacuguguuguu

SEQ ID NO: 32746 - RNA, 22 nt, Homo sapiens
uaaaguguuuguuauuaaaggu

SEQ ID NO: 32747 - RNA, 22 nt, Homo sapiens
uaaaguuauugccccucaguua

SEQ ID NO: 32748 - RNA, 22 nt, Homo sapiens
uaaaugacugucaguagaugaa

SEQ ID NO: 32749 - RNA, 22 nt, Homo sapiens
uaaaugcuuaauugaaugugga

SEQ ID NO: 32750 - RNA, 22 nt, Homo sapiens
uaaaugcuugagaugauggaua

SEQ ID NO: 32751 - RNA, 22 nt, Homo sapiens
uaacaaugucuuaugggcuuaa

SEQ ID NO: 32752 - RNA, 21 nt, Homo sapiens
uaacagcuccacuccauucuc

SEQ ID NO: 32753 - RNA, 22 nt, Homo sapiens
uaacaguauaugugguaucuau

SEQ ID NO: 32754 - RNA, 22 nt, Homo sapiens
uaacagucaagguuugaccagg

SEQ ID NO: 32755 - RNA, 22 nt, Homo sapiens
uaacauugucuugcuuaguuuu

SEQ ID NO: 32756 - RNA, 22 nt, Homo sapiens
uaacauuguugauuauacuaag

SEQ ID NO: 32757 - RNA, 21 nt, Homo sapiens
uaacccugaaggagcucugga

SEQ ID NO: 32758 - RNA, 22 nt, Homo sapiens
uaacuaaagagaagucaauguc

SEQ ID NO: 32759 - RNA, 22 nt, Homo sapiens
uaacuaguagauggcugacaua

SEQ ID NO: 32760 - RNA, 22 nt, Homo sapiens
uaacucugccuagugacauggu

SEQ ID NO: 32761 - RNA, 22 nt, Homo sapiens
uaacugcaaccuccgccucccg

SEQ ID NO: 32762 - RNA, 20 nt, Homo sapiens
uaacuguggcuucuuuuggc

SEQ ID NO: 32763 - RNA, 22 nt, Homo sapiens
uaagacacuuaaaauguuacau

SEQ ID NO: 32764 - RNA, 22 nt, Homo sapiens
uaagacucuggacucuaauguu

SEQ ID NO: 32765 - RNA, 22 nt, Homo sapiens
uaagacugccccagacagcaag

SEQ ID NO: 32766 - RNA, 22 nt, Homo sapiens
uaagacuuuuugggaauauaga

SEQ ID NO: 32767 - RNA, 22 nt, Homo sapiens
uaagagagcuccaucuuuuccu

SEQ ID NO: 32768 - RNA, 22 nt, Homo sapiens
uaagagcuaggauuuuaaauca

SEQ ID NO: 32769 - RNA, 19 nt, Homo sapiens
uaagaugaagcugucuggg

SEQ ID NO: 32770 - RNA, 22 nt, Homo sapiens
uaagaugaaggcucaccuagaa

SEQ ID NO: 32771 - RNA, 16 nt, Homo sapiens
uaagccccacgugcau

SEQ ID NO: 32772 - RNA, 22 nt, Homo sapiens
uaaggaaggcugugugcuuuua

SEQ ID NO: 32773 - RNA, 22 nt, Homo sapiens
uaaggauuuuggugauuacacu

SEQ ID NO: 32774 - RNA, 22 nt, Homo sapiens
uaaggcaaucagucaugguguu

SEQ ID NO: 32775 - RNA, 22 nt, Homo sapiens
uaaggcucuuguuauuuugagg

SEQ ID NO: 32776 - RNA, 22 nt, Homo sapiens
uaaggcuugaucuuggugagau

SEQ ID NO: 32777 - RNA, 22 nt, Homo sapiens
uaagggacauguguugccuaag

SEQ ID NO: 32778 - RNA, 22 nt, Homo sapiens
uaagggacgcccccuucucucu

SEQ ID NO: 32779 - RNA, 22 nt, Homo sapiens
uaagggcacuaaucccauuuau

SEQ ID NO: 32780 - RNA, 22 nt, Homo sapiens
uaagguuacaaaggacuucaua

SEQ ID NO: 32781 - RNA, 22 nt, Homo sapiens
uaaguaauuuguauuuuaccca

SEQ ID NO: 32782 - RNA, 22 nt, Homo sapiens
uaaguacuuuacagacauuauc

SEQ ID NO: 32783 - RNA, 22 nt, Homo sapiens
uaaguaguauaagguuuuuuga

SEQ ID NO: 32784 - RNA, 22 nt, Homo sapiens
uaaguaucaguuuagcuaugau

SEQ ID NO: 32785 - RNA, 22 nt, Homo sapiens
uaaguauuuuaauuccuggcau

SEQ ID NO: 32786 - RNA, 22 nt, Homo sapiens
uaagucacuccagguuaaagug

SEQ ID NO: 32787 - RNA, 22 nt, Homo sapiens
uaagucuuuuuggaguuuauaa

SEQ ID NO: 32788 - RNA, 22 nt, Homo sapiens
uaagugaauauggacaguuagc

SEQ ID NO: 32789 - RNA, 22 nt, Homo sapiens
uaagugaugucuuuuugugugc

SEQ ID NO: 32790 - RNA, 22 nt, Homo sapiens
uaagugcaacauaaguguuaaa

SEQ ID NO: 32791 - RNA, 20 nt, Homo sapiens
uaagugcauaggauauuucu

SEQ ID NO: 32792 - RNA, 22 nt, Homo sapiens
uaagugcuguguuguuaccuaa

SEQ ID NO: 32793 - RNA, 20 nt, Homo sapiens
uaagugcuuuauauugauua

SEQ ID NO: 32794 - RNA, 22 nt, Homo sapiens
uaaguggaagaugucaaucaua

SEQ ID NO: 32795 - RNA, 22 nt, Homo sapiens
uaaguucauucaugaaacuuag

SEQ ID NO: 32796 - RNA, 21 nt, Homo sapiens
uaauaaugucucagacaccua

SEQ ID NO: 32797 - RNA, 22 nt, Homo sapiens
uaauacuguaauggugguuccg

SEQ ID NO: 32798 - RNA, 22 nt, Homo sapiens
uaauaguuucagaaguuguuuu

SEQ ID NO: 32799 - RNA, 22 nt, Homo sapiens
uaauaugugguugcuugggcac

SEQ ID NO: 32800 - RNA, 22 nt, Homo sapiens
ucagaauguaacuuuaguugga

SEQ ID NO: 32801 - RNA, 22 nt, Homo sapiens
ucagaguggagucugcagccuu

SEQ ID NO: 32802 - RNA, 22 nt, Homo sapiens
ucagauacuggugacaugaaug

SEQ ID NO: 32803 - RNA, 22 nt, Homo sapiens
ucagaucauuaagguagguuua

SEQ ID NO: 32804 - RNA, 22 nt, Homo sapiens
uaauugcaguucuguguuauau

SEQ ID NO: 32805 - RNA, 22 nt, Homo sapiens
uacaaagugggaaacgaagguu

SEQ ID NO: 32806 - RNA, 22 nt, Homo sapiens
uacaacacugguucgacaugug

SEQ ID NO: 32807 - RNA, 16 nt, Homo sapiens
uacaacagugaguaug

SEQ ID NO: 32808 - RNA, 22 nt, Homo sapiens
uacaagcacaggcagcaggcug

SEQ ID NO: 32809 - RNA, 22 nt, Homo sapiens
uacaagcaggaaaugguauaug

SEQ ID NO: 32810 - RNA, 22 nt, Homo sapiens
uacaaguaauaagggaagaauu

SEQ ID NO: 32811 - RNA, 22 nt, Homo sapiens
uacaaguauuuuuauuagugcc

SEQ ID NO: 32812 - RNA, 22 nt, Homo sapiens
uacaaguggguuugugcaggag

SEQ ID NO: 32813 - RNA, 22 nt, Homo sapiens
uacaccaauuuaaucaaaagca

SEQ ID NO: 32814 - RNA, 22 nt, Homo sapiens
uacacgugcacaacgugcacgu

SEQ ID NO: 32815 - RNA, 20 nt, Homo sapiens
uacacguguagcauucucua

SEQ ID NO: 32816 - RNA, 22 nt, Homo sapiens
uacagaauucugucccuugagu

SEQ ID NO: 32817 - RNA, 22 nt, Homo sapiens
uacagaauugcagguguggcag

SEQ ID NO: 32818 - RNA, 23 nt, Homo sapiens
uacagcacacugaugggucuuga

SEQ ID NO: 32819 - RNA, 22 nt, Homo sapiens
uacagcacugugcauagugguu

SEQ ID NO: 32820 - RNA, 22 nt, Homo sapiens
uacagcuaugugcaugcaugcu

SEQ ID NO: 32821 - RNA, 22 nt, Homo sapiens
uacaggaaugucagguugcugu

SEQ ID NO: 32822 - RNA, 22 nt, Homo sapiens
uacaggacuucucagaguuauu

SEQ ID NO: 32823 - RNA, 22 nt, Homo sapiens
uacaggauagacaauuuauuaa

SEQ ID NO: 32824 - RNA, 22 nt, Homo sapiens
uacaggcagguguucccugguu

SEQ ID NO: 32825 - RNA, 22 nt, Homo sapiens
uacaggugcucuacagacagga

SEQ ID NO: 32826 - RNA, 22 nt, Homo sapiens
uacaguagagaucagcaaacua

SEQ ID NO: 32827 - RNA, 22 nt, Homo sapiens
uacaguaguaucuucauuuguu

SEQ ID NO: 32828 - RNA, 22 nt, Homo sapiens
uacagucacauuccugaccaua

SEQ ID NO: 32829 - RNA, 22 nt, Homo sapiens
uacagugcuuuuugguggagaa

SEQ ID NO: 32830 - RNA, 22 nt, Homo sapiens
uacauagucuucuuuugguuau

SEQ ID NO: 32831 - RNA, 22 nt, Homo sapiens
uacauguauguguuuauggcug

SEQ ID NO: 32832 - RNA, 22 nt, Homo sapiens
uaccacaggcuggguaaucuau

SEQ ID NO: 32833 - RNA, 22 nt, Homo sapiens
uaccacugccgagaaaacagau

SEQ ID NO: 32834 - RNA, 22 nt, Homo sapiens
uaccaucauuauacguagaaau

SEQ ID NO: 32835 - RNA, 22 nt, Homo sapiens
uaccucaguucaauaacagaua

SEQ ID NO: 32836 - RNA, 22 nt, Homo sapiens
uaccucuguaaguaaagauuca

SEQ ID NO: 32837 - RNA, 22 nt, Homo sapiens
uaccugagucuagagucuagaa

SEQ ID NO: 32838 - RNA, 22 nt, Homo sapiens
uacuagaaccuuauucagagug

SEQ ID NO: 32839 - RNA, 22 nt, Homo sapiens
uacuagaguagugcagagggga

SEQ ID NO: 32840 - RNA, 22 nt, Homo sapiens
uacuaguaagggugguuuggcu

SEQ ID NO: 32841 - RNA, 22 nt, Homo sapiens
uacucacauucuguuucuugcu

SEQ ID NO: 32842 - RNA, 22 nt, Homo sapiens
uacucaguagucuguugcuguc

SEQ ID NO: 32843 - RNA, 22 nt, Homo sapiens
uacucugcagagaugcauaaca

SEQ ID NO: 32844 - RNA, 22 nt, Homo sapiens
uacucugcaguaauuccagccc

SEQ ID NO: 32845 - RNA, 22 nt, Homo sapiens
uacugcacuccagccugggaga

SEQ ID NO: 32846 - RNA, 22 nt, Homo sapiens
uacugcacuccagccuggguga

SEQ ID NO: 32847 - RNA, 22 nt, Homo sapiens
uacugcacuccagccuugccaa

SEQ ID NO: 32848 - RNA, 20 nt, Homo sapiens
uacugcacuccauccugggu

SEQ ID NO: 32849 - RNA, 22 nt, Homo sapiens
uacugcacucuagccuggguga

SEQ ID NO: 32850 - RNA, 22 nt, Homo sapiens
uacugcacuggaggccucagau

SEQ ID NO: 32851 - RNA, 20 nt, Homo sapiens
uacugcacuuuccucauggu

SEQ ID NO: 32852 - RNA, 22 nt, Homo sapiens
uacugcugucagugccaaguag

SEQ ID NO: 32853 - RNA, 22 nt, Homo sapiens
uacugcuuaaaagucaauuacu

SEQ ID NO: 32854 - RNA, 22 nt, Homo sapiens
uacuuuguagauuguuuccuuu

SEQ ID NO: 32855 - RNA, 22 nt, Homo sapiens
uagaagcuacucuucuuguggc

SEQ ID NO: 32856 - RNA, 22 nt, Homo sapiens
uagaaguaggcuacgugucugg

SEQ ID NO: 32857 - RNA, 22 nt, Homo sapiens
uagaaucuaacucgcaugaaaa

SEQ ID NO: 32858 - RNA, 22 nt, Homo sapiens
uagaauguaaauuccaagggca

SEQ ID NO: 32859 - RNA, 22 nt, Homo sapiens
uagaauguaacaguuaaaagca

SEQ ID NO: 32860 - RNA, 22 nt, Homo sapiens
uagaauguauaauauuuuacuu

SEQ ID NO: 32861 - RNA, 22 nt, Homo sapiens
uagacacugcauauuuuuuuaa

SEQ ID NO: 32862 - RNA, 22 nt, Homo sapiens
uagaccaauuggcauauaguaa

SEQ ID NO: 32863 - RNA, 22 nt, Homo sapiens
uagaccauucuauuuccuaugc

SEQ ID NO: 32864 - RNA, 20 nt, Homo sapiens
uagagagauauggggguucc

SEQ ID NO: 32865 - RNA, 22 nt, Homo sapiens
uagagcacaagguagauuucua

SEQ ID NO: 32866 - RNA, 22 nt, Homo sapiens
uagagcacauuaucauuuccaa

SEQ ID NO: 32867 - RNA, 22 nt, Homo sapiens
uagagcaugugccauacguaca

SEQ ID NO: 32868 - RNA, 22 nt, Homo sapiens
uagagguagccuacuacacacc

SEQ ID NO: 32869 - RNA, 22 nt, Homo sapiens
uagagguaggucuucgagucuc

SEQ ID NO: 32870 - RNA, 22 nt, Homo sapiens
uagagguagguguaugaacuag

SEQ ID NO: 32871 - RNA, 22 nt, Homo sapiens
uagagguauguauaguauucuu

SEQ ID NO: 32872 - RNA, 21 nt, Homo sapiens
uagauaguugguucugaaucu

SEQ ID NO: 32873 - RNA, 22 nt, Homo sapiens
uagaucauauacuugccaugac

SEQ ID NO: 32874 - RNA, 23 nt, Homo sapiens
uagaucaucaaguuuacugugcu

SEQ ID NO: 32875 - RNA, 22 nt, Homo sapiens
uagauuaucucaccacucgagu

SEQ ID NO: 32876 - RNA, 22 nt, Homo sapiens
uagauuauuggcugauuugauc

SEQ ID NO: 32877 - RNA, 22 nt, Homo sapiens
uagauucaucuguuccuuuuga

SEQ ID NO: 32878 - RNA, 22 nt, Homo sapiens
uagcacaguucacccucgauuu

SEQ ID NO: 32879 - RNA, 22 nt, Homo sapiens
uagcaccaaacauauacucagu

SEQ ID NO: 32880 - RNA, 22 nt, Homo sapiens
uagcacugucuugcaccugugc

SEQ ID NO: 32881 - RNA, 22 nt, Homo sapiens
uagcagaauaacuugccagccu

SEQ ID NO: 32882 - RNA, 22 nt, Homo sapiens
uagcagaauauaccucuuacuu

SEQ ID NO: 32883 - RNA, 18 nt, Homo sapiens
uagcagacaucauugggg

SEQ ID NO: 32884 - RNA, 21 nt, Homo sapiens
uagcagcguuguugcaaaugu

SEQ ID NO: 32885 - RNA, 22 nt, Homo sapiens
uagcagcuuuauugagguaaau

SEQ ID NO: 32886 - RNA, 22 nt, Homo sapiens
uagcaguaagaaacugacauug

SEQ ID NO: 32887 - RNA, 22 nt, Homo sapiens
uagcaguaccccaguauccugg

SEQ ID NO: 32888 - RNA, 22 nt, Homo sapiens
uagcaguauacguacugggucc

SEQ ID NO: 32889 - RNA, 22 nt, Homo sapiens
uagcaguaucccaccaucuggu

SEQ ID NO: 32890 - RNA, 22 nt, Homo sapiens
uagcaguauugaaagaugaggg

SEQ ID NO: 32891 - RNA, 22 nt, Homo sapiens
uagcagucaagauagucauuau

SEQ ID NO: 32892 - RNA, 22 nt, Homo sapiens
uagcagugugaaaacagacuaa

SEQ ID NO: 32893 - RNA, 22 nt, Homo sapiens
uagcauggaggcggccauagug

SEQ ID NO: 32894 - RNA, 22 nt, Homo sapiens
uagcccagugagguugauuugg

SEQ ID NO: 32895 - RNA, 22 nt, Homo sapiens
uagcugauguuugucuaguagc

SEQ ID NO: 32896 - RNA, 22 nt, Homo sapiens
uagcugcauccugugcacucaa

SEQ ID NO: 32897 - RNA, 17 nt, Homo sapiens
uagcuucacauuaggaa

SEQ ID NO: 32898 - RNA, 22 nt, Homo sapiens
uagcuucuccauagcuccaugu

SEQ ID NO: 32899 - RNA, 22 nt, Homo sapiens
uaggaaguuuucuugcugggcc

SEQ ID NO: 32900 - RNA, 20 nt, Homo sapiens
uaggagcaaugagaguagaa

SEQ ID NO: 32901 - RNA, 22 nt, Homo sapiens
ucagauguuucuuuaacgcaug

SEQ ID NO: 32902 - RNA, 22 nt, Homo sapiens
ucagauuggugcaaaaguaauu

SEQ ID NO: 32903 - RNA, 22 nt, Homo sapiens
ucagcaaugcugcacucuacug

SEQ ID NO: 32904 - RNA, 22 nt, Homo sapiens
ucagcaguggacagaaugguag

SEQ ID NO: 32905 - RNA, 16 nt, Homo sapiens
ucagcgagggagccag

SEQ ID NO: 32906 - RNA, 22 nt, Homo sapiens
ucaggguacuuguggccaaagu

SEQ ID NO: 32907 - RNA, 22 nt, Homo sapiens
ucagguagcuagauuaugugag

SEQ ID NO: 32908 - RNA, 23 nt, Homo sapiens
ucagguaguuucagaggaccuug

SEQ ID NO: 32909 - RNA, 22 nt, Homo sapiens
ucagguccuuacugugcucccu

SEQ ID NO: 32910 - RNA, 22 nt, Homo sapiens
ucaggugcagagaagaaauggg

SEQ ID NO: 32911 - RNA, 22 nt, Homo sapiens
ucaguagcaugaaaacagacua

SEQ ID NO: 32912 - RNA, 22 nt, Homo sapiens
ucaguaguaaauggauuuggaa

SEQ ID NO: 32913 - RNA, 22 nt, Homo sapiens
ucaguauaugaaucuggggcag

SEQ ID NO: 32914 - RNA, 22 nt, Homo sapiens
ucagucauucaauuguugaaug

SEQ ID NO: 32915 - RNA, 22 nt, Homo sapiens
ucagucauucacucacucggac

SEQ ID NO: 32916 - RNA, 22 nt, Homo sapiens
ucagucauugauggaguagguc

SEQ ID NO: 32917 - RNA, 23 nt, Homo sapiens
ucagugaaggaacaacuaaauag

SEQ ID NO: 32918 - RNA, 22 nt, Homo sapiens
ucagugacugcugcuuguauac

SEQ ID NO: 32919 - RNA, 22 nt, Homo sapiens
ucagugcaggaauuuccuuaga

SEQ ID NO: 32920 - RNA, 22 nt, Homo sapiens
ucagugggcuauguaauuaacu

SEQ ID NO: 32921 - RNA, 23 nt, Homo sapiens
ucagugucuggauccugcucagu

SEQ ID NO: 32922 - RNA, 22 nt, Homo sapiens
ucaguguugauggcugcugacu

SEQ ID NO: 32923 - RNA, 21 nt, Homo sapiens
ucaguuacugagagagaagug

SEQ ID NO: 32924 - RNA, 22 nt, Homo sapiens
ucauacaguaguccucacuugu

SEQ ID NO: 32925 - RNA, 22 nt, Homo sapiens
ucauacuguuaaaugguuuagu

SEQ ID NO: 32926 - RNA, 20 nt, Homo sapiens
ucauagggugguggcagugg

SEQ ID NO: 32927 - RNA, 22 nt, Homo sapiens
ucauaguagucacuuaauaaau

SEQ ID NO: 32928 - RNA, 22 nt, Homo sapiens
ucauauguaugugcaauuuugu

SEQ ID NO: 32929 - RNA, 22 nt, Homo sapiens
ucauauugguuaaaauaguggg

SEQ ID NO: 32930 - RNA, 22 nt, Homo sapiens
ucaucaggcucauucaagcuga

SEQ ID NO: 32931 - RNA, 21 nt, Homo sapiens
ucaucagucaaagacaauggu

SEQ ID NO: 32932 - RNA, 20 nt, Homo sapiens
ucaucaguuggugcucgcug

SEQ ID NO: 32933 - RNA, 22 nt, Homo sapiens
ucaucuggcgaaugugaagagu

SEQ ID NO: 32934 - RNA, 22 nt, Homo sapiens
ucaugacacuggcaggagcuaa

SEQ ID NO: 32935 - RNA, 22 nt, Homo sapiens
ucaugcaucuuguggaauuuga

SEQ ID NO: 32936 - RNA, 21 nt, Homo sapiens
ucaugccacugcacuuuagcc

SEQ ID NO: 32937 - RNA, 22 nt, Homo sapiens
ucauggcauuguuaaggguuuu

SEQ ID NO: 32938 - RNA, 22 nt, Homo sapiens
ucauggcuuuuauuauguugag

SEQ ID NO: 32939 - RNA, 19 nt, Homo sapiens
ucauggcuuuuucagcugu

SEQ ID NO: 32940 - RNA, 22 nt, Homo sapiens
ucauggguuuugguccaagcaa

SEQ ID NO: 32941 - RNA, 22 nt, Homo sapiens
ucauguaauuuugugucuauga

SEQ ID NO: 32942 - RNA, 22 nt, Homo sapiens
ucauguauuaucauuagugggu

SEQ ID NO: 32943 - RNA, 22 nt, Homo sapiens
ucaugugaggauaacaauagug

SEQ ID NO: 32944 - RNA, 22 nt, Homo sapiens
ucauucauuugcucacuccaca

SEQ ID NO: 32945 - RNA, 22 nt, Homo sapiens
ucauugcacuccagccugggug

SEQ ID NO: 32946 - RNA, 22 nt, Homo sapiens
ucauugguagcuugaaggggau

SEQ ID NO: 32947 - RNA, 22 nt, Homo sapiens
ucauuguccaacuucuuucagu

SEQ ID NO: 32948 - RNA, 22 nt, Homo sapiens
uccacaguaaggacccugccuu

SEQ ID NO: 32949 - RNA, 20 nt, Homo sapiens
uccacugagcgucacggcag

SEQ ID NO: 32950 - RNA, 21 nt, Homo sapiens
uccagcuuugagaguuguggu

SEQ ID NO: 32951 - RNA, 22 nt, Homo sapiens
uccagcuuuuucuaauucugug

SEQ ID NO: 32952 - RNA, 22 nt, Homo sapiens
uccagguuuggcuuuauaacuu

SEQ ID NO: 32953 - RNA, 22 nt, Homo sapiens
uccagguuuugugaguuuaaau

SEQ ID NO: 32954 - RNA, 22 nt, Homo sapiens
uccaguuguucucgaagcuccu

SEQ ID NO: 32955 - RNA, 22 nt, Homo sapiens
uccauaguugcacucuggagcc

SEQ ID NO: 32956 - RNA, 22 nt, Homo sapiens
uccaugaguccauuagaaaaaa

SEQ ID NO: 32957 - RNA, 18 nt, Homo sapiens
uccauuuguaugggaugg

SEQ ID NO: 32958 - RNA, 22 nt, Homo sapiens
uccauuuguucagcuucaggaa

SEQ ID NO: 32959 - RNA, 22 nt, Homo sapiens
uccauuuguuguaggguauagu

SEQ ID NO: 32960 - RNA, 22 nt, Homo sapiens
ucccaagaugagaugggggcug

SEQ ID NO: 32961 - RNA, 22 nt, Homo sapiens
ucccacugucuucucgugcucg

SEQ ID NO: 32962 - RNA, 22 nt, Homo sapiens
ucccagaaacgcauauguucau

SEQ ID NO: 32963 - RNA, 22 nt, Homo sapiens
ucccagucuagagccggauugg

SEQ ID NO: 32964 - RNA, 22 nt, Homo sapiens
ucccagugcuaugcaaaagccu

SEQ ID NO: 32965 - RNA, 22 nt, Homo sapiens
ucccaguguguagcuugucucu

SEQ ID NO: 32966 - RNA, 22 nt, Homo sapiens
uccccgucacacgcaggcuuac

SEQ ID NO: 32967 - RNA, 22 nt, Homo sapiens
uccccugagaacuugcuagaaa

SEQ ID NO: 32968 - RNA, 22 nt, Homo sapiens
ucccuagacuccugccuuucag

SEQ ID NO: 32969 - RNA, 18 nt, Homo sapiens
ucccucagaauuauagaa

SEQ ID NO: 32970 - RNA, 22 nt, Homo sapiens
ucccugaaaaauuggcuuaaca

SEQ ID NO: 32971 - RNA, 22 nt, Homo sapiens
ucccugaaaauuagcauuuuaa

SEQ ID NO: 32972 - RNA, 22 nt, Homo sapiens
ucccugaaagcugagauuggaa

SEQ ID NO: 32973 - RNA, 22 nt, Homo sapiens
ucccugaaucucagguucugua

SEQ ID NO: 32974 - RNA, 18 nt, Homo sapiens
ucccugacucaaauucuu

SEQ ID NO: 32975 - RNA, 22 nt, Homo sapiens
ucccugagugauugaaaauaaa

SEQ ID NO: 32976 - RNA, 22 nt, Homo sapiens
ucccuguguccugggggcaccu

SEQ ID NO: 32977 - RNA, 22 nt, Homo sapiens
ucccuguuaggcacagauuuau

SEQ ID NO: 32978 - RNA, 22 nt, Homo sapiens
ucccuugagccuggcuucucac

SEQ ID NO: 32979 - RNA, 18 nt, Homo sapiens
ucccuuuguagaugaccc

SEQ ID NO: 32980 - RNA, 22 nt, Homo sapiens
uccuacaugcaguacauucaaa

SEQ ID NO: 32981 - RNA, 22 nt, Homo sapiens
uccucaguggauuggauggugc

SEQ ID NO: 32982 - RNA, 22 nt, Homo sapiens
uccugagacucacaggcucccc

SEQ ID NO: 32983 - RNA, 22 nt, Homo sapiens
uccugagacugaggagcuuugg

SEQ ID NO: 32984 - RNA, 22 nt, Homo sapiens
uccugagagcagacccucuaua

SEQ ID NO: 32985 - RNA, 22 nt, Homo sapiens
uccuucauuugucaacucuagu

SEQ ID NO: 32986 - RNA, 22 nt, Homo sapiens
uccuugaaacaggaagaauuca

SEQ ID NO: 32987 - RNA, 22 nt, Homo sapiens
uccuugagccuuaaauuauaaa

SEQ ID NO: 32988 - RNA, 22 nt, Homo sapiens
uccuugagucuuugcucagaug

SEQ ID NO: 32989 - RNA, 22 nt, Homo sapiens
uccuuggucauggaagagacag

SEQ ID NO: 32990 - RNA, 21 nt, Homo sapiens
uccuuggugaugcccugcagu

SEQ ID NO: 32991 - RNA, 23 nt, Homo sapiens
uccuugguuggcgcccuaugugu

SEQ ID NO: 32992 - RNA, 22 nt, Homo sapiens
uccuuuagacugaauccugaga

SEQ ID NO: 32993 - RNA, 22 nt, Homo sapiens
uccuuugguggagucuuuaggg

SEQ ID NO: 32994 - RNA, 18 nt, Homo sapiens
uccuuuugggguaggaga

SEQ ID NO: 32995 - RNA, 22 nt, Homo sapiens
ucgcagcacgagcaugcaaggu

SEQ ID NO: 32996 - RNA, 22 nt, Homo sapiens
ucgcaguuaauaaugaugugcg

SEQ ID NO: 32997 - RNA, 22 nt, Homo sapiens
ucgugccacugcacuccagccu

SEQ ID NO: 32998 - RNA, 22 nt, Homo sapiens
ucuaaaacuagauugugaugau

SEQ ID NO: 32999 - RNA, 22 nt, Homo sapiens
ucuaagacuaagggcuagcuuc

SEQ ID NO: 33000 - RNA, 22 nt, Homo sapiens
ucuacccugugagggacacagu

SEQ ID NO: 33001 - RNA, 22 nt, Homo sapiens
uauugcacuccucaugcauuug

SEQ ID NO: 33002 - RNA, 16 nt, Homo sapiens
ugagaacaugugacau

SEQ ID NO: 33003 - RNA, 17 nt, Homo sapiens
ugagaacaugugguauu

SEQ ID NO: 33004 - RNA, 22 nt, Homo sapiens
ugagaacggauacuaagggcug

SEQ ID NO: 33005 - RNA, 22 nt, Homo sapiens
ugagaacuagagaacaagguga

SEQ ID NO: 33006 - RNA, 22 nt, Homo sapiens
ugagaacugguagcacuuguga

SEQ ID NO: 33007 - RNA, 22 nt, Homo sapiens
ugagaacuguuuugguuugggu

SEQ ID NO: 33008 - RNA, 22 nt, Homo sapiens
ugagaacuuauggugauuuuuu

SEQ ID NO: 33009 - RNA, 22 nt, Homo sapiens
ugagaagugacgcagcaggguu

SEQ ID NO: 33010 - RNA, 22 nt, Homo sapiens
ugagaagugauauagaaguuaa

SEQ ID NO: 33011 - RNA, 22 nt, Homo sapiens
ugagaaugacugggcaugcugc

SEQ ID NO: 33012 - RNA, 22 nt, Homo sapiens
ugagaaugaugauugguaaacc

SEQ ID NO: 33013 - RNA, 22 nt, Homo sapiens
ugagaauguagggcucucccag

SEQ ID NO: 33014 - RNA, 22 nt, Homo sapiens
ugagacaaaguuguuggauguu

SEQ ID NO: 33015 - RNA, 22 nt, Homo sapiens
ugagacacuucccagaucccuu

SEQ ID NO: 33016 - RNA, 22 nt, Homo sapiens
ugagacaucacaaaauccucaa

SEQ ID NO: 33017 - RNA, 22 nt, Homo sapiens
ugagacaugugaauauuuguac

SEQ ID NO: 33018 - RNA, 23 nt, Homo sapiens
ugagacauuggaaaguuaggcag

SEQ ID NO: 33019 - RNA, 22 nt, Homo sapiens
ugagacggagucucgcucucua

SEQ ID NO: 33020 - RNA, 22 nt, Homo sapiens
ugagacggaguuucacucuugu

SEQ ID NO: 33021 - RNA, 22 nt, Homo sapiens
ugagacugaaauuaggaaacug

SEQ ID NO: 33022 - RNA, 22 nt, Homo sapiens
ugagacugaguuuugccuuugu

SEQ ID NO: 33023 - RNA, 22 nt, Homo sapiens
ugagacugaguuuugcucguug

SEQ ID NO: 33024 - RNA, 22 nt, Homo sapiens
ugagagaugauaaaauguuugu

SEQ ID NO: 33025 - RNA, 22 nt, Homo sapiens
ugagagcugguuguuuaaagga

SEQ ID NO: 33026 - RNA, 22 nt, Homo sapiens
ugagaguagggguugggauugg

SEQ ID NO: 33027 - RNA, 21 nt, Homo sapiens
ugagaguaguguauuauucuc

SEQ ID NO: 33028 - RNA, 22 nt, Homo sapiens
ugagagucauacaaauaaaaau

SEQ ID NO: 33029 - RNA, 22 nt, Homo sapiens
ugagauaaucaugugguuuuug

SEQ ID NO: 33030 - RNA, 22 nt, Homo sapiens
ugagauaauuuacuuguugagg

SEQ ID NO: 33031 - RNA, 22 nt, Homo sapiens
ugagauagaaaacauaggagaa

SEQ ID NO: 33032 - RNA, 22 nt, Homo sapiens
ugagauauauauauuugagaca

SEQ ID NO: 33033 - RNA, 22 nt, Homo sapiens
ugagaucgagucucgcucuguc

SEQ ID NO: 33034 - RNA, 22 nt, Homo sapiens
ugagaucucauuaugguuuuaa

SEQ ID NO: 33035 - RNA, 22 nt, Homo sapiens
ugagaucuguaaagucugacau

SEQ ID NO: 33036 - RNA, 22 nt, Homo sapiens
ugagaucuuaucagaaauggug

SEQ ID NO: 33037 - RNA, 22 nt, Homo sapiens
ugagaucuuugcuguccucacc

SEQ ID NO: 33038 - RNA, 22 nt, Homo sapiens
ugagaugaaagcagaaagacuu

SEQ ID NO: 33039 - RNA, 22 nt, Homo sapiens
ugagaugaacuugauuguuuua

SEQ ID NO: 33040 - RNA, 22 nt, Homo sapiens
ugagaugaagcuagaagaaugg

SEQ ID NO: 33041 - RNA, 22 nt, Homo sapiens
ugagaugaagugauguaaaaca

SEQ ID NO: 33042 - RNA, 22 nt, Homo sapiens
ugagaugagggaagccuaggca

SEQ ID NO: 33043 - RNA, 22 nt, Homo sapiens
ugagaugaguucucgcucuguc

SEQ ID NO: 33044 - RNA, 22 nt, Homo sapiens
ugagaugaguugcgcucugucg

SEQ ID NO: 33045 - RNA, 22 nt, Homo sapiens
ugagaugaugggauaagagggc

SEQ ID NO: 33046 - RNA, 22 nt, Homo sapiens
ugagaugauuuaauggagccca

SEQ ID NO: 33047 - RNA, 22 nt, Homo sapiens
ugagaugcauauucuggcuccu

SEQ ID NO: 33048 - RNA, 22 nt, Homo sapiens
ugagaugcuccucuugcaaagc

SEQ ID NO: 33049 - RNA, 22 nt, Homo sapiens
ugagaugcuuguaaauucauuu

SEQ ID NO: 33050 - RNA, 22 nt, Homo sapiens
ugagauggguucugguccccug

SEQ ID NO: 33051 - RNA, 22 nt, Homo sapiens
ugagauguaaucucgcucuguc

SEQ ID NO: 33052 - RNA, 22 nt, Homo sapiens
ugagaugugaucaccugaaggg

SEQ ID NO: 33053 - RNA, 22 nt, Homo sapiens
ugagauguguccagaucuaguu

SEQ ID NO: 33054 - RNA, 22 nt, Homo sapiens
ugagauguugcucugaaacaag

SEQ ID NO: 33055 - RNA, 23 nt, Homo sapiens
ugagauuauaaucuuuuacuucu

SEQ ID NO: 33056 - RNA, 22 nt, Homo sapiens
ugagauuaucguaauguaucuc

SEQ ID NO: 33057 - RNA, 20 nt, Homo sapiens
ugagauuggugugguauaag

SEQ ID NO: 33058 - RNA, 22 nt, Homo sapiens
ugagcaagaaauagaaacagau

SEQ ID NO: 33059 - RNA, 23 nt, Homo sapiens
ugagcaauauucuacuauugagu

SEQ ID NO: 33060 - RNA, 22 nt, Homo sapiens
ugagcacagagccugggguggc

SEQ ID NO: 33061 - RNA, 22 nt, Homo sapiens
ugagcacagcgugugggagagc

SEQ ID NO: 33062 - RNA, 22 nt, Homo sapiens
ugagcacaggugcgcgguuacu

SEQ ID NO: 33063 - RNA, 22 nt, Homo sapiens
ugagcagaaguuuugauuggcg

SEQ ID NO: 33064 - RNA, 21 nt, Homo sapiens
ugagcauuaguacaguaggga

SEQ ID NO: 33065 - RNA, 22 nt, Homo sapiens
ugagcgaugggaggaagugaua

SEQ ID NO: 33066 - RNA, 22 nt, Homo sapiens
ugagcuaggauccugucacugu

SEQ ID NO: 33067 - RNA, 22 nt, Homo sapiens
ugagcuauguucuucuuguuuu

SEQ ID NO: 33068 - RNA, 22 nt, Homo sapiens
ugagcucagcuuucuuuuucac

SEQ ID NO: 33069 - RNA, 22 nt, Homo sapiens
ugagcucaguauuucauaaaca

SEQ ID NO: 33070 - RNA, 22 nt, Homo sapiens
ugagcugagaucuuaccacugc

SEQ ID NO: 33071 - RNA, 18 nt, Homo sapiens
ugaggaaaggguuugcua

SEQ ID NO: 33072 - RNA, 22 nt, Homo sapiens
ugaggacugagaggcacugugg

SEQ ID NO: 33073 - RNA, 22 nt, Homo sapiens
ugaggaguauguucuguagacc

SEQ ID NO: 33074 - RNA, 22 nt, Homo sapiens
ugaggcaagauacugauuucau

SEQ ID NO: 33075 - RNA, 22 nt, Homo sapiens
ugaggcacucccuagcggggug

SEQ ID NO: 33076 - RNA, 22 nt, Homo sapiens
ugaggcuaggauaggcugauuc

SEQ ID NO: 33077 - RNA, 22 nt, Homo sapiens
ugaggcuagucagaucagauga

SEQ ID NO: 33078 - RNA, 22 nt, Homo sapiens
ugagguaagauguucauuuuuc

SEQ ID NO: 33079 - RNA, 22 nt, Homo sapiens
ugagguaauagauaauauuuuu

SEQ ID NO: 33080 - RNA, 22 nt, Homo sapiens
ugagguagguaccauuaucacu

SEQ ID NO: 33081 - RNA, 22 nt, Homo sapiens
ugagguaugugaugucuuuuag

SEQ ID NO: 33082 - RNA, 22 nt, Homo sapiens
ugaggucacuuguuuuaugcuu

SEQ ID NO: 33083 - RNA, 20 nt, Homo sapiens
ugaggucaggaguuacagac

SEQ ID NO: 33084 - RNA, 21 nt, Homo sapiens
ugaggucaugaugcugcuucc

SEQ ID NO: 33085 - RNA, 22 nt, Homo sapiens
ugaggugaggguaucaaaugcu

SEQ ID NO: 33086 - RNA, 22 nt, Homo sapiens
ugaggugcagcaauccucaugu

SEQ ID NO: 33087 - RNA, 22 nt, Homo sapiens
ugagguguauugggggaaauuc

SEQ ID NO: 33088 - RNA, 22 nt, Homo sapiens
ugagguguuauccagaguucuu

SEQ ID NO: 33089 - RNA, 22 nt, Homo sapiens
ugagguguuugugcaccaucug

SEQ ID NO: 33090 - RNA, 22 nt, Homo sapiens
ugagguugguauuacugucucu

SEQ ID NO: 33091 - RNA, 22 nt, Homo sapiens
ugagguuguccacuauaaucca

SEQ ID NO: 33092 - RNA, 22 nt, Homo sapiens
ugaguacuacuaguuacugcua

SEQ ID NO: 33093 - RNA, 23 nt, Homo sapiens
ugaguaggugguuuuccccucac

SEQ ID NO: 33094 - RNA, 17 nt, Homo sapiens
uucucaguucugaucuc

SEQ ID NO: 33095 - RNA, 22 nt, Homo sapiens
uucucuggucagaggggagguu

SEQ ID NO: 33096 - RNA, 22 nt, Homo sapiens
uucucuguggauugggugagag

SEQ ID NO: 33097 - RNA, 22 nt, Homo sapiens
uucugaguggcuuucaacacug

SEQ ID NO: 33098 - RNA, 22 nt, Homo sapiens
uucugccaaucaacccacaucc

SEQ ID NO: 33099 - RNA, 23 nt, Homo sapiens
uucugccacugaaaaugccucag

SEQ ID NO: 33100 - RNA, 22 nt, Homo sapiens
uucuggcuaugggauacuaaau

SEQ ID NO: 33101 - RNA, 22 nt, Homo sapiens
uucuggcuuauaaacgugacuu

SEQ ID NO: 33102 - RNA, 22 nt, Homo sapiens
uucugugcugaaucaaagacug

SEQ ID NO: 33103 - RNA, 22 nt, Homo sapiens
uuggaaaccucugcagguguuu

SEQ ID NO: 33104 - RNA, 22 nt, Homo sapiens
uuggaagacaaugcugauucuc

SEQ ID NO: 33105 - RNA, 22 nt, Homo sapiens
uuggaagagaagggagauaaac

SEQ ID NO: 33106 - RNA, 22 nt, Homo sapiens
uuggaagauuacuuaguuuucu

SEQ ID NO: 33107 - RNA, 22 nt, Homo sapiens
uuggaaggcuccuaaugaaugg

SEQ ID NO: 33108 - RNA, 22 nt, Homo sapiens
uuggaauauuauuauugggcag

SEQ ID NO: 33109 - RNA, 22 nt, Homo sapiens
uuggaaugcacacugagccugc

SEQ ID NO: 33110 - RNA, 22 nt, Homo sapiens
uuggaaugugacugauaauauu

SEQ ID NO: 33111 - RNA, 22 nt, Homo sapiens
uuggaauuaagagauauuuucu

SEQ ID NO: 33112 - RNA, 22 nt, Homo sapiens
uuggaauuuuaaaauaggcaac

SEQ ID NO: 33113 - RNA, 19 nt, Homo sapiens
uuggaauuuuagaguuuga

SEQ ID NO: 33114 - RNA, 22 nt, Homo sapiens
uuggacaagauugcagagaauu

SEQ ID NO: 33115 - RNA, 22 nt, Homo sapiens
uuggacagaugguuacauuuuu

SEQ ID NO: 33116 - RNA, 18 nt, Homo sapiens
uuggacggagagucaaau

SEQ ID NO: 33117 - RNA, 22 nt, Homo sapiens
uuggacucccuccccagcuuca

SEQ ID NO: 33118 - RNA, 22 nt, Homo sapiens
uuggacuuuaagauagagaugu

SEQ ID NO: 33119 - RNA, 22 nt, Homo sapiens
uuggagagagaggacucccggc

SEQ ID NO: 33120 - RNA, 22 nt, Homo sapiens
uuggagucaucucuguacugua

SEQ ID NO: 33121 - RNA, 22 nt, Homo sapiens
uuggauaguuuaugaaaaaugg

SEQ ID NO: 33122 - RNA, 22 nt, Homo sapiens
uuggcaagaaccuucuuccaag

SEQ ID NO: 33123 - RNA, 22 nt, Homo sapiens
uuggcaaguuucugucagcaaa

SEQ ID NO: 33124 - RNA, 22 nt, Homo sapiens
uuggcaauugcuaugauuugaa

SEQ ID NO: 33125 - RNA, 21 nt, Homo sapiens
uuggcacucuucucuccuuau

SEQ ID NO: 33126 - RNA, 22 nt, Homo sapiens
uuggcacugagcaagaacaggg

SEQ ID NO: 33127 - RNA, 22 nt, Homo sapiens
uuggcagcauuccagccaagca

SEQ ID NO: 33128 - RNA, 22 nt, Homo sapiens
uuggcagcuguggaaucugggc

SEQ ID NO: 33129 - RNA, 22 nt, Homo sapiens
uuggcauuguggauggaaucau

SEQ ID NO: 33130 - RNA, 20 nt, Homo sapiens
uuggcauuuagacaagaguu

SEQ ID NO: 33131 - RNA, 22 nt, Homo sapiens
uuggcccugcugaccauucccu

SEQ ID NO: 33132 - RNA, 19 nt, Homo sapiens
uuggcccugguucucuucu

SEQ ID NO: 33133 - RNA, 22 nt, Homo sapiens
uuggcuaagaucacgugagaau

SEQ ID NO: 33134 - RNA, 22 nt, Homo sapiens
uuggcucugcgucucgcggacg

SEQ ID NO: 33135 - RNA, 22 nt, Homo sapiens
uuggcucuggcugggcuccagc

SEQ ID NO: 33136 - RNA, 22 nt, Homo sapiens
uuggcuuaguugaccacagucu

SEQ ID NO: 33137 - RNA, 22 nt, Homo sapiens
uuggcuucuggacuauugugca

SEQ ID NO: 33138 - RNA, 22 nt, Homo sapiens
uugggccacuuuaguuuccuua

SEQ ID NO: 33139 - RNA, 22 nt, Homo sapiens
uugguauguaauuuauauugua

SEQ ID NO: 33140 - RNA, 22 nt, Homo sapiens
uuggucaggcuaaucucgaacg

SEQ ID NO: 33141 - RNA, 22 nt, Homo sapiens
uuggucaggcuagaguguggug

SEQ ID NO: 33142 - RNA, 22 nt, Homo sapiens
uugguccccuucaaccagcugu

SEQ ID NO: 33143 - RNA, 19 nt, Homo sapiens
uuggucccuuuggguucuu

SEQ ID NO: 33144 - RNA, 22 nt, Homo sapiens
uugguccucccaugcucaagag

SEQ ID NO: 33145 - RNA, 22 nt, Homo sapiens
uuggucucaucaagagcagcuu

SEQ ID NO: 33146 - RNA, 22 nt, Homo sapiens
uuggucugcucugauguuuucu

SEQ ID NO: 33147 - RNA, 22 nt, Homo sapiens
uugguuaccuucagaaaugagu

SEQ ID NO: 33148 - RNA, 22 nt, Homo sapiens
uugguuauccugucgguaauuc

SEQ ID NO: 33149 - RNA, 22 nt, Homo sapiens
uugguucucuuuauaugcugga

SEQ ID NO: 33150 - RNA, 22 nt, Homo sapiens
uuguaaagaucauaugcuguuc

SEQ ID NO: 33151 - RNA, 22 nt, Homo sapiens
uuguaaaguucucucccgaaaa

SEQ ID NO: 33152 - RNA, 22 nt, Homo sapiens
uuguaacaguuuauugacucga

SEQ ID NO: 33153 - RNA, 22 nt, Homo sapiens
uuguaacucugaauacauccua

SEQ ID NO: 33154 - RNA, 22 nt, Homo sapiens
uuguaauguuaccaaauggugu

SEQ ID NO: 33155 - RNA, 20 nt, Homo sapiens
uuguacuccugggcucaagc

SEQ ID NO: 33156 - RNA, 22 nt, Homo sapiens
uuguacuggguuuucuggaauu

SEQ ID NO: 33157 - RNA, 21 nt, Homo sapiens
uuguagcagcauaaucccaga

SEQ ID NO: 33158 - RNA, 21 nt, Homo sapiens
uuguaugguugaacuugauac

SEQ ID NO: 33159 - RNA, 22 nt, Homo sapiens
uuguauguuuguucuuucagau

SEQ ID NO: 33160 - RNA, 22 nt, Homo sapiens
uuguauugucuugaugaguuga

SEQ ID NO: 33161 - RNA, 22 nt, Homo sapiens
uugucacccuacauaacaggga

SEQ ID NO: 33162 - RNA, 22 nt, Homo sapiens
uugucacugcacuccagucugg

SEQ ID NO: 33163 - RNA, 22 nt, Homo sapiens
uuguccaagucccauuuguuga

SEQ ID NO: 33164 - RNA, 22 nt, Homo sapiens
uuguccccacccaaaugucauc

SEQ ID NO: 33165 - RNA, 22 nt, Homo sapiens
uuguccccaucugcugccagaa

SEQ ID NO: 33166 - RNA, 16 nt, Homo sapiens
uugucccuucccaaau

SEQ ID NO: 33167 - RNA, 22 nt, Homo sapiens
uuguccuggagguucuugcaag

SEQ ID NO: 33168 - RNA, 22 nt, Homo sapiens
uuguccuugagauaguuugcag

SEQ ID NO: 33169 - RNA, 22 nt, Homo sapiens
uuguccuugagauaguuugcug

SEQ ID NO: 33170 - RNA, 22 nt, Homo sapiens
uugucuagugaauacauuaaug

SEQ ID NO: 33171 - RNA, 22 nt, Homo sapiens
uugucuugcagcuuaggcauca

SEQ ID NO: 33172 - RNA, 22 nt, Homo sapiens
uugugaaaucuaggcagagguu

SEQ ID NO: 33173 - RNA, 22 nt, Homo sapiens
uugugaaugaugccgcaauaaa

SEQ ID NO: 33174 - RNA, 22 nt, Homo sapiens
uugugaaugaugucgcaauaaa

SEQ ID NO: 33175 - RNA, 22 nt, Homo sapiens
uugugaauggugccgcaguaaa

SEQ ID NO: 33176 - RNA, 22 nt, Homo sapiens
uugugcacauguacccuagaac

SEQ ID NO: 33177 - RNA, 22 nt, Homo sapiens
uugugcaugaugcauacauggu

SEQ ID NO: 33178 - RNA, 20 nt, Homo sapiens
uugugcauugggccauuggg

SEQ ID NO: 33179 - RNA, 22 nt, Homo sapiens
uugugccccuucucagucgggc

SEQ ID NO: 33180 - RNA, 22 nt, Homo sapiens
uugugcuuaauaaaaaguggua

SEQ ID NO: 33181 - RNA, 22 nt, Homo sapiens
uugugcuucaucaccuagcaga

SEQ ID NO: 33182 - RNA, 22 nt, Homo sapiens
uugugcuugauuugccuagcug

SEQ ID NO: 33183 - RNA, 22 nt, Homo sapiens
uugugcuugcuguguucuaugc

SEQ ID NO: 33184 - RNA, 22 nt, Homo sapiens
uugugcuuguaacuacauucag

SEQ ID NO: 33185 - RNA, 22 nt, Homo sapiens
uuguggcuuaucucauuuagcg

SEQ ID NO: 33186 - RNA, 22 nt, Homo sapiens
uugugguagugaaugagucuca

SEQ ID NO: 33187 - RNA, 22 nt, Homo sapiens
uuguuaagaugcagauucugga

SEQ ID NO: 33188 - RNA, 17 nt, Homo sapiens
uuguucccauuaaaaag

SEQ ID NO: 33189 - RNA, 22 nt, Homo sapiens
uuguuuagagacuggaauuaaa

SEQ ID NO: 33190 - RNA, 22 nt, Homo sapiens
uuuaaacugucuuggguuugga

SEQ ID NO: 33191 - RNA, 22 nt, Homo sapiens
ugguuguuuuaaaugucgucug

SEQ ID NO: 33192 - RNA, 23 nt, Homo sapiens
ugguuuguaagagauggacugga

SEQ ID NO: 33193 - RNA, 22 nt, Homo sapiens
uguaaacauguauguguuuaug

SEQ ID NO: 33194 - RNA, 22 nt, Homo sapiens
uguacaaaacaagaugggggua

SEQ ID NO: 33195 - RNA, 22 nt, Homo sapiens
uguacuagaaauuaaggcaggg

SEQ ID NO: 33196 - RNA, 22 nt, Homo sapiens
uguagacagcacguaguugagu

SEQ ID NO: 33197 - RNA, 22 nt, Homo sapiens
uguagauaucauuagugcugug

SEQ ID NO: 33198 - RNA, 22 nt, Homo sapiens
uguagauaucuaucaggucaau

SEQ ID NO: 33199 - RNA, 22 nt, Homo sapiens
uguagguguacauacaugguua

SEQ ID NO: 33200 - RNA, 21 nt, Homo sapiens
uguauacauggaagaaugguc

SEQ ID NO: 33201 - RNA, 22 nt, Homo sapiens
uguauacugucuaauauguugu

SEQ ID NO: 33202 - RNA, 22 nt, Homo sapiens
uguaugaguuguuuauaaauuu

SEQ ID NO: 33203 - RNA, 22 nt, Homo sapiens
ugucaaagagacaucugcacuc

SEQ ID NO: 33204 - RNA, 22 nt, Homo sapiens
ucugguuccugcauucauucaa

SEQ ID NO: 33205 - RNA, 22 nt, Homo sapiens
ucuguacuccuugaguagugcu

SEQ ID NO: 33206 - RNA, 22 nt, Homo sapiens
ucuguaguuaacagcuucagcu

SEQ ID NO: 33207 - RNA, 22 nt, Homo sapiens
ucugucacugguggacgaucac

SEQ ID NO: 33208 - RNA, 22 nt, Homo sapiens
ucugucuugugguuugagugcc

SEQ ID NO: 33209 - RNA, 22 nt, Homo sapiens
ucugugaaaucauuuccuguaa

SEQ ID NO: 33210 - RNA, 22 nt, Homo sapiens
uugcaaaguuugccuccuguag

SEQ ID NO: 33211 - RNA, 21 nt, Homo sapiens
uugcaaaugcugcugccugau

SEQ ID NO: 33212 - RNA, 22 nt, Homo sapiens
uugcaacauguauucuggugau

SEQ ID NO: 33213 - RNA, 22 nt, Homo sapiens
uugcaagaaaugcagauucuca

SEQ ID NO: 33214 - RNA, 22 nt, Homo sapiens
uugcaagauguucaugggcugu

SEQ ID NO: 33215 - RNA, 22 nt, Homo sapiens
uugcaaugugaugugauuugga

SEQ ID NO: 33216 - RNA, 22 nt, Homo sapiens
uugcacagugcuuucuuugccc

SEQ ID NO: 33217 - RNA, 22 nt, Homo sapiens
uugcacaguguguacagcacca

SEQ ID NO: 33218 - RNA, 22 nt, Homo sapiens
uugcacauugauuuuguauccu

SEQ ID NO: 33219 - RNA, 22 nt, Homo sapiens
uugcacauugcaccuuuuguau

SEQ ID NO: 33220 - RNA, 22 nt, Homo sapiens
uugcacuccggccuggguaaca

SEQ ID NO: 33221 - RNA, 22 nt, Homo sapiens
uugcacuguaauuuauuuaugu

SEQ ID NO: 33222 - RNA, 22 nt, Homo sapiens
uugcacuuccgccugggugaca

SEQ ID NO: 33223 - RNA, 22 nt, Homo sapiens
uugcauaagugcauucugugau

SEQ ID NO: 33224 - RNA, 22 nt, Homo sapiens
uugcaugguuuuuaucugaaau

SEQ ID NO: 33225 - RNA, 22 nt, Homo sapiens
uugccaauauuuuacugagaag

SEQ ID NO: 33226 - RNA, 22 nt, Homo sapiens
uugccauagugcugccagauau

SEQ ID NO: 33227 - RNA, 22 nt, Homo sapiens
uugccuaggcuggaguucagug

SEQ ID NO: 33228 - RNA, 22 nt, Homo sapiens
uugccuaguuuaggucugugcu

SEQ ID NO: 33229 - RNA, 21 nt, Homo sapiens
uugccugacacuggaagaaau

SEQ ID NO: 33230 - RNA, 22 nt, Homo sapiens
uugcugagucuuucuagguugc

SEQ ID NO: 33231 - RNA, 20 nt, Homo sapiens
uugcugguguuagaggaggc

SEQ ID NO: 33232 - RNA, 22 nt, Homo sapiens
uugcuucauucaacauugaggg

SEQ ID NO: 33233 - RNA, 22 nt, Homo sapiens
uugcuucuuucgucuggcccca

SEQ ID NO: 33234 - RNA, 22 nt, Homo sapiens
uugcuuuguugucuggggaaua

SEQ ID NO: 33235 - RNA, 22 nt, Homo sapiens
uuggaaaguuguuguaguuauu

SEQ ID NO: 33236 - RNA, 22 nt, Homo sapiens
uuggaaauauguuaagugucau

SEQ ID NO: 33237 - RNA, 20 nt, Homo sapiens
uuggaaaugugaauugggag

SEQ ID NO: 33238 - RNA, 22 nt, Homo sapiens
uuggaaauguguuugcauucag

SEQ ID NO: 33239 - RNA, 22 nt, Homo sapiens
uuggaaguguguauguauagcu

SEQ ID NO: 33240 - RNA, 22 nt, Homo sapiens
uuggaauguacucuagccuaug

SEQ ID NO: 33241 - RNA, 22 nt, Homo sapiens
uuggaauuagacaagugguggu

SEQ ID NO: 33242 - RNA, 22 nt, Homo sapiens
uuggaauuuauuuggaugggag

SEQ ID NO: 33243 - RNA, 22 nt, Homo sapiens
uuggagcacuggggcacugaca

SEQ ID NO: 33244 - RNA, 22 nt, Homo sapiens
uuggagugugagagcagccugg

SEQ ID NO: 33245 - RNA, 22 nt, Homo sapiens
uuggagugugcucauaacugcu

SEQ ID NO: 33246 - RNA, 22 nt, Homo sapiens
uuggagugugucuuauuccauu

SEQ ID NO: 33247 - RNA, 22 nt, Homo sapiens
uuggauuuugguggcaacucau

SEQ ID NO: 33248 - RNA, 22 nt, Homo sapiens
uuggcaaguccccaccucucuc

SEQ ID NO: 33249 - RNA, 22 nt, Homo sapiens
uuggcaauauuuacugaaguug

SEQ ID NO: 33250 - RNA, 22 nt, Homo sapiens
uuggcagaauguuagaaacuua

SEQ ID NO: 33251 - RNA, 22 nt, Homo sapiens
uuggcagucugaggcacagacu

SEQ ID NO: 33252 - RNA, 22 nt, Homo sapiens
uuggccaauggugauucccggc

SEQ ID NO: 33253 - RNA, 22 nt, Homo sapiens
uuggccccuccaaaucucaugu

SEQ ID NO: 33254 - RNA, 22 nt, Homo sapiens
uuggccccucccaaauuucaug

SEQ ID NO: 33255 - RNA, 23 nt, Homo sapiens
uuggccuccuugugucuagggcu

SEQ ID NO: 33256 - RNA, 21 nt, Homo sapiens
uuggcuacugcuucagaggga

SEQ ID NO: 33257 - RNA, 22 nt, Homo sapiens
uuggcuuuuaugcagcuuaggu

SEQ ID NO: 33258 - RNA, 22 nt, Homo sapiens
uugggaauguccuaauaucucg

SEQ ID NO: 33259 - RNA, 22 nt, Homo sapiens
uugggacuggaaggaguaaggg

SEQ ID NO: 33260 - RNA, 22 nt, Homo sapiens
uugggagugucucuggacugca

SEQ ID NO: 33261 - RNA, 17 nt, Homo sapiens
uugggcaagguagguga

SEQ ID NO: 33262 - RNA, 22 nt, Homo sapiens
uugggcaaguggcaugaccaug

SEQ ID NO: 33263 - RNA, 22 nt, Homo sapiens
uugggcaauaggaagcaggugg

SEQ ID NO: 33264 - RNA, 22 nt, Homo sapiens
uugggcauugggcuaaacuccc

SEQ ID NO: 33265 - RNA, 22 nt, Homo sapiens
uugggguaggaauauggaauga

SEQ ID NO: 33266 - RNA, 22 nt, Homo sapiens
uugguaaugggcugguauaacc

SEQ ID NO: 33267 - RNA, 22 nt, Homo sapiens
uugguaggcuggccucucucag

SEQ ID NO: 33268 - RNA, 22 nt, Homo sapiens
uuggucagcuagauuauucccu

SEQ ID NO: 33269 - RNA, 22 nt, Homo sapiens
uugguccguugugaaaaggccu

SEQ ID NO: 33270 - RNA, 23 nt, Homo sapiens
uuggucucccaaaguguugagau

SEQ ID NO: 33271 - RNA, 22 nt, Homo sapiens
uugguucaguuuaacgaguaau

SEQ ID NO: 33272 - RNA, 21 nt, Homo sapiens
uugguucccucugacaggucu

SEQ ID NO: 33273 - RNA, 22 nt, Homo sapiens
uugguuccuuagccuaggacua

SEQ ID NO: 33274 - RNA, 22 nt, Homo sapiens
uugguucucuuagccaucuuaa

SEQ ID NO: 33275 - RNA, 22 nt, Homo sapiens
uuguaaacaucuguacauugcu

SEQ ID NO: 33276 - RNA, 22 nt, Homo sapiens
uuguaaucaacacaucauuggg

SEQ ID NO: 33277 - RNA, 23 nt, Homo sapiens
uuguacacuaagaaucgcagaug

SEQ ID NO: 33278 - RNA, 22 nt, Homo sapiens
uuguacaggaguguaagcuuca

SEQ ID NO: 33279 - RNA, 22 nt, Homo sapiens
uuguaccacagggcaugaagug

SEQ ID NO: 33280 - RNA, 22 nt, Homo sapiens
uuguacuagaaaauuauucuuu

SEQ ID NO: 33281 - RNA, 22 nt, Homo sapiens
uuguacuucagacaugccaaag

SEQ ID NO: 33282 - RNA, 22 nt, Homo sapiens
uuguacuuuuaguagagacggg

SEQ ID NO: 33283 - RNA, 22 nt, Homo sapiens
uuguagaucuucaguugcuaca

SEQ ID NO: 33284 - RNA, 22 nt, Homo sapiens
uuguauguaaccauuuggcaaa

SEQ ID NO: 33285 - RNA, 22 nt, Homo sapiens
uugucaaugggugagugcagag

SEQ ID NO: 33286 - RNA, 22 nt, Homo sapiens
uugucacccucucuuggugucu

SEQ ID NO: 33287 - RNA, 22 nt, Homo sapiens
uugucacucuuccuaggguagg

SEQ ID NO: 33288 - RNA, 22 nt, Homo sapiens
uugucauuuucagaguguuacg

SEQ ID NO: 33289 - RNA, 22 nt, Homo sapiens
uucacugugugacccugggcca

SEQ ID NO: 33290 - RNA, 22 nt, Homo sapiens
uucagcacaguguggaucauuc

SEQ ID NO: 33291 - RNA, 22 nt, Homo sapiens
uucagcacugaaaauaugucau

SEQ ID NO: 33292 - RNA, 22 nt, Homo sapiens
uucagcaguggccaguggaaau

SEQ ID NO: 33293 - RNA, 19 nt, Homo sapiens
uucagcagugucugcucuu

SEQ ID NO: 33294 - RNA, 22 nt, Homo sapiens
uucagcuacuugggaggcugaa

SEQ ID NO: 33295 - RNA, 22 nt, Homo sapiens
uucaggcaccauggucauugau

SEQ ID NO: 33296 - RNA, 22 nt, Homo sapiens
uucaggcuccgugccagcuccg

SEQ ID NO: 33297 - RNA, 22 nt, Homo sapiens
uucagggacuuuagacaagaga

SEQ ID NO: 33298 - RNA, 22 nt, Homo sapiens
uucaguacuucaaaaucuuuaa

SEQ ID NO: 33299 - RNA, 22 nt, Homo sapiens
uucaguaguaaguuggaacucu

SEQ ID NO: 33300 - RNA, 22 nt, Homo sapiens
uucaguccauuuccuuggucac

SEQ ID NO: 33301 - RNA, 22 nt, Homo sapiens
uucaguggagaggcugaguggu

SEQ ID NO: 33302 - RNA, 22 nt, Homo sapiens
uucagugguuauuugugagauu

SEQ ID NO: 33303 - RNA, 22 nt, Homo sapiens
uucagugucauuaacacaguag

SEQ ID NO: 33304 - RNA, 18 nt, Homo sapiens
uucaguuuguaucugggg

SEQ ID NO: 33305 - RNA, 22 nt, Homo sapiens
uucauagaggacauuacuggag

SEQ ID NO: 33306 - RNA, 22 nt, Homo sapiens
uucauaguuuauacugauauuu

SEQ ID NO: 33307 - RNA, 22 nt, Homo sapiens
uucaucacagucuccgaugccc

SEQ ID NO: 33308 - RNA, 21 nt, Homo sapiens
uucaucagccagaaaucaagc

SEQ ID NO: 33309 - RNA, 22 nt, Homo sapiens
uucaucagcuguagaugucaug

SEQ ID NO: 33310 - RNA, 20 nt, Homo sapiens
uucaucaggauauuggucua

SEQ ID NO: 33311 - RNA, 22 nt, Homo sapiens
acacauacacauaugguguaua

SEQ ID NO: 33312 - RNA, 22 nt, Homo sapiens
acacaugcuccacuguggccuc

SEQ ID NO: 33313 - RNA, 22 nt, Homo sapiens
acacaugugaaaaaaauguuac

SEQ ID NO: 33314 - RNA, 22 nt, Homo sapiens
acacaugugcguagacucuuua

SEQ ID NO: 33315 - RNA, 22 nt, Homo sapiens
acacauuagcaagugcuguuau

SEQ ID NO: 33316 - RNA, 22 nt, Homo sapiens
acaccaguacuuuauacaagca

SEQ ID NO: 33317 - RNA, 22 nt, Homo sapiens
acaccaugucuguuucugguuu

SEQ ID NO: 33318 - RNA, 22 nt, Homo sapiens
acaccauugcauuccagccugg

SEQ ID NO: 33319 - RNA, 22 nt, Homo sapiens
acaccuguggucccaguaacuu

SEQ ID NO: 33320 - RNA, 22 nt, Homo sapiens
acacuauugagguuuguuugca

SEQ ID NO: 33321 - RNA, 22 nt, Homo sapiens
acacuggaggagagcuguugcu

SEQ ID NO: 33322 - RNA, 22 nt, Homo sapiens
acacuguauccuucuguccuuu

SEQ ID NO: 33323 - RNA, 20 nt, Homo sapiens
acacugugcuaaggauuuuc

SEQ ID NO: 33324 - RNA, 22 nt, Homo sapiens
acacuguuggugggaguguaaa

SEQ ID NO: 33325 - RNA, 22 nt, Homo sapiens
acacuguuuuaguuauuauagc

SEQ ID NO: 33326 - RNA, 23 nt, Homo sapiens
acacuugcugaguaaaucaaaua

SEQ ID NO: 33327 - RNA, 22 nt, Homo sapiens
acacuuucuggagcugcacaua

SEQ ID NO: 33328 - RNA, 22 nt, Homo sapiens
acagaccuauuucaaucauuua

SEQ ID NO: 33329 - RNA, 22 nt, Homo sapiens
acagauugcugggccccagccc

SEQ ID NO: 33330 - RNA, 22 nt, Homo sapiens
acaguaaugggccccuuuuccu

SEQ ID NO: 33331 - RNA, 21 nt, Homo sapiens
acaguaguaauaguguagcca

SEQ ID NO: 33332 - RNA, 22 nt, Homo sapiens
acaguagugggcuacagaauca

SEQ ID NO: 33333 - RNA, 22 nt, Homo sapiens
acaguauaaugcuguagggaga

SEQ ID NO: 33334 - RNA, 23 nt, Homo sapiens
acaguauguggauguggcuaagu

SEQ ID NO: 33335 - RNA, 19 nt, Homo sapiens
acaguauugugcacagguu

SEQ ID NO: 33336 - RNA, 22 nt, Homo sapiens
acagucuggagaaugggugcuc

SEQ ID NO: 33337 - RNA, 22 nt, Homo sapiens
acagugcugucugcuuuggcua

SEQ ID NO: 33338 - RNA, 22 nt, Homo sapiens
acagugcuucugauaugaugcc

SEQ ID NO: 33339 - RNA, 22 nt, Homo sapiens
acagugcuuucaauguucagua

SEQ ID NO: 33340 - RNA, 17 nt, Homo sapiens
acagugcuuugcuuucc

SEQ ID NO: 33341 - RNA, 19 nt, Homo sapiens
acagugcuuugucagaagc

SEQ ID NO: 33342 - RNA, 23 nt, Homo sapiens
acaguggugugaucuuggcucag

SEQ ID NO: 33343 - RNA, 22 nt, Homo sapiens
acaguguuacuugauaguguau

SEQ ID NO: 33344 - RNA, 22 nt, Homo sapiens
acauaaagaagcaggacauugu

SEQ ID NO: 33345 - RNA, 22 nt, Homo sapiens
acaucaggcuugugaugauuac

SEQ ID NO: 33346 - RNA, 22 nt, Homo sapiens
acaucauugggggcuacaggug

SEQ ID NO: 33347 - RNA, 22 nt, Homo sapiens
acaucccuuucccacccuucac

SEQ ID NO: 33348 - RNA, 22 nt, Homo sapiens
acaucuguacaguggguguggu

SEQ ID NO: 33349 - RNA, 22 nt, Homo sapiens
acaugacauugggguggggaua

SEQ ID NO: 33350 - RNA, 22 nt, Homo sapiens
acaugagacuggguuuguaggg

SEQ ID NO: 33351 - RNA, 22 nt, Homo sapiens
acaugcauauguuggaagaaag

SEQ ID NO: 33352 - RNA, 22 nt, Homo sapiens
acaugcauggcaugcauuguac

SEQ ID NO: 33353 - RNA, 22 nt, Homo sapiens
acaugccucccugguccgcugu

SEQ ID NO: 33354 - RNA, 22 nt, Homo sapiens
acauggcacugcgggcuucuug

SEQ ID NO: 33355 - RNA, 22 nt, Homo sapiens
acauguaauugauuuuguguua

SEQ ID NO: 33356 - RNA, 21 nt, Homo sapiens
acauguacacauguaugcaca

SEQ ID NO: 33357 - RNA, 22 nt, Homo sapiens
accacuguuucaagaagcuugu

SEQ ID NO: 33358 - RNA, 22 nt, Homo sapiens
accaucuagauuuguguaggua

SEQ ID NO: 33359 - RNA, 22 nt, Homo sapiens
acccagaguuccuugucuuuca

SEQ ID NO: 33360 - RNA, 22 nt, Homo sapiens
acccaguagucauucaggagca

SEQ ID NO: 33361 - RNA, 22 nt, Homo sapiens
acccaguguugggcagaacugu

SEQ ID NO: 33362 - RNA, 17 nt, Homo sapiens
accccuaccucagaagc

SEQ ID NO: 33363 - RNA, 22 nt, Homo sapiens
accccugugacggguauuugag

SEQ ID NO: 33364 - RNA, 22 nt, Homo sapiens
acccucagaccaguuucccugg

SEQ ID NO: 33365 - RNA, 22 nt, Homo sapiens
acccuggagagugcuguaguaa

SEQ ID NO: 33366 - RNA, 22 nt, Homo sapiens
acccuggaggucuacagugcag

SEQ ID NO: 33367 - RNA, 22 nt, Homo sapiens
acccuggauucguggccuugaa

SEQ ID NO: 33368 - RNA, 22 nt, Homo sapiens
acccuguaggugcuggcagaga

SEQ ID NO: 33369 - RNA, 19 nt, Homo sapiens
acccuguccccaccuuuac

SEQ ID NO: 33370 - RNA, 18 nt, Homo sapiens
acccuucagcacugggcc

SEQ ID NO: 33371 - RNA, 22 nt, Homo sapiens
acccuuugucaaucaguacuaa

SEQ ID NO: 33372 - RNA, 22 nt, Homo sapiens
accgggcugagcgcaggccccg

SEQ ID NO: 33373 - RNA, 22 nt, Homo sapiens
accugagacuaggcauuuuaua

SEQ ID NO: 33374 - RNA, 22 nt, Homo sapiens
aggugcuaucugguuuuauagu

SEQ ID NO: 33375 - RNA, 22 nt, Homo sapiens
aggugguauuuaaaauuauuug

SEQ ID NO: 33376 - RNA, 22 nt, Homo sapiens
aggugguguuggguuccagccc

SEQ ID NO: 33377 - RNA, 22 nt, Homo sapiens
aggugguuuuaggcagagacau

SEQ ID NO: 33378 - RNA, 21 nt, Homo sapiens
aggugucuuggguucccuggc

SEQ ID NO: 33379 - RNA, 22 nt, Homo sapiens
agguuguugcaugcuccuuagg

SEQ ID NO: 33380 - RNA, 22 nt, Homo sapiens
aguaaagcaucagcuagaugug

SEQ ID NO: 33381 - RNA, 22 nt, Homo sapiens
aguaacauuucuaguagagagu

SEQ ID NO: 33382 - RNA, 22 nt, Homo sapiens
aguacacuguugaacagaagug

SEQ ID NO: 33383 - RNA, 22 nt, Homo sapiens
aguauguuuugaaaccaagaag

SEQ ID NO: 33384 - RNA, 22 nt, Homo sapiens
aguauuuguuggaauaccuguu

SEQ ID NO: 33385 - RNA, 22 nt, Homo sapiens
agucaagaugagauuugggugg

SEQ ID NO: 33386 - RNA, 22 nt, Homo sapiens
agucaaggaggccuuucagaug

SEQ ID NO: 33387 - RNA, 22 nt, Homo sapiens
agucaaguuuuuucagagaaua

SEQ ID NO: 33388 - RNA, 22 nt, Homo sapiens
agucacagugaccuugucugac

SEQ ID NO: 33389 - RNA, 17 nt, Homo sapiens
agucaguaguuuguauu

SEQ ID NO: 33390 - RNA, 22 nt, Homo sapiens
agucagugucuguaaggagaac

SEQ ID NO: 33391 - RNA, 22 nt, Homo sapiens
agucaguguguauugauggcac

SEQ ID NO: 33392 - RNA, 22 nt, Homo sapiens
agucauagaguuugcccuucuc

SEQ ID NO: 33393 - RNA, 22 nt, Homo sapiens
agucauaggagagauaucacug

SEQ ID NO: 33394 - RNA, 22 nt, Homo sapiens
agucauggaucacaguagccuc

SEQ ID NO: 33395 - RNA, 22 nt, Homo sapiens
agucauggcagaaggcaccucu

SEQ ID NO: 33396 - RNA, 22 nt, Homo sapiens
aguccauuugaugaugauucca

SEQ ID NO: 33397 - RNA, 22 nt, Homo sapiens
agugaacacagcuucuuugguu

SEQ ID NO: 33398 - RNA, 22 nt, Homo sapiens
agugaauguuggaaaguuauuu

SEQ ID NO: 33399 - RNA, 22 nt, Homo sapiens
agugacuagaauaugaauuuua

SEQ ID NO: 33400 - RNA, 22 nt, Homo sapiens
agugauauguuugccuugaggg

SEQ ID NO: 33401 - RNA, 22 nt, Homo sapiens
agugcaaagccgagguuucuug

SEQ ID NO: 33402 - RNA, 22 nt, Homo sapiens
agugcaauaaggauguagaacu

SEQ ID NO: 33403 - RNA, 22 nt, Homo sapiens
agugcaauggcgugaucuuggc

SEQ ID NO: 33404 - RNA, 22 nt, Homo sapiens
agugcaguggcacaaucuuggc

SEQ ID NO: 33405 - RNA, 22 nt, Homo sapiens
agugcaguggcauggucauaac

SEQ ID NO: 33406 - RNA, 22 nt, Homo sapiens
agugcauugcaucucugcuuca

SEQ ID NO: 33407 - RNA, 22 nt, Homo sapiens
agugccaaaucgagggcucuga

SEQ ID NO: 33408 - RNA, 22 nt, Homo sapiens
agugccauggcugcuagauggc

SEQ ID NO: 33409 - RNA, 19 nt, Homo sapiens
agugggcuagaaaucaggg

SEQ ID NO: 33410 - RNA, 19 nt, Homo sapiens
aguggguguuuucuguuug

SEQ ID NO: 33411 - RNA, 22 nt, Homo sapiens
agugguaguacaggagauaccg

SEQ ID NO: 33412 - RNA, 22 nt, Homo sapiens
auagugaacuuugugagaacaa

SEQ ID NO: 33413 - RNA, 22 nt, Homo sapiens
auagugcugcaaaaaacauacg

SEQ ID NO: 33414 - RNA, 22 nt, Homo sapiens
auagugcugcaauaaacauaug

SEQ ID NO: 33415 - RNA, 22 nt, Homo sapiens
auagugcugcaaucaacauaca

SEQ ID NO: 33416 - RNA, 22 nt, Homo sapiens
auagugcugcauuaaacauacg

SEQ ID NO: 33417 - RNA, 22 nt, Homo sapiens
auagugcuggaauaaauauacg

SEQ ID NO: 33418 - RNA, 19 nt, Homo sapiens
auaguguaggaaaacagcu

SEQ ID NO: 33419 - RNA, 22 nt, Homo sapiens
auauaugcacacgugugcauau

SEQ ID NO: 33420 - RNA, 22 nt, Homo sapiens
auauaugcuaagugcuaauaaa

SEQ ID NO: 33421 - RNA, 22 nt, Homo sapiens
auaucaaggccauuuucuaaau

SEQ ID NO: 33422 - RNA, 22 nt, Homo sapiens
auauccguacaguggaauauua

SEQ ID NO: 33423 - RNA, 22 nt, Homo sapiens
auauccuggagcauuuuugcaa

SEQ ID NO: 33424 - RNA, 20 nt, Homo sapiens
auaugcagacacauacauac

SEQ ID NO: 33425 - RNA, 22 nt, Homo sapiens
auaugcuaauuuuuagucgagc

SEQ ID NO: 33426 - RNA, 22 nt, Homo sapiens
auauggcuaugugagcauacca

SEQ ID NO: 33427 - RNA, 22 nt, Homo sapiens
auauggguauuaagaaucaaaa

SEQ ID NO: 33428 - RNA, 22 nt, Homo sapiens
auauggucccuguucucaagga

SEQ ID NO: 33429 - RNA, 22 nt, Homo sapiens
auauguaguauggaaacauugu

SEQ ID NO: 33430 - RNA, 21 nt, Homo sapiens
auauuacuguuagaggacugc

SEQ ID NO: 33431 - RNA, 22 nt, Homo sapiens
auauuagcacuaaugucacgau

SEQ ID NO: 33432 - RNA, 22 nt, Homo sapiens
auauuagguuggugcaaaagua

SEQ ID NO: 33433 - RNA, 22 nt, Homo sapiens
auauuggacugugcuaguuaga

SEQ ID NO: 33434 - RNA, 22 nt, Homo sapiens
auauuugguuaccugugggucu

SEQ ID NO: 33435 - RNA, 20 nt, Homo sapiens
aucaaagacuuagaggggga

SEQ ID NO: 33436 - RNA, 22 nt, Homo sapiens
aucaaagcagcauggcccaguc

SEQ ID NO: 33437 - RNA, 22 nt, Homo sapiens
aucaaagugaaauauuaguuau

SEQ ID NO: 33438 - RNA, 22 nt, Homo sapiens
aucaaaguuucccagaaguugu

SEQ ID NO: 33439 - RNA, 22 nt, Homo sapiens
aucaagcugcuuguuugaaucu

SEQ ID NO: 33440 - RNA, 22 nt, Homo sapiens
aucacaauuguacguaggagcc

SEQ ID NO: 33441 - RNA, 22 nt, Homo sapiens
aucacagagucacgggcaacuu

SEQ ID NO: 33442 - RNA, 22 nt, Homo sapiens
aucacagguacuauggcugaca

SEQ ID NO: 33443 - RNA, 22 nt, Homo sapiens
aucacaggucaaaucauuauuu

SEQ ID NO: 33444 - RNA, 22 nt, Homo sapiens
aucacagugagcauaugucuau

SEQ ID NO: 33445 - RNA, 22 nt, Homo sapiens
aucacaguggucagguauagau

SEQ ID NO: 33446 - RNA, 22 nt, Homo sapiens
aucacaguuauaacauccuuuu

SEQ ID NO: 33447 - RNA, 22 nt, Homo sapiens
aucacaguuuuaccauuuggua

SEQ ID NO: 33448 - RNA, 22 nt, Homo sapiens
aucacauggccuagccuaaccu

SEQ ID NO: 33449 - RNA, 19 nt, Homo sapiens
aucaccauuauuuggaaca

SEQ ID NO: 33450 - RNA, 22 nt, Homo sapiens
aucaccuggaggugaucacuug

SEQ ID NO: 33451 - RNA, 22 nt, Homo sapiens
aucaccuuucccuuucugaauc

SEQ ID NO: 33452 - RNA, 22 nt, Homo sapiens
aucacuagaucauagguaaaca

SEQ ID NO: 33453 - RNA, 22 nt, Homo sapiens
aucacugggcaagauaucauga

SEQ ID NO: 33454 - RNA, 22 nt, Homo sapiens
agcaacauuguucauaauagcu

SEQ ID NO: 33455 - RNA, 22 nt, Homo sapiens
agcaacauuuuugaccuuucuu

SEQ ID NO: 33456 - RNA, 22 nt, Homo sapiens
agcaagaaugaacucucccaga

SEQ ID NO: 33457 - RNA, 22 nt, Homo sapiens
agcaagacauggcuuccaaaug

SEQ ID NO: 33458 - RNA, 22 nt, Homo sapiens
agcaccacaauuuccugccuaa

SEQ ID NO: 33459 - RNA, 22 nt, Homo sapiens
agcaccauuguacuccagccug

SEQ ID NO: 33460 - RNA, 22 nt, Homo sapiens
agcaccguucaaacccagguua

SEQ ID NO: 33461 - RNA, 22 nt, Homo sapiens
agcagcaucgggaaguuggcca

SEQ ID NO: 33462 - RNA, 22 nt, Homo sapiens
agcagcaugaggggacuucugc

SEQ ID NO: 33463 - RNA, 22 nt, Homo sapiens
agcagcauggguauaaaucucc

SEQ ID NO: 33464 - RNA, 22 nt, Homo sapiens
agcagcauuaguggaaucuugu

SEQ ID NO: 33465 - RNA, 22 nt, Homo sapiens
agcagcauuaugauauaucuua

SEQ ID NO: 33466 - RNA, 22 nt, Homo sapiens
agcagcgacacccuguggugag

SEQ ID NO: 33467 - RNA, 22 nt, Homo sapiens
agcagcuuugcauggccuguga

SEQ ID NO: 33468 - RNA, 21 nt, Homo sapiens
agcagcuuugguugaagcaga

SEQ ID NO: 33469 - RNA, 22 nt, Homo sapiens
agcaggacaauaugggaucagg

SEQ ID NO: 33470 - RNA, 22 nt, Homo sapiens
agcaguagaauuccugcaucac

SEQ ID NO: 33471 - RNA, 22 nt, Homo sapiens
agcagugucauuuucuggugag

SEQ ID NO: 33472 - RNA, 22 nt, Homo sapiens
agcagugugaaaugauuuaagg

SEQ ID NO: 33473 - RNA, 22 nt, Homo sapiens
agcaucacaugggcugcuuggg

SEQ ID NO: 33474 - RNA, 20 nt, Homo sapiens
agcaucagugguaguguugc

SEQ ID NO: 33475 - RNA, 19 nt, Homo sapiens
agcaucauuauuguuuugg

SEQ ID NO: 33476 - RNA, 20 nt, Homo sapiens
agcaucauugcaauuuguca

SEQ ID NO: 33477 - RNA, 22 nt, Homo sapiens
agcauggucacuuugggcccca

SEQ ID NO: 33478 - RNA, 17 nt, Homo sapiens
agcauguguuugagauu

SEQ ID NO: 33479 - RNA, 20 nt, Homo sapiens
agcauugguuagaacaguag

SEQ ID NO: 33480 - RNA, 16 nt, Homo sapiens
agccaccauuuacuug

SEQ ID NO: 33481 - RNA, 21 nt, Homo sapiens
agccaguguuccuuguggcuc

SEQ ID NO: 33482 - RNA, 22 nt, Homo sapiens
agcccauuuugcacugagaugc

SEQ ID NO: 33483 - RNA, 22 nt, Homo sapiens
agcuaacauuuuuccucuucca

SEQ ID NO: 33484 - RNA, 22 nt, Homo sapiens
agcuccuuucugcagguagguu

SEQ ID NO: 33485 - RNA, 22 nt, Homo sapiens
agcugcauucguaucauauugu

SEQ ID NO: 33486 - RNA, 22 nt, Homo sapiens
agcuggauuguuuaccuggggc

SEQ ID NO: 33487 - RNA, 22 nt, Homo sapiens
agcugguauuuugucaaggaua

SEQ ID NO: 33488 - RNA, 22 nt, Homo sapiens
agcuggucuuggggaagaguag

SEQ ID NO: 33489 - RNA, 21 nt, Homo sapiens
agcugguuucuucuuacuccu

SEQ ID NO: 33490 - RNA, 19 nt, Homo sapiens
agcuguguugccugugaga

SEQ ID NO: 33491 - RNA, 22 nt, Homo sapiens
agcuguuguacacuuuaccuuu

SEQ ID NO: 33492 - RNA, 22 nt, Homo sapiens
agcuguuguucucagaggcuuu

SEQ ID NO: 33493 - RNA, 22 nt, Homo sapiens
agcuguuuuugugggcauguga

SEQ ID NO: 33494 - RNA, 22 nt, Homo sapiens
agcuucacaaugcagagggcag

SEQ ID NO: 33495 - RNA, 22 nt, Homo sapiens
agcuucauucugaauagguuga

SEQ ID NO: 33496 - RNA, 22 nt, Homo sapiens
agcuucauuguuaugaauguca

SEQ ID NO: 33497 - RNA, 22 nt, Homo sapiens
agcuugugauucuccaucaugu

SEQ ID NO: 33498 - RNA, 21 nt, Homo sapiens
agcuuguguguaucacagugu

SEQ ID NO: 33499 - RNA, 22 nt, Homo sapiens
aggaagacugaaauugcuguuc

SEQ ID NO: 33500 - RNA, 22 nt, Homo sapiens
aggaagguaaacuaacuugccu

SEQ ID NO: 33501 - RNA, 22 nt, Homo sapiens
auucacuuuuauagacaggucu

SEQ ID NO: 33502 - RNA, 22 nt, Homo sapiens
auucagaggggcagcugucuug

SEQ ID NO: 33503 - RNA, 22 nt, Homo sapiens
auucaucagggauacuggccug

SEQ ID NO: 33504 - RNA, 20 nt, Homo sapiens
auucauggugguacguuguc

SEQ ID NO: 33505 - RNA, 22 nt, Homo sapiens
auuccacaguuaacacagaccg

SEQ ID NO: 33506 - RNA, 22 nt, Homo sapiens
auuccacuuagugacucauuug

SEQ ID NO: 33507 - RNA, 22 nt, Homo sapiens
auucuugcuugaacuuggugca

SEQ ID NO: 33508 - RNA, 22 nt, Homo sapiens
auugaacacagaguagcuuucc

SEQ ID NO: 33509 - RNA, 22 nt, Homo sapiens
auugaacuuaaaagacuugcca

SEQ ID NO: 33510 - RNA, 20 nt, Homo sapiens
auugaagacuccggggcaga

SEQ ID NO: 33511 - RNA, 22 nt, Homo sapiens
auugacaguuggccaguaagug

SEQ ID NO: 33512 - RNA, 22 nt, Homo sapiens
auugagcaauuccuaugugcuu

SEQ ID NO: 33513 - RNA, 21 nt, Homo sapiens
auugagcacaugaaacauggc

SEQ ID NO: 33514 - RNA, 22 nt, Homo sapiens
auugaguaaaaaauagugaugu

SEQ ID NO: 33515 - RNA, 22 nt, Homo sapiens
auugcaacaguguugagaggug

SEQ ID NO: 33516 - RNA, 22 nt, Homo sapiens
auugcaauuaguccauagaguu

SEQ ID NO: 33517 - RNA, 18 nt, Homo sapiens
auugcacaccagccuggg

SEQ ID NO: 33518 - RNA, 22 nt, Homo sapiens
auugcaccacugcccuccagcc

SEQ ID NO: 33519 - RNA, 22 nt, Homo sapiens
auugcacuccacccugggcaac

SEQ ID NO: 33520 - RNA, 22 nt, Homo sapiens
auugcacuccagccucggugac

SEQ ID NO: 33521 - RNA, 22 nt, Homo sapiens
auugcacuccagccugcggaac

SEQ ID NO: 33522 - RNA, 22 nt, Homo sapiens
auugcacuccagccuggcaaua

SEQ ID NO: 33523 - RNA, 22 nt, Homo sapiens
auugcacuccagccugggggac

SEQ ID NO: 33524 - RNA, 22 nt, Homo sapiens
auugcacuccagccugggugac

SEQ ID NO: 33525 - RNA, 22 nt, Homo sapiens
auugcacuccauccugggcaau

SEQ ID NO: 33526 - RNA, 22 nt, Homo sapiens
auugcacucugaucugcacucc

SEQ ID NO: 33527 - RNA, 23 nt, Homo sapiens
auugcagaaucacagagguagug

SEQ ID NO: 33528 - RNA, 22 nt, Homo sapiens
auugccucaauuccaagacugc

SEQ ID NO: 33529 - RNA, 22 nt, Homo sapiens
auugcucagucagggagcucgg

SEQ ID NO: 33530 - RNA, 22 nt, Homo sapiens
auugcuuacccuguauuagauc

SEQ ID NO: 33531 - RNA, 22 nt, Homo sapiens
auuggcaauccauauauuuucu

SEQ ID NO: 33532 - RNA, 22 nt, Homo sapiens
auuggggaaugguggcuuuagu

SEQ ID NO: 33533 - RNA, 22 nt, Homo sapiens
auuguaauuuuagagaaagugg

SEQ ID NO: 33534 - RNA, 22 nt, Homo sapiens
auuguacuccagccugggcaaa

SEQ ID NO: 33535 - RNA, 22 nt, Homo sapiens
auuguacucuagccucugggca

SEQ ID NO: 33536 - RNA, 20 nt, Homo sapiens
auuguccuugauuacacaga

SEQ ID NO: 33537 - RNA, 22 nt, Homo sapiens
cagguaggccaauguuuuccaa

SEQ ID NO: 33538 - RNA, 22 nt, Homo sapiens
cagguagucaacgggucuugga

SEQ ID NO: 33539 - RNA, 23 nt, Homo sapiens
cagguaguucuuuauaguagugu

SEQ ID NO: 33540 - RNA, 22 nt, Homo sapiens
caggugcauuggcugacaccug

SEQ ID NO: 33541 - RNA, 22 nt, Homo sapiens
caguaaauaucugagcgagguc

SEQ ID NO: 33542 - RNA, 22 nt, Homo sapiens
caguacaauguugauuagaagu

SEQ ID NO: 33543 - RNA, 22 nt, Homo sapiens
cagugauaggugguuguuggca

SEQ ID NO: 33544 - RNA, 22 nt, Homo sapiens
cagugcaaccuccaucucucgg

SEQ ID NO: 33545 - RNA, 20 nt, Homo sapiens
cagugcaccuggcguguuga

SEQ ID NO: 33546 - RNA, 22 nt, Homo sapiens
cagugcauagaugugccacauu

SEQ ID NO: 33547 - RNA, 20 nt, Homo sapiens
cagugcauugcuucugauuu

SEQ ID NO: 33548 - RNA, 23 nt, Homo sapiens
cagugcauuguggcauucagcau

SEQ ID NO: 33549 - RNA, 22 nt, Homo sapiens
cagugcuuguuauuguucuauu

SEQ ID NO: 33550 - RNA, 22 nt, Homo sapiens
cagugucugcauuuggaacuca

SEQ ID NO: 33551 - RNA, 22 nt, Homo sapiens
caguugguguacauauauguau

SEQ ID NO: 33552 - RNA, 22 nt, Homo sapiens
cauaaagauggaggaggccagg

SEQ ID NO: 33553 - RNA, 22 nt, Homo sapiens
cauaaaucuuguugaauagcac

SEQ ID NO: 33554 - RNA, 21 nt, Homo sapiens
cauaaugcuacuuauuuuaug

SEQ ID NO: 33555 - RNA, 22 nt, Homo sapiens
cauacaugugcuugucuuaugc

SEQ ID NO: 33556 - RNA, 22 nt, Homo sapiens
cauaguacuugcauaguacuau

SEQ ID NO: 33557 - RNA, 22 nt, Homo sapiens
cauaugguuuuauguucuucau

SEQ ID NO: 33558 - RNA, 22 nt, Homo sapiens
cauauucacuuuacagagcugu

SEQ ID NO: 33559 - RNA, 21 nt, Homo sapiens
caucaaauugucauggugggu

SEQ ID NO: 33560 - RNA, 22 nt, Homo sapiens
caucacacuuggauguaagaca

SEQ ID NO: 33561 - RNA, 22 nt, Homo sapiens
caucacaucugcaugguaagua

SEQ ID NO: 33562 - RNA, 22 nt, Homo sapiens
caucagcaauguaugaggguuc

SEQ ID NO: 33563 - RNA, 22 nt, Homo sapiens
caucauugcacccuauagagaa

SEQ ID NO: 33564 - RNA, 22 nt, Homo sapiens
caucgcacuccagccugggcaa

SEQ ID NO: 33565 - RNA, 22 nt, Homo sapiens
caugaaagacugaggaauugga

SEQ ID NO: 33566 - RNA, 22 nt, Homo sapiens
cauggcacagagaauguguucu

SEQ ID NO: 33567 - RNA, 22 nt, Homo sapiens
cauggcacaucuuuucugacua

SEQ ID NO: 33568 - RNA, 22 nt, Homo sapiens
cauggcacuggugggagugucu

SEQ ID NO: 33569 - RNA, 22 nt, Homo sapiens
cauggcauuugcagaguugaaa

SEQ ID NO: 33570 - RNA, 22 nt, Homo sapiens
cauggcuacugcagauguaggg

SEQ ID NO: 33571 - RNA, 22 nt, Homo sapiens
cauggcucuuguuuacucccag

SEQ ID NO: 33572 - RNA, 22 nt, Homo sapiens
cauggcucuuugcugcuaaagu

SEQ ID NO: 33573 - RNA, 19 nt, Homo sapiens
cauggcuuauaauuuuaau

SEQ ID NO: 33574 - RNA, 22 nt, Homo sapiens
cauggcuuuaagcaacaccaag

SEQ ID NO: 33575 - RNA, 22 nt, Homo sapiens
cauggcuuucacaguaaagccu

SEQ ID NO: 33576 - RNA, 22 nt, Homo sapiens
caugggacugucuuggcuauac

SEQ ID NO: 33577 - RNA, 22 nt, Homo sapiens
caugguacugccacagaagagu

SEQ ID NO: 33578 - RNA, 22 nt, Homo sapiens
caugucacuuccucucugaugg

SEQ ID NO: 33579 - RNA, 22 nt, Homo sapiens
caugucuuuuaaacauucaacu

SEQ ID NO: 33580 - RNA, 22 nt, Homo sapiens
caugugcaugagcacauacgug

SEQ ID NO: 33581 - RNA, 20 nt, Homo sapiens
cauuacacuccaaccugggu

SEQ ID NO: 33582 - RNA, 22 nt, Homo sapiens
cauuacacuccagccuggguga

SEQ ID NO: 33583 - RNA, 22 nt, Homo sapiens
cauuccacauguaggacaauuu

SEQ ID NO: 33584 - RNA, 22 nt, Homo sapiens
cauugcacacauuuaccuaugu

SEQ ID NO: 33585 - RNA, 22 nt, Homo sapiens
cauugcacuccaccuuggguaa

SEQ ID NO: 33586 - RNA, 22 nt, Homo sapiens
cauugcacuccagcccuggcaa

SEQ ID NO: 33587 - RNA, 22 nt, Homo sapiens
cauugcacuccagccuggcaac

SEQ ID NO: 33588 - RNA, 22 nt, Homo sapiens
cauugcacuccagccuggccaa

SEQ ID NO: 33589 - RNA, 22 nt, Homo sapiens
cauugcacuccagccuugguga

SEQ ID NO: 33590 - RNA, 20 nt, Homo sapiens
cauugcacuccagcuugggc

SEQ ID NO: 33591 - RNA, 22 nt, Homo sapiens
cauugcacucuagccucggcaa

SEQ ID NO: 33592 - RNA, 22 nt, Homo sapiens
cauugcaugccagccugggcaa

SEQ ID NO: 33593 - RNA, 22 nt, Homo sapiens
cauugguuggacaguucucucu

SEQ ID NO: 33594 - RNA, 22 nt, Homo sapiens
cauuuugguuaaauagguagcu

SEQ ID NO: 33595 - RNA, 22 nt, Homo sapiens
ccaaaguauuuucacugauauc

SEQ ID NO: 33596 - RNA, 22 nt, Homo sapiens
ccaagccucaguuucccucugu

SEQ ID NO: 33597 - RNA, 22 nt, Homo sapiens
ccaaguguucucauuguucaau

SEQ ID NO: 33598 - RNA, 22 nt, Homo sapiens
ccacaaccuccauauccugggu

SEQ ID NO: 33599 - RNA, 23 nt, Homo sapiens
ccacacuguuuagaauggcauca

SEQ ID NO: 33600 - RNA, 22 nt, Homo sapiens
ccacagucuaugcaacaagguc

SEQ ID NO: 33601 - RNA, 22 nt, Homo sapiens
ccacauuaccuugcuugcucca

SEQ ID NO: 33602 - RNA, 22 nt, Homo sapiens
cauagcacugcacuucagccug

SEQ ID NO: 33603 - RNA, 22 nt, Homo sapiens
caucaaaguggagggaaggacc

SEQ ID NO: 33604 - RNA, 22 nt, Homo sapiens
caucacaguacuaaucgucaua

SEQ ID NO: 33605 - RNA, 23 nt, Homo sapiens
caucacauagaggaaagaggaca

SEQ ID NO: 33606 - RNA, 22 nt, Homo sapiens
caucagagugagauauaagauc

SEQ ID NO: 33607 - RNA, 22 nt, Homo sapiens
cauccccugcaccaaccuuuac

SEQ ID NO: 33608 - RNA, 22 nt, Homo sapiens
caugacacauguuuaccuaugu

SEQ ID NO: 33609 - RNA, 22 nt, Homo sapiens
caugacacuggcauguuucuuu

SEQ ID NO: 33610 - RNA, 22 nt, Homo sapiens
caugcacugaguccaccucugg

SEQ ID NO: 33611 - RNA, 22 nt, Homo sapiens
caugccacugcacgccauccug

SEQ ID NO: 33612 - RNA, 19 nt, Homo sapiens
caugccacugcacuugagu

SEQ ID NO: 33613 - RNA, 22 nt, Homo sapiens
cauggagcuaggcuugaucccu

SEQ ID NO: 33614 - RNA, 22 nt, Homo sapiens
cauggauuuuuuugaauggcag

SEQ ID NO: 33615 - RNA, 22 nt, Homo sapiens
cauggcacuguaugaaaugugc

SEQ ID NO: 33616 - RNA, 22 nt, Homo sapiens
cauggcaucuguguggccucca

SEQ ID NO: 33617 - RNA, 22 nt, Homo sapiens
cauggcccugggcugggcgaac

SEQ ID NO: 33618 - RNA, 22 nt, Homo sapiens
cauggcuuuuauaacaagaaau

SEQ ID NO: 33619 - RNA, 22 nt, Homo sapiens
cauggguuuucucaaguaguca

SEQ ID NO: 33620 - RNA, 22 nt, Homo sapiens
cauguaacaucccgcuguagga

SEQ ID NO: 33621 - RNA, 22 nt, Homo sapiens
caugugcaugcuuucuuaugug

SEQ ID NO: 33622 - RNA, 19 nt, Homo sapiens
cauugcacuccacccuggg

SEQ ID NO: 33623 - RNA, 22 nt, Homo sapiens
cauugcacuccagccugaguga

SEQ ID NO: 33624 - RNA, 22 nt, Homo sapiens
cauugcacuccagccugcacga

SEQ ID NO: 33625 - RNA, 20 nt, Homo sapiens
cauugcacuccagccugcug

SEQ ID NO: 33626 - RNA, 22 nt, Homo sapiens
cauugcacuccagccuuggcaa

SEQ ID NO: 33627 - RNA, 22 nt, Homo sapiens
cauugcacuccagcucugggcg

SEQ ID NO: 33628 - RNA, 22 nt, Homo sapiens
cauugcacuccagucugggcaa

SEQ ID NO: 33629 - RNA, 22 nt, Homo sapiens
cauugcacuccauccuuggcaa

SEQ ID NO: 33630 - RNA, 22 nt, Homo sapiens
cauugcacuccaucuugggcaa

SEQ ID NO: 33631 - RNA, 22 nt, Homo sapiens
cauugcacucugcauuccaguc

SEQ ID NO: 33632 - RNA, 22 nt, Homo sapiens
gagauucaucuagguccagaga

SEQ ID NO: 33633 - RNA, 22 nt, Homo sapiens
gagcaaaaguauguauugguua

SEQ ID NO: 33634 - RNA, 22 nt, Homo sapiens
gagcaaugagcugccugcugag

SEQ ID NO: 33635 - RNA, 22 nt, Homo sapiens
gagcacauguggagagucuggg

SEQ ID NO: 33636 - RNA, 22 nt, Homo sapiens
gagcaguugagagugcuggcca

SEQ ID NO: 33637 - RNA, 22 nt, Homo sapiens
gagcuagggucaugcuacugca

SEQ ID NO: 33638 - RNA, 22 nt, Homo sapiens
gagcucauuguugcuaaagaga

SEQ ID NO: 33639 - RNA, 22 nt, Homo sapiens
gagcugaaguuuccauuuguac

SEQ ID NO: 33640 - RNA, 22 nt, Homo sapiens
gagcugaauugcugccauuugc

SEQ ID NO: 33641 - RNA, 22 nt, Homo sapiens
gagcugaucuuuauguaaauuc

SEQ ID NO: 33642 - RNA, 22 nt, Homo sapiens
gaggaaguagcuacugucuuuc

SEQ ID NO: 33643 - RNA, 22 nt, Homo sapiens
gaggaaguuuacaaagcaucug

SEQ ID NO: 33644 - RNA, 22 nt, Homo sapiens
gaggaguagggcacaaagccuu

SEQ ID NO: 33645 - RNA, 22 nt, Homo sapiens
gaggagucagacugugcaaggu

SEQ ID NO: 33646 - RNA, 22 nt, Homo sapiens
gaggcaaguggccaccgagucu

SEQ ID NO: 33647 - RNA, 22 nt, Homo sapiens
gaggcauugaagauauggaagu

SEQ ID NO: 33648 - RNA, 22 nt, Homo sapiens
gaggcggugugaugucacaugc

SEQ ID NO: 33649 - RNA, 22 nt, Homo sapiens
gagggcacugcuuuccuuucaa

SEQ ID NO: 33650 - RNA, 22 nt, Homo sapiens
gagguaagagaauaaacaguuu

SEQ ID NO: 33651 - RNA, 22 nt, Homo sapiens
gagguaagaguuuuccauuucu

SEQ ID NO: 33652 - RNA, 22 nt, Homo sapiens
gagguaaguggauuaugagguc

SEQ ID NO: 33653 - RNA, 22 nt, Homo sapiens
gagguagagaguuuugauucug

SEQ ID NO: 33654 - RNA, 22 nt, Homo sapiens
gagguagguacaauugccacca

SEQ ID NO: 33655 - RNA, 17 nt, Homo sapiens
gagguaguuuacuuuca

SEQ ID NO: 33656 - RNA, 22 nt, Homo sapiens
gagguguagagauauaccugaa

SEQ ID NO: 33657 - RNA, 22 nt, Homo sapiens
gaguagugcuguaauaaacaua

SEQ ID NO: 33658 - RNA, 22 nt, Homo sapiens
gaguaucuuuaaggugguuugg

SEQ ID NO: 33659 - RNA, 22 nt, Homo sapiens
gaguauguauaugagugugucu

SEQ ID NO: 33660 - RNA, 22 nt, Homo sapiens
gaguauuuuacaucguguaauu

SEQ ID NO: 33661 - RNA, 22 nt, Homo sapiens
gagucagugucuugcucuguca

SEQ ID NO: 33662 - RNA, 23 nt, Homo sapiens
gagugcaaugacaugaucucgga

SEQ ID NO: 33663 - RNA, 22 nt, Homo sapiens
gagugcaauggcaagaucuugg

SEQ ID NO: 33664 - RNA, 22 nt, Homo sapiens
gagugcaauggcaugaucuugg

SEQ ID NO: 33665 - RNA, 22 nt, Homo sapiens
gagugcaauggcgcgaucucgg

SEQ ID NO: 33666 - RNA, 22 nt, Homo sapiens
gagugcaauggugccaucucgg

SEQ ID NO: 33667 - RNA, 22 nt, Homo sapiens
gagugcugagcccacuuccuug

SEQ ID NO: 33668 - RNA, 22 nt, Homo sapiens
gaguggugguucugaaacuuuu

SEQ ID NO: 33669 - RNA, 22 nt, Homo sapiens
gaguucauaucuaugagugugc

SEQ ID NO: 33670 - RNA, 22 nt, Homo sapiens
gaguugagagaguuguuauuuc

SEQ ID NO: 33671 - RNA, 22 nt, Homo sapiens
gaguuguuuuaaggcacugacu

SEQ ID NO: 33672 - RNA, 22 nt, Homo sapiens
gauaaaguauuggguacuaugc

SEQ ID NO: 33673 - RNA, 18 nt, Homo sapiens
gauaacaguggacuaugc

SEQ ID NO: 33674 - RNA, 22 nt, Homo sapiens
gauaagagaugauuuugccaug

SEQ ID NO: 33675 - RNA, 22 nt, Homo sapiens
gauagcagccauucuuuuuauu

SEQ ID NO: 33676 - RNA, 22 nt, Homo sapiens
gauagcauucaauuaucuguug

SEQ ID NO: 33677 - RNA, 22 nt, Homo sapiens
gauaugaccauguagaccucag

SEQ ID NO: 33678 - RNA, 22 nt, Homo sapiens
gauauguucugagaaaugcauu

SEQ ID NO: 33679 - RNA, 22 nt, Homo sapiens
gauauuacuuccaauauugcaa

SEQ ID NO: 33680 - RNA, 22 nt, Homo sapiens
gaucaauuggcugaagacacgu

SEQ ID NO: 33681 - RNA, 22 nt, Homo sapiens
gaucagauggcuguuggugugu

SEQ ID NO: 33682 - RNA, 22 nt, Homo sapiens
gaucugagaaagugucauaaca

SEQ ID NO: 33683 - RNA, 22 nt, Homo sapiens
gaucuguuuuccuauuguuugu

SEQ ID NO: 33684 - RNA, 22 nt, Homo sapiens
gaugacagugaguaaccccaac

SEQ ID NO: 33685 - RNA, 22 nt, Homo sapiens
gaugacuaagaauuuuauaauu

SEQ ID NO: 33686 - RNA, 22 nt, Homo sapiens
gaugagaucauaaguguggagc

SEQ ID NO: 33687 - RNA, 22 nt, Homo sapiens
gaugagguagaagacucagcaa

SEQ ID NO: 33688 - RNA, 22 nt, Homo sapiens
gaugagguaggccugcuuugaa

SEQ ID NO: 33689 - RNA, 22 nt, Homo sapiens
gaugagguaguguaccuagucu

SEQ ID NO: 33690 - RNA, 22 nt, Homo sapiens
gaugcaaauuaagcuugggaca

SEQ ID NO: 33691 - RNA, 22 nt, Homo sapiens
gauggaguugacuaagacaaca

SEQ ID NO: 33692 - RNA, 22 nt, Homo sapiens
gauggaguugucgccugggcug

SEQ ID NO: 33693 - RNA, 22 nt, Homo sapiens
gauggcagugcagccccuggcu

SEQ ID NO: 33694 - RNA, 22 nt, Homo sapiens
gaugguuuucaccugcaugcuu

SEQ ID NO: 33695 - RNA, 22 nt, Homo sapiens
gauguguugggaagauuucaag

SEQ ID NO: 33696 - RNA, 22 nt, Homo sapiens
gauuagucccauuuuacaggug

SEQ ID NO: 33697 - RNA, 22 nt, Homo sapiens
gauuccauuuguggcuauuuac

SEQ ID NO: 33698 - RNA, 22 nt, Homo sapiens
gauugguugaaaguagaauacu

SEQ ID NO: 33699 - RNA, 22 nt, Homo sapiens
gauuuuccaguggcccugauca

SEQ ID NO: 33700 - RNA, 22 nt, Homo sapiens
gcaaagaaugcagauuugccuc

SEQ ID NO: 33701 - RNA, 21 nt, Homo sapiens
gcaaaggaauugccuaagcuu

SEQ ID NO: 33702 - RNA, 20 nt, Homo sapiens
gcaaaguuuagcucccacua

SEQ ID NO: 33703 - RNA, 22 nt, Homo sapiens
ggaaagacaccuuacuauguua

SEQ ID NO: 33704 - RNA, 22 nt, Homo sapiens
ggaaagacuauuguaaaggaug

SEQ ID NO: 33705 - RNA, 22 nt, Homo sapiens
ggaaaguccuucuguaggcucc

SEQ ID NO: 33706 - RNA, 22 nt, Homo sapiens
ggaaaucaucauucucgguaua

SEQ ID NO: 33707 - RNA, 22 nt, Homo sapiens
ggaaaucucugaggcucccuuc

SEQ ID NO: 33708 - RNA, 22 nt, Homo sapiens
ggaagaauauuaggggauuucg

SEQ ID NO: 33709 - RNA, 20 nt, Homo sapiens
ggaagagugacacaagguau

SEQ ID NO: 33710 - RNA, 22 nt, Homo sapiens
ggaaguauaaacuuaguggagu

SEQ ID NO: 33711 - RNA, 22 nt, Homo sapiens
ggaaguuaauacagauagagua

SEQ ID NO: 33712 - RNA, 20 nt, Homo sapiens
ggaauagucuacacucugac

SEQ ID NO: 33713 - RNA, 22 nt, Homo sapiens
ggaaucugaaccaugggaaugg

SEQ ID NO: 33714 - RNA, 23 nt, Homo sapiens
ggaaugaaaccugguuaugauau

SEQ ID NO: 33715 - RNA, 17 nt, Homo sapiens
ggaaugaauuccagccc

SEQ ID NO: 33716 - RNA, 22 nt, Homo sapiens
ggaaugagaaauauuacacaau

SEQ ID NO: 33717 - RNA, 22 nt, Homo sapiens
ggaaugcagugagcauuagaua

SEQ ID NO: 33718 - RNA, 22 nt, Homo sapiens
ggaauggaacaaagucuugaaa

SEQ ID NO: 33719 - RNA, 22 nt, Homo sapiens
ggacaguagugcuuucuaucau

SEQ ID NO: 33720 - RNA, 22 nt, Homo sapiens
ggacagugaaugccacuccucc

SEQ ID NO: 33721 - RNA, 22 nt, Homo sapiens
ggacuaggagcuaggaagaucu

SEQ ID NO: 33722 - RNA, 22 nt, Homo sapiens
guuugguugcauggaaaauuua

SEQ ID NO: 33723 - RNA, 22 nt, Homo sapiens
guuugugcuccuaugagaaucu

SEQ ID NO: 33724 - RNA, 22 nt, Homo sapiens
guuugugguuaaagccuuucau

SEQ ID NO: 33725 - RNA, 22 nt, Homo sapiens
uaaacacucacuucauagccau

SEQ ID NO: 33726 - RNA, 22 nt, Homo sapiens
uaaacugcuugaaaugguguca

SEQ ID NO: 33727 - RNA, 22 nt, Homo sapiens
uaaagagcuuuugaggugucau

SEQ ID NO: 33728 - RNA, 22 nt, Homo sapiens
uaaagcauguaauuagguuaga

SEQ ID NO: 33729 - RNA, 22 nt, Homo sapiens
uaaagccagugauuaugucucu

SEQ ID NO: 33730 - RNA, 22 nt, Homo sapiens
uaaagccauugucaaguuugua

SEQ ID NO: 33731 - RNA, 22 nt, Homo sapiens
uaaagccuagaacuuucagccc

SEQ ID NO: 33732 - RNA, 22 nt, Homo sapiens
uaaagcuacagagcggaaaauu

SEQ ID NO: 33733 - RNA, 22 nt, Homo sapiens
uaaagcuaucacauuggugauu

SEQ ID NO: 33734 - RNA, 22 nt, Homo sapiens
uaaagcugaaaugauuaugaca

SEQ ID NO: 33735 - RNA, 22 nt, Homo sapiens
uaaagugaggauggcaguaggu

SEQ ID NO: 33736 - RNA, 22 nt, Homo sapiens
uaaaugcucuuuaaaagugcuu

SEQ ID NO: 33737 - RNA, 22 nt, Homo sapiens
uaaauggauauugccaucuccu

SEQ ID NO: 33738 - RNA, 22 nt, Homo sapiens
uaaauugcauaaguacaaauga

SEQ ID NO: 33739 - RNA, 19 nt, Homo sapiens
uaacacaguuguguuugag

SEQ ID NO: 33740 - RNA, 22 nt, Homo sapiens
uaacaguguauuuacuacuucc

SEQ ID NO: 33741 - RNA, 23 nt, Homo sapiens
uaacauguuuuuaagggaagcuu

SEQ ID NO: 33742 - RNA, 22 nt, Homo sapiens
uaacauucacaugcugcaaaaa

SEQ ID NO: 33743 - RNA, 22 nt, Homo sapiens
uaacccacgcagaauggacaag

SEQ ID NO: 33744 - RNA, 22 nt, Homo sapiens
uaacccagugucugugaugggu

SEQ ID NO: 33745 - RNA, 22 nt, Homo sapiens
uaacgcuaguaucaccaggcua

SEQ ID NO: 33746 - RNA, 22 nt, Homo sapiens
uaacugccuacugugcaaauau

SEQ ID NO: 33747 - RNA, 22 nt, Homo sapiens
uaagaauucuguccgguauacu

SEQ ID NO: 33748 - RNA, 23 nt, Homo sapiens
uaagacacuaacuuuaugcuuug

SEQ ID NO: 33749 - RNA, 20 nt, Homo sapiens
uaagacaugguccacaugcc

SEQ ID NO: 33750 - RNA, 22 nt, Homo sapiens
uaagcucauuccagccaugucc

SEQ ID NO: 33751 - RNA, 22 nt, Homo sapiens
uaagcuguguggacuaugccuc

SEQ ID NO: 33752 - RNA, 22 nt, Homo sapiens
uaaggcacccuucugaguagag

SEQ ID NO: 33753 - RNA, 22 nt, Homo sapiens
uaaggcacuacuuuaggcuuuc

SEQ ID NO: 33754 - RNA, 20 nt, Homo sapiens
uaaggcacugugcuuuuagg

SEQ ID NO: 33755 - RNA, 22 nt, Homo sapiens
uaaggcccggccuuuccaagca

SEQ ID NO: 33756 - RNA, 22 nt, Homo sapiens
uaaggcuucuuggaauacugca

SEQ ID NO: 33757 - RNA, 22 nt, Homo sapiens
uaaggcuugcuucagucuugaa

SEQ ID NO: 33758 - RNA, 22 nt, Homo sapiens
uaagguacuuuggagaaaacug

SEQ ID NO: 33759 - RNA, 22 nt, Homo sapiens
uaagguauuuacauuucuguuu

SEQ ID NO: 33760 - RNA, 22 nt, Homo sapiens
uaagguuuuugauaugcugcug

SEQ ID NO: 33761 - RNA, 22 nt, Homo sapiens
uaaguaauuguuaauagggaag

SEQ ID NO: 33762 - RNA, 22 nt, Homo sapiens
uaaguacugucagaauuggacu

SEQ ID NO: 33763 - RNA, 22 nt, Homo sapiens
uaaguauuaggccccaggcugg

SEQ ID NO: 33764 - RNA, 22 nt, Homo sapiens
uaagugacuuugagauuccuca

SEQ ID NO: 33765 - RNA, 22 nt, Homo sapiens
uaagugcaugauuacaugcaua

SEQ ID NO: 33766 - RNA, 20 nt, Homo sapiens
uaagugcuugagacuucuga

SEQ ID NO: 33767 - RNA, 20 nt, Homo sapiens
uaaguuguauuugucaugaa

SEQ ID NO: 33768 - RNA, 22 nt, Homo sapiens
uaauacuagugaauagcaggau

SEQ ID NO: 33769 - RNA, 22 nt, Homo sapiens
uaauacuugucauaaaggcauu

SEQ ID NO: 33770 - RNA, 22 nt, Homo sapiens
uaauagagucauuauuauuguu

SEQ ID NO: 33771 - RNA, 22 nt, Homo sapiens
uaauagcucggauaaacaugau

SEQ ID NO: 33772 - RNA, 22 nt, Homo sapiens
uaauaguguuaaugcuagagcu

SEQ ID NO: 33773 - RNA, 22 nt, Homo sapiens
uaauauguauacagacagauac

SEQ ID NO: 33774 - RNA, 22 nt, Homo sapiens
uaauauguuuugaaaucaggaa

SEQ ID NO: 33775 - RNA, 22 nt, Homo sapiens
uaauccuggcacuuugggaggc

SEQ ID NO: 33776 - RNA, 22 nt, Homo sapiens
uaaucucagcuacucaggaggc

SEQ ID NO: 33777 - RNA, 22 nt, Homo sapiens
uaaugcacuuuccuccaaggcu

SEQ ID NO: 33778 - RNA, 22 nt, Homo sapiens
uaaugcauacagaagguguuuu

SEQ ID NO: 33779 - RNA, 21 nt, Homo sapiens
uaauggcaugaucucggcuca

SEQ ID NO: 33780 - RNA, 22 nt, Homo sapiens
uaauucacauaaagcacuuaga

SEQ ID NO: 33781 - RNA, 22 nt, Homo sapiens
uaauuggaucucaaaaaagugu

SEQ ID NO: 33782 - RNA, 22 nt, Homo sapiens
uacaaagcuacucgagggcagg

SEQ ID NO: 33783 - RNA, 22 nt, Homo sapiens
uacaaaucuagguuuguuacug

SEQ ID NO: 33784 - RNA, 21 nt, Homo sapiens
uacaaugcacaggagagccuc

SEQ ID NO: 33785 - RNA, 22 nt, Homo sapiens
uacacaugugaguucuuuucua

SEQ ID NO: 33786 - RNA, 22 nt, Homo sapiens
uacagaguagaagauuugcaga

SEQ ID NO: 33787 - RNA, 22 nt, Homo sapiens
uacaggacuauagaacuuuccc

SEQ ID NO: 33788 - RNA, 20 nt, Homo sapiens
uacaggacugagaaucugug

SEQ ID NO: 33789 - RNA, 19 nt, Homo sapiens
uacaguacacaacaccuuu

SEQ ID NO: 33790 - RNA, 22 nt, Homo sapiens
uacaguacagugacaccauuau

SEQ ID NO: 33791 - RNA, 22 nt, Homo sapiens
uacaguauuaugagugauugaa

SEQ ID NO: 33792 - RNA, 22 nt, Homo sapiens
uacaguguuuugguauuccaca

SEQ ID NO: 33793 - RNA, 20 nt, Homo sapiens
uacauaguaaacugagagca

SEQ ID NO: 33794 - RNA, 22 nt, Homo sapiens
uacaucagccugaaagagcucg

SEQ ID NO: 33795 - RNA, 19 nt, Homo sapiens
uacaugcagcaggcacgca

SEQ ID NO: 33796 - RNA, 22 nt, Homo sapiens
uacauguauacaggguuuacuu

SEQ ID NO: 33797 - RNA, 16 nt, Homo sapiens
uacauuuguuacaugg

SEQ ID NO: 33798 - RNA, 22 nt, Homo sapiens
uaccugagacaacuuugaggaa

SEQ ID NO: 33799 - RNA, 22 nt, Homo sapiens
uaccuguagacuacagcuucag

SEQ ID NO: 33800 - RNA, 22 nt, Homo sapiens
uacguuaucagguaugcaagag

SEQ ID NO: 33801 - RNA, 22 nt, Homo sapiens
uacuagaggcgggguuucgcca

SEQ ID NO: 33802 - RNA, 18 nt, Homo sapiens
uacuaguaaggcuucuga

SEQ ID NO: 33803 - RNA, 22 nt, Homo sapiens
uacucuuuagcuccuuaaggaa

SEQ ID NO: 33804 - RNA, 22 nt, Homo sapiens
uaucacaguagaacucuuucca

SEQ ID NO: 33805 - RNA, 22 nt, Homo sapiens
uaucacagugcuggaguauucc

SEQ ID NO: 33806 - RNA, 22 nt, Homo sapiens
uaucacggaguacauguucugu

SEQ ID NO: 33807 - RNA, 22 nt, Homo sapiens
uaucacugucaggcccucauau

SEQ ID NO: 33808 - RNA, 22 nt, Homo sapiens
uaucagaguuacacugaagacu

SEQ ID NO: 33809 - RNA, 22 nt, Homo sapiens
uaucagaucccaauuucuggcc

SEQ ID NO: 33810 - RNA, 22 nt, Homo sapiens
uaucauagucacuuccaguuug

SEQ ID NO: 33811 - RNA, 22 nt, Homo sapiens
uaucaucauuggcaggugagaa

SEQ ID NO: 33812 - RNA, 21 nt, Homo sapiens
uaucauggccauccucuucuc

SEQ ID NO: 33813 - RNA, 22 nt, Homo sapiens
uaucauuguguuauuucuucca

SEQ ID NO: 33814 - RNA, 22 nt, Homo sapiens
uaucuacauguagguauguaug

SEQ ID NO: 33815 - RNA, 22 nt, Homo sapiens
uaucucacauauucaguagguu

SEQ ID NO: 33816 - RNA, 20 nt, Homo sapiens
uaucucaguuuguccuaaac

SEQ ID NO: 33817 - RNA, 22 nt, Homo sapiens
uaucugguuuuguuacagguuc

SEQ ID NO: 33818 - RNA, 22 nt, Homo sapiens
uaugaacacuuuugggaggcau

SEQ ID NO: 33819 - RNA, 22 nt, Homo sapiens
gcauggagcauacauuucuguu

SEQ ID NO: 33820 - RNA, 22 nt, Homo sapiens
gcauggccuuuaaaugucacag

SEQ ID NO: 33821 - RNA, 22 nt, Homo sapiens
gcaugugaauguguaagaaaau

SEQ ID NO: 33822 - RNA, 22 nt, Homo sapiens
gccaacauggcgcuccauucuu

SEQ ID NO: 33823 - RNA, 22 nt, Homo sapiens
gccaagaucugaauaauuaaga

SEQ ID NO: 33824 - RNA, 20 nt, Homo sapiens
gccacaguuaagcuucugcc

SEQ ID NO: 33825 - RNA, 21 nt, Homo sapiens
gccaguguggcaauuuuucaa

SEQ ID NO: 33826 - RNA, 22 nt, Homo sapiens
gccauugcacuccagccucggc

SEQ ID NO: 33827 - RNA, 22 nt, Homo sapiens
gccauugcacuccgcccugggc

SEQ ID NO: 33828 - RNA, 22 nt, Homo sapiens
gccauugcacucuagccugagc

SEQ ID NO: 33829 - RNA, 22 nt, Homo sapiens
gccccugagacuugccucgggc

SEQ ID NO: 33830 - RNA, 22 nt, Homo sapiens
gcccgugagacuggaagcaaga

SEQ ID NO: 33831 - RNA, 22 nt, Homo sapiens
gcccuguugcccugaauacaua

SEQ ID NO: 33832 - RNA, 22 nt, Homo sapiens
gccuagagaaguaaauauuauc

SEQ ID NO: 33833 - RNA, 22 nt, Homo sapiens
gccuaguguuaauguguguuca

SEQ ID NO: 33834 - RNA, 22 nt, Homo sapiens
gccugagaggauaugauccccu

SEQ ID NO: 33835 - RNA, 22 nt, Homo sapiens
gcggguguuuuacccuugcaga

SEQ ID NO: 33836 - RNA, 22 nt, Homo sapiens
gcgugguguuagaaugagaagu

SEQ ID NO: 33837 - RNA, 22 nt, Homo sapiens
gcuaaaugcaugaggcgaugug

SEQ ID NO: 33838 - RNA, 22 nt, Homo sapiens
gcuacugucuaucugugcuucu

SEQ ID NO: 33839 - RNA, 22 nt, Homo sapiens
gcuaggagauccacugcucucu

SEQ ID NO: 33840 - RNA, 22 nt, Homo sapiens
gcuaugucuguugcucuugggc

SEQ ID NO: 33841 - RNA, 22 nt, Homo sapiens
gcucaguuuccucagcugcaaa

SEQ ID NO: 33842 - RNA, 22 nt, Homo sapiens
gcucaugggcagugugauuguu

SEQ ID NO: 33843 - RNA, 22 nt, Homo sapiens
gcucugguuacaaaggcaaauu

SEQ ID NO: 33844 - RNA, 22 nt, Homo sapiens
gcugagguucaagaagguuaaa

SEQ ID NO: 33845 - RNA, 22 nt, Homo sapiens
gcugauguugaccuugaucacc

SEQ ID NO: 33846 - RNA, 22 nt, Homo sapiens
gcugauguuggccucugggcuu

SEQ ID NO: 33847 - RNA, 22 nt, Homo sapiens
gcugcuguggcagauuggauuc

SEQ ID NO: 33848 - RNA, 22 nt, Homo sapiens
gcugcuguuucucuuucagcau

SEQ ID NO: 33849 - RNA, 22 nt, Homo sapiens
gcuggaauuaacauagaugugc

SEQ ID NO: 33850 - RNA, 22 nt, Homo sapiens
gcuggauguuucaauacaaaua

SEQ ID NO: 33851 - RNA, 22 nt, Homo sapiens
gcugguauuacaggcaugagcc

SEQ ID NO: 33852 - RNA, 22 nt, Homo sapiens
gcuggucugccguaguaggugc

SEQ ID NO: 33853 - RNA, 22 nt, Homo sapiens
gcugguguagagugcagaaagg

SEQ ID NO: 33854 - RNA, 22 nt, Homo sapiens
gcugguguucaggcccucaguc

SEQ ID NO: 33855 - RNA, 22 nt, Homo sapiens
gcuguaguugaggauuuuaaga

SEQ ID NO: 33856 - RNA, 22 nt, Homo sapiens
gcugucuggagucuguucaaug

SEQ ID NO: 33857 - RNA, 16 nt, Homo sapiens
gcuguuguuuuguccu

SEQ ID NO: 33858 - RNA, 19 nt, Homo sapiens
gcuucuugaggacgaugac

SEQ ID NO: 33859 - RNA, 22 nt, Homo sapiens
gcuuguguuugcuccccagaau

SEQ ID NO: 33860 - RNA, 22 nt, Homo sapiens
gcuuuggcauguagauguaugg

SEQ ID NO: 33861 - RNA, 22 nt, Homo sapiens
gcuuugguucaaccaggcaauu

SEQ ID NO: 33862 - RNA, 21 nt, Homo sapiens
gcuuuuucggaagucuuuggc

SEQ ID NO: 33863 - RNA, 23 nt, Homo sapiens
ggaaacauccagucuuucaccau

SEQ ID NO: 33864 - RNA, 22 nt, Homo sapiens
ggaaagcuagguguggguguac

SEQ ID NO: 33865 - RNA, 21 nt, Homo sapiens
ggaaaguuaaggaaauacccc

SEQ ID NO: 33866 - RNA, 19 nt, Homo sapiens
ggaaaugucuauuaagauc

SEQ ID NO: 33867 - RNA, 22 nt, Homo sapiens
ggaagacuuagaguagcaucag

SEQ ID NO: 33868 - RNA, 22 nt, Homo sapiens
ggaauaguauaaauaccacaaa

SEQ ID NO: 33869 - RNA, 19 nt, Homo sapiens
ggaaugcuauucaaccuuu

SEQ ID NO: 33870 - RNA, 22 nt, Homo sapiens
ggaauguaguaauuugguuagu

SEQ ID NO: 33871 - RNA, 22 nt, Homo sapiens
ggaauguuaaagacuacacuga

SEQ ID NO: 33872 - RNA, 22 nt, Homo sapiens
ggaauguuaaggcgcuguuggu

SEQ ID NO: 33873 - RNA, 20 nt, Homo sapiens
ggaauguuaaucuccaugau

SEQ ID NO: 33874 - RNA, 21 nt, Homo sapiens
ggaauguugccagcagccaga

SEQ ID NO: 33875 - RNA, 22 nt, Homo sapiens
ggacaaaguauuuucaaaugua

SEQ ID NO: 33876 - RNA, 22 nt, Homo sapiens
ggagagcuaggcagagguuugu

SEQ ID NO: 33877 - RNA, 20 nt, Homo sapiens
ggagagugacauaauucugg

SEQ ID NO: 33878 - RNA, 22 nt, Homo sapiens
ggagaucauuuccuauuugaag

SEQ ID NO: 33879 - RNA, 22 nt, Homo sapiens
ggagaucuuguuaaaguacaga

SEQ ID NO: 33880 - RNA, 22 nt, Homo sapiens
ggagaucuuuaggaguuggacu

SEQ ID NO: 33881 - RNA, 22 nt, Homo sapiens
ggagaugugccugcucugcucu

SEQ ID NO: 33882 - RNA, 22 nt, Homo sapiens
ggagauuauuaguguuucaugc

SEQ ID NO: 33883 - RNA, 22 nt, Homo sapiens
ggagcaaugccucauucucacu

SEQ ID NO: 33884 - RNA, 22 nt, Homo sapiens
ggagcucaucuagcauagaggu

SEQ ID NO: 33885 - RNA, 22 nt, Homo sapiens
ggagguagguuugugauuugua

SEQ ID NO: 33886 - RNA, 20 nt, Homo sapiens
ggagguguugauuuuucuuu

SEQ ID NO: 33887 - RNA, 22 nt, Homo sapiens
ggaguaugaaacccacuccaau

SEQ ID NO: 33888 - RNA, 22 nt, Homo sapiens
ggagucugauguucuaaggcag

SEQ ID NO: 33889 - RNA, 23 nt, Homo sapiens
ggaguguauuggcacgaucucag

SEQ ID NO: 33890 - RNA, 22 nt, Homo sapiens
ggagugucccaaucucagcuca

SEQ ID NO: 33891 - RNA, 22 nt, Homo sapiens
ggaguguguaggagaaagguaa

SEQ ID NO: 33892 - RNA, 22 nt, Homo sapiens
ggaguguuccauuugucacauu

SEQ ID NO: 33893 - RNA, 22 nt, Homo sapiens
ggauacaucuggacagccgaau

SEQ ID NO: 33894 - RNA, 22 nt, Homo sapiens
ggaucacuugagaccaggaguu

SEQ ID NO: 33895 - RNA, 22 nt, Homo sapiens
ggaugcauuuuugguugucaca

SEQ ID NO: 33896 - RNA, 21 nt, Homo sapiens
ggauucaucccucaugaauuu

SEQ ID NO: 33897 - RNA, 22 nt, Homo sapiens
ggauugugauaauuguugcaaa

SEQ ID NO: 33898 - RNA, 22 nt, Homo sapiens
ggcaaaaucgcaauuacuuuug

SEQ ID NO: 33899 - RNA, 22 nt, Homo sapiens
ggcaacaugaugaaaugccauc

SEQ ID NO: 33900 - RNA, 22 nt, Homo sapiens
ggcaagaaaaugcaauuacugu

SEQ ID NO: 33901 - RNA, 17 nt, Homo sapiens
ggcaagaaguggaacuc

SEQ ID NO: 33902 - RNA, 22 nt, Homo sapiens
ggcaaggaggggcacuuucacu

SEQ ID NO: 33903 - RNA, 22 nt, Homo sapiens
ggcaagugggagggaguguuuc

SEQ ID NO: 33904 - RNA, 22 nt, Homo sapiens
ggcaauauuauuaacccucugu

SEQ ID NO: 33905 - RNA, 22 nt, Homo sapiens
uggcaggugcacuggcuuugaa

SEQ ID NO: 33906 - RNA, 22 nt, Homo sapiens
uggcaguuucacauggcucaac

SEQ ID NO: 33907 - RNA, 22 nt, Homo sapiens
uggcauauaaagauguguucaa

SEQ ID NO: 33908 - RNA, 22 nt, Homo sapiens
uggcaucuguucuacacauaaa

SEQ ID NO: 33909 - RNA, 17 nt, Homo sapiens
uggcaugaggguguggg

SEQ ID NO: 33910 - RNA, 22 nt, Homo sapiens
uggcaugauguguucauugaaa

SEQ ID NO: 33911 - RNA, 22 nt, Homo sapiens
uggcauggaacuacuuugaaac

SEQ ID NO: 33912 - RNA, 22 nt, Homo sapiens
uggcauggaguggauggcccca

SEQ ID NO: 33913 - RNA, 22 nt, Homo sapiens
uggcauguagucugggaccugg

SEQ ID NO: 33914 - RNA, 22 nt, Homo sapiens
uggcaugucguuuuucauagga

SEQ ID NO: 33915 - RNA, 22 nt, Homo sapiens
uggcauguguuugaaugaguau

SEQ ID NO: 33916 - RNA, 20 nt, Homo sapiens
uggcauguugguaugcaccc

SEQ ID NO: 33917 - RNA, 22 nt, Homo sapiens
uggcauuuugugugaauuagaa

SEQ ID NO: 33918 - RNA, 22 nt, Homo sapiens
uggccagugucggaggccagga

SEQ ID NO: 33919 - RNA, 22 nt, Homo sapiens
uggccuguaacccucucauagg

SEQ ID NO: 33920 - RNA, 22 nt, Homo sapiens
uggccuuuuccaagaacuacua

SEQ ID NO: 33921 - RNA, 22 nt, Homo sapiens
uggcgggaaaguugggagaaga

SEQ ID NO: 33922 - RNA, 22 nt, Homo sapiens
uggcuaagaugcacacuucacu

SEQ ID NO: 33923 - RNA, 22 nt, Homo sapiens
uggcuaaguuaaucaaggagau

SEQ ID NO: 33924 - RNA, 22 nt, Homo sapiens
uggcuacagaaaguacuaguga

SEQ ID NO: 33925 - RNA, 22 nt, Homo sapiens
uggcuacugacugaugauuaua

SEQ ID NO: 33926 - RNA, 22 nt, Homo sapiens
uggcuagauauccagaguucug

SEQ ID NO: 33927 - RNA, 22 nt, Homo sapiens
uggcucauuucuaaacccagcu

SEQ ID NO: 33928 - RNA, 22 nt, Homo sapiens
uggcuguuuauuucacaugggu

SEQ ID NO: 33929 - RNA, 22 nt, Homo sapiens
uggcuuucuggggcuucuguuc

SEQ ID NO: 33930 - RNA, 22 nt, Homo sapiens
uggcuuuuauuauguugaggua

SEQ ID NO: 33931 - RNA, 22 nt, Homo sapiens
uggcuuuuguuauuuggaagcu

SEQ ID NO: 33932 - RNA, 22 nt, Homo sapiens
ugggaaauguagccuagcugug

SEQ ID NO: 33933 - RNA, 22 nt, Homo sapiens
ugggaagagggagcgauuuugg

SEQ ID NO: 33934 - RNA, 22 nt, Homo sapiens
ugggaagaugcugcuucuuccu

SEQ ID NO: 33935 - RNA, 22 nt, Homo sapiens
ugggaagcugcauuuuaacaag

SEQ ID NO: 33936 - RNA, 22 nt, Homo sapiens
ugggaccccuacucuuuccaca

SEQ ID NO: 33937 - RNA, 22 nt, Homo sapiens
ugggaugaauacaaugggauca

SEQ ID NO: 33938 - RNA, 22 nt, Homo sapiens
ugggaugaugaaaaggcuuucu

SEQ ID NO: 33939 - RNA, 22 nt, Homo sapiens
ugggcaaauugugagggaggua

SEQ ID NO: 33940 - RNA, 22 nt, Homo sapiens
ugggcaagugacuuggcuucuc

SEQ ID NO: 33941 - RNA, 22 nt, Homo sapiens
ugggcagugggacagcuuugug

SEQ ID NO: 33942 - RNA, 22 nt, Homo sapiens
uggggcaaugaacauuuuugca

SEQ ID NO: 33943 - RNA, 22 nt, Homo sapiens
uggggcuuuuucuuguauucuc

SEQ ID NO: 33944 - RNA, 22 nt, Homo sapiens
uggguagagcacugggggcgag

SEQ ID NO: 33945 - RNA, 22 nt, Homo sapiens
uggguaggcccucauuggacag

SEQ ID NO: 33946 - RNA, 22 nt, Homo sapiens
uggguccccuacucuuuccaca

SEQ ID NO: 33947 - RNA, 23 nt, Homo sapiens
uggguucccuaagcgcaugcugc

SEQ ID NO: 33948 - RNA, 22 nt, Homo sapiens
ugguaaaaugucauuuaccaga

SEQ ID NO: 33949 - RNA, 22 nt, Homo sapiens
ugguacuucaugcucacagaua

SEQ ID NO: 33950 - RNA, 22 nt, Homo sapiens
ugguaucauuuuaucugcucua

SEQ ID NO: 33951 - RNA, 22 nt, Homo sapiens
ugguaucuaagaugcacguugu

SEQ ID NO: 33952 - RNA, 22 nt, Homo sapiens
ugguauguaugauuaacaugga

SEQ ID NO: 33953 - RNA, 22 nt, Homo sapiens
ugguauguguucuaaaauuaug

SEQ ID NO: 33954 - RNA, 22 nt, Homo sapiens
ugguauguuuauaaguauagga

SEQ ID NO: 33955 - RNA, 22 nt, Homo sapiens
uggucaaaucugaugugagaaa

SEQ ID NO: 33956 - RNA, 22 nt, Homo sapiens
uggucaaaugccaaucuguagu

SEQ ID NO: 33957 - RNA, 22 nt, Homo sapiens
uggucaccuucuugcucugucu

SEQ ID NO: 33958 - RNA, 19 nt, Homo sapiens
uggucaguucugggagcug

SEQ ID NO: 33959 - RNA, 22 nt, Homo sapiens
uggucaguugugccucaauucc

SEQ ID NO: 33960 - RNA, 23 nt, Homo sapiens
uggucccguguucuggcuuuagg

SEQ ID NO: 33961 - RNA, 22 nt, Homo sapiens
uggugagaaaagaugucuuugu

SEQ ID NO: 33962 - RNA, 19 nt, Homo sapiens
uggugccuuguucuuggau

SEQ ID NO: 33963 - RNA, 22 nt, Homo sapiens
uggugcuugaugaggguggagc

SEQ ID NO: 33964 - RNA, 20 nt, Homo sapiens
uggugguuuuaugugguuua

SEQ ID NO: 33965 - RNA, 22 nt, Homo sapiens
ugguuaucacuuuccuuccauc

SEQ ID NO: 33966 - RNA, 22 nt, Homo sapiens
ugguugaucccaucacccaggu

SEQ ID NO: 33967 - RNA, 22 nt, Homo sapiens
uguaaaaagcccagccgcugag

SEQ ID NO: 33968 - RNA, 22 nt, Homo sapiens
uguaaagaaagcuguuguugua

SEQ ID NO: 33969 - RNA, 22 nt, Homo sapiens
uguaaaucuauuuuuaguguuu

SEQ ID NO: 33970 - RNA, 22 nt, Homo sapiens
uguaaaucuuucacaguugaug

SEQ ID NO: 33971 - RNA, 22 nt, Homo sapiens
uguaacaguaguuacuauucuu

SEQ ID NO: 33972 - RNA, 22 nt, Homo sapiens
uguaaccauccagagucccagg

SEQ ID NO: 33973 - RNA, 22 nt, Homo sapiens
uguaagcauuauauaauuguug

SEQ ID NO: 33974 - RNA, 22 nt, Homo sapiens
uguaaugaucaaaucagaguaa

SEQ ID NO: 33975 - RNA, 22 nt, Homo sapiens
uguaauuuaaaugauccuugga

SEQ ID NO: 33976 - RNA, 20 nt, Homo sapiens
uguacacaguguacccacau

SEQ ID NO: 33977 - RNA, 22 nt, Homo sapiens
uguacaugggacaggaggagag

SEQ ID NO: 33978 - RNA, 22 nt, Homo sapiens
uguagacaccaaagacagcaua

SEQ ID NO: 33979 - RNA, 22 nt, Homo sapiens
uguagauauucuuucaguuuuu

SEQ ID NO: 33980 - RNA, 22 nt, Homo sapiens
uguagcaaauaaaagucuggau

SEQ ID NO: 33981 - RNA, 22 nt, Homo sapiens
uguagcaaaucgauacuauugg

SEQ ID NO: 33982 - RNA, 22 nt, Homo sapiens
uguauaacucacauugaaguuu

SEQ ID NO: 33983 - RNA, 23 nt, Homo sapiens
uguauacacccugugcaucuggg

SEQ ID NO: 33984 - RNA, 22 nt, Homo sapiens
uguauacauauguauguuuugu

SEQ ID NO: 33985 - RNA, 22 nt, Homo sapiens
uguauagaucugauucaucucc

SEQ ID NO: 33986 - RNA, 22 nt, Homo sapiens
uguaugagagacauggcugcuu

SEQ ID NO: 33987 - RNA, 22 nt, Homo sapiens
uguauguaaagacaggauaaca

SEQ ID NO: 33988 - RNA, 22 nt, Homo sapiens
uguaugucugcucuuuggaacu

SEQ ID NO: 33989 - RNA, 22 nt, Homo sapiens
uguauguuucuuaggccugaga

SEQ ID NO: 33990 - RNA, 22 nt, Homo sapiens
uguauuuguuguuaaauggaga

SEQ ID NO: 33991 - RNA, 22 nt, Homo sapiens
ugucaaauucuggguuaaaaca

SEQ ID NO: 33992 - RNA, 22 nt, Homo sapiens
ugucagaaucuagaggcugcua

SEQ ID NO: 33993 - RNA, 22 nt, Homo sapiens
ugucaggagcaaugauaaauuu

SEQ ID NO: 33994 - RNA, 22 nt, Homo sapiens
ugucaguggucuggaugcagcc

SEQ ID NO: 33995 - RNA, 22 nt, Homo sapiens
ugucaguguaugagccccggau

SEQ ID NO: 33996 - RNA, 22 nt, Homo sapiens
ugucaguuucaguguuagccuu

SEQ ID NO: 33997 - RNA, 21 nt, Homo sapiens
ugucaguuuccagaguucaac

SEQ ID NO: 33998 - RNA, 22 nt, Homo sapiens
ugucaugaacucacauucuggg

SEQ ID NO: 33999 - RNA, 21 nt, Homo sapiens
ugucaugcagagacccuggag

SEQ ID NO: 34000 - RNA, 22 nt, Homo sapiens
ugucauguauauaccacuucca

SEQ ID NO: 34001 - RNA, 22 nt, Homo sapiens
ugucaugucuuuguguaucaau

SEQ ID NO: 34002 - RNA, 20 nt, Homo sapiens
ugucauuaagcacugugcca

SEQ ID NO: 34003 - RNA, 21 nt, Homo sapiens
ucuaccuacugcucacaggcu

SEQ ID NO: 34004 - RNA, 18 nt, Homo sapiens
ucuagacacugugucuau

SEQ ID NO: 34005 - RNA, 22 nt, Homo sapiens
ucuagccuaugaagcuugucca

SEQ ID NO: 34006 - RNA, 19 nt, Homo sapiens
uggaccccuuccuuacacc

SEQ ID NO: 34007 - RNA, 21 nt, Homo sapiens
uggaccccuuccuuacaucau

SEQ ID NO: 34008 - RNA, 22 nt, Homo sapiens
uggacuguaaauuggggacucu

SEQ ID NO: 34009 - RNA, 22 nt, Homo sapiens
uggagagucauuuauaguauuu

SEQ ID NO: 34010 - RNA, 18 nt, Homo sapiens
uggagauaagaagaacuu

SEQ ID NO: 34011 - RNA, 22 nt, Homo sapiens
uggagguagacauugggaagag

SEQ ID NO: 34012 - RNA, 22 nt, Homo sapiens
uggagguagagaugggaucucc

SEQ ID NO: 34013 - RNA, 20 nt, Homo sapiens
uggaggucaucugucacuac

SEQ ID NO: 34014 - RNA, 22 nt, Homo sapiens
uggaguaggccuaagaaugaca

SEQ ID NO: 34015 - RNA, 16 nt, Homo sapiens
uggagucauccuugac

SEQ ID NO: 34016 - RNA, 22 nt, Homo sapiens
uggagugaaaacacacuaaucu

SEQ ID NO: 34017 - RNA, 22 nt, Homo sapiens
uggaguguguugcagaugaagg

SEQ ID NO: 34018 - RNA, 20 nt, Homo sapiens
uggaguuugaguucuuggag

SEQ ID NO: 34019 - RNA, 22 nt, Homo sapiens
uggauaguaaagucagauuccc

SEQ ID NO: 34020 - RNA, 18 nt, Homo sapiens
uggauaguuguuggcaga

SEQ ID NO: 34021 - RNA, 18 nt, Homo sapiens
uggauaugaaauucugga

SEQ ID NO: 34022 - RNA, 22 nt, Homo sapiens
uggaugaagagaugguaguugc

SEQ ID NO: 34023 - RNA, 22 nt, Homo sapiens
uggaugacuguuauaugcauau

SEQ ID NO: 34024 - RNA, 22 nt, Homo sapiens
uggaugccuaauaaaugcagac

SEQ ID NO: 34025 - RNA, 22 nt, Homo sapiens
uggauggagaggcuugugaugc

SEQ ID NO: 34026 - RNA, 22 nt, Homo sapiens
uggcaaaaaaccgcaguugccu

SEQ ID NO: 34027 - RNA, 22 nt, Homo sapiens
uggcaaaaaucacaaguaccuu

SEQ ID NO: 34028 - RNA, 21 nt, Homo sapiens
uggcaaaaugggcaguggguu

SEQ ID NO: 34029 - RNA, 22 nt, Homo sapiens
uggcaaagugugacgugggggu

SEQ ID NO: 34030 - RNA, 22 nt, Homo sapiens
uggcaaaugaagucagcuguac

SEQ ID NO: 34031 - RNA, 22 nt, Homo sapiens
uggcaaaugugagaugagaacu

SEQ ID NO: 34032 - RNA, 22 nt, Homo sapiens
uggcaagaaccacaauuacuuu

SEQ ID NO: 34033 - RNA, 22 nt, Homo sapiens
uggcaagaccccaucucuacaa

SEQ ID NO: 34034 - RNA, 22 nt, Homo sapiens
uggcaagagcugcauucaucug

SEQ ID NO: 34035 - RNA, 22 nt, Homo sapiens
uggcaagcaggacuaaagcacc

SEQ ID NO: 34036 - RNA, 22 nt, Homo sapiens
uggcaaguuucaauccgaggga

SEQ ID NO: 34037 - RNA, 20 nt, Homo sapiens
uggcaccugacagauagcca

SEQ ID NO: 34038 - RNA, 22 nt, Homo sapiens
uggcaccugacuccgagaugca

SEQ ID NO: 34039 - RNA, 22 nt, Homo sapiens
uggcacuaugugacaagguuuu

SEQ ID NO: 34040 - RNA, 21 nt, Homo sapiens
uggcacuauucacaauagcaa

SEQ ID NO: 34041 - RNA, 22 nt, Homo sapiens
uggcacuggagauacauuaaua

SEQ ID NO: 34042 - RNA, 22 nt, Homo sapiens
uggcagcugcuucaugggaugc

SEQ ID NO: 34043 - RNA, 19 nt, Homo sapiens
uggcaugaaugugaacuaa

SEQ ID NO: 34044 - RNA, 22 nt, Homo sapiens
uggcauggaaagcuuuucauac

SEQ ID NO: 34045 - RNA, 22 nt, Homo sapiens
uggcauggggcagaacauuaca

SEQ ID NO: 34046 - RNA, 22 nt, Homo sapiens
uggcaugggguaguagcgcugg

SEQ ID NO: 34047 - RNA, 22 nt, Homo sapiens
uggcauguaaugcagaaguugc

SEQ ID NO: 34048 - RNA, 22 nt, Homo sapiens
uggcaugugugaagugcccagc

SEQ ID NO: 34049 - RNA, 22 nt, Homo sapiens
uggcauuuuguuuuagaauuag

SEQ ID NO: 34050 - RNA, 23 nt, Homo sapiens
uggccaagauaaucucaguuuuc

SEQ ID NO: 34051 - RNA, 18 nt, Homo sapiens
uggccaauggcaaacaga

SEQ ID NO: 34052 - RNA, 22 nt, Homo sapiens
uggccaguguuuuuccugggcu

SEQ ID NO: 34053 - RNA, 22 nt, Homo sapiens
uggccaguugaagacaaugcuc

SEQ ID NO: 34054 - RNA, 18 nt, Homo sapiens
uggcuacugaacuagaug

SEQ ID NO: 34055 - RNA, 22 nt, Homo sapiens
uggcuacugaccugcuaggggg

SEQ ID NO: 34056 - RNA, 22 nt, Homo sapiens
uggcuacuguacuugagcuauu

SEQ ID NO: 34057 - RNA, 19 nt, Homo sapiens
uggcuagaggccaggcguu

SEQ ID NO: 34058 - RNA, 22 nt, Homo sapiens
uggcucuguuuguuaacuagac

SEQ ID NO: 34059 - RNA, 22 nt, Homo sapiens
uggcucuuucuagacuuaauua

SEQ ID NO: 34060 - RNA, 22 nt, Homo sapiens
uggcuguuuauuucacgugggu

SEQ ID NO: 34061 - RNA, 21 nt, Homo sapiens
uggcuguuuucaugcuagaac

SEQ ID NO: 34062 - RNA, 20 nt, Homo sapiens
uggcuucuuaauugcaggca

SEQ ID NO: 34063 - RNA, 22 nt, Homo sapiens
uggcuuuuaucuacucucaacu

SEQ ID NO: 34064 - RNA, 20 nt, Homo sapiens
ugggaaauguccaggacaua

SEQ ID NO: 34065 - RNA, 22 nt, Homo sapiens
ugggaauaugauacaggucuuu

SEQ ID NO: 34066 - RNA, 22 nt, Homo sapiens
ugggagugugcacaauuucagc

SEQ ID NO: 34067 - RNA, 22 nt, Homo sapiens
ugggaucauuaugcauagugua

SEQ ID NO: 34068 - RNA, 22 nt, Homo sapiens
ugggaucauucaaugacgaaau

SEQ ID NO: 34069 - RNA, 22 nt, Homo sapiens
ugggauccaugugguuuaagca

SEQ ID NO: 34070 - RNA, 22 nt, Homo sapiens
ugggaucuuuccuauuagcgag

SEQ ID NO: 34071 - RNA, 22 nt, Homo sapiens
ugggaugugagucuucgcuuuc

SEQ ID NO: 34072 - RNA, 23 nt, Homo sapiens
ugggauguuuuuggaaacuucug

SEQ ID NO: 34073 - RNA, 22 nt, Homo sapiens
uggguagagaaucaggaucuua

SEQ ID NO: 34074 - RNA, 22 nt, Homo sapiens
uggguagaugaauccauuccaa

SEQ ID NO: 34075 - RNA, 23 nt, Homo sapiens
ugggucaguuuuucugacaucau

SEQ ID NO: 34076 - RNA, 17 nt, Homo sapiens
ugguagguuuuucuggc

SEQ ID NO: 34077 - RNA, 22 nt, Homo sapiens
ugguagugugagucuaaauugg

SEQ ID NO: 34078 - RNA, 22 nt, Homo sapiens
uggucauggaaauagaaugcac

SEQ ID NO: 34079 - RNA, 20 nt, Homo sapiens
ugguccccaccaaaucucau

SEQ ID NO: 34080 - RNA, 19 nt, Homo sapiens
uggucccccgcaaucucau

SEQ ID NO: 34081 - RNA, 22 nt, Homo sapiens
ugguccuuuccauuggagacac

SEQ ID NO: 34082 - RNA, 22 nt, Homo sapiens
uggucuucuggccuccagaacc

SEQ ID NO: 34083 - RNA, 22 nt, Homo sapiens
uggugcuuaaauaaggcuuuca

SEQ ID NO: 34084 - RNA, 15 nt, Homo sapiens
uggugguguugagac

SEQ ID NO: 34085 - RNA, 22 nt, Homo sapiens
ugguguuugagaagcugauguc

SEQ ID NO: 34086 - RNA, 22 nt, Homo sapiens
ugguucaguugcacaggcuguu

SEQ ID NO: 34087 - RNA, 22 nt, Homo sapiens
uguaaaccauauauguauguag

SEQ ID NO: 34088 - RNA, 22 nt, Homo sapiens
uguaaacuaugagcugauuauu

SEQ ID NO: 34089 - RNA, 22 nt, Homo sapiens
uguaaaucugguuaauuggaua

SEQ ID NO: 34090 - RNA, 22 nt, Homo sapiens
uguaacaggaggaaaaugugaa

SEQ ID NO: 34091 - RNA, 20 nt, Homo sapiens
uguaaucuaaguuuuaagcc

SEQ ID NO: 34092 - RNA, 22 nt, Homo sapiens
uguacacauaugugggguacau

SEQ ID NO: 34093 - RNA, 22 nt, Homo sapiens
uuuaaaguuagaaggaaagggc

SEQ ID NO: 34094 - RNA, 20 nt, Homo sapiens
uuuaagacaugcugaauuga

SEQ ID NO: 34095 - RNA, 23 nt, Homo sapiens
uuuaagcuucauguccuaacauc

SEQ ID NO: 34096 - RNA, 22 nt, Homo sapiens
uuuacaguuuucuaggcuacca

SEQ ID NO: 34097 - RNA, 22 nt, Homo sapiens
uuuacugucuucagucccucug

SEQ ID NO: 34098 - RNA, 21 nt, Homo sapiens
uuuacuguggacccauugcuu

SEQ ID NO: 34099 - RNA, 22 nt, Homo sapiens
uuuagcacugugauugacaaaa

SEQ ID NO: 34100 - RNA, 22 nt, Homo sapiens
uuuagcagcaaagagccaugcu

SEQ ID NO: 34101 - RNA, 22 nt, Homo sapiens
uuuauagucaggaacuugagga

SEQ ID NO: 34102 - RNA, 22 nt, Homo sapiens
uuuaucaggccuuuggaaaaau

SEQ ID NO: 34103 - RNA, 22 nt, Homo sapiens
uuuaugcuacauguguuggaaa

SEQ ID NO: 34104 - RNA, 22 nt, Homo sapiens
uuuauggagagauauuuauggu

SEQ ID NO: 34105 - RNA, 22 nt, Homo sapiens
uuuauguggagcacuugacaca

SEQ ID NO: 34106 - RNA, 23 nt, Homo sapiens
uuucacagaaggauuguagggcc

SEQ ID NO: 34107 - RNA, 23 nt, Homo sapiens
uuguccccuccaaagcucauguu

SEQ ID NO: 34108 - RNA, 22 nt, Homo sapiens
uugucucacuggaguuuaguaa

SEQ ID NO: 34109 - RNA, 22 nt, Homo sapiens
uugucuccuagacgaccaggcg

SEQ ID NO: 34110 - RNA, 22 nt, Homo sapiens
uugugaaugaugucgcaguaaa

SEQ ID NO: 34111 - RNA, 22 nt, Homo sapiens
uugugaauggaguagcaggauc

SEQ ID NO: 34112 - RNA, 22 nt, Homo sapiens
uugugaauggugccacaauaaa

SEQ ID NO: 34113 - RNA, 22 nt, Homo sapiens
uugugaauggugccgcaauaaa

SEQ ID NO: 34114 - RNA, 22 nt, Homo sapiens
uugugaauggugccucaguaaa

SEQ ID NO: 34115 - RNA, 22 nt, Homo sapiens
uugugaguggugccgcaauaaa

SEQ ID NO: 34116 - RNA, 22 nt, Homo sapiens
uugugaucauugucaaauagug

SEQ ID NO: 34117 - RNA, 22 nt, Homo sapiens
uugugauggugcauacugagcu

SEQ ID NO: 34118 - RNA, 22 nt, Homo sapiens
uugugcuacugaguuggggugg

SEQ ID NO: 34119 - RNA, 22 nt, Homo sapiens
uugugcuccuaugagaaucuaa

SEQ ID NO: 34120 - RNA, 22 nt, Homo sapiens
uugugcuccugugagaaucuag

SEQ ID NO: 34121 - RNA, 22 nt, Homo sapiens
uugugcuuuugagcugagauga

SEQ ID NO: 34122 - RNA, 22 nt, Homo sapiens
uugugguaaucugugacagcag

SEQ ID NO: 34123 - RNA, 22 nt, Homo sapiens
uugugguaggcauguaagauga

SEQ ID NO: 34124 - RNA, 22 nt, Homo sapiens
uugugguuauagagucucccug

SEQ ID NO: 34125 - RNA, 22 nt, Homo sapiens
uugugguuuuagcacuguggau

SEQ ID NO: 34126 - RNA, 22 nt, Homo sapiens
uugugucccuacccaaaucuca

SEQ ID NO: 34127 - RNA, 22 nt, Homo sapiens
uugugucccugcccaaaucuca

SEQ ID NO: 34128 - RNA, 22 nt, Homo sapiens
uuguucccuucuggcuuuuaug

SEQ ID NO: 34129 - RNA, 22 nt, Homo sapiens
uuguuuuggagaugagcuaaaa

SEQ ID NO: 34130 - RNA, 22 nt, Homo sapiens
uucagggagaaggcaaacguug

SEQ ID NO: 34131 - RNA, 22 nt, Homo sapiens
uucagguaguuuaacuguucca

SEQ ID NO: 34132 - RNA, 22 nt, Homo sapiens
uucaguacacguguucucauuu

SEQ ID NO: 34133 - RNA, 22 nt, Homo sapiens
uucaguagucuccauagaaccg

SEQ ID NO: 34134 - RNA, 18 nt, Homo sapiens
uucagugaauucuuuuga

SEQ ID NO: 34135 - RNA, 22 nt, Homo sapiens
uucauacaguggcugcacucca

SEQ ID NO: 34136 - RNA, 18 nt, Homo sapiens
uucauaguagcaugauuu

SEQ ID NO: 34137 - RNA, 22 nt, Homo sapiens
uucauagucacauucgaugucu

SEQ ID NO: 34138 - RNA, 22 nt, Homo sapiens
uucauaguguuuccuuccagug

SEQ ID NO: 34139 - RNA, 18 nt, Homo sapiens
uucauauguugaaccaga

SEQ ID NO: 34140 - RNA, 23 nt, Homo sapiens
uucaucagggauauuggccugaa

SEQ ID NO: 34141 - RNA, 22 nt, Homo sapiens
uucaucaguuauauuggccuga

SEQ ID NO: 34142 - RNA, 22 nt, Homo sapiens
uucauccccuccaaaucucaug

SEQ ID NO: 34143 - RNA, 22 nt, Homo sapiens
uucauggacucaauaguuucgc

SEQ ID NO: 34144 - RNA, 22 nt, Homo sapiens
uucauggaguugagaaggcuaa

SEQ ID NO: 34145 - RNA, 22 nt, Homo sapiens
uucauggaguuuaaauuguagu

SEQ ID NO: 34146 - RNA, 22 nt, Homo sapiens
uucauggauggaaaugauuuug

SEQ ID NO: 34147 - RNA, 22 nt, Homo sapiens
uucauggguuaauuuguucgau

SEQ ID NO: 34148 - RNA, 18 nt, Homo sapiens
uuugugcuccacaaagga

SEQ ID NO: 34149 - RNA, 22 nt, Homo sapiens
uuugugcuccuguugagaaucu

SEQ ID NO: 34150 - RNA, 22 nt, Homo sapiens
uuugugcugcaauuaauuuccc

SEQ ID NO: 34151 - RNA, 22 nt, Homo sapiens
uuuguggaaugcucauguguag

SEQ ID NO: 34152 - RNA, 22 nt, Homo sapiens
uuuguguccccacccaaaucuc

SEQ ID NO: 34153 - RNA, 23 nt, Homo sapiens
uuugugucccucuagaauucaug

SEQ ID NO: 34154 - RNA, 22 nt, Homo sapiens
uuugugugugauuauaaaaggu

SEQ ID NO: 34155 - RNA, 22 nt, Homo sapiens
uuuuaagcuacaagagacauau

SEQ ID NO: 34156 - RNA, 22 nt, Homo sapiens
uuuuagcaaagagacugguggc

SEQ ID NO: 34157 - RNA, 22 nt, Homo sapiens
uuuuagcuuuucccaggacucc

SEQ ID NO: 34158 - RNA, 22 nt, Homo sapiens
uuuuaguugcucagguauucuc

SEQ ID NO: 34159 - RNA, 22 nt, Homo sapiens
uuuuaugggcuauuugcauuag

SEQ ID NO: 34160 - RNA, 22 nt, Homo sapiens
uuuucacggugucccagagagu

SEQ ID NO: 34161 - RNA, 20 nt, Homo sapiens
uuuugcacuccuacuaaggu

SEQ ID NO: 34162 - RNA, 22 nt, Homo sapiens
uuuugcauuggcugaggagugu

SEQ ID NO: 34163 - RNA, 22 nt, Homo sapiens
uuuugcucuucggaagagcuug

SEQ ID NO: 34164 - RNA, 19 nt, Homo sapiens
uuuugcucuuuauaccuau

SEQ ID NO: 34165 - RNA, 22 nt, Homo sapiens
uuuuggcucugucuguaucuuu

SEQ ID NO: 34166 - RNA, 20 nt, Homo sapiens
uuuuggcuuaaagcagucug

SEQ ID NO: 34167 - RNA, 22 nt, Homo sapiens
uuuugguguacaauucuaugga

SEQ ID NO: 34168 - RNA, 22 nt, Homo sapiens
uuuugguuguuggguaagagua

SEQ ID NO: 34169 - RNA, 22 nt, Homo sapiens
uuuugucccaugggcuguuccc

SEQ ID NO: 34170 - RNA, 22 nt, Homo sapiens
uuuugugacuauuguaaauggg

SEQ ID NO: 34171 - RNA, 22 nt, Homo sapiens
uuuuugagguauaguguggcua

SEQ ID NO: 34172 - RNA, 22 nt, Homo sapiens
uuuuuggaggagguuagaucau

SEQ ID NO: 34173 - RNA, 21 nt, Homo sapiens
uuuuugguggucauggauaga

SEQ ID NO: 34174 - RNA, 22 nt, Homo sapiens
uuuuugugguauauugcaacaa

SEQ ID NO: 34175 - RNA, 22 nt, Homo sapiens
uuuggaaugaaacagcagagcc

SEQ ID NO: 34176 - RNA, 22 nt, Homo sapiens
uuuggacuucuagccuccagag

SEQ ID NO: 34177 - RNA, 22 nt, Homo sapiens
uuuggcaacguuggaucccuca

SEQ ID NO: 34178 - RNA, 20 nt, Homo sapiens
uuuggcaauaggguuuuugu

SEQ ID NO: 34179 - RNA, 20 nt, Homo sapiens
uuuggcacugagugguauaa

SEQ ID NO: 34180 - RNA, 22 nt, Homo sapiens
uuuggcagaaaacuaaaaggua

SEQ ID NO: 34181 - RNA, 22 nt, Homo sapiens
uuuggcagaugacccucaaguu

SEQ ID NO: 34182 - RNA, 22 nt, Homo sapiens
uuuggcaguuauuuacucagug

SEQ ID NO: 34183 - RNA, 22 nt, Homo sapiens
uuuggcauuaagaugcuguauc

SEQ ID NO: 34184 - RNA, 22 nt, Homo sapiens
uuuggcauuagauaauugugua

SEQ ID NO: 34185 - RNA, 22 nt, Homo sapiens
uuuggcauuugaguuuguagga

SEQ ID NO: 34186 - RNA, 22 nt, Homo sapiens
uuuggcccugagggauggcaua

SEQ ID NO: 34187 - RNA, 22 nt, Homo sapiens
uuuggcuguuucuggacuaaga

SEQ ID NO: 34188 - RNA, 22 nt, Homo sapiens
uuuggcuuuuguaauaacugcc

SEQ ID NO: 34189 - RNA, 22 nt, Homo sapiens
uuuggcuuuugugauacguaau

SEQ ID NO: 34190 - RNA, 22 nt, Homo sapiens
uuugggaaaugaaguugguaga

SEQ ID NO: 34191 - RNA, 22 nt, Homo sapiens
uuugggaaugaguuuaucauuu

SEQ ID NO: 34192 - RNA, 22 nt, Homo sapiens
uuugggccauggcuuuuccacg

SEQ ID NO: 34193 - RNA, 22 nt, Homo sapiens
uuugguccaguguucagguccu

SEQ ID NO: 34194 - RNA, 18 nt, Homo sapiens
uuugguccuuuauaaaca

SEQ ID NO: 34195 - RNA, 22 nt, Homo sapiens
uuuggucuuuuauuuaaagcag

SEQ ID NO: 34196 - RNA, 22 nt, Homo sapiens
uuuguaauaccugaggcugggu

SEQ ID NO: 34197 - RNA, 22 nt, Homo sapiens
uuuguacacgugggugaauugu

SEQ ID NO: 34198 - RNA, 23 nt, Homo sapiens
uuuguacuaugucaguuuagaua

SEQ ID NO: 34199 - RNA, 22 nt, Homo sapiens
uuuguacuucauacaauaacuc

SEQ ID NO: 34200 - RNA, 21 nt, Homo sapiens
uuuguaguagcaugauuuaua

SEQ ID NO: 34201 - RNA, 20 nt, Homo sapiens
uuuguaucucuggguacugg

SEQ ID NO: 34202 - RNA, 22 nt, Homo sapiens
uuuguccccgcccagaucucau

SEQ ID NO: 34203 - RNA, 22 nt, Homo sapiens
uuugucuccuaagacucugugg

SEQ ID NO: 34204 - RNA, 22 nt, Homo sapiens
uuugugaggugauggauauguc

SEQ ID NO: 34205 - RNA, 22 nt, Homo sapiens
uuuguggaaugcccuuauuuau

SEQ ID NO: 34206 - RNA, 23 nt, Homo sapiens
uuuguguccccacccaaaucuca

SEQ ID NO: 34207 - RNA, 22 nt, Homo sapiens
uuuguguccccacccacaucuc

SEQ ID NO: 34208 - RNA, 22 nt, Homo sapiens
gagguagggucccacuauguug

SEQ ID NO: 34209 - RNA, 22 nt, Homo sapiens
gaggugauaucucauugugguu

SEQ ID NO: 34210 - RNA, 22 nt, Homo sapiens
gagguggauacauuaaauaaug

SEQ ID NO: 34211 - RNA, 22 nt, Homo sapiens
gaggugguagguucacagcagc

SEQ ID NO: 34212 - RNA, 22 nt, Homo sapiens
gagguguaaggacaacagagac

SEQ ID NO: 34213 - RNA, 22 nt, Homo sapiens
gaguaaauguccuagcuucuug

SEQ ID NO: 34214 - RNA, 22 nt, Homo sapiens
gaguagugcugcaauaaacaua

SEQ ID NO: 34215 - RNA, 22 nt, Homo sapiens
gagugcaucguggccauuuuaa

SEQ ID NO: 34216 - RNA, 18 nt, Homo sapiens
gaguggugcuucccuugu

SEQ ID NO: 34217 - RNA, 22 nt, Homo sapiens
gaguucaaaucucagcucuguu

SEQ ID NO: 34218 - RNA, 22 nt, Homo sapiens
gaguuccuuugagccugagagg

SEQ ID NO: 34219 - RNA, 22 nt, Homo sapiens
gauaaagauagcaauagggaca

SEQ ID NO: 34220 - RNA, 22 nt, Homo sapiens
gauaaaucuuggcuagucuaag

SEQ ID NO: 34221 - RNA, 22 nt, Homo sapiens
gauaacagauaaugucaguuau

SEQ ID NO: 34222 - RNA, 22 nt, Homo sapiens
gauagugaaccaagggguaauu

SEQ ID NO: 34223 - RNA, 22 nt, Homo sapiens
gauaguugugagaacucuuacu

SEQ ID NO: 34224 - RNA, 19 nt, Homo sapiens
gauaucuagggggagguuc

SEQ ID NO: 34225 - RNA, 21 nt, Homo sapiens
gauaucuuuauucccaagagc

SEQ ID NO: 34226 - RNA, 22 nt, Homo sapiens
gauauguaaaaauuauaucuga

SEQ ID NO: 34227 - RNA, 22 nt, Homo sapiens
gauauguguuuuagucaggguu

SEQ ID NO: 34228 - RNA, 22 nt, Homo sapiens
gauauugacuuauucuauguuu

SEQ ID NO: 34229 - RNA, 17 nt, Homo sapiens
gaucacagucgucuccu

SEQ ID NO: 34230 - RNA, 22 nt, Homo sapiens
gaucacauguguacucaaugug

SEQ ID NO: 34231 - RNA, 20 nt, Homo sapiens
gaucaguuuggaguaagugc

SEQ ID NO: 34232 - RNA, 22 nt, Homo sapiens
gaucugucuuuccuuauagucu

SEQ ID NO: 34233 - RNA, 19 nt, Homo sapiens
gaucuguugaucaaugugu

SEQ ID NO: 34234 - RNA, 22 nt, Homo sapiens
gaucuguuguuuggaaguauca

SEQ ID NO: 34235 - RNA, 22 nt, Homo sapiens
gaucuguuucaauugucuuagu

SEQ ID NO: 34236 - RNA, 22 nt, Homo sapiens
gaugaacugucuuacuacucac

SEQ ID NO: 34237 - RNA, 22 nt, Homo sapiens
gaugacagcugacucccuugcu

SEQ ID NO: 34238 - RNA, 22 nt, Homo sapiens
gaugagauguucucauggauug

SEQ ID NO: 34239 - RNA, 22 nt, Homo sapiens
gaugaugcuagguguuagggcu

SEQ ID NO: 34240 - RNA, 22 nt, Homo sapiens
gaugauguugaauguucucacc

SEQ ID NO: 34241 - RNA, 22 nt, Homo sapiens
gaugcaguaagaaugcauagcg

SEQ ID NO: 34242 - RNA, 22 nt, Homo sapiens
gaugccuauugcuaguccuaaa

SEQ ID NO: 34243 - RNA, 22 nt, Homo sapiens
gauggaauuaaaaucagaauca

SEQ ID NO: 34244 - RNA, 22 nt, Homo sapiens
gauggcaucugagaguguuaga

SEQ ID NO: 34245 - RNA, 22 nt, Homo sapiens
gauggcaugugcugccaccaag

SEQ ID NO: 34246 - RNA, 22 nt, Homo sapiens
gauggcauuucuggaucugaca

SEQ ID NO: 34247 - RNA, 22 nt, Homo sapiens
gauggcauuucuggaucugccc

SEQ ID NO: 34248 - RNA, 22 nt, Homo sapiens
gauggcucugcaggugagggua

SEQ ID NO: 34249 - RNA, 22 nt, Homo sapiens
gaugguggucuacccuuucccu

SEQ ID NO: 34250 - RNA, 22 nt, Homo sapiens
gauguagaaagagugggcugga

SEQ ID NO: 34251 - RNA, 22 nt, Homo sapiens
gauguuguuuagccuuugaugu

SEQ ID NO: 34252 - RNA, 22 nt, Homo sapiens
gauuagaacagaagucagauua

SEQ ID NO: 34253 - RNA, 22 nt, Homo sapiens
gauuauagaaguaauggguuua

SEQ ID NO: 34254 - RNA, 22 nt, Homo sapiens
gcaaaaaguagugcugguuagg

SEQ ID NO: 34255 - RNA, 22 nt, Homo sapiens
gcaaaauugagaagggaauaua

SEQ ID NO: 34256 - RNA, 21 nt, Homo sapiens
gcaaaguggcuaccuugcucc

SEQ ID NO: 34257 - RNA, 23 nt, Homo sapiens
gcaaauaucguagagugucccug

SEQ ID NO: 34258 - RNA, 22 nt, Homo sapiens
gcaaaugcuacaccauuuugua

SEQ ID NO: 34259 - RNA, 22 nt, Homo sapiens
gcaagaugagagcccgggcagu

SEQ ID NO: 34260 - RNA, 21 nt, Homo sapiens
gcaaguacuaucaucauuauc

SEQ ID NO: 34261 - RNA, 22 nt, Homo sapiens
gcaaugcugucugugcacagau

SEQ ID NO: 34262 - RNA, 22 nt, Homo sapiens
gcacagaugaggagaggucuca

SEQ ID NO: 34263 - RNA, 22 nt, Homo sapiens
gcacaggguuacauucuaaggu

SEQ ID NO: 34264 - RNA, 22 nt, Homo sapiens
gcacaguguuacuugauauauu

SEQ ID NO: 34265 - RNA, 22 nt, Homo sapiens
gcacgcauuguccuucuaguca

SEQ ID NO: 34266 - RNA, 22 nt, Homo sapiens
gcacugggccacauuuauuuuc

SEQ ID NO: 34267 - RNA, 22 nt, Homo sapiens
gcagagaaacaggucuaaggag

SEQ ID NO: 34268 - RNA, 22 nt, Homo sapiens
gcagaucuucgcgguaaguguu

SEQ ID NO: 34269 - RNA, 22 nt, Homo sapiens
gcagcacaugacuguauguaua

SEQ ID NO: 34270 - RNA, 20 nt, Homo sapiens
gcagcaccauauuucuaaga

SEQ ID NO: 34271 - RNA, 22 nt, Homo sapiens
gcagcagugcccuggauggaaa

SEQ ID NO: 34272 - RNA, 22 nt, Homo sapiens
gcagcaucaaaucacacaagau

SEQ ID NO: 34273 - RNA, 22 nt, Homo sapiens
gcaggcaugacauuucacucuu

SEQ ID NO: 34274 - RNA, 22 nt, Homo sapiens
gcaguagugcgaucucagcuca

SEQ ID NO: 34275 - RNA, 22 nt, Homo sapiens
gcaguagugugaucuuggcuca

SEQ ID NO: 34276 - RNA, 22 nt, Homo sapiens
gcagucaucugaaggcuuaacu

SEQ ID NO: 34277 - RNA, 22 nt, Homo sapiens
gcagugcaugacgguauauaua

SEQ ID NO: 34278 - RNA, 22 nt, Homo sapiens
gcaguggugugugccagccuag

SEQ ID NO: 34279 - RNA, 22 nt, Homo sapiens
gcaguguggguagagggcaaga

SEQ ID NO: 34280 - RNA, 22 nt, Homo sapiens
gcaguguucugggcaggaagaa

SEQ ID NO: 34281 - RNA, 22 nt, Homo sapiens
gcauaugucuuuauagcagcau

SEQ ID NO: 34282 - RNA, 22 nt, Homo sapiens
gcaucacagggagacaggccuc

SEQ ID NO: 34283 - RNA, 19 nt, Homo sapiens
gcaucauuaguugcuuuuc

SEQ ID NO: 34284 - RNA, 22 nt, Homo sapiens
gcaugguacuggaugguaguau

SEQ ID NO: 34285 - RNA, 22 nt, Homo sapiens
gccaaaaugcugggauuacagg

SEQ ID NO: 34286 - RNA, 22 nt, Homo sapiens
gccaagauugguuuaauauucc

SEQ ID NO: 34287 - RNA, 22 nt, Homo sapiens
gccagauuguccaguuuuuuau

SEQ ID NO: 34288 - RNA, 22 nt, Homo sapiens
gccaguguuuuauugagaauuu

SEQ ID NO: 34289 - RNA, 22 nt, Homo sapiens
gccauggaggauuuauagaggc

SEQ ID NO: 34290 - RNA, 22 nt, Homo sapiens
gccauugcacuccagccucggg

SEQ ID NO: 34291 - RNA, 22 nt, Homo sapiens
gcccaguagcaguacaucccuu

SEQ ID NO: 34292 - RNA, 22 nt, Homo sapiens
gccccaguacaggcuccuuaga

SEQ ID NO: 34293 - RNA, 22 nt, Homo sapiens
gcccugagauucuuggauucug

SEQ ID NO: 34294 - RNA, 22 nt, Homo sapiens
gcccugauacauucuucugccu

SEQ ID NO: 34295 - RNA, 22 nt, Homo sapiens
gcccuuugugucuggcuggggu

SEQ ID NO: 34296 - RNA, 22 nt, Homo sapiens
gccuagagaguuaucaggcugu

SEQ ID NO: 34297 - RNA, 22 nt, Homo sapiens
gccuagggacaaaccguccgac

SEQ ID NO: 34298 - RNA, 22 nt, Homo sapiens
gcguugcacuccagccugggua

SEQ ID NO: 34299 - RNA, 22 nt, Homo sapiens
gcuaggagaucugcugcucucu

SEQ ID NO: 34300 - RNA, 22 nt, Homo sapiens
gcuaguguuugccagcguagcc

SEQ ID NO: 34301 - RNA, 22 nt, Homo sapiens
gcucaaguaauggcaguuuugc

SEQ ID NO: 34302 - RNA, 19 nt, Homo sapiens
gcucaccuugcugcuccag

SEQ ID NO: 34303 - RNA, 22 nt, Homo sapiens
gcucuuuugggguaauucugag

SEQ ID NO: 34304 - RNA, 22 nt, Homo sapiens
gcugagcuaugccauauaugcc

SEQ ID NO: 34305 - RNA, 22 nt, Homo sapiens
gcugaguaguauuucauuguau

SEQ ID NO: 34306 - RNA, 22 nt, Homo sapiens
gcugcacuuuaaggcauccccu

SEQ ID NO: 34307 - RNA, 22 nt, Homo sapiens
gcugcuguaccagaugugguua

SEQ ID NO: 34308 - RNA, 22 nt, Homo sapiens
gcugcuguuuaguuucuccugg

SEQ ID NO: 34309 - RNA, 22 nt, Homo sapiens
gcuggguucagagugggcugcg

SEQ ID NO: 34310 - RNA, 22 nt, Homo sapiens
gcugguguugugaaucaggccg

SEQ ID NO: 34311 - RNA, 22 nt, Homo sapiens
gcuguauugacuuuguaucaua

SEQ ID NO: 34312 - RNA, 20 nt, Homo sapiens
gcugugcuuaauacacuuuc

SEQ ID NO: 34313 - RNA, 22 nt, Homo sapiens
gcuguguugugcccagcaucau

SEQ ID NO: 34314 - RNA, 22 nt, Homo sapiens
gcuguugugaacuauacaucua

SEQ ID NO: 34315 - RNA, 22 nt, Homo sapiens
gcuuguguuuacuguaguuacu

SEQ ID NO: 34316 - RNA, 19 nt, Homo sapiens
gcuuuguggggaaggagcc

SEQ ID NO: 34317 - RNA, 22 nt, Homo sapiens
gcuuuguugauggugagucugu

SEQ ID NO: 34318 - RNA, 22 nt, Homo sapiens
ggaaagaucagcuaaauguaag

SEQ ID NO: 34319 - RNA, 22 nt, Homo sapiens
ggaaagauguaauauuaucuaa

SEQ ID NO: 34320 - RNA, 22 nt, Homo sapiens
ggaaaguaacccauucucuuac

SEQ ID NO: 34321 - RNA, 22 nt, Homo sapiens
ggaaauguaaacaauggggcua

SEQ ID NO: 34322 - RNA, 22 nt, Homo sapiens
ggaacaccauuuuuccugccuu

SEQ ID NO: 34323 - RNA, 22 nt, Homo sapiens
ggaagaauaaugggccuuagag

SEQ ID NO: 34324 - RNA, 22 nt, Homo sapiens
ggaagacaguguggugauuccu

SEQ ID NO: 34325 - RNA, 22 nt, Homo sapiens
ggaagagugaauuaucuugacu

SEQ ID NO: 34326 - RNA, 22 nt, Homo sapiens
ggaagccugcacucgggcaggg

SEQ ID NO: 34327 - RNA, 22 nt, Homo sapiens
ggaagccuggaaaaaauuguga

SEQ ID NO: 34328 - RNA, 17 nt, Homo sapiens
ggaagccuuugguuuaa

SEQ ID NO: 34329 - RNA, 22 nt, Homo sapiens
ggaaugcuaaaauaggaugcug

SEQ ID NO: 34330 - RNA, 22 nt, Homo sapiens
ggaaugggauuugaagucuggc

SEQ ID NO: 34331 - RNA, 22 nt, Homo sapiens
ggaaugugugucaugcuuuugc

SEQ ID NO: 34332 - RNA, 22 nt, Homo sapiens
ggacaagagacugggacacuga

SEQ ID NO: 34333 - RNA, 22 nt, Homo sapiens
ggacagaaaggguucaccaaac

SEQ ID NO: 34334 - RNA, 22 nt, Homo sapiens
ggacauuaacugcaagauagau

SEQ ID NO: 34335 - RNA, 22 nt, Homo sapiens
ggacuagggacauggggagcug

SEQ ID NO: 34336 - RNA, 22 nt, Homo sapiens
ggacuguaauaccaugaggaca

SEQ ID NO: 34337 - RNA, 22 nt, Homo sapiens
ggagaauguaauugguauuuug

SEQ ID NO: 34338 - RNA, 22 nt, Homo sapiens
ggagaucuuugaaguguugugc

SEQ ID NO: 34339 - RNA, 22 nt, Homo sapiens
ggagaucuuuguuaucuuuuga

SEQ ID NO: 34340 - RNA, 22 nt, Homo sapiens
ggagaugauuaugaaucacuua

SEQ ID NO: 34341 - RNA, 22 nt, Homo sapiens
ggagauguuuaaccuuuuaucu

SEQ ID NO: 34342 - RNA, 22 nt, Homo sapiens
ggagguagucuuucccuuauca

SEQ ID NO: 34343 - RNA, 16 nt, Homo sapiens
ggaggucaucugggaa

SEQ ID NO: 34344 - RNA, 22 nt, Homo sapiens
ggaguaaaagaguaggaggaau

SEQ ID NO: 34345 - RNA, 22 nt, Homo sapiens
ggagucugaacuggacaaugac

SEQ ID NO: 34346 - RNA, 22 nt, Homo sapiens
ggagucugauuuuuauguugcu

SEQ ID NO: 34347 - RNA, 22 nt, Homo sapiens
ggagugcuguuguuacacaagg

SEQ ID NO: 34348 - RNA, 22 nt, Homo sapiens
ggagugugauucaguauaauau

SEQ ID NO: 34349 - RNA, 22 nt, Homo sapiens
ggaguguguuuuccaacuuggu

SEQ ID NO: 34350 - RNA, 21 nt, Homo sapiens
ggauagaaaacuuggcuguau

SEQ ID NO: 34351 - RNA, 22 nt, Homo sapiens
ggauaucauuauuucuagggcu

SEQ ID NO: 34352 - RNA, 18 nt, Homo sapiens
ucaagcuauugucaugcc

SEQ ID NO: 34353 - RNA, 21 nt, Homo sapiens
ucaaggaguauacguaugcca

SEQ ID NO: 34354 - RNA, 22 nt, Homo sapiens
ucaaguacugccuugcucuggc

SEQ ID NO: 34355 - RNA, 22 nt, Homo sapiens
ucaaugcaugugacaaagagua

SEQ ID NO: 34356 - RNA, 22 nt, Homo sapiens
ucaauugcaucaacaguguaca

SEQ ID NO: 34357 - RNA, 22 nt, Homo sapiens
ucaauugcuuaugaagauacau

SEQ ID NO: 34358 - RNA, 22 nt, Homo sapiens
ucacaaggcaggaaugaaaggg

SEQ ID NO: 34359 - RNA, 22 nt, Homo sapiens
ucacaaguguauagacaugucc

SEQ ID NO: 34360 - RNA, 21 nt, Homo sapiens
ucacaaugaacagcagcagaa

SEQ ID NO: 34361 - RNA, 22 nt, Homo sapiens
ucacaccauucuucuacuucag

SEQ ID NO: 34362 - RNA, 22 nt, Homo sapiens
ucacacgugaacucaucacaga

SEQ ID NO: 34363 - RNA, 22 nt, Homo sapiens
ucacacugucuugguuacucuu

SEQ ID NO: 34364 - RNA, 22 nt, Homo sapiens
ucacagaugcuugacccauuuc

SEQ ID NO: 34365 - RNA, 22 nt, Homo sapiens
ucacagcuaaaaugaaaguagu

SEQ ID NO: 34366 - RNA, 22 nt, Homo sapiens
ucacaguagcaaauguuagaaa

SEQ ID NO: 34367 - RNA, 20 nt, Homo sapiens
ucacagucacacauaauccu

SEQ ID NO: 34368 - RNA, 22 nt, Homo sapiens
ucacaguccuguuuaggagagg

SEQ ID NO: 34369 - RNA, 22 nt, Homo sapiens
ucacauagcugaguaaaaugga

SEQ ID NO: 34370 - RNA, 22 nt, Homo sapiens
ucacaugcacaucucuggaacc

SEQ ID NO: 34371 - RNA, 22 nt, Homo sapiens
ucacauggauuaacucauuuau

SEQ ID NO: 34372 - RNA, 22 nt, Homo sapiens
ucacaugggugcaauauaauca

SEQ ID NO: 34373 - RNA, 22 nt, Homo sapiens
ucacaugugacauauauauuug

SEQ ID NO: 34374 - RNA, 22 nt, Homo sapiens
ucaccaccuuccaggaccacug

SEQ ID NO: 34375 - RNA, 19 nt, Homo sapiens
ucaccaguacacaauacaa

SEQ ID NO: 34376 - RNA, 16 nt, Homo sapiens
ucaccccuagagaucc

SEQ ID NO: 34377 - RNA, 20 nt, Homo sapiens
ucacccugacaucugcccag

SEQ ID NO: 34378 - RNA, 22 nt, Homo sapiens
ucaccuggagaagauggaucau

SEQ ID NO: 34379 - RNA, 21 nt, Homo sapiens
ucaccuguugcgaugaagcug

SEQ ID NO: 34380 - RNA, 18 nt, Homo sapiens
ucaccuugaugcuggguc

SEQ ID NO: 34381 - RNA, 22 nt, Homo sapiens
ucacgcugcugcaaccagccug

SEQ ID NO: 34382 - RNA, 18 nt, Homo sapiens
ucacggggagcagcagcc

SEQ ID NO: 34383 - RNA, 19 nt, Homo sapiens
ucacgugcagcagccacac

SEQ ID NO: 34384 - RNA, 22 nt, Homo sapiens
ucacuaaagaaaauggcaugga

SEQ ID NO: 34385 - RNA, 20 nt, Homo sapiens
ucacuauggagcucuuucuu

SEQ ID NO: 34386 - RNA, 22 nt, Homo sapiens
ucacucagaccuggugauaugc

SEQ ID NO: 34387 - RNA, 22 nt, Homo sapiens
ucacugaaaccuccaccucucg

SEQ ID NO: 34388 - RNA, 22 nt, Homo sapiens
ucacugagcuagaucacuugac

SEQ ID NO: 34389 - RNA, 22 nt, Homo sapiens
ucacugcgcuucagccugggug

SEQ ID NO: 34390 - RNA, 22 nt, Homo sapiens
ucacuggacagaaauaaaggug

SEQ ID NO: 34391 - RNA, 22 nt, Homo sapiens
ucacuggccaaauucuggguga

SEQ ID NO: 34392 - RNA, 22 nt, Homo sapiens
ucacugggagcauuugagccuu

SEQ ID NO: 34393 - RNA, 22 nt, Homo sapiens
ucacugugcaugaaggaugcug

SEQ ID NO: 34394 - RNA, 22 nt, Homo sapiens
uccagugugcaggcaaguuuga

SEQ ID NO: 34395 - RNA, 22 nt, Homo sapiens
uccaguguuauaauaugcgucu

SEQ ID NO: 34396 - RNA, 18 nt, Homo sapiens
uccaguuuucccagcauc

SEQ ID NO: 34397 - RNA, 20 nt, Homo sapiens
uccaguuuuggagacauucu

SEQ ID NO: 34398 - RNA, 22 nt, Homo sapiens
uccauguagaagacaggggaga

SEQ ID NO: 34399 - RNA, 22 nt, Homo sapiens
uccauuuguagguagugagaca

SEQ ID NO: 34400 - RNA, 22 nt, Homo sapiens
uccauuugucuauguuucuguu

SEQ ID NO: 34401 - RNA, 20 nt, Homo sapiens
ucccaguaggagaaggaagg

SEQ ID NO: 34402 - RNA, 17 nt, Homo sapiens
ucccauguuucuucuac

SEQ ID NO: 34403 - RNA, 22 nt, Homo sapiens
uccccugagaccccucagcacu

SEQ ID NO: 34404 - RNA, 22 nt, Homo sapiens
ucccuacugggguacugccuag

SEQ ID NO: 34405 - RNA, 22 nt, Homo sapiens
ucccugaacacauguugagaag

SEQ ID NO: 34406 - RNA, 19 nt, Homo sapiens
ucccugagucuuagcuuga

SEQ ID NO: 34407 - RNA, 22 nt, Homo sapiens
ucccuggacagccuugccuggg

SEQ ID NO: 34408 - RNA, 22 nt, Homo sapiens
ucccuggagcaagagaagaagg

SEQ ID NO: 34409 - RNA, 19 nt, Homo sapiens
ucccuguagaccacagugc

SEQ ID NO: 34410 - RNA, 16 nt, Homo sapiens
ucccugugacaugugc

SEQ ID NO: 34411 - RNA, 22 nt, Homo sapiens
ucccuugguaauucuguuccuu

SEQ ID NO: 34412 - RNA, 19 nt, Homo sapiens
ucccuuuguauggacauac

SEQ ID NO: 34413 - RNA, 22 nt, Homo sapiens
uccucugaacuccagacccaua

SEQ ID NO: 34414 - RNA, 21 nt, Homo sapiens
uccugagagaggaguaacucu

SEQ ID NO: 34415 - RNA, 22 nt, Homo sapiens
uccugcauucauccugguguug

SEQ ID NO: 34416 - RNA, 22 nt, Homo sapiens
uccuucaguccaguggguuuug

SEQ ID NO: 34417 - RNA, 22 nt, Homo sapiens
uccuucaugcaucaauguaucc

SEQ ID NO: 34418 - RNA, 22 nt, Homo sapiens
uccuugagaggacagagccaua

SEQ ID NO: 34419 - RNA, 22 nt, Homo sapiens
uccuugagccucccagacucag

SEQ ID NO: 34420 - RNA, 22 nt, Homo sapiens
uccuugagucugaacuuuggau

SEQ ID NO: 34421 - RNA, 19 nt, Homo sapiens
uccuugauugcaccacugc

SEQ ID NO: 34422 - RNA, 22 nt, Homo sapiens
uccuugcacuaacuuaaggagg

SEQ ID NO: 34423 - RNA, 22 nt, Homo sapiens
uccuuggugacauuucuugucu

SEQ ID NO: 34424 - RNA, 22 nt, Homo sapiens
uccuuuggcuaacuuucuaagu

SEQ ID NO: 34425 - RNA, 23 nt, Homo sapiens
ucgcagcauucaauaccaggcag

SEQ ID NO: 34426 - RNA, 22 nt, Homo sapiens
ucgcauggucuccaggcagcuc

SEQ ID NO: 34427 - RNA, 22 nt, Homo sapiens
ucggcucagugcaagcucugcc

SEQ ID NO: 34428 - RNA, 22 nt, Homo sapiens
ucuaaugcucugagaacagugc

SEQ ID NO: 34429 - RNA, 22 nt, Homo sapiens
ucuagaugaaguauaaaguagu

SEQ ID NO: 34430 - RNA, 22 nt, Homo sapiens
ucuaucacagugauguuccaga

SEQ ID NO: 34431 - RNA, 22 nt, Homo sapiens
ucucacagaguugaacuuucuu

SEQ ID NO: 34432 - RNA, 22 nt, Homo sapiens
uugagacugagucucgcccugu

SEQ ID NO: 34433 - RNA, 22 nt, Homo sapiens
uugagagcugaugaaagauaaa

SEQ ID NO: 34434 - RNA, 22 nt, Homo sapiens
uugagaucaugcuacugcacuc

SEQ ID NO: 34435 - RNA, 22 nt, Homo sapiens
uugagauggagucucacuccuu

SEQ ID NO: 34436 - RNA, 22 nt, Homo sapiens
uugagauggagucucgcucugu

SEQ ID NO: 34437 - RNA, 22 nt, Homo sapiens
uugagauguaagauguuaauau

SEQ ID NO: 34438 - RNA, 22 nt, Homo sapiens
uugagauguauguauauaaugu

SEQ ID NO: 34439 - RNA, 21 nt, Homo sapiens
uugagcaacuaggguuauagg

SEQ ID NO: 34440 - RNA, 22 nt, Homo sapiens
uugagcaaugaacgauucaggg

SEQ ID NO: 34441 - RNA, 22 nt, Homo sapiens
uugagcauugguauagguuuua

SEQ ID NO: 34442 - RNA, 22 nt, Homo sapiens
uugagccaaggauugucuuucc

SEQ ID NO: 34443 - RNA, 22 nt, Homo sapiens
uugagcccuggagguggaggcu

SEQ ID NO: 34444 - RNA, 22 nt, Homo sapiens
uugagcuauguacagaugcugu

SEQ ID NO: 34445 - RNA, 22 nt, Homo sapiens
uugagcucuuccagccuggagc

SEQ ID NO: 34446 - RNA, 22 nt, Homo sapiens
uugagcucuucuagcaauucua

SEQ ID NO: 34447 - RNA, 22 nt, Homo sapiens
uugagcuuuuuacuuguccaau

SEQ ID NO: 34448 - RNA, 22 nt, Homo sapiens
uugaggacuggaacacaggucu

SEQ ID NO: 34449 - RNA, 22 nt, Homo sapiens
uugaggaggcagucucuccauu

SEQ ID NO: 34450 - RNA, 22 nt, Homo sapiens
uugaggaggcagucuguccguu

SEQ ID NO: 34451 - RNA, 22 nt, Homo sapiens
uugaggaggcagucuucccauu

SEQ ID NO: 34452 - RNA, 22 nt, Homo sapiens
uugaggcaaugaggagaagcug

SEQ ID NO: 34453 - RNA, 22 nt, Homo sapiens
uugaggcuuuugaccucaugug

SEQ ID NO: 34454 - RNA, 22 nt, Homo sapiens
uugaggguggcauauauugauu

SEQ ID NO: 34455 - RNA, 20 nt, Homo sapiens
uugaggucaggaguuuggga

SEQ ID NO: 34456 - RNA, 22 nt, Homo sapiens
uugaggugaagggcagagcagc

SEQ ID NO: 34457 - RNA, 22 nt, Homo sapiens
gucccugcgauugugggauccu

SEQ ID NO: 34458 - RNA, 22 nt, Homo sapiens
gucccugugucuuuauguggcc

SEQ ID NO: 34459 - RNA, 22 nt, Homo sapiens
guccuggagaagcguggaccgg

SEQ ID NO: 34460 - RNA, 22 nt, Homo sapiens
gucuaugagucccugaauuuaa

SEQ ID NO: 34461 - RNA, 22 nt, Homo sapiens
gucucacagcuagcugcuuuau

SEQ ID NO: 34462 - RNA, 22 nt, Homo sapiens
gucucauugcaguuagaccugu

SEQ ID NO: 34463 - RNA, 22 nt, Homo sapiens
gucucccagccuacaucuuucu

SEQ ID NO: 34464 - RNA, 22 nt, Homo sapiens
gucuggcuccuucuacuacaug

SEQ ID NO: 34465 - RNA, 22 nt, Homo sapiens
gucugguuuuuuauauccucac

SEQ ID NO: 34466 - RNA, 20 nt, Homo sapiens
gucugucuccgaguagaauu

SEQ ID NO: 34467 - RNA, 22 nt, Homo sapiens
gucuguuuggggaccuguggcc

SEQ ID NO: 34468 - RNA, 22 nt, Homo sapiens
gucuugaaggcugaguaccugu

SEQ ID NO: 34469 - RNA, 22 nt, Homo sapiens
gucuuggagacauugccauuga

SEQ ID NO: 34470 - RNA, 22 nt, Homo sapiens
gucuuugaugucuaugugcuuc

SEQ ID NO: 34471 - RNA, 17 nt, Homo sapiens
gugaaaucaucauuuuu

SEQ ID NO: 34472 - RNA, 20 nt, Homo sapiens
gugacacucguuaaccucug

SEQ ID NO: 34473 - RNA, 22 nt, Homo sapiens
gugacagaguaagacccuguau

SEQ ID NO: 34474 - RNA, 22 nt, Homo sapiens
gugaccagaugggcaggggugu

SEQ ID NO: 34475 - RNA, 22 nt, Homo sapiens
gugacuacaggccacaguuugg

SEQ ID NO: 34476 - RNA, 20 nt, Homo sapiens
gugagaacaugugguauuug

SEQ ID NO: 34477 - RNA, 22 nt, Homo sapiens
gugagaacugcuggggccacag

SEQ ID NO: 34478 - RNA, 22 nt, Homo sapiens
gugagaauauuuuaaauacuaa

SEQ ID NO: 34479 - RNA, 22 nt, Homo sapiens
gugagaauugacacccuugucu

SEQ ID NO: 34480 - RNA, 22 nt, Homo sapiens
auuagguuggugcaaaaguaau

SEQ ID NO: 34481 - RNA, 22 nt, Homo sapiens
auuagugaaugugaugucuuga

SEQ ID NO: 34482 - RNA, 22 nt, Homo sapiens
auucaacuaauuauugaagaug

SEQ ID NO: 34483 - RNA, 22 nt, Homo sapiens
auucaaggagucuucgucccaa

SEQ ID NO: 34484 - RNA, 22 nt, Homo sapiens
auucaagggauuucaggaggcu

SEQ ID NO: 34485 - RNA, 23 nt, Homo sapiens
auucaaguagugagagugguuau

SEQ ID NO: 34486 - RNA, 20 nt, Homo sapiens
auucaaguaugccuugagaa

SEQ ID NO: 34487 - RNA, 22 nt, Homo sapiens
auucacagcuuuaaaaggcgug

SEQ ID NO: 34488 - RNA, 22 nt, Homo sapiens
auucauagugcuaagguguauc

SEQ ID NO: 34489 - RNA, 22 nt, Homo sapiens
auucaucagggauauuggucug

SEQ ID NO: 34490 - RNA, 22 nt, Homo sapiens
auucaucagggauauugguuga

SEQ ID NO: 34491 - RNA, 22 nt, Homo sapiens
auuccacagccgauaccaugac

SEQ ID NO: 34492 - RNA, 20 nt, Homo sapiens
auuccacuuauaugaggucc

SEQ ID NO: 34493 - RNA, 22 nt, Homo sapiens
auuccaguggguuuacauccca

SEQ ID NO: 34494 - RNA, 22 nt, Homo sapiens
auuccaguuugugagaagcugu

SEQ ID NO: 34495 - RNA, 22 nt, Homo sapiens
auucccuguagaauaaggaugg

SEQ ID NO: 34496 - RNA, 18 nt, Homo sapiens
auucuacaggccuuuuga

SEQ ID NO: 34497 - RNA, 22 nt, Homo sapiens
auucuauaguccuaggauuggg

SEQ ID NO: 34498 - RNA, 22 nt, Homo sapiens
auugaacacuucugugugccag

SEQ ID NO: 34499 - RNA, 23 nt, Homo sapiens
auugaacacuuucauaugugagg

SEQ ID NO: 34500 - RNA, 22 nt, Homo sapiens
auugaauuugguuugcuaagaa

SEQ ID NO: 34501 - RNA, 22 nt, Homo sapiens
auugacacugauuuuucuuuaa

SEQ ID NO: 34502 - RNA, 22 nt, Homo sapiens
cagcccguaaucccagcacuuu

SEQ ID NO: 34503 - RNA, 22 nt, Homo sapiens
cagccgggugagguggcuuguu

SEQ ID NO: 34504 - RNA, 22 nt, Homo sapiens
cagccggguggcuccuagggua

SEQ ID NO: 34505 - RNA, 22 nt, Homo sapiens
cagcuaaauuguuaaauccaag

SEQ ID NO: 34506 - RNA, 20 nt, Homo sapiens
cagcuagugguaggagucgg

SEQ ID NO: 34507 - RNA, 23 nt, Homo sapiens
cagcucauuuggguccccuuguc

SEQ ID NO: 34508 - RNA, 23 nt, Homo sapiens
cagcuucauugaacauaacuccu

SEQ ID NO: 34509 - RNA, 22 nt, Homo sapiens
caggcagucuggcucccaagug

SEQ ID NO: 34510 - RNA, 20 nt, Homo sapiens
cagggcaaugaggagguaaa

SEQ ID NO: 34511 - RNA, 22 nt, Homo sapiens
cagguacauuuuaaagggcuca

SEQ ID NO: 34512 - RNA, 22 nt, Homo sapiens
cagguaguguguagcacagcag

SEQ ID NO: 34513 - RNA, 22 nt, Homo sapiens
caggucaucugaguuuaguucu

SEQ ID NO: 34514 - RNA, 22 nt, Homo sapiens
caggugaaugccucuccuucug

SEQ ID NO: 34515 - RNA, 22 nt, Homo sapiens
caguaguagccccuuagaugga

SEQ ID NO: 34516 - RNA, 19 nt, Homo sapiens
caguaucauugcacauagu

SEQ ID NO: 34517 - RNA, 22 nt, Homo sapiens
cagucacagugacaggaugugg

SEQ ID NO: 34518 - RNA, 20 nt, Homo sapiens
cagucauagacaucagaguc

SEQ ID NO: 34519 - RNA, 20 nt, Homo sapiens
cagucaugaagaacugugag

SEQ ID NO: 34520 - RNA, 22 nt, Homo sapiens
cagugaauuucaggucaagagu

SEQ ID NO: 34521 - RNA, 22 nt, Homo sapiens
cagugacacugaaaaguucggg

SEQ ID NO: 34522 - RNA, 22 nt, Homo sapiens
cagugcacugggauuauaagug

SEQ ID NO: 34523 - RNA, 22 nt, Homo sapiens
cagugcauaggaucuaaaauuu

SEQ ID NO: 34524 - RNA, 22 nt, Homo sapiens
cagugcauguggcacucuccag

SEQ ID NO: 34525 - RNA, 22 nt, Homo sapiens
cagugcuuuaucaaguccucca

SEQ ID NO: 34526 - RNA, 22 nt, Homo sapiens
caguggaugaacaagaagugau

SEQ ID NO: 34527 - RNA, 22 nt, Homo sapiens
caguggaugauguuuucugugg

SEQ ID NO: 34528 - RNA, 22 nt, Homo sapiens
cagugguuuucaacccugguug

SEQ ID NO: 34529 - RNA, 22 nt, Homo sapiens
caguguaugcuucuauuuuugg

SEQ ID NO: 34530 - RNA, 22 nt, Homo sapiens
caguugcacuagccccguuuca

SEQ ID NO: 34531 - RNA, 22 nt, Homo sapiens
cauacaguaggcacuauuugua

SEQ ID NO: 34532 - RNA, 22 nt, Homo sapiens
cauagcacacauuuaccuaugu

SEQ ID NO: 34533 - RNA, 19 nt, Homo sapiens
caucacagagucuuccauu

SEQ ID NO: 34534 - RNA, 22 nt, Homo sapiens
caucacagcaaguagggagugg

SEQ ID NO: 34535 - RNA, 22 nt, Homo sapiens
caucacaugcuuauuuuccuca

SEQ ID NO: 34536 - RNA, 21 nt, Homo sapiens
caucacauuacucaaaguccu

SEQ ID NO: 34537 - RNA, 22 nt, Homo sapiens
caucacauucugagauacugag

SEQ ID NO: 34538 - RNA, 20 nt, Homo sapiens
caucaccuggcaggauuugu

SEQ ID NO: 34539 - RNA, 22 nt, Homo sapiens
caucacuguugguacaaguaau

SEQ ID NO: 34540 - RNA, 22 nt, Homo sapiens
caucacuuugccuccgucucua

SEQ ID NO: 34541 - RNA, 22 nt, Homo sapiens
caucacuuuuccuuuuacagau

SEQ ID NO: 34542 - RNA, 22 nt, Homo sapiens
caucccauucgaggggcacagc

SEQ ID NO: 34543 - RNA, 22 nt, Homo sapiens
caucccugaaccccagaaaucu

SEQ ID NO: 34544 - RNA, 19 nt, Homo sapiens
caucccugagcugaagugg

SEQ ID NO: 34545 - RNA, 22 nt, Homo sapiens
caucgcacuccagcuugggcaa

SEQ ID NO: 34546 - RNA, 22 nt, Homo sapiens
caucucauugaauugcugagca

SEQ ID NO: 34547 - RNA, 23 nt, Homo sapiens
caugaacuaguuugcagccauga

SEQ ID NO: 34548 - RNA, 22 nt, Homo sapiens
caugcagcacacaugucugugc

SEQ ID NO: 34549 - RNA, 22 nt, Homo sapiens
caugcauagccauucauucguu

SEQ ID NO: 34550 - RNA, 22 nt, Homo sapiens
caugccacuguggacaaagaca

SEQ ID NO: 34551 - RNA, 22 nt, Homo sapiens
cauggcauuucaagauuuacca

SEQ ID NO: 34552 - RNA, 22 nt, Homo sapiens
cauggcccuggguccauaggaa

SEQ ID NO: 34553 - RNA, 22 nt, Homo sapiens
cauggccuuuggaaugugucua

SEQ ID NO: 34554 - RNA, 22 nt, Homo sapiens
cauggucaccuuccaaguuauu

SEQ ID NO: 34555 - RNA, 22 nt, Homo sapiens
cauguaguagaaggagccagac

SEQ ID NO: 34556 - RNA, 22 nt, Homo sapiens
caugucuuuuauucugugugau

SEQ ID NO: 34557 - RNA, 19 nt, Homo sapiens
caugugcacuacuggcuuc

SEQ ID NO: 34558 - RNA, 20 nt, Homo sapiens
cauuccacuuuccugucagu

SEQ ID NO: 34559 - RNA, 22 nt, Homo sapiens
cauugcaauccagccugggcaa

SEQ ID NO: 34560 - RNA, 22 nt, Homo sapiens
cauugcacuccagccuagccaa

SEQ ID NO: 34561 - RNA, 22 nt, Homo sapiens
cauugcacuccagccucggcaa

SEQ ID NO: 34562 - RNA, 22 nt, Homo sapiens
cauugcacuccagccugaggga

SEQ ID NO: 34563 - RNA, 22 nt, Homo sapiens
cauugcacuccagccugcugac

SEQ ID NO: 34564 - RNA, 22 nt, Homo sapiens
cauugcacugcagcccgggcaa

SEQ ID NO: 34565 - RNA, 22 nt, Homo sapiens
cauugcacugcuucuugggugu

SEQ ID NO: 34566 - RNA, 22 nt, Homo sapiens
cauugguugaacagauuguguu

SEQ ID NO: 34567 - RNA, 22 nt, Homo sapiens
cauugguuuuucaggaguauau

SEQ ID NO: 34568 - RNA, 22 nt, Homo sapiens
cauuuugcaguuucugucucca

SEQ ID NO: 34569 - RNA, 22 nt, Homo sapiens
ccaaggaauacccucccuuuuu

SEQ ID NO: 34570 - RNA, 22 nt, Homo sapiens
ccacacugucuuggugggaaac

SEQ ID NO: 34571 - RNA, 22 nt, Homo sapiens
ccacauuggaaaggaucccccc

SEQ ID NO: 34572 - RNA, 22 nt, Homo sapiens
ccacccuggagaauuugagguc

SEQ ID NO: 34573 - RNA, 22 nt, Homo sapiens
ccaccuguacuuaagucacuuu

SEQ ID NO: 34574 - RNA, 22 nt, Homo sapiens
ccagaguugccucagguuucug

SEQ ID NO: 34575 - RNA, 22 nt, Homo sapiens
ccagaguuucugauucagcagg

SEQ ID NO: 34576 - RNA, 19 nt, Homo sapiens
agcuuuggcuaacuuucuc

SEQ ID NO: 34577 - RNA, 22 nt, Homo sapiens
aggaagacauauagaacuaaaa

SEQ ID NO: 34578 - RNA, 21 nt, Homo sapiens
aggaagacuaugaucaauugg

SEQ ID NO: 34579 - RNA, 22 nt, Homo sapiens
aggaagugugcaauuaauuucu

SEQ ID NO: 34580 - RNA, 18 nt, Homo sapiens
aggaaugguaauacuuca

SEQ ID NO: 34581 - RNA, 22 nt, Homo sapiens
aggaauguuaguacuucuuagu

SEQ ID NO: 34582 - RNA, 20 nt, Homo sapiens
gugagucauuaguaaccaaa

SEQ ID NO: 34583 - RNA, 22 nt, Homo sapiens
gugaguggacgugaccaauaaa

SEQ ID NO: 34584 - RNA, 22 nt, Homo sapiens
gugaucaugauccugaagcauu

SEQ ID NO: 34585 - RNA, 22 nt, Homo sapiens
gugaucauuguauugggguuau

SEQ ID NO: 34586 - RNA, 22 nt, Homo sapiens
gugaucucauuuggaauuagag

SEQ ID NO: 34587 - RNA, 22 nt, Homo sapiens
gugaugcaguacguagaggaga

SEQ ID NO: 34588 - RNA, 22 nt, Homo sapiens
gugauuuaguagaugcuaguua

SEQ ID NO: 34589 - RNA, 21 nt, Homo sapiens
gugcaaacaucauagaaugua

SEQ ID NO: 34590 - RNA, 22 nt, Homo sapiens
gugcaaauguuauugagguuuu

SEQ ID NO: 34591 - RNA, 22 nt, Homo sapiens
gugcaacaucccuccauaauuu

SEQ ID NO: 34592 - RNA, 22 nt, Homo sapiens
gugcaauucacuguuaugucug

SEQ ID NO: 34593 - RNA, 22 nt, Homo sapiens
gugcacaacgugcagguuuguu

SEQ ID NO: 34594 - RNA, 22 nt, Homo sapiens
gugcacaacguguagguuuguu

SEQ ID NO: 34595 - RNA, 21 nt, Homo sapiens
gugcacaguaguguuuaauag

SEQ ID NO: 34596 - RNA, 22 nt, Homo sapiens
gugcacauuguuuaugucuguu

SEQ ID NO: 34597 - RNA, 21 nt, Homo sapiens
gugcagaugccacagucacuc

SEQ ID NO: 34598 - RNA, 22 nt, Homo sapiens
gugcaguuuacaguuacccagu

SEQ ID NO: 34599 - RNA, 22 nt, Homo sapiens
gugcaguuugaaaguagaaaca

SEQ ID NO: 34600 - RNA, 22 nt, Homo sapiens
gugcaguuuugagugaguuucu

SEQ ID NO: 34601 - RNA, 18 nt, Homo sapiens
gugcauagccauggcagc

SEQ ID NO: 34602 - RNA, 22 nt, Homo sapiens
gugcauauaaguuguuucuagu

SEQ ID NO: 34603 - RNA, 22 nt, Homo sapiens
gugcauaugcaugugcaugcac

SEQ ID NO: 34604 - RNA, 22 nt, Homo sapiens
gugcgggaggcgcgccuaggug

SEQ ID NO: 34605 - RNA, 22 nt, Homo sapiens
guggaagaaaucagguuauuug

SEQ ID NO: 34606 - RNA, 22 nt, Homo sapiens
guggaagcacaggccuccugga

SEQ ID NO: 34607 - RNA, 22 nt, Homo sapiens
guggaaggucaugaauguucuu

SEQ ID NO: 34608 - RNA, 22 nt, Homo sapiens
guggaaugcaguguugauucaa

SEQ ID NO: 34609 - RNA, 22 nt, Homo sapiens
guggacguguguccccauggcu

SEQ ID NO: 34610 - RNA, 22 nt, Homo sapiens
guggacugggagagauaguucc

SEQ ID NO: 34611 - RNA, 22 nt, Homo sapiens
guggagacaaaggcugagugag

SEQ ID NO: 34612 - RNA, 22 nt, Homo sapiens
guggagucaucacucagagugg

SEQ ID NO: 34613 - RNA, 17 nt, Homo sapiens
guggauagaacaaugaa

SEQ ID NO: 34614 - RNA, 22 nt, Homo sapiens
guggcagagucagagggaaaug

SEQ ID NO: 34615 - RNA, 22 nt, Homo sapiens
guggcauuucccaaaguauucu

SEQ ID NO: 34616 - RNA, 22 nt, Homo sapiens
guggcgagaucauagcucauug

SEQ ID NO: 34617 - RNA, 22 nt, Homo sapiens
guggcuagaaugaagguagcug

SEQ ID NO: 34618 - RNA, 22 nt, Homo sapiens
guggcuuguaggggucaaggga

SEQ ID NO: 34619 - RNA, 22 nt, Homo sapiens
guggcuuuaaguacgauugagg

SEQ ID NO: 34620 - RNA, 22 nt, Homo sapiens
gugggcaaagcuaguguguaga

SEQ ID NO: 34621 - RNA, 22 nt, Homo sapiens
gugggcaagucacuucaguucu

SEQ ID NO: 34622 - RNA, 22 nt, Homo sapiens
gugggguaggcaauuccuagug

SEQ ID NO: 34623 - RNA, 22 nt, Homo sapiens
gugggguaggugacuugaugag

SEQ ID NO: 34624 - RNA, 22 nt, Homo sapiens
gugguaaaauggcauagagcua

SEQ ID NO: 34625 - RNA, 22 nt, Homo sapiens
gugguucuaaaccuuuuuuggu

SEQ ID NO: 34626 - RNA, 22 nt, Homo sapiens
gugguuuuuagauuucuacagu

SEQ ID NO: 34627 - RNA, 20 nt, Homo sapiens
guguaagagcaagcuuccua

SEQ ID NO: 34628 - RNA, 22 nt, Homo sapiens
guguauauccuauuaguucugu

SEQ ID NO: 34629 - RNA, 22 nt, Homo sapiens
gugucaaggaugccugucaggc

SEQ ID NO: 34630 - RNA, 22 nt, Homo sapiens
gugucacuguugagaaguccac

SEQ ID NO: 34631 - RNA, 22 nt, Homo sapiens
gugucaugggcauguccuuaac

SEQ ID NO: 34632 - RNA, 22 nt, Homo sapiens
gugucccagugugcauacaggu

SEQ ID NO: 34633 - RNA, 22 nt, Homo sapiens
gugucuccuguggagcuaugua

SEQ ID NO: 34634 - RNA, 18 nt, Homo sapiens
gugucugguuaugggagu

SEQ ID NO: 34635 - RNA, 22 nt, Homo sapiens
gugugacagcuauagacaugau

SEQ ID NO: 34636 - RNA, 22 nt, Homo sapiens
gugugauguaaagaacugggga

SEQ ID NO: 34637 - RNA, 23 nt, Homo sapiens
gugugguaggcuauaccaucuag

SEQ ID NO: 34638 - RNA, 22 nt, Homo sapiens
gugugucuugaccaggaucgga

SEQ ID NO: 34639 - RNA, 22 nt, Homo sapiens
guguucauggaauuugcaauug

SEQ ID NO: 34640 - RNA, 22 nt, Homo sapiens
guuacagucuuguguaagguua

SEQ ID NO: 34641 - RNA, 18 nt, Homo sapiens
guuagguaguaugaugcu

SEQ ID NO: 34642 - RNA, 22 nt, Homo sapiens
guuauguuauguuauguuaugu

SEQ ID NO: 34643 - RNA, 22 nt, Homo sapiens
guucacaguuaggacaacugcu

SEQ ID NO: 34644 - RNA, 22 nt, Homo sapiens
guucagcaggggcuucaauggu

SEQ ID NO: 34645 - RNA, 22 nt, Homo sapiens
guucagguauucuggaacagag

SEQ ID NO: 34646 - RNA, 22 nt, Homo sapiens
guucaguuuugaaauguuaauu

SEQ ID NO: 34647 - RNA, 22 nt, Homo sapiens
guucaucaggaauauuggccua

SEQ ID NO: 34648 - RNA, 22 nt, Homo sapiens
guucaucagggauacuggccug

SEQ ID NO: 34649 - RNA, 22 nt, Homo sapiens
guucaucagggauacuggcuua

SEQ ID NO: 34650 - RNA, 23 nt, Homo sapiens
guucaucagggauauuggccuga

SEQ ID NO: 34651 - RNA, 20 nt, Homo sapiens
guucccuguaggugugcgga

SEQ ID NO: 34652 - RNA, 22 nt, Homo sapiens
guucucacuggugcugguaagu

SEQ ID NO: 34653 - RNA, 22 nt, Homo sapiens
guugacuaggagcuacuacuac

SEQ ID NO: 34654 - RNA, 22 nt, Homo sapiens
guugagcaaacagcuuaacagu

SEQ ID NO: 34655 - RNA, 22 nt, Homo sapiens
guugaggcaggagaauuacuug

SEQ ID NO: 34656 - RNA, 22 nt, Homo sapiens
guugcaaaguaauugugguuuu

SEQ ID NO: 34657 - RNA, 22 nt, Homo sapiens
guugcaauugauguaugucuga

SEQ ID NO: 34658 - RNA, 22 nt, Homo sapiens
guugcacagucuuuccuggacu

SEQ ID NO: 34659 - RNA, 22 nt, Homo sapiens
guugcugagucccaucaccaga

SEQ ID NO: 34660 - RNA, 22 nt, Homo sapiens
guuggucucguauaaaucaagg

SEQ ID NO: 34661 - RNA, 22 nt, Homo sapiens
guuggugaccugaagagaguaa

SEQ ID NO: 34662 - RNA, 22 nt, Homo sapiens
guugguuuccuguaacuggaca

SEQ ID NO: 34663 - RNA, 22 nt, Homo sapiens
guuugcauagugcugggagggg

SEQ ID NO: 34664 - RNA, 22 nt, Homo sapiens
guuuggauuuucuaauuucugu

SEQ ID NO: 34665 - RNA, 22 nt, Homo sapiens
guuuggcucuuguuucugucaa

SEQ ID NO: 34666 - RNA, 17 nt, Homo sapiens
guuuggguacuggguaa

SEQ ID NO: 34667 - RNA, 21 nt, Homo sapiens
uaaaacuguaacuuuguccug

SEQ ID NO: 34668 - RNA, 22 nt, Homo sapiens
uaaagaugcugggaaggcuagg

SEQ ID NO: 34669 - RNA, 22 nt, Homo sapiens
uaaagcacaaguaaagaauacu

SEQ ID NO: 34670 - RNA, 17 nt, Homo sapiens
uaaagccagucaaguca

SEQ ID NO: 34671 - RNA, 22 nt, Homo sapiens
uaaagcuacaguauaugguauu

SEQ ID NO: 34672 - RNA, 21 nt, Homo sapiens
uaaagcuagaaccuuagcuuu

SEQ ID NO: 34673 - RNA, 22 nt, Homo sapiens
uaaagcuaugagaacaccguag

SEQ ID NO: 34674 - RNA, 21 nt, Homo sapiens
uaaaggcuccaauuauacccc

SEQ ID NO: 34675 - RNA, 22 nt, Homo sapiens
uaaauggauaaaugaauaccua

SEQ ID NO: 34676 - RNA, 22 nt, Homo sapiens
uaacaagagagucagucagucc

SEQ ID NO: 34677 - RNA, 22 nt, Homo sapiens
uaacaccuuugauagcacuuuu

SEQ ID NO: 34678 - RNA, 22 nt, Homo sapiens
uaacagcauuugugucuaguag

SEQ ID NO: 34679 - RNA, 22 nt, Homo sapiens
uaacaggcaaggucacaccuug

SEQ ID NO: 34680 - RNA, 22 nt, Homo sapiens
uaacaggcuacucuugcauugc

SEQ ID NO: 34681 - RNA, 18 nt, Homo sapiens
uaacagucucucaggauc

SEQ ID NO: 34682 - RNA, 22 nt, Homo sapiens
uagcacaucccuaaaaugcugu

SEQ ID NO: 34683 - RNA, 22 nt, Homo sapiens
uagcaccaggguugacugaccu

SEQ ID NO: 34684 - RNA, 22 nt, Homo sapiens
uagcaccuuagcauuucuagug

SEQ ID NO: 34685 - RNA, 23 nt, Homo sapiens
uagcacuuuuuacauauggacau

SEQ ID NO: 34686 - RNA, 22 nt, Homo sapiens
uagcagcaccccacucuacugg

SEQ ID NO: 34687 - RNA, 22 nt, Homo sapiens
uagcagcaucucuggcuucuac

SEQ ID NO: 34688 - RNA, 22 nt, Homo sapiens
uagcagcauuuuuguagaguau

SEQ ID NO: 34689 - RNA, 22 nt, Homo sapiens
uagcaggaaaggggucagaucu

SEQ ID NO: 34690 - RNA, 22 nt, Homo sapiens
uagcagguguuccacaaauauu

SEQ ID NO: 34691 - RNA, 22 nt, Homo sapiens
uagcaguaaagaaugugauguu

SEQ ID NO: 34692 - RNA, 22 nt, Homo sapiens
uagcaguagacagacuuuggcu

SEQ ID NO: 34693 - RNA, 22 nt, Homo sapiens
uagcagugucuagguaggccau

SEQ ID NO: 34694 - RNA, 22 nt, Homo sapiens
uagcaguucauuguugugugaa

SEQ ID NO: 34695 - RNA, 22 nt, Homo sapiens
uagcaucaauucauguuaugau

SEQ ID NO: 34696 - RNA, 18 nt, Homo sapiens
uagcaugaugcugagugc

SEQ ID NO: 34697 - RNA, 22 nt, Homo sapiens
uagccucacaaagugcuuaaga

SEQ ID NO: 34698 - RNA, 21 nt, Homo sapiens
uagcuacacugugauucaugg

SEQ ID NO: 34699 - RNA, 17 nt, Homo sapiens
uagcucuauuucuagcc

SEQ ID NO: 34700 - RNA, 22 nt, Homo sapiens
uagcugagacuacaguaggugc

SEQ ID NO: 34701 - RNA, 21 nt, Homo sapiens
uagcugcacccaggccuccuu

SEQ ID NO: 34702 - RNA, 22 nt, Homo sapiens
uagcuggaguuuuuguuauagg

SEQ ID NO: 34703 - RNA, 18 nt, Homo sapiens
uaggaacauugauuggag

SEQ ID NO: 34704 - RNA, 22 nt, Homo sapiens
uaggaaugaacgauuuauuggu

SEQ ID NO: 34705 - RNA, 22 nt, Homo sapiens
uaggacaaugguacagcagaaa

SEQ ID NO: 34706 - RNA, 22 nt, Homo sapiens
uaggcaaguugcccaaucucuc

SEQ ID NO: 34707 - RNA, 22 nt, Homo sapiens
uaggcacacaucuacuacaaau

SEQ ID NO: 34708 - RNA, 22 nt, Homo sapiens
uaggcacuguguuuguaggagu

SEQ ID NO: 34709 - RNA, 22 nt, Homo sapiens
uaggcagccagcuguggauuga

SEQ ID NO: 34710 - RNA, 22 nt, Homo sapiens
uaggcuguguggccguggggcu

SEQ ID NO: 34711 - RNA, 22 nt, Homo sapiens
uaggcuuuucugggaugugggc

SEQ ID NO: 34712 - RNA, 22 nt, Homo sapiens
uagggaguguccuuucgggaaa

SEQ ID NO: 34713 - RNA, 22 nt, Homo sapiens
uagggcaaggaacaguuaaaaa

SEQ ID NO: 34714 - RNA, 19 nt, Homo sapiens
uagggcacgaggcagaguc

SEQ ID NO: 34715 - RNA, 22 nt, Homo sapiens
uagggcauuuagaggcuauuaa

SEQ ID NO: 34716 - RNA, 22 nt, Homo sapiens
uagggcuuuaguuugcuugugu

SEQ ID NO: 34717 - RNA, 22 nt, Homo sapiens
uagggcuuuuccaagcugccac

SEQ ID NO: 34718 - RNA, 22 nt, Homo sapiens
uaggggcacacuucgguuagca

SEQ ID NO: 34719 - RNA, 22 nt, Homo sapiens
uaggguaguaauaguuguuuca

SEQ ID NO: 34720 - RNA, 19 nt, Homo sapiens
uagguacauucaagucucc

SEQ ID NO: 34721 - RNA, 22 nt, Homo sapiens
uagguacuuuacauguuaucuc

SEQ ID NO: 34722 - RNA, 22 nt, Homo sapiens
uagguaguuacacagcaaugua

SEQ ID NO: 34723 - RNA, 22 nt, Homo sapiens
uaggucacugcucugugucuaa

SEQ ID NO: 34724 - RNA, 22 nt, Homo sapiens
uaggucuuuuaugaaauauauu

SEQ ID NO: 34725 - RNA, 22 nt, Homo sapiens
uaggugaauguaguaagguguu

SEQ ID NO: 34726 - RNA, 22 nt, Homo sapiens
uaggugcacaguaaauauaugu

SEQ ID NO: 34727 - RNA, 22 nt, Homo sapiens
uagguugucuguucacucugau

SEQ ID NO: 34728 - RNA, 22 nt, Homo sapiens
uagguuguguucugagccucag

SEQ ID NO: 34729 - RNA, 22 nt, Homo sapiens
uaguaaacauuuuucuaucauu

SEQ ID NO: 34730 - RNA, 22 nt, Homo sapiens
uaguagcaccucucaugagcuu

SEQ ID NO: 34731 - RNA, 22 nt, Homo sapiens
uaguaguuuuguguauaauaau

SEQ ID NO: 34732 - RNA, 22 nt, Homo sapiens
uagucaaaucugaaggaaauuu

SEQ ID NO: 34733 - RNA, 20 nt, Homo sapiens
uagucaugagauucuccaag

SEQ ID NO: 34734 - RNA, 22 nt, Homo sapiens
uaguggauguucagagauuuga

SEQ ID NO: 34735 - RNA, 22 nt, Homo sapiens
uaguguuuuucauuggcagagg

SEQ ID NO: 34736 - RNA, 22 nt, Homo sapiens
uaguucauuauguguugcucag

SEQ ID NO: 34737 - RNA, 22 nt, Homo sapiens
uaguuguugcagguaggaugua

SEQ ID NO: 34738 - RNA, 22 nt, Homo sapiens
ugaguagaacuccuggagaugu

SEQ ID NO: 34739 - RNA, 23 nt, Homo sapiens
ugaguaggcaguuuuccccucac

SEQ ID NO: 34740 - RNA, 19 nt, Homo sapiens
ugaguaucuuuacacaucu

SEQ ID NO: 34741 - RNA, 22 nt, Homo sapiens
ugaguauguuuaaugugacaau

SEQ ID NO: 34742 - RNA, 22 nt, Homo sapiens
ugaguauguuuagaaguaaagg

SEQ ID NO: 34743 - RNA, 22 nt, Homo sapiens
ugagucaauggaggcucagagc

SEQ ID NO: 34744 - RNA, 22 nt, Homo sapiens
ugagucagucucacucugcugc

SEQ ID NO: 34745 - RNA, 22 nt, Homo sapiens
ugagucauguaauaaugcugcu

SEQ ID NO: 34746 - RNA, 22 nt, Homo sapiens
ugagucgagauugcgccacugu

SEQ ID NO: 34747 - RNA, 22 nt, Homo sapiens
ugagucuguucucacauugcua

SEQ ID NO: 34748 - RNA, 22 nt, Homo sapiens
ugagugagguucuacucuguga

SEQ ID NO: 34749 - RNA, 22 nt, Homo sapiens
ugaguggagacuguguguagag

SEQ ID NO: 34750 - RNA, 22 nt, Homo sapiens
ugaguggagaucgcaccauugc

SEQ ID NO: 34751 - RNA, 22 nt, Homo sapiens
ugagugugaggaagaauuagaa

SEQ ID NO: 34752 - RNA, 22 nt, Homo sapiens
ugaguuaauuuuuguaucaugu

SEQ ID NO: 34753 - RNA, 22 nt, Homo sapiens
ugaguuagguguuuuaaauaua

SEQ ID NO: 34754 - RNA, 22 nt, Homo sapiens
ugaguucaugcuuguaguucua

SEQ ID NO: 34755 - RNA, 22 nt, Homo sapiens
ugaguucauggucauuugucac

SEQ ID NO: 34756 - RNA, 22 nt, Homo sapiens
ugaguucuuuuagggauauugc

SEQ ID NO: 34757 - RNA, 22 nt, Homo sapiens
ugaguuguaggggucaccuggc

SEQ ID NO: 34758 - RNA, 23 nt, Homo sapiens
ugauaacagcauaugaagauucu

SEQ ID NO: 34759 - RNA, 22 nt, Homo sapiens
ugauaacauugggggaagcuga

SEQ ID NO: 34760 - RNA, 22 nt, Homo sapiens
ugauacuggcuucauagaauga

SEQ ID NO: 34761 - RNA, 22 nt, Homo sapiens
ugauacugugcauuagaggcua

SEQ ID NO: 34762 - RNA, 22 nt, Homo sapiens
ugauagaucugggcaaaguaaa

SEQ ID NO: 34763 - RNA, 22 nt, Homo sapiens
ugauagucauucaauuuagcca

SEQ ID NO: 34764 - RNA, 22 nt, Homo sapiens
ugauagugccuuuuauaucucu

SEQ ID NO: 34765 - RNA, 22 nt, Homo sapiens
ugauauauugaaugaugaaaca

SEQ ID NO: 34766 - RNA, 22 nt, Homo sapiens
ugauaucugaauagauacacaa

SEQ ID NO: 34767 - RNA, 22 nt, Homo sapiens
ugauaucugaucauccuugaua

SEQ ID NO: 34768 - RNA, 22 nt, Homo sapiens
ugauaugaaguucaaaccaggu

SEQ ID NO: 34769 - RNA, 22 nt, Homo sapiens
ugauaugcuuugaacucucugg

SEQ ID NO: 34770 - RNA, 21 nt, Homo sapiens
ugauaugguuuggauaugugu

SEQ ID NO: 34771 - RNA, 22 nt, Homo sapiens
ugauauguggauucagcucaaa

SEQ ID NO: 34772 - RNA, 22 nt, Homo sapiens
ugauauguuagaaucuugcaag

SEQ ID NO: 34773 - RNA, 22 nt, Homo sapiens
ugaucuguguaacauaggaguc

SEQ ID NO: 34774 - RNA, 22 nt, Homo sapiens
ugaugacccugcaguucucaag

SEQ ID NO: 34775 - RNA, 22 nt, Homo sapiens
ugaugcuacuaccugggcugaa

SEQ ID NO: 34776 - RNA, 22 nt, Homo sapiens
ugauggcacagugaguuccagg

SEQ ID NO: 34777 - RNA, 22 nt, Homo sapiens
ugaugguuuuaaaaagaggagu

SEQ ID NO: 34778 - RNA, 23 nt, Homo sapiens
ugauguccacuuagggucuaggu

SEQ ID NO: 34779 - RNA, 22 nt, Homo sapiens
ugauguccaguucauagaaacu

SEQ ID NO: 34780 - RNA, 22 nt, Homo sapiens
ugauuguucuguccccaggggc

SEQ ID NO: 34781 - RNA, 22 nt, Homo sapiens
ugauuuguuuagugccaaguuu

SEQ ID NO: 34782 - RNA, 22 nt, Homo sapiens
ugcaaacuuccuugggcagcau

SEQ ID NO: 34783 - RNA, 22 nt, Homo sapiens
ugcaaagucgaaacugcaguuu

SEQ ID NO: 34784 - RNA, 22 nt, Homo sapiens
ugcaaaugcugcuauuucucuu

SEQ ID NO: 34785 - RNA, 22 nt, Homo sapiens
ugcaaaugucaaggguuagugu

SEQ ID NO: 34786 - RNA, 22 nt, Homo sapiens
ugcaaccauuguuaagugugca

SEQ ID NO: 34787 - RNA, 22 nt, Homo sapiens
ugcaagaaacauauuccacaag

SEQ ID NO: 34788 - RNA, 22 nt, Homo sapiens
ugcaagacuaaaccuuccccuc

SEQ ID NO: 34789 - RNA, 22 nt, Homo sapiens
ugcaagaugagauuuuggaugg

SEQ ID NO: 34790 - RNA, 22 nt, Homo sapiens
ugcaagaugauuucaauugaua

SEQ ID NO: 34791 - RNA, 22 nt, Homo sapiens
ugcaagucaucuguccuucaga

SEQ ID NO: 34792 - RNA, 22 nt, Homo sapiens
ugcaaguggauuuuuccccaga

SEQ ID NO: 34793 - RNA, 22 nt, Homo sapiens
ugcaauagcuucaggagaaggg

SEQ ID NO: 34794 - RNA, 18 nt, Homo sapiens
ugcaauggagaugcagcc

SEQ ID NO: 34795 - RNA, 22 nt, Homo sapiens
ugcacacucuguaugagaaucu

SEQ ID NO: 34796 - RNA, 22 nt, Homo sapiens
ugcaccacacuccauccugggc

SEQ ID NO: 34797 - RNA, 22 nt, Homo sapiens
ugcaccacuacacuccaggcug

SEQ ID NO: 34798 - RNA, 22 nt, Homo sapiens
ugcaccacugcacuucagccug

SEQ ID NO: 34799 - RNA, 18 nt, Homo sapiens
ugcaccaguuuacacuuc

SEQ ID NO: 34800 - RNA, 22 nt, Homo sapiens
ugcaccaucuugcuucuguggu

SEQ ID NO: 34801 - RNA, 22 nt, Homo sapiens
ugcaccauuacacuccaggcug

SEQ ID NO: 34802 - RNA, 22 nt, Homo sapiens
ugcacugucuugucgcauagca

SEQ ID NO: 34803 - RNA, 22 nt, Homo sapiens
ugcagagaaacauuuuguauuu

SEQ ID NO: 34804 - RNA, 20 nt, Homo sapiens
ugcagcacgggcccuuucca

SEQ ID NO: 34805 - RNA, 22 nt, Homo sapiens
ugcagcacugaacuucugggcu

SEQ ID NO: 34806 - RNA, 22 nt, Homo sapiens
ugcagcauugcacuccagccug

SEQ ID NO: 34807 - RNA, 22 nt, Homo sapiens
ugcagcucaaauuccuaacaag

SEQ ID NO: 34808 - RNA, 22 nt, Homo sapiens
ugcaggauguucaguaauuucc

SEQ ID NO: 34809 - RNA, 22 nt, Homo sapiens
ugcaggguccauugucccaagu

SEQ ID NO: 34810 - RNA, 22 nt, Homo sapiens
ugcaguacauucagcauccucu

SEQ ID NO: 34811 - RNA, 22 nt, Homo sapiens
uggcaugaagaccccauccuuu

SEQ ID NO: 34812 - RNA, 22 nt, Homo sapiens
uggcaugcauuguggguaauua

SEQ ID NO: 34813 - RNA, 22 nt, Homo sapiens
uggcauggucugcccaaguuuc

SEQ ID NO: 34814 - RNA, 22 nt, Homo sapiens
uggcauguuggguguugacucc

SEQ ID NO: 34815 - RNA, 22 nt, Homo sapiens
uggccaagagcacagauauugg

SEQ ID NO: 34816 - RNA, 22 nt, Homo sapiens
uggccagagggcaauuagcugu

SEQ ID NO: 34817 - RNA, 22 nt, Homo sapiens
uggccagugucuauugguuucc

SEQ ID NO: 34818 - RNA, 22 nt, Homo sapiens
uggccaguuuuuaauugggucu

SEQ ID NO: 34819 - RNA, 22 nt, Homo sapiens
uggccuguaacgcugucucagc

SEQ ID NO: 34820 - RNA, 21 nt, Homo sapiens
uggcuauuucuguggcauaca

SEQ ID NO: 34821 - RNA, 22 nt, Homo sapiens
uggcuccguuguacaggcugga

SEQ ID NO: 34822 - RNA, 22 nt, Homo sapiens
uggcuguuguuacuaacaguuc

SEQ ID NO: 34823 - RNA, 22 nt, Homo sapiens
uggcuguuuauuucaccugggu

SEQ ID NO: 34824 - RNA, 21 nt, Homo sapiens
uggcuuauuugaaucuggcuu

SEQ ID NO: 34825 - RNA, 20 nt, Homo sapiens
ugggaacaugugguauaugg

SEQ ID NO: 34826 - RNA, 18 nt, Homo sapiens
ugggaagaaauucuucuc

SEQ ID NO: 34827 - RNA, 22 nt, Homo sapiens
ugggaagaagguuuacuugcca

SEQ ID NO: 34828 - RNA, 22 nt, Homo sapiens
ugggagcauugcauuagaagcc

SEQ ID NO: 34829 - RNA, 22 nt, Homo sapiens
ugggaugaugcuugagaauauc

SEQ ID NO: 34830 - RNA, 22 nt, Homo sapiens
ugggaugauguuaaacguacuc

SEQ ID NO: 34831 - RNA, 22 nt, Homo sapiens
ugggauguagccuucuauuuuc

SEQ ID NO: 34832 - RNA, 22 nt, Homo sapiens
ugggcaaaacuaagagcugugg

SEQ ID NO: 34833 - RNA, 22 nt, Homo sapiens
ugggcaguauggucauuuucgu

SEQ ID NO: 34834 - RNA, 21 nt, Homo sapiens
ugggccccuuccuuacaucau

SEQ ID NO: 34835 - RNA, 19 nt, Homo sapiens
accagauugcauucuugga

SEQ ID NO: 34836 - RNA, 22 nt, Homo sapiens
acccaguguugggcagaacugu

SEQ ID NO: 34837 - RNA, 22 nt, Homo sapiens
acccucagaccaguuucccugg

SEQ ID NO: 34838 - RNA, 21 nt, Homo sapiens
accugauguuucaguuggagu

SEQ ID NO: 34839 - RNA, 22 nt, Homo sapiens
acuacauaugacaucuucuuua

SEQ ID NO: 34840 - RNA, 21 nt, Homo sapiens
acugcacuccaaccucaacag

SEQ ID NO: 34841 - RNA, 19 nt, Homo sapiens
acugcacuccaaccuccug

SEQ ID NO: 34842 - RNA, 22 nt, Homo sapiens
acugcacuccagcccgggugac

SEQ ID NO: 34843 - RNA, 22 nt, Homo sapiens
acugcacuccagccucgcaaca

SEQ ID NO: 34844 - RNA, 22 nt, Homo sapiens
acugcacuccagccucggugac

SEQ ID NO: 34845 - RNA, 22 nt, Homo sapiens
acugcacuccagccucgugaca

SEQ ID NO: 34846 - RNA, 22 nt, Homo sapiens
acugcacuccagccugaugaaa

SEQ ID NO: 34847 - RNA, 22 nt, Homo sapiens
acugcacuccagccuguugaca

SEQ ID NO: 34848 - RNA, 22 nt, Homo sapiens
acugcacuccagccuugagagc

SEQ ID NO: 34849 - RNA, 22 nt, Homo sapiens
acugcacuccagccuuggagac

SEQ ID NO: 34850 - RNA, 22 nt, Homo sapiens
acugcacuccagccuuugcgau

SEQ ID NO: 34851 - RNA, 22 nt, Homo sapiens
acugcacuccagcuuuggguga

SEQ ID NO: 34852 - RNA, 22 nt, Homo sapiens
acugcacuccagcuuuggugac

SEQ ID NO: 34853 - RNA, 20 nt, Homo sapiens
acugcacuccaggcugccca

SEQ ID NO: 34854 - RNA, 22 nt, Homo sapiens
acugcacuccaucuuagguggc

SEQ ID NO: 34855 - RNA, 19 nt, Homo sapiens
acugcacuccuccuugggu

SEQ ID NO: 34856 - RNA, 22 nt, Homo sapiens
acugcacuccuccuugggugac

SEQ ID NO: 34857 - RNA, 22 nt, Homo sapiens
acugcacuucaaccucauugac

SEQ ID NO: 34858 - RNA, 19 nt, Homo sapiens
acuguacuccagucugggc

SEQ ID NO: 34859 - RNA, 22 nt, Homo sapiens
acuuuuugcaaccauuuggacc

SEQ ID NO: 34860 - RNA, 21 nt, Homo sapiens
agaaaaucuuaugggaaacau

SEQ ID NO: 34861 - RNA, 22 nt, Homo sapiens
agacuagacagaugaacagcac

SEQ ID NO: 34862 - RNA, 22 nt, Homo sapiens
agagaucaacugaauuacugga

SEQ ID NO: 34863 - RNA, 22 nt, Homo sapiens
agagaucaauaugaaggaaaug

SEQ ID NO: 34864 - RNA, 22 nt, Homo sapiens
agagauuauccuggcuucucug

SEQ ID NO: 34865 - RNA, 22 nt, Homo sapiens
agauauguuauugauguuaaug

SEQ ID NO: 34866 - RNA, 22 nt, Homo sapiens
agcaagaaugaacucucccaga

SEQ ID NO: 34867 - RNA, 22 nt, Homo sapiens
agcaagaugaaguugagcuagg

SEQ ID NO: 34868 - RNA, 21 nt, Homo sapiens
agcagcuuugguugaagcaga

SEQ ID NO: 34869 - RNA, 22 nt, Homo sapiens
agccuguagugagcugugauug

SEQ ID NO: 34870 - RNA, 22 nt, Homo sapiens
agcuaaaucucauguugaauug

SEQ ID NO: 34871 - RNA, 20 nt, Homo sapiens
agcuguuguuaaaaaggagg

SEQ ID NO: 34872 - RNA, 22 nt, Homo sapiens
aggaagacauauagaacuaaaa

SEQ ID NO: 34873 - RNA, 22 nt, Homo sapiens
aggaagcuagcauuuguucagu

SEQ ID NO: 34874 - RNA, 22 nt, Homo sapiens
aggcagucugaguuuugaaagg

SEQ ID NO: 34875 - RNA, 22 nt, Homo sapiens
aggcuagacuuugagaauuuuu

SEQ ID NO: 34876 - RNA, 22 nt, Homo sapiens
aguauuaggugaguguauuuca

SEQ ID NO: 34877 - RNA, 22 nt, Homo sapiens
agucagugcauaagaaugaagu

SEQ ID NO: 34878 - RNA, 22 nt, Homo sapiens
aguccagguuuuguaauggcaa

SEQ ID NO: 34879 - RNA, 22 nt, Homo sapiens
aguggcaaugugauguccugaa

SEQ ID NO: 34880 - RNA, 23 nt, Homo sapiens
aguggucuccugggcccagcugu

SEQ ID NO: 34881 - RNA, 18 nt, Homo sapiens
aguuguuuuauccugccc

SEQ ID NO: 34882 - RNA, 22 nt, Homo sapiens
auaaaguguuuaguauaggcaa

SEQ ID NO: 34883 - RNA, 20 nt, Homo sapiens
auaaauguauagguguacau

SEQ ID NO: 34884 - RNA, 22 nt, Homo sapiens
auaagauaguggaagugggauu

SEQ ID NO: 34885 - RNA, 22 nt, Homo sapiens
auacccauacauauuggugacu

SEQ ID NO: 34886 - RNA, 22 nt, Homo sapiens
auagaagcugccaacguuucag

SEQ ID NO: 34887 - RNA, 22 nt, Homo sapiens
auagaggacugaggugaucuuu

SEQ ID NO: 34888 - RNA, 22 nt, Homo sapiens
auagcauaucccacaugucaga

SEQ ID NO: 34889 - RNA, 22 nt, Homo sapiens
auaucacagguguuuaccugau

SEQ ID NO: 34890 - RNA, 20 nt, Homo sapiens
auaugguugugagugauuuu

SEQ ID NO: 34891 - RNA, 22 nt, Homo sapiens
auauucaagugaggauggcuaa

SEQ ID NO: 34892 - RNA, 22 nt, Homo sapiens
aucaaacugcaaggcagcagca

SEQ ID NO: 34893 - RNA, 22 nt, Homo sapiens
aucaaaugcuggcagagugccu

SEQ ID NO: 34894 - RNA, 22 nt, Homo sapiens
aucacagcccuccucuuggaug

SEQ ID NO: 34895 - RNA, 22 nt, Homo sapiens
aucacaguuaagaggugaugaa

SEQ ID NO: 34896 - RNA, 20 nt, Homo sapiens
aucacuggagaaggaaaccu

SEQ ID NO: 34897 - RNA, 22 nt, Homo sapiens
aucagaaucucuugagaguguu

SEQ ID NO: 34898 - RNA, 22 nt, Homo sapiens
auccucugagagaguuucauaa

SEQ ID NO: 34899 - RNA, 22 nt, Homo sapiens
auccucugagaucuaggcagag

SEQ ID NO: 34900 - RNA, 22 nt, Homo sapiens
aucgcgccauuguacuccagcc

SEQ ID NO: 34901 - RNA, 21 nt, Homo sapiens
aucucacuugaauguaaaagc

SEQ ID NO: 34902 - RNA, 22 nt, Homo sapiens
aucucuugccagucagaauggu

SEQ ID NO: 34903 - RNA, 22 nt, Homo sapiens
augaaguauuaggacacauuua

SEQ ID NO: 34904 - RNA, 22 nt, Homo sapiens
augacagagauaugugaauuuu

SEQ ID NO: 34905 - RNA, 17 nt, Homo sapiens
augacuucuucagugug

SEQ ID NO: 34906 - RNA, 22 nt, Homo sapiens
augagaacugucaaugagagcu

SEQ ID NO: 34907 - RNA, 22 nt, Homo sapiens
augagaaugaagccuggcgugu

SEQ ID NO: 34908 - RNA, 22 nt, Homo sapiens
augagauauguuaaaaguuaaa

SEQ ID NO: 34909 - RNA, 22 nt, Homo sapiens
augaggagauauuaaauaccau

SEQ ID NO: 34910 - RNA, 22 nt, Homo sapiens
augaggcaggaaaggcguaucu

SEQ ID NO: 34911 - RNA, 22 nt, Homo sapiens
augagguccuagccaacuuuuu

SEQ ID NO: 34912 - RNA, 22 nt, Homo sapiens
augaggugaguaaauaaaugaa

SEQ ID NO: 34913 - RNA, 22 nt, Homo sapiens
augaggugggcggcuuggaaga

SEQ ID NO: 34914 - RNA, 22 nt, Homo sapiens
augauugugaauaugugguuuu

SEQ ID NO: 34915 - RNA, 22 nt, Homo sapiens
augccaagaugagcacgcgucu

SEQ ID NO: 34916 - RNA, 22 nt, Homo sapiens
auggaaggagaggaaugaauga

SEQ ID NO: 34917 - RNA, 22 nt, Homo sapiens
auggcaauaugaugcacuguuu

SEQ ID NO: 34918 - RNA, 22 nt, Homo sapiens
auggcuguuuaagaguuucauu

SEQ ID NO: 34919 - RNA, 22 nt, Homo sapiens
augguauuuaacagucuuucua

SEQ ID NO: 34920 - RNA, 22 nt, Homo sapiens
auguaaacagaugugcagcuug

SEQ ID NO: 34921 - RNA, 22 nt, Homo sapiens
auguaacuaucugagccauggg

SEQ ID NO: 34922 - RNA, 17 nt, Homo sapiens
auguaauccucaucucu

SEQ ID NO: 34923 - RNA, 22 nt, Homo sapiens
auguagugugauuuucacuaga

SEQ ID NO: 34924 - RNA, 22 nt, Homo sapiens
uacugcacuccagccugggaga

SEQ ID NO: 34925 - RNA, 22 nt, Homo sapiens
uacugcacuccagccuggguga

SEQ ID NO: 34926 - RNA, 19 nt, Homo sapiens
uacugcacuccagucuggg

SEQ ID NO: 34927 - RNA, 20 nt, Homo sapiens
uacugcacuccauccugggu

SEQ ID NO: 34928 - RNA, 22 nt, Homo sapiens
uacugcacucuagccuggguga

SEQ ID NO: 34929 - RNA, 19 nt, Homo sapiens
uacuggcucgggaauuuuc

SEQ ID NO: 34930 - RNA, 22 nt, Homo sapiens
uagaaguaggcuacgugucugg

SEQ ID NO: 34931 - RNA, 18 nt, Homo sapiens
uagaauauaggucauucu

SEQ ID NO: 34932 - RNA, 22 nt, Homo sapiens
uagaauguauaauauuuuacuu

SEQ ID NO: 34933 - RNA, 22 nt, Homo sapiens
uagacccauuguucagagagug

SEQ ID NO: 34934 - RNA, 22 nt, Homo sapiens
uagcagcauaaauggacuaaga

SEQ ID NO: 34935 - RNA, 22 nt, Homo sapiens
uaggcaauggagauagaggaug

SEQ ID NO: 34936 - RNA, 22 nt, Homo sapiens
uaggcuguguggccguggggcu

SEQ ID NO: 34937 - RNA, 22 nt, Homo sapiens
uagguaguuacacagcaaugua

SEQ ID NO: 34938 - RNA, 22 nt, Homo sapiens
uaguaacacauugaacgaucgc

SEQ ID NO: 34939 - RNA, 22 nt, Homo sapiens
uaguaccauucccaaaccaacu

SEQ ID NO: 34940 - RNA, 22 nt, Homo sapiens
uaucccaguggauguaccccau

SEQ ID NO: 34941 - RNA, 22 nt, Homo sapiens
uaucccuguggacuucccaaca

SEQ ID NO: 34942 - RNA, 23 nt, Homo sapiens
uaucucaaugcacagagaggaaa

SEQ ID NO: 34943 - RNA, 22 nt, Homo sapiens
uauggcuuuucacuuaaguccu

SEQ ID NO: 34944 - RNA, 22 nt, Homo sapiens
uauugcagauacccaggaaguu

SEQ ID NO: 34945 - RNA, 18 nt, Homo sapiens
uauugcuugguuuggaga

SEQ ID NO: 34946 - RNA, 22 nt, Homo sapiens
uauuugguagcuauuuugcagu

SEQ ID NO: 34947 - RNA, 22 nt, Homo sapiens
ucaaaucaucuuuuccaaagcu

SEQ ID NO: 34948 - RNA, 22 nt, Homo sapiens
ucaauguaucuccaagaauuga

SEQ ID NO: 34949 - RNA, 19 nt, Homo sapiens
ucaauucugucaauggcuu

SEQ ID NO: 34950 - RNA, 22 nt, Homo sapiens
ucacagcuaaaaugaaaguagu

SEQ ID NO: 34951 - RNA, 22 nt, Homo sapiens
ucacaguaacuuuguugcuuuu

SEQ ID NO: 34952 - RNA, 22 nt, Homo sapiens
ucacaguagcaaauguuagaaa

SEQ ID NO: 34953 - RNA, 22 nt, Homo sapiens
ucacagucacugucacguugaa

SEQ ID NO: 34954 - RNA, 22 nt, Homo sapiens
ucacauagcugaguaaaaugga

SEQ ID NO: 34955 - RNA, 22 nt, Homo sapiens
ucacaucucagguuucuugaca

SEQ ID NO: 34956 - RNA, 22 nt, Homo sapiens
ucacauguguaaauugguguaa

SEQ ID NO: 34957 - RNA, 22 nt, Homo sapiens
ucaccuggagacaugaagacug

SEQ ID NO: 34958 - RNA, 21 nt, Homo sapiens
ucacugagcaucaugguuuca

SEQ ID NO: 34959 - RNA, 21 nt, Homo sapiens
ucacugagguuaaauaggguu

SEQ ID NO: 34960 - RNA, 22 nt, Homo sapiens
aaaagagcugagagguauucuu

SEQ ID NO: 34961 - RNA, 22 nt, Homo sapiens
gcauggaguggaaauucuuggg

SEQ ID NO: 34962 - RNA, 22 nt, Homo sapiens
gcaugugaauguguaagaaaau

SEQ ID NO: 34963 - RNA, 22 nt, Homo sapiens
gccaaaaugcugggauuacagg

SEQ ID NO: 34964 - RNA, 22 nt, Homo sapiens
gccaagauuuaauucaucaguu

SEQ ID NO: 34965 - RNA, 22 nt, Homo sapiens
gccauugcacuccagccuaggc

SEQ ID NO: 34966 - RNA, 22 nt, Homo sapiens
gccauugcacucuagccuaggu

SEQ ID NO: 34967 - RNA, 22 nt, Homo sapiens
gcucaugagacaagcaggagua

SEQ ID NO: 34968 - RNA, 22 nt, Homo sapiens
gcugaguaguauuucauuguau

SEQ ID NO: 34969 - RNA, 22 nt, Homo sapiens
gcuguguugugcccagcaucau

SEQ ID NO: 34970 - RNA, 22 nt, Homo sapiens
ggaauauaaaaagccccagaau

SEQ ID NO: 34971 - RNA, 20 nt, Homo sapiens
ggaauguuaaucuccaugau

SEQ ID NO: 34972 - RNA, 21 nt, Homo sapiens
ggaauguugccagcagccaga

SEQ ID NO: 34973 - RNA, 20 nt, Homo sapiens
ggagguguugauuuuucuuu

SEQ ID NO: 34974 - RNA, 20 nt, Homo sapiens
ggagguguuggauuucuagu

SEQ ID NO: 34975 - RNA, 20 nt, Homo sapiens
ggagguuguauaaguacauc

SEQ ID NO: 34976 - RNA, 22 nt, Homo sapiens
ggagucugauuuuuauguugcu

SEQ ID NO: 34977 - RNA, 23 nt, Homo sapiens
ggcaagaucucagcucacugcaa

SEQ ID NO: 34978 - RNA, 22 nt, Homo sapiens
ggcaaggauuagauucuccccu

SEQ ID NO: 34979 - RNA, 22 nt, Homo sapiens
ggcaaggugcuacagacaguga

SEQ ID NO: 34980 - RNA, 22 nt, Homo sapiens
ggcacgguggcucacaccugua

SEQ ID NO: 34981 - RNA, 22 nt, Homo sapiens
ggcaguuuggcaguuucauaaa

SEQ ID NO: 34982 - RNA, 22 nt, Homo sapiens
ggcaguuuguucuugcuccuuu

SEQ ID NO: 34983 - RNA, 22 nt, Homo sapiens
ggcaugaugcgcacgccuguag

SEQ ID NO: 34984 - RNA, 18 nt, Homo sapiens
gggcaaguugccuggcuu

SEQ ID NO: 34985 - RNA, 22 nt, Homo sapiens
ggguaggcaagcggaugucaga

SEQ ID NO: 34986 - RNA, 22 nt, Homo sapiens
ggucaggagaaugguaacugag

SEQ ID NO: 34987 - RNA, 22 nt, Homo sapiens
ggucagugcauucuaaaggcaa

SEQ ID NO: 34988 - RNA, 21 nt, Homo sapiens
ggugagaaaggagacauagac

SEQ ID NO: 34989 - RNA, 19 nt, Homo sapiens
ggugcuugaauauuccucc

SEQ ID NO: 34990 - RNA, 22 nt, Homo sapiens
guaaauguccugcuacagagug

SEQ ID NO: 34991 - RNA, 22 nt, Homo sapiens
guaaucucagcuacucgggaga

SEQ ID NO: 34992 - RNA, 22 nt, Homo sapiens
guagaagcacagggccuguauu

SEQ ID NO: 34993 - RNA, 22 nt, Homo sapiens
guaugcacauauguguauguau

SEQ ID NO: 34994 - RNA, 22 nt, Homo sapiens
guauuuguugcagcagcacuau

SEQ ID NO: 34995 - RNA, 22 nt, Homo sapiens
gucacagaaaaagauaugccaa

SEQ ID NO: 34996 - RNA, 18 nt, Homo sapiens
gucucacaugguggaagc

SEQ ID NO: 34997 - RNA, 22 nt, Homo sapiens
gucucauugcaguuagaccugu

SEQ ID NO: 34998 - RNA, 22 nt, Homo sapiens
gucugucuuuugucuuugaaau

SEQ ID NO: 34999 - RNA, 20 nt, Homo sapiens
gugaauacauuugguuucau

SEQ ID NO: 35000 - RNA, 22 nt, Homo sapiens
gugagaaucaaacuacauaaau

SEQ ID NO: 35001 - RNA, 22 nt, Homo sapiens
gugagauuaccauuuaaaucag

SEQ ID NO: 35002 - RNA, 22 nt, Homo sapiens
gugcacuguagaacccuuuguu

SEQ ID NO: 35003 - RNA, 21 nt, Homo sapiens
gugcagaugccacagucacuc

SEQ ID NO: 35004 - RNA, 22 nt, Homo sapiens
gugcaguuuuaagugaguuucu

SEQ ID NO: 35005 - RNA, 23 nt, Homo sapiens
gugccuucugagccuagucucca

SEQ ID NO: 35006 - RNA, 22 nt, Homo sapiens
guggacggagguugcagugagc

SEQ ID NO: 35007 - RNA, 22 nt, Homo sapiens
guggcaaacucagcaugcccca

SEQ ID NO: 35008 - RNA, 22 nt, Homo sapiens
guggcagaaaagagaagcaaug

SEQ ID NO: 35009 - RNA, 22 nt, Homo sapiens
guggcuaaagauuuggaaucug

SEQ ID NO: 35010 - RNA, 22 nt, Homo sapiens
gugguuuuaucccagaaauuaa

SEQ ID NO: 35011 - RNA, 22 nt, Homo sapiens
guguaaaacaauuagaggauuu

SEQ ID NO: 35012 - RNA, 22 nt, Homo sapiens
guguccucgaguacacaucagg

SEQ ID NO: 35013 - RNA, 19 nt, Homo sapiens
gugugcauaucacagagca

SEQ ID NO: 35014 - RNA, 22 nt, Homo sapiens
gugugcauaugucuuuauagua

SEQ ID NO: 35015 - RNA, 22 nt, Homo sapiens
gugugcaugucuuuuuaguagg

SEQ ID NO: 35016 - RNA, 22 nt, Homo sapiens
guugaaauccuaacccccuagu

SEQ ID NO: 35017 - RNA, 22 nt, Homo sapiens
guugcuuauuccuguaauccca

SEQ ID NO: 35018 - RNA, 22 nt, Homo sapiens
uaaggcaaaccuuggcugcagu

SEQ ID NO: 35019 - RNA, 20 nt, Homo sapiens
uaaggcacugugcuuuuagg

SEQ ID NO: 35020 - RNA, 22 nt, Homo sapiens
uaaguauuaugugcugcauuuu

SEQ ID NO: 35021 - RNA, 22 nt, Homo sapiens
uaagucguggaugauucuucgg

SEQ ID NO: 35022 - RNA, 22 nt, Homo sapiens
uaauugaaugcagacaccaggg

SEQ ID NO: 35023 - RNA, 22 nt, Homo sapiens
uaccucagccaaugcccagaag

SEQ ID NO: 35024 - RNA, 22 nt, Homo sapiens
uaccugagaaagaaagcccucg

SEQ ID NO: 35025 - RNA, 19 nt, Homo sapiens
uacugcaccucaaccuggg

SEQ ID NO: 35026 - RNA, 22 nt, Homo sapiens
uacugcacuccacccuggguga

SEQ ID NO: 35027 - RNA, 22 nt, Homo sapiens
uuaaguagaugaaugugaaugu

SEQ ID NO: 35028 - RNA, 22 nt, Homo sapiens
uuaauuguaucuauagauguca

SEQ ID NO: 35029 - RNA, 22 nt, Homo sapiens
uuaauuguccaaguucaucucu

SEQ ID NO: 35030 - RNA, 22 nt, Homo sapiens
uuacaguggugaccuuguauug

SEQ ID NO: 35031 - RNA, 22 nt, Homo sapiens
uuacaugagacugucgcuaguu

SEQ ID NO: 35032 - RNA, 22 nt, Homo sapiens
uuacuguagugucauaucguau

SEQ ID NO: 35033 - RNA, 17 nt, Homo sapiens
uuagacagacauccugc

SEQ ID NO: 35034 - RNA, 22 nt, Homo sapiens
uuagacaguggugcacugcacu

SEQ ID NO: 35035 - RNA, 22 nt, Homo sapiens
uuagaucaacauggaacucuau

SEQ ID NO: 35036 - RNA, 22 nt, Homo sapiens
uuagggcaggcaugagagaacu

SEQ ID NO: 35037 - RNA, 22 nt, Homo sapiens
uuaguagcacagaguaucagca

SEQ ID NO: 35038 - RNA, 22 nt, Homo sapiens
uuaugguuuuucugugagaugg

SEQ ID NO: 35039 - RNA, 22 nt, Homo sapiens
uuaugucuuuuguguucagcua

SEQ ID NO: 35040 - RNA, 22 nt, Homo sapiens
uuauugcacuccagccugggua

SEQ ID NO: 35041 - RNA, 23 nt, Homo sapiens
uucaaauguucucugguugucag

SEQ ID NO: 35042 - RNA, 22 nt, Homo sapiens
uucaaauguucuuucaccaccc

SEQ ID NO: 35043 - RNA, 20 nt, Homo sapiens
uucacaggcagcuucuuucu

SEQ ID NO: 35044 - RNA, 22 nt, Homo sapiens
uucaccuggaguucaggauaag

SEQ ID NO: 35045 - RNA, 22 nt, Homo sapiens
uucacuggagcccaggaguugg

SEQ ID NO: 35046 - RNA, 22 nt, Homo sapiens
uucaguaaauguucuuacuaua

SEQ ID NO: 35047 - RNA, 22 nt, Homo sapiens
uuccagugggacgagaugugga

SEQ ID NO: 35048 - RNA, 22 nt, Homo sapiens
uuccuacugcccauuaaaaugg

SEQ ID NO: 35049 - RNA, 22 nt, Homo sapiens
uucucacaguacagggagcucu

SEQ ID NO: 35050 - RNA, 22 nt, Homo sapiens
uucuucaggccacaaaaauggu

SEQ ID NO: 35051 - RNA, 22 nt, Homo sapiens
uucuugguguaguaguugaaaa

SEQ ID NO: 35052 - RNA, 22 nt, Homo sapiens
uucuuugguacaagggccgacc

SEQ ID NO: 35053 - RNA, 22 nt, Homo sapiens
uugaaagacagaggggcaaguu

SEQ ID NO: 35054 - RNA, 22 nt, Homo sapiens
uugaaagucauggcacaggcaa

SEQ ID NO: 35055 - RNA, 22 nt, Homo sapiens
uugaagacuaaguuaucaggau

SEQ ID NO: 35056 - RNA, 22 nt, Homo sapiens
uugaagacuauaugauucuuca

SEQ ID NO: 35057 - RNA, 22 nt, Homo sapiens
uugaauagcauguuuagugcau

SEQ ID NO: 35058 - RNA, 22 nt, Homo sapiens
uugacaaggagugggguugaga

SEQ ID NO: 35059 - RNA, 22 nt, Homo sapiens
uugacaaugcacugugcuaagu

SEQ ID NO: 35060 - RNA, 20 nt, Homo sapiens
uugacaguggguuguuaaag

SEQ ID NO: 35061 - RNA, 22 nt, Homo sapiens
uugacauaaucauuucacagug

SEQ ID NO: 35062 - RNA, 22 nt, Homo sapiens
uugacuuagacauucaguugga

SEQ ID NO: 35063 - RNA, 22 nt, Homo sapiens
uugagacggagucucacucugu

SEQ ID NO: 35064 - RNA, 22 nt, Homo sapiens
uugagaucaugcuacugcacuc

SEQ ID NO: 35065 - RNA, 22 nt, Homo sapiens
uugagauggagucucacucuug

SEQ ID NO: 35066 - RNA, 22 nt, Homo sapiens
uugagauggaguuucacucucg

SEQ ID NO: 35067 - RNA, 22 nt, Homo sapiens
uugagauggaguuucacucugu

SEQ ID NO: 35068 - RNA, 22 nt, Homo sapiens
uugagauggugccacuguacuc

SEQ ID NO: 35069 - RNA, 22 nt, Homo sapiens
uugaggcaaugaggagaagcug

SEQ ID NO: 35070 - RNA, 22 nt, Homo sapiens
uugagggcugaauaccaaucag

SEQ ID NO: 35071 - RNA, 22 nt, Homo sapiens
uugaguaguaagugguucaccg

SEQ ID NO: 35072 - RNA, 21 nt, Homo sapiens
uugaguugaagcaaggaggga

SEQ ID NO: 35073 - RNA, 22 nt, Homo sapiens
uugauuagauccaguugauuga

SEQ ID NO: 35074 - RNA, 22 nt, Homo sapiens
uugcaccacugcguuccagccu

SEQ ID NO: 35075 - RNA, 22 nt, Homo sapiens
uugcacucuccagccucggcaa

SEQ ID NO: 35076 - RNA, 22 nt, Homo sapiens
uugcacugagauuuugcuuaca

SEQ ID NO: 35077 - RNA, 22 nt, Homo sapiens
uugcagagaaauuucugguuua

SEQ ID NO: 35078 - RNA, 22 nt, Homo sapiens
uugcugagucuuucuagguugc

SEQ ID NO: 35079 - RNA, 22 nt, Homo sapiens
uugcuuagagccaaucuugauu

SEQ ID NO: 35080 - RNA, 22 nt, Homo sapiens
uuggaagguaaucaaaaguucu

SEQ ID NO: 35081 - RNA, 22 nt, Homo sapiens
uuggaauuuuacuucuguaaga

SEQ ID NO: 35082 - RNA, 22 nt, Homo sapiens
uuggcaaguccccaccucucuc

SEQ ID NO: 35083 - RNA, 22 nt, Homo sapiens
uuguaacaguuuauugacucga

SEQ ID NO: 35084 - RNA, 23 nt, Homo sapiens
uuguaacuggagaguaacauucc

SEQ ID NO: 35085 - RNA, 22 nt, Homo sapiens
uuguauccaucuuucaggcaac

SEQ ID NO: 35086 - RNA, 22 nt, Homo sapiens
uugucaaacucauucuccaucc

SEQ ID NO: 35087 - RNA, 22 nt, Homo sapiens
uugucacccuacauaacaggga

SEQ ID NO: 35088 - RNA, 22 nt, Homo sapiens
uugucacucuuccuaggguagg

SEQ ID NO: 35089 - RNA, 22 nt, Homo sapiens
uugugucccugcggcugaggag

SEQ ID NO: 35090 - RNA, 19 nt, Homo sapiens
uuuagaucuuuuaugcagc

SEQ ID NO: 35091 - RNA, 22 nt, Homo sapiens
uuucacagagggcuucuuucua

SEQ ID NO: 35092 - RNA, 23 nt, Homo sapiens
uuucacaguagcuggaucagccu

SEQ ID NO: 35093 - RNA, 22 nt, Homo sapiens
uuucacaguguucucccccaga

SEQ ID NO: 35094 - RNA, 22 nt, Homo sapiens
uuucaucaagcacagaguagau

SEQ ID NO: 35095 - RNA, 22 nt, Homo sapiens
uuugacuuuuagaauaugaguu

SEQ ID NO: 35096 - RNA, 22 nt, Homo sapiens
uuugggaaugaguuuaucauuu

SEQ ID NO: 35097 - RNA, 22 nt, Homo sapiens
uuuguaauccuauuccaaagga

SEQ ID NO: 35098 - RNA, 22 nt, Homo sapiens
uuuguacucccuuuagauaaaa

SEQ ID NO: 35099 - RNA, 22 nt, Homo sapiens
uuugugauugcacacucaagau

SEQ ID NO: 35100 - RNA, 19 nt, Homo sapiens
uuuuccccuuucuuaagac

SEQ ID NO: 35101 - RNA, 22 nt, Homo sapiens
ugaggugaggguaucaaaugcu

SEQ ID NO: 35102 - RNA, 22 nt, Homo sapiens
ugaguguguaugugcauacaca

SEQ ID NO: 35103 - RNA, 17 nt, Homo sapiens
ugauaagugugagguga

SEQ ID NO: 35104 - RNA, 22 nt, Homo sapiens
ugaucugucacuuaucacauuu

SEQ ID NO: 35105 - RNA, 22 nt, Homo sapiens
ugaucuguccaccucagcuucc

SEQ ID NO: 35106 - RNA, 22 nt, Homo sapiens
ugauguguuuuguaguucaacu

SEQ ID NO: 35107 - RNA, 22 nt, Homo sapiens
ugcaagauaggcaguuugcacu

SEQ ID NO: 35108 - RNA, 22 nt, Homo sapiens
ugcaccacacuccauccugggc

SEQ ID NO: 35109 - RNA, 22 nt, Homo sapiens
ugcaccacuacacuccaggcug

SEQ ID NO: 35110 - RNA, 22 nt, Homo sapiens
ugcaccacugcacuccacccug

SEQ ID NO: 35111 - RNA, 22 nt, Homo sapiens
ugcaccacugcacuucagccug

SEQ ID NO: 35112 - RNA, 22 nt, Homo sapiens
ugcaccacugcuagccugggua

SEQ ID NO: 35113 - RNA, 22 nt, Homo sapiens
ugcagcacugaacuucugggcu

SEQ ID NO: 35114 - RNA, 20 nt, Homo sapiens
ugcagcacugggaaugcagu

SEQ ID NO: 35115 - RNA, 23 nt, Homo sapiens
ugcaguagugagaucuaggcuca

SEQ ID NO: 35116 - RNA, 22 nt, Homo sapiens
ugccuucuguuaaacgaggaug

SEQ ID NO: 35117 - RNA, 22 nt, Homo sapiens
ugcugcuguuguuguuacuagc

SEQ ID NO: 35118 - RNA, 20 nt, Homo sapiens
uggaaggcaucugcauuauu

SEQ ID NO: 35119 - RNA, 21 nt, Homo sapiens
uggaaucuauuauuccaguuu

SEQ ID NO: 35120 - RNA, 18 nt, Homo sapiens
uggacagugauuauccau

SEQ ID NO: 35121 - RNA, 22 nt, Homo sapiens
uggagauguuuaaaauccacug

SEQ ID NO: 35122 - RNA, 20 nt, Homo sapiens
uggaguuguggcaguuugga

SEQ ID NO: 35123 - RNA, 22 nt, Homo sapiens
uggauagaacuaagugcuuaga

SEQ ID NO: 35124 - RNA, 22 nt, Homo sapiens
uggauggagaggcuugugaugc

SEQ ID NO: 35125 - RNA, 22 nt, Homo sapiens
uggcaagagauaugugucuaua

SEQ ID NO: 35126 - RNA, 22 nt, Homo sapiens
uggcaagagggaugcaagguuu

SEQ ID NO: 35127 - RNA, 22 nt, Homo sapiens
uggcaauguggaaugguccagg

SEQ ID NO: 35128 - RNA, 23 nt, Homo sapiens
uggcuagacguccuuuccugaug

SEQ ID NO: 35129 - RNA, 22 nt, Homo sapiens
uggcucauuucuaaacccagcu

SEQ ID NO: 35130 - RNA, 22 nt, Homo sapiens
uggcucuguuuguuaacuagac

SEQ ID NO: 35131 - RNA, 22 nt, Homo sapiens
ugggaagaagguuuacuugcca

SEQ ID NO: 35132 - RNA, 22 nt, Homo sapiens
ugggaucuuuccuauuagcgag

SEQ ID NO: 35133 - RNA, 22 nt, Homo sapiens
ugguaagaggcccugaguuugu

SEQ ID NO: 35134 - RNA, 22 nt, Homo sapiens
uggugagaaaagaugucuuugu

SEQ ID NO: 35135 - RNA, 17 nt, Homo sapiens
uggugcuugaaaguugc

SEQ ID NO: 35136 - RNA, 22 nt, Homo sapiens
uguagucauuuggaguccagcu

SEQ ID NO: 35137 - RNA, 20 nt, Homo sapiens
ugucaagaaacauuacuuau

SEQ ID NO: 35138 - RNA, 22 nt, Homo sapiens
ugucagaaucugagacgacaac

SEQ ID NO: 35139 - RNA, 22 nt, Homo sapiens
ugucucaguuacggcaauucca

SEQ ID NO: 35140 - RNA, 22 nt, Homo sapiens
ugugcauagugugugcggggcg

SEQ ID NO: 35141 - RNA, 22 nt, Homo sapiens
ugugcauauaaguguguauaua

SEQ ID NO: 35142 - RNA, 20 nt, Homo sapiens
aagacacuguccccacugga

SEQ ID NO: 35143 - RNA, 23 nt, Homo sapiens
aagagguaugacuaugaagugga

SEQ ID NO: 35144 - RNA, 22 nt, Homo sapiens
aagaucaucauagagggcauga

SEQ ID NO: 35145 - RNA, 22 nt, Homo sapiens
aagaugauguuguguuuucacu

SEQ ID NO: 35146 - RNA, 22 nt, Homo sapiens
aagcacccuuugucuggacaug

SEQ ID NO: 35147 - RNA, 22 nt, Homo sapiens
aagcugguguguauuauucacu

SEQ ID NO: 35148 - RNA, 22 nt, Homo sapiens
aaggagugugauucuucaguuu

SEQ ID NO: 35149 - RNA, 22 nt, Homo sapiens
aaggcaauuuguugugaggauu

SEQ ID NO: 35150 - RNA, 22 nt, Homo sapiens
aaggcagucacuaaauagugag

SEQ ID NO: 35151 - RNA, 22 nt, Homo sapiens
aaggugguuuucucuuggaguc

SEQ ID NO: 35152 - RNA, 22 nt, Homo sapiens
aaguaguuaggaacauucucuc

SEQ ID NO: 35153 - RNA, 22 nt, Homo sapiens
aaguauguaucaagucauacuu

SEQ ID NO: 35154 - RNA, 22 nt, Homo sapiens
aagugcuuuguacagggguuga

SEQ ID NO: 35155 - RNA, 19 nt, Homo sapiens
aauauugacaguggugucu

SEQ ID NO: 35156 - RNA, 22 nt, Homo sapiens
aaucacaggucuuggcugcaug

SEQ ID NO: 35157 - RNA, 22 nt, Homo sapiens
aaucccauuucucuguguuuuu

SEQ ID NO: 35158 - RNA, 22 nt, Homo sapiens
aaugacuaagaugguacauuuu

SEQ ID NO: 35159 - RNA, 22 nt, Homo sapiens
aaugccuagugugugacaggug

SEQ ID NO: 35160 - RNA, 22 nt, Homo sapiens
acacaguauaugacaaugcuuu

SEQ ID NO: 35161 - RNA, 22 nt, Homo sapiens
acagcacugccaagugacccau

SEQ ID NO: 35162 - RNA, 20 nt, Homo sapiens
acagcauagccuuuuaaagc

SEQ ID NO: 35163 - RNA, 22 nt, Homo sapiens
acagucacaauuuguaccuuuu

SEQ ID NO: 35164 - RNA, 22 nt, Homo sapiens
acaugcauauguuggaagaaag

SEQ ID NO: 35165 - RNA, 22 nt, Homo sapiens
accauugcacuccagccugggc

SEQ ID NO: 35166 - RNA, 22 nt, Homo sapiens
acuaugagacgaaugcaucagu

SEQ ID NO: 35167 - RNA, 22 nt, Homo sapiens
acugcacuccaaccuguugggc

SEQ ID NO: 35168 - RNA, 22 nt, Homo sapiens
acugcacuccacccuuggcagc

SEQ ID NO: 35169 - RNA, 18 nt, Homo sapiens
acugcacuccaccuuggg

SEQ ID NO: 35170 - RNA, 22 nt, Homo sapiens
acugcacuccagcccaggugac

SEQ ID NO: 35171 - RNA, 22 nt, Homo sapiens
acugcacuccagccucccgucu

SEQ ID NO: 35172 - RNA, 22 nt, Homo sapiens
acugcacuccagccuccugaca

SEQ ID NO: 35173 - RNA, 22 nt, Homo sapiens
acugcacuccagccuccugggu

SEQ ID NO: 35174 - RNA, 22 nt, Homo sapiens
acugcacuccagccucggcaau

SEQ ID NO: 35175 - RNA, 22 nt, Homo sapiens
acugcacuccagccuggaccac

SEQ ID NO: 35176 - RNA, 22 nt, Homo sapiens
acugcacuccagccuggcggac

SEQ ID NO: 35177 - RNA, 22 nt, Homo sapiens
acugcacuccagccugugcgua

SEQ ID NO: 35178 - RNA, 20 nt, Homo sapiens
acugcacuccagccuuccag

SEQ ID NO: 35179 - RNA, 22 nt, Homo sapiens
acugcacuccagccuucggaca

SEQ ID NO: 35180 - RNA, 22 nt, Homo sapiens
acugcacuccagccuugcgaca

SEQ ID NO: 35181 - RNA, 22 nt, Homo sapiens
acugcacuccagccuuggcaac

SEQ ID NO: 35182 - RNA, 22 nt, Homo sapiens
acugcacuccagccuugugaca

SEQ ID NO: 35183 - RNA, 22 nt, Homo sapiens
acugcacucuagcauggguaau

SEQ ID NO: 35184 - RNA, 22 nt, Homo sapiens
acugcacucuagccccugcgac

SEQ ID NO: 35185 - RNA, 22 nt, Homo sapiens
acugcacucuagccuuggcaac

SEQ ID NO: 35186 - RNA, 20 nt, Homo sapiens
acugcacuucagccugcugg

SEQ ID NO: 35187 - RNA, 22 nt, Homo sapiens
acuggcaauggcagaaauaguu

SEQ ID NO: 35188 - RNA, 22 nt, Homo sapiens
acuguacuccagccugggugac

SEQ ID NO: 35189 - RNA, 22 nt, Homo sapiens
acuguacuccauccugggugac

SEQ ID NO: 35190 - RNA, 22 nt, Homo sapiens
acuguguguuugucuagcacag

SEQ ID NO: 35191 - RNA, 22 nt, Homo sapiens
acuuuuugauggggagaacauu

SEQ ID NO: 35192 - RNA, 22 nt, Homo sapiens
agaaagugcuucccuuugguga

SEQ ID NO: 35193 - RNA, 19 nt, Homo sapiens
agaaucuaaauuauuucug

SEQ ID NO: 35194 - RNA, 22 nt, Homo sapiens
agaauguauauucuguaguugu

SEQ ID NO: 35195 - RNA, 22 nt, Homo sapiens
agaauguuuuagaccaauacaa

SEQ ID NO: 35196 - RNA, 22 nt, Homo sapiens
agacagcugguagcacuuccug

SEQ ID NO: 35197 - RNA, 22 nt, Homo sapiens
agagaacuggcuucaccauucu

SEQ ID NO: 35198 - RNA, 22 nt, Homo sapiens
agaguaguaggaugaauggacu

SEQ ID NO: 35199 - RNA, 22 nt, Homo sapiens
agaguaguuuauuaugcuaagg

SEQ ID NO: 35200 - RNA, 23 nt, Homo sapiens
agagugcaauggugccaucucgg

SEQ ID NO: 35201 - RNA, 22 nt, Homo sapiens
agauauguuuaguuucaaaaug

SEQ ID NO: 35202 - RNA, 22 nt, Homo sapiens
agauggucuucauaaguuuuaa

SEQ ID NO: 35203 - RNA, 22 nt, Homo sapiens
agcacgaaaccaaauucuguga

SEQ ID NO: 35204 - RNA, 22 nt, Homo sapiens
agcagcauuaguggaaucuugu

SEQ ID NO: 35205 - RNA, 22 nt, Homo sapiens
agcagcuuugaucugaaugauu

SEQ ID NO: 35206 - RNA, 22 nt, Homo sapiens
agcuuaugcuuggaagagauga

SEQ ID NO: 35207 - RNA, 22 nt, Homo sapiens
aggaaugucaaugguaguuuaa

SEQ ID NO: 35208 - RNA, 22 nt, Homo sapiens
aggaauguuaguacuucuuagu

SEQ ID NO: 35209 - RNA, 22 nt, Homo sapiens
aggacacugagcaugggagguu

SEQ ID NO: 35210 - RNA, 22 nt, Homo sapiens
aggacacugauagucuuuggca

SEQ ID NO: 35211 - RNA, 22 nt, Homo sapiens
aggacacugauguaugcugugg

SEQ ID NO: 35212 - RNA, 22 nt, Homo sapiens
aggagaauugguucuucuugau

SEQ ID NO: 35213 - RNA, 22 nt, Homo sapiens
aggcaagaaugcuuguuucacc

SEQ ID NO: 35214 - RNA, 22 nt, Homo sapiens
aggcuagaaucuuccaucuugg

SEQ ID NO: 35215 - RNA, 22 nt, Homo sapiens
agguauuuucaacuuagaaugg

SEQ ID NO: 35216 - RNA, 22 nt, Homo sapiens
agugacaugggaucaaaucuga

SEQ ID NO: 35217 - RNA, 22 nt, Homo sapiens
agugacuagaauaugaauuuua

SEQ ID NO: 35218 - RNA, 22 nt, Homo sapiens
agugcaguggcacaaucuuggc

SEQ ID NO: 35219 - RNA, 22 nt, Homo sapiens
agugcauugagacuugugaguu

SEQ ID NO: 35220 - RNA, 22 nt, Homo sapiens
agugucaggagacagguagcug

SEQ ID NO: 35221 - RNA, 23 nt, Homo sapiens
auaaugcaaguggugguaaucug

SEQ ID NO: 35222 - RNA, 22 nt, Homo sapiens
auacccucugggugguuaguug

SEQ ID NO: 35223 - RNA, 22 nt, Homo sapiens
ucaggugcaguggcucaugcuu

SEQ ID NO: 35224 - RNA, 22 nt, Homo sapiens
ucaggugcaguggcucugaccu

SEQ ID NO: 35225 - RNA, 22 nt, Homo sapiens
ucagucauucacucacucggac

SEQ ID NO: 35226 - RNA, 22 nt, Homo sapiens
ucagugguuaaaagauucuaga

SEQ ID NO: 35227 - RNA, 22 nt, Homo sapiens
ucaucaggcucauucaagcuga

SEQ ID NO: 35228 - RNA, 22 nt, Homo sapiens
ucauguaauuuugugucuauga

SEQ ID NO: 35229 - RNA, 22 nt, Homo sapiens
uccacaauggcugaacuagauu

SEQ ID NO: 35230 - RNA, 19 nt, Homo sapiens
ucccaauguuuccaggcag

SEQ ID NO: 35231 - RNA, 22 nt, Homo sapiens
uccccugagaccccucagcacu

SEQ ID NO: 35232 - RNA, 22 nt, Homo sapiens
uccugagacucacaggcucccc

SEQ ID NO: 35233 - RNA, 22 nt, Homo sapiens
uccugagacugaggagcuuugg

SEQ ID NO: 35234 - RNA, 22 nt, Homo sapiens
uccugagagcagacccucuaua

SEQ ID NO: 35235 - RNA, 20 nt, Homo sapiens
uccugagauucccaguucuc

SEQ ID NO: 35236 - RNA, 22 nt, Homo sapiens
ucucaaguggucgcaguuagau

SEQ ID NO: 35237 - RNA, 22 nt, Homo sapiens
ucucacagaguugaacuuucuu

SEQ ID NO: 35238 - RNA, 22 nt, Homo sapiens
ucucacagccauuucucccucu

SEQ ID NO: 35239 - RNA, 22 nt, Homo sapiens
ucucacauuucacagggauggg

SEQ ID NO: 35240 - RNA, 22 nt, Homo sapiens
ucuccauuguccagaugaggaa

SEQ ID NO: 35241 - RNA, 22 nt, Homo sapiens
ucucuggauaucuacuuauguu

SEQ ID NO: 35242 - RNA, 22 nt, Homo sapiens
ucugagcaauagauguggauau

SEQ ID NO: 35243 - RNA, 22 nt, Homo sapiens
ucugagguuacugcuuuguaga

SEQ ID NO: 35244 - RNA, 22 nt, Homo sapiens
ucugucuugugguuugagugcc

SEQ ID NO: 35245 - RNA, 22 nt, Homo sapiens
ucuuaguuuagauuagcaauuc

SEQ ID NO: 35246 - RNA, 20 nt, Homo sapiens
ucuugggaauguagccuagg

SEQ ID NO: 35247 - RNA, 22 nt, Homo sapiens
ucuugguuuauugugguaugaa

SEQ ID NO: 35248 - RNA, 22 nt, Homo sapiens
ucuuuggguagauauguagcug

SEQ ID NO: 35249 - RNA, 22 nt, Homo sapiens
ucuuuugugagucagccucucc

SEQ ID NO: 35250 - RNA, 20 nt, Homo sapiens
ucuuuuuguggccccagagu

SEQ ID NO: 35251 - RNA, 22 nt, Homo sapiens
ugaaauacuuaauuucuccaug

SEQ ID NO: 35252 - RNA, 22 nt, Homo sapiens
ugaagagucuaaaucugucuuc

SEQ ID NO: 35253 - RNA, 21 nt, Homo sapiens
ugaauauuuggguugugucca

SEQ ID NO: 35254 - RNA, 22 nt, Homo sapiens
ugacagagcaggacuucaucuc

SEQ ID NO: 35255 - RNA, 22 nt, Homo sapiens
ugacagaggucuuuuaauagcu

SEQ ID NO: 35256 - RNA, 21 nt, Homo sapiens
ugacauguugguguucugcac

SEQ ID NO: 35257 - RNA, 22 nt, Homo sapiens
ugacuucagacugaaaugauuc

SEQ ID NO: 35258 - RNA, 22 nt, Homo sapiens
ugacuugaacuucuaugucacc

SEQ ID NO: 35259 - RNA, 22 nt, Homo sapiens
ugagaagaugaacuccuugguc

SEQ ID NO: 35260 - RNA, 22 nt, Homo sapiens
ugagaagugauauagaaguuaa

SEQ ID NO: 35261 - RNA, 22 nt, Homo sapiens
ugagagaugaacucugauaugu

SEQ ID NO: 35262 - RNA, 22 nt, Homo sapiens
ugagauaaagcauguacugugu

SEQ ID NO: 35263 - RNA, 22 nt, Homo sapiens
ugagauguguccagaucuaguu

SEQ ID NO: 35264 - RNA, 22 nt, Homo sapiens
ugagcagugagugugcugcagg

SEQ ID NO: 35265 - RNA, 22 nt, Homo sapiens
ugagcugagaucgugccauugu

SEQ ID NO: 35266 - RNA, 22 nt, Homo sapiens
ugaggagugagaaauugguuuc

SEQ ID NO: 35267 - RNA, 17 nt, Homo sapiens
ugaggcacuaguaucac

SEQ ID NO: 35268 - RNA, 22 nt, Homo sapiens
ugagguagaggugaacuugacc

SEQ ID NO: 35269 - RNA, 22 nt, Homo sapiens
ugagguaggugaagaaugcacg

SEQ ID NO: 35270 - RNA, 22 nt, Homo sapiens
ugaggucacuuguuuuaugcuu

SEQ ID NO: 35271 - RNA, 20 nt, Homo sapiens
ugaggucaggaguuacagac

SEQ ID NO: 35272 - RNA, 22 nt, Homo sapiens
ugaggucauucaugugggcgca

SEQ ID NO: 35273 - RNA, 22 nt, Homo sapiens
ugaggugagauggcuaccccaa

SEQ ID NO: 35274 - RNA, 22 nt, Homo sapiens
ugaggugagggguuaggugcua

SEQ ID NO: 35275 - RNA, 22 nt, Homo sapiens
ugaguacugauuuaagauacac

SEQ ID NO: 35276 - RNA, 22 nt, Homo sapiens
ugagucagucucacucugcugc

SEQ ID NO: 35277 - RNA, 22 nt, Homo sapiens
ugagugugacuuagcagaagga

SEQ ID NO: 35278 - RNA, 20 nt, Homo sapiens
ugauauuucuggaaguggag

SEQ ID NO: 35279 - RNA, 22 nt, Homo sapiens
ugaugcugaugccugccagaag

SEQ ID NO: 35280 - RNA, 22 nt, Homo sapiens
ugauggcauuuggaguugggac

SEQ ID NO: 35281 - RNA, 22 nt, Homo sapiens
ugcaaagucgaaacugcaguuu

SEQ ID NO: 35282 - RNA, 22 nt, Homo sapiens
ugcaagacacuguccugggcau

SEQ ID NO: 35283 - RNA, 22 nt, Homo sapiens
ugcaguuuaggaacugguaaca

SEQ ID NO: 35284 - RNA, 22 nt, Homo sapiens
ugcaugcaucuuuuauaguagc

SEQ ID NO: 35285 - RNA, 22 nt, Homo sapiens
ugccaucauuaauauuaggcau

SEQ ID NO: 35286 - RNA, 22 nt, Homo sapiens
ugccuacuuugcaucugucagg

SEQ ID NO: 35287 - RNA, 22 nt, Homo sapiens
ugccuaguagaaggugaacaug

SEQ ID NO: 35288 - RNA, 22 nt, Homo sapiens
ugccuaguggaaggagagcaaa

SEQ ID NO: 35289 - RNA, 21 nt, Homo sapiens
ugcucaugaguaaugcaguga

SEQ ID NO: 35290 - RNA, 22 nt, Homo sapiens
ugcugcaaacaugagaggaagu

SEQ ID NO: 35291 - RNA, 22 nt, Homo sapiens
uggaauacaugucgcugagcug

SEQ ID NO: 35292 - RNA, 20 nt, Homo sapiens
uggaaucugaagaucucagu

SEQ ID NO: 35293 - RNA, 22 nt, Homo sapiens
uggaauguauaucguuuuuugu

SEQ ID NO: 35294 - RNA, 22 nt, Homo sapiens
uggacacuggagauucgucagu

SEQ ID NO: 35295 - RNA, 22 nt, Homo sapiens
uggacauguacauauguguaug

SEQ ID NO: 35296 - RNA, 22 nt, Homo sapiens
uggaguguuggggcaggaucuc

SEQ ID NO: 35297 - RNA, 22 nt, Homo sapiens
uggauagaaauguacuguuuuc

SEQ ID NO: 35298 - RNA, 22 nt, Homo sapiens
uggcaaaugugagaugagaacu

SEQ ID NO: 35299 - RNA, 22 nt, Homo sapiens
auauagcucuggcuggaugacu

SEQ ID NO: 35300 - RNA, 22 nt, Homo sapiens
auauuacagagaggaccuggga

SEQ ID NO: 35301 - RNA, 22 nt, Homo sapiens
auauugcuugaggccaggaggu

SEQ ID NO: 35302 - RNA, 22 nt, Homo sapiens
aucaaagcagcauggcccaguc

SEQ ID NO: 35303 - RNA, 22 nt, Homo sapiens
aucacagcuacuccucugucuu

SEQ ID NO: 35304 - RNA, 22 nt, Homo sapiens
aucaccagaugcuucaagcaga

SEQ ID NO: 35305 - RNA, 22 nt, Homo sapiens
aucaccuggaggugaucacuug

SEQ ID NO: 35306 - RNA, 22 nt, Homo sapiens
aucaccuuucccuuucugaauc

SEQ ID NO: 35307 - RNA, 22 nt, Homo sapiens
aucaggaaccuuuuuggugugu

SEQ ID NO: 35308 - RNA, 22 nt, Homo sapiens
aucaugucuucccagugauucu

SEQ ID NO: 35309 - RNA, 22 nt, Homo sapiens
aucauugugugaguugauggga

SEQ ID NO: 35310 - RNA, 22 nt, Homo sapiens
auccauguggauaaauguguau

SEQ ID NO: 35311 - RNA, 22 nt, Homo sapiens
auccugagacuuugcugaaguu

SEQ ID NO: 35312 - RNA, 22 nt, Homo sapiens
augaaaucuuuggcagaucuua

SEQ ID NO: 35313 - RNA, 22 nt, Homo sapiens
augaagacaucgucugggauua

SEQ ID NO: 35314 - RNA, 22 nt, Homo sapiens
augaggagguaugauuuucuga

SEQ ID NO: 35315 - RNA, 22 nt, Homo sapiens
augaggugauaucuggaaauua

SEQ ID NO: 35316 - RNA, 22 nt, Homo sapiens
augagguguuuauuguauccug

SEQ ID NO: 35317 - RNA, 22 nt, Homo sapiens
aaaaggcuagcuaguaacagaa

SEQ ID NO: 35318 - RNA, 22 nt, Homo sapiens
aaagucacuggagaaggaauau

SEQ ID NO: 35319 - RNA, 22 nt, Homo sapiens
aaagugcugggauuggccgggc

SEQ ID NO: 35320 - RNA, 22 nt, Homo sapiens
aacaucaaccaugaggguugga

SEQ ID NO: 35321 - RNA, 22 nt, Homo sapiens
aacugcacuaggacagguuuuu

SEQ ID NO: 35322 - RNA, 22 nt, Homo sapiens
aagcagauguguugaaaguacu

SEQ ID NO: 35323 - RNA, 22 nt, Homo sapiens
aagcauccagcauggaacugaa

SEQ ID NO: 35324 - RNA, 22 nt, Homo sapiens
aagcugccaggcaugguggcug

SEQ ID NO: 35325 - RNA, 22 nt, Homo sapiens
aagcuggagugcaguggugcaa

SEQ ID NO: 35326 - RNA, 22 nt, Homo sapiens
aaggcaguggcagaagauguca

SEQ ID NO: 35327 - RNA, 22 nt, Homo sapiens
aagguggugucagagagcuuau

SEQ ID NO: 35328 - RNA, 22 nt, Homo sapiens
aagugcuuacagggaacaugau

SEQ ID NO: 35329 - RNA, 23 nt, Homo sapiens
aaguucaugcucaucuguuacac

SEQ ID NO: 35330 - RNA, 20 nt, Homo sapiens
aauaacagccccagggaggu

SEQ ID NO: 35331 - RNA, 21 nt, Homo sapiens
aauacucuagguuaagagagc

SEQ ID NO: 35332 - RNA, 22 nt, Homo sapiens
aauaugucugcuaauuguuucu

SEQ ID NO: 35333 - RNA, 22 nt, Homo sapiens
aaucaacauuguuuuaagucaa

SEQ ID NO: 35334 - RNA, 22 nt, Homo sapiens
aaugaaguuagauguugagaag

SEQ ID NO: 35335 - RNA, 17 nt, Homo sapiens
aaugagacauuucugcu

SEQ ID NO: 35336 - RNA, 22 nt, Homo sapiens
aauggcaagagccacagaggcg

SEQ ID NO: 35337 - RNA, 22 nt, Homo sapiens
aaugucacugugguccuccagu

SEQ ID NO: 35338 - RNA, 22 nt, Homo sapiens
aaugugcuguucagaggagucc

SEQ ID NO: 35339 - RNA, 22 nt, Homo sapiens
aauuacucgugucuuuacugcu

SEQ ID NO: 35340 - RNA, 23 nt, Homo sapiens
aauugcuuuugaggacuuaguug

SEQ ID NO: 35341 - RNA, 22 nt, Homo sapiens
acacauuagcaagugcuguuau

SEQ ID NO: 35342 - RNA, 22 nt, Homo sapiens
acagaauucucagaacugggag

SEQ ID NO: 35343 - RNA, 22 nt, Homo sapiens
acagccauuccagccaaauacu

SEQ ID NO: 35344 - RNA, 22 nt, Homo sapiens
acauacacuagggauguggugu

SEQ ID NO: 35345 - RNA, 21 nt, Homo sapiens
acauguacacauguaugcaca

SEQ ID NO: 35346 - RNA, 18 nt, Homo sapiens
acauucagcuugaagaua

SEQ ID NO: 35347 - RNA, 22 nt, Homo sapiens
acugcacuccaaccuuggugac

SEQ ID NO: 35348 - RNA, 22 nt, Homo sapiens
acugcacuccaccuugggcaac

SEQ ID NO: 35349 - RNA, 22 nt, Homo sapiens
acugcacuccagacucugucuc

SEQ ID NO: 35350 - RNA, 22 nt, Homo sapiens
acugcacuccagccucggggac

SEQ ID NO: 35351 - RNA, 22 nt, Homo sapiens
acugcacuccagccugagccug

SEQ ID NO: 35352 - RNA, 22 nt, Homo sapiens
acugcacuccagccugccgaca

SEQ ID NO: 35353 - RNA, 22 nt, Homo sapiens
acugcacuccagccugcugaca

SEQ ID NO: 35354 - RNA, 22 nt, Homo sapiens
acugcacuccagccugcuggau

SEQ ID NO: 35355 - RNA, 22 nt, Homo sapiens
acugcacuccagccugcuggca

SEQ ID NO: 35356 - RNA, 22 nt, Homo sapiens
acugcacuccagccuggacgac

SEQ ID NO: 35357 - RNA, 22 nt, Homo sapiens
acugcacuccagccuuagugac

SEQ ID NO: 35358 - RNA, 22 nt, Homo sapiens
acugcacuccagccuugauggc

SEQ ID NO: 35359 - RNA, 22 nt, Homo sapiens
acugcacuccagccuuggcggc

SEQ ID NO: 35360 - RNA, 22 nt, Homo sapiens
acugcacuccagcuccagggug

SEQ ID NO: 35361 - RNA, 20 nt, Homo sapiens
acugcacuccagucucuggg

SEQ ID NO: 35362 - RNA, 22 nt, Homo sapiens
acugcacugucaaccuccuggg

SEQ ID NO: 35363 - RNA, 22 nt, Homo sapiens
acugcacuuauccuccaauguu

SEQ ID NO: 35364 - RNA, 22 nt, Homo sapiens
acugcacuucagccuguugaca

SEQ ID NO: 35365 - RNA, 22 nt, Homo sapiens
acugcacuucagccuuggggac

SEQ ID NO: 35366 - RNA, 22 nt, Homo sapiens
acuggcuguuaggaauuaccuc

SEQ ID NO: 35367 - RNA, 22 nt, Homo sapiens
acuguacuacagccugggugac

SEQ ID NO: 35368 - RNA, 22 nt, Homo sapiens
acuugacacuuauauuacucac

SEQ ID NO: 35369 - RNA, 22 nt, Homo sapiens
acuuuuugaugaggucguuugu

SEQ ID NO: 35370 - RNA, 22 nt, Homo sapiens
agaauaauguccccccaaggga

SEQ ID NO: 35371 - RNA, 22 nt, Homo sapiens
agaauguaaacagaauagagga

SEQ ID NO: 35372 - RNA, 22 nt, Homo sapiens
agaaugucagcuggauucagcu

SEQ ID NO: 35373 - RNA, 22 nt, Homo sapiens
agacccuguauguguuuaguuu

SEQ ID NO: 35374 - RNA, 22 nt, Homo sapiens
agcaagauugauggccugcagg

SEQ ID NO: 35375 - RNA, 22 nt, Homo sapiens
agcagcuuugcauggccugugg

SEQ ID NO: 35376 - RNA, 22 nt, Homo sapiens
agcauggucacuuugggcccca

SEQ ID NO: 35377 - RNA, 22 nt, Homo sapiens
agcgccacugcacuccagccug

SEQ ID NO: 35378 - RNA, 22 nt, Homo sapiens
agcucacagccuagcacuguga

SEQ ID NO: 35379 - RNA, 22 nt, Homo sapiens
agcugauggucuuguaugaugu

SEQ ID NO: 35380 - RNA, 18 nt, Homo sapiens
aggaaugguaauacuuca

SEQ ID NO: 35381 - RNA, 22 nt, Homo sapiens
aggcaagcaucuugcucccuuc

SEQ ID NO: 35382 - RNA, 22 nt, Homo sapiens
agucagugucuguaaggagaac

SEQ ID NO: 35383 - RNA, 22 nt, Homo sapiens
agucaguguguauugauggcac

SEQ ID NO: 35384 - RNA, 22 nt, Homo sapiens
auacaaggaaugaagagauuug

SEQ ID NO: 35385 - RNA, 22 nt, Homo sapiens
auacuccugucucagcugagau

SEQ ID NO: 35386 - RNA, 22 nt, Homo sapiens
auagaaucaucugugcacuagu

SEQ ID NO: 35387 - RNA, 22 nt, Homo sapiens
auagcagcaccucacucuacug

SEQ ID NO: 35388 - RNA, 22 nt, Homo sapiens
auagcaggagaauggucauggg

SEQ ID NO: 35389 - RNA, 22 nt, Homo sapiens
auagcauagucagcuucgcuga

SEQ ID NO: 35390 - RNA, 22 nt, Homo sapiens
auagccucauucuucagaugag

SEQ ID NO: 35391 - RNA, 22 nt, Homo sapiens
auaggcacauuaggaacuuuug

SEQ ID NO: 35392 - RNA, 22 nt, Homo sapiens
auauaccuaggcuacaugguuu

SEQ ID NO: 35393 - RNA, 22 nt, Homo sapiens
auauauguuuucugggaagaaa

SEQ ID NO: 35394 - RNA, 18 nt, Homo sapiens
auauugccuucagacuag

SEQ ID NO: 35395 - RNA, 22 nt, Homo sapiens
auauuguacugcuacugguucu

SEQ ID NO: 35396 - RNA, 22 nt, Homo sapiens
aucaaauugucauuuuaaggau

SEQ ID NO: 35397 - RNA, 22 nt, Homo sapiens
aucaaguacuguacugaaagug

SEQ ID NO: 35398 - RNA, 22 nt, Homo sapiens
aucacacucaccuucuguccuu

SEQ ID NO: 35399 - RNA, 22 nt, Homo sapiens
aucacauuuauaguggcacgca

SEQ ID NO: 35400 - RNA, 22 nt, Homo sapiens
aucaccugagcaguauacacug

SEQ ID NO: 35401 - RNA, 22 nt, Homo sapiens
aucaccuggaguagcccguccc

SEQ ID NO: 35402 - RNA, 22 nt, Homo sapiens
aucagaaucucuagugggacca

SEQ ID NO: 35403 - RNA, 22 nt, Homo sapiens
aucaucaugcacuacagccugg

SEQ ID NO: 35404 - RNA, 22 nt, Homo sapiens
aucccaguaaaaauggcuucua

SEQ ID NO: 35405 - RNA, 22 nt, Homo sapiens
aucccgagacuuugcugaaguu

SEQ ID NO: 35406 - RNA, 22 nt, Homo sapiens
aucgcaccauugcacuccagca

SEQ ID NO: 35407 - RNA, 22 nt, Homo sapiens
augaaaucacugugaugcccua

SEQ ID NO: 35408 - RNA, 22 nt, Homo sapiens
augaauccauuccugccacaga

SEQ ID NO: 35409 - RNA, 22 nt, Homo sapiens
augaauuuucugauguugggua

SEQ ID NO: 35410 - RNA, 22 nt, Homo sapiens
augaggugaggucaguaaggua

SEQ ID NO: 35411 - RNA, 22 nt, Homo sapiens
augaggugauuucuguucgggu

SEQ ID NO: 35412 - RNA, 20 nt, Homo sapiens
augagguguaugacacugaa

SEQ ID NO: 35413 - RNA, 22 nt, Homo sapiens
augauggaggccgugauggacg

SEQ ID NO: 35414 - RNA, 22 nt, Homo sapiens
augcacuguauaggaucuugcg

SEQ ID NO: 35415 - RNA, 20 nt, Homo sapiens
ucacugagugguccacagua

SEQ ID NO: 35416 - RNA, 22 nt, Homo sapiens
ucacugcacuccagccuuuaug

SEQ ID NO: 35417 - RNA, 21 nt, Homo sapiens
ucagaagcucccagggaggac

SEQ ID NO: 35418 - RNA, 22 nt, Homo sapiens
ucagaguaguuccuggcagaaa

SEQ ID NO: 35419 - RNA, 22 nt, Homo sapiens
ucagaguggagucugcagccuu

SEQ ID NO: 35420 - RNA, 22 nt, Homo sapiens
ucagauacuggugacaugaaug

SEQ ID NO: 35421 - RNA, 22 nt, Homo sapiens
ucagucauugauggaguagguc

SEQ ID NO: 35422 - RNA, 22 nt, Homo sapiens
ucaguuaaugcugccugcugga

SEQ ID NO: 35423 - RNA, 22 nt, Homo sapiens
ucauauugguuaaaauaguggg

SEQ ID NO: 35424 - RNA, 22 nt, Homo sapiens
ucaucagguaugucagcggagu

SEQ ID NO: 35425 - RNA, 22 nt, Homo sapiens
ucaugacacuggcaggagcuaa

SEQ ID NO: 35426 - RNA, 22 nt, Homo sapiens
ucaugggagcccccaucaugag

SEQ ID NO: 35427 - RNA, 22 nt, Homo sapiens
ucaugugagcacagagcaagau

SEQ ID NO: 35428 - RNA, 22 nt, Homo sapiens
uccagguuuggcuuuauaacuu

SEQ ID NO: 35429 - RNA, 22 nt, Homo sapiens
uccaugaggcuacaguaaucuc

SEQ ID NO: 35430 - RNA, 22 nt, Homo sapiens
uccuguaaucccagcuaccaga

SEQ ID NO: 35431 - RNA, 22 nt, Homo sapiens
uccuucaguccaguggguuuug

SEQ ID NO: 35432 - RNA, 22 nt, Homo sapiens
uccuugagccucccagacucag

SEQ ID NO: 35433 - RNA, 22 nt, Homo sapiens
ucgcaccauugcacuccagcca

SEQ ID NO: 35434 - RNA, 22 nt, Homo sapiens
ucgugccacugcacuccagccu

SEQ ID NO: 35435 - RNA, 22 nt, Homo sapiens
ucuaaaacuagauugugaugau

SEQ ID NO: 35436 - RNA, 19 nt, Homo sapiens
ucuaaaucucuugauagac

SEQ ID NO: 35437 - RNA, 22 nt, Homo sapiens
ucucaaguaacugggacaauaa

SEQ ID NO: 35438 - RNA, 22 nt, Homo sapiens
ucucacacugaauguguguggg

SEQ ID NO: 35439 - RNA, 18 nt, Homo sapiens
ucucacagcaaucuguca

SEQ ID NO: 35440 - RNA, 22 nt, Homo sapiens
ucucagcacagucagggcgccu

SEQ ID NO: 35441 - RNA, 22 nt, Homo sapiens
ucucaguggugcuggcagggga

SEQ ID NO: 35442 - RNA, 22 nt, Homo sapiens
ucugacucugugaugggcccaa

SEQ ID NO: 35443 - RNA, 22 nt, Homo sapiens
ucuuaggugggccaucacccca

SEQ ID NO: 35444 - RNA, 22 nt, Homo sapiens
ucuugguuaggggaaauaggca

SEQ ID NO: 35445 - RNA, 22 nt, Homo sapiens
ucuugguuuauugauggagagg

SEQ ID NO: 35446 - RNA, 22 nt, Homo sapiens
ucuuugguagaagcuauuuuau

SEQ ID NO: 35447 - RNA, 22 nt, Homo sapiens
ucuuuguuggaguccaaggaua

SEQ ID NO: 35448 - RNA, 22 nt, Homo sapiens
ugaaauguugggugauggaauc

SEQ ID NO: 35449 - RNA, 22 nt, Homo sapiens
ugaaauuguuugcaaggauagg

SEQ ID NO: 35450 - RNA, 22 nt, Homo sapiens
ugaaggaguauggauaagucgu

SEQ ID NO: 35451 - RNA, 22 nt, Homo sapiens
ugaaggcaggagggagaaaagu

SEQ ID NO: 35452 - RNA, 23 nt, Homo sapiens
ugacaagagcgagacuuggucuc

SEQ ID NO: 35453 - RNA, 22 nt, Homo sapiens
ugacacagcaagauggaaccau

SEQ ID NO: 35454 - RNA, 22 nt, Homo sapiens
ugacauguagagaacuucucau

SEQ ID NO: 35455 - RNA, 22 nt, Homo sapiens
ugacccuguggcagcgucuaag

SEQ ID NO: 35456 - RNA, 22 nt, Homo sapiens
ugacuaaaacugaguuucauua

SEQ ID NO: 35457 - RNA, 22 nt, Homo sapiens
ugacuaaggaaggauuaugugc

SEQ ID NO: 35458 - RNA, 22 nt, Homo sapiens
ugacuugaaacgugaacagauc

SEQ ID NO: 35459 - RNA, 22 nt, Homo sapiens
ugagaagacaucagcuuucgga

SEQ ID NO: 35460 - RNA, 22 nt, Homo sapiens
ugagaagacaucuuugcuuugu

SEQ ID NO: 35461 - RNA, 22 nt, Homo sapiens
ugagaauauuuuccaugucuca

SEQ ID NO: 35462 - RNA, 22 nt, Homo sapiens
ugagacugagucucgcucuauu

SEQ ID NO: 35463 - RNA, 22 nt, Homo sapiens
ugagauagggucucacucuguc

SEQ ID NO: 35464 - RNA, 22 nt, Homo sapiens
ugagaucacgccacugcacucc

SEQ ID NO: 35465 - RNA, 22 nt, Homo sapiens
ugagaucaugccacugcacuuc

SEQ ID NO: 35466 - RNA, 22 nt, Homo sapiens
ugagaugaggucucgcucuguc

SEQ ID NO: 35467 - RNA, 22 nt, Homo sapiens
ugagauguuuguuucagugccu

SEQ ID NO: 35468 - RNA, 23 nt, Homo sapiens
ugagauuacccagaaagaguaua

SEQ ID NO: 35469 - RNA, 21 nt, Homo sapiens
ugagauuauauuaacauggua

SEQ ID NO: 35470 - RNA, 22 nt, Homo sapiens
ugagauuaucguaauguaucuc

SEQ ID NO: 35471 - RNA, 22 nt, Homo sapiens
ugagcaacauuucaaaacucca

SEQ ID NO: 35472 - RNA, 22 nt, Homo sapiens
ugagcagugaguguggugcagg

SEQ ID NO: 35473 - RNA, 22 nt, Homo sapiens
ugagcugguacuaauauuauca

SEQ ID NO: 35474 - RNA, 22 nt, Homo sapiens
ugaggacugagaggcacugugg

SEQ ID NO: 35475 - RNA, 22 nt, Homo sapiens
ugaggaguguauuucauucgcu

SEQ ID NO: 35476 - RNA, 22 nt, Homo sapiens
acagucauagcagccuuuguua

SEQ ID NO: 35477 - RNA, 22 nt, Homo sapiens
acaguggugcgaucucggcuca

SEQ ID NO: 35478 - RNA, 22 nt, Homo sapiens
acaucuguacaguggguguggu

SEQ ID NO: 35479 - RNA, 22 nt, Homo sapiens
acauucagcuguuguuucaaug

SEQ ID NO: 35480 - RNA, 22 nt, Homo sapiens
acauugcagauguguuuaaugu

SEQ ID NO: 35481 - RNA, 22 nt, Homo sapiens
acccaguguucaacauucacau

SEQ ID NO: 35482 - RNA, 22 nt, Homo sapiens
acccgggaggcaggagucauag

SEQ ID NO: 35483 - RNA, 22 nt, Homo sapiens
acccuguaacauacaagugguu

SEQ ID NO: 35484 - RNA, 22 nt, Homo sapiens
accugagacuaggcauuuuaua

SEQ ID NO: 35485 - RNA, 22 nt, Homo sapiens
accugagauuacaggugcuggc

SEQ ID NO: 35486 - RNA, 22 nt, Homo sapiens
acucacagcaaccuccgccucc

SEQ ID NO: 35487 - RNA, 20 nt, Homo sapiens
acugcacuccaaccuuugug

SEQ ID NO: 35488 - RNA, 22 nt, Homo sapiens
acugcacuccagccuaggcgac

SEQ ID NO: 35489 - RNA, 22 nt, Homo sapiens
acugcacuccagccucaugaca

SEQ ID NO: 35490 - RNA, 22 nt, Homo sapiens
acugcacuccagccucguggac

SEQ ID NO: 35491 - RNA, 22 nt, Homo sapiens
acugcacuccagccugcccaac

SEQ ID NO: 35492 - RNA, 22 nt, Homo sapiens
acugcacuccagccugcugggu

SEQ ID NO: 35493 - RNA, 22 nt, Homo sapiens
acugcacuccagccuggacgaa

SEQ ID NO: 35494 - RNA, 22 nt, Homo sapiens
acugcacuccagccugugagac

SEQ ID NO: 35495 - RNA, 22 nt, Homo sapiens
acugcacuccagccuucaggac

SEQ ID NO: 35496 - RNA, 22 nt, Homo sapiens
acugcacuccagccuucgugac

SEQ ID NO: 35497 - RNA, 22 nt, Homo sapiens
acugcacuccagccuuggccac

SEQ ID NO: 35498 - RNA, 22 nt, Homo sapiens
acugcacuccagcuugggugac

SEQ ID NO: 35499 - RNA, 22 nt, Homo sapiens
acugcacuccaguuccgggcaa

SEQ ID NO: 35500 - RNA, 22 nt, Homo sapiens
acugcacuccaguuugggcagc

SEQ ID NO: 35501 - RNA, 18 nt, Homo sapiens
acugcacuccauccuagg

SEQ ID NO: 35502 - RNA, 22 nt, Homo sapiens
acugcacucccgcccgggugac

SEQ ID NO: 35503 - RNA, 22 nt, Homo sapiens
acugcacuccggccucgugaca

SEQ ID NO: 35504 - RNA, 22 nt, Homo sapiens
acugcacuccggccuggcaaca

SEQ ID NO: 35505 - RNA, 22 nt, Homo sapiens
acugcacucuagcuugggugac

SEQ ID NO: 35506 - RNA, 22 nt, Homo sapiens
acugcacugcagccuggccaac

SEQ ID NO: 35507 - RNA, 22 nt, Homo sapiens
acugcacuguccuagaguccuc

SEQ ID NO: 35508 - RNA, 22 nt, Homo sapiens
acugcacuucagccuuggcuac

SEQ ID NO: 35509 - RNA, 22 nt, Homo sapiens
acugcacuucagccuugggaaa

SEQ ID NO: 35510 - RNA, 22 nt, Homo sapiens
acugcacuucagccuugugaca

SEQ ID NO: 35511 - RNA, 22 nt, Homo sapiens
acugcauuugucugucucaauu

SEQ ID NO: 35512 - RNA, 22 nt, Homo sapiens
acuuggcaaaguuuuaaacagc

SEQ ID NO: 35513 - RNA, 22 nt, Homo sapiens
ugugccacuccaaccuggguga

SEQ ID NO: 35514 - RNA, 22 nt, Homo sapiens
ugugccacuccaggaggcuguu

SEQ ID NO: 35515 - RNA, 22 nt, Homo sapiens
ugugccacugcacuccugggug

SEQ ID NO: 35516 - RNA, 22 nt, Homo sapiens
uguggaaauaaaagaaagguua

SEQ ID NO: 35517 - RNA, 22 nt, Homo sapiens
uguuacagcagcacaaaaugga

SEQ ID NO: 35518 - RNA, 21 nt, Homo sapiens
uguuuuugcuguguaucucuc

SEQ ID NO: 35519 - RNA, 22 nt, Homo sapiens
uuaaagugaucauaaggauagu

SEQ ID NO: 35520 - RNA, 22 nt, Homo sapiens
uuaaagugcacacgggucaggc

SEQ ID NO: 35521 - RNA, 22 nt, Homo sapiens
uuaaagugcuguuuuugccggg

SEQ ID NO: 35522 - RNA, 21 nt, Homo sapiens
uuacaauggcuccuugaaggu

SEQ ID NO: 35523 - RNA, 19 nt, Homo sapiens
uuacagugugcccuuuuag

SEQ ID NO: 35524 - RNA, 22 nt, Homo sapiens
uuacuguauagaaucaucuuga

SEQ ID NO: 35525 - RNA, 22 nt, Homo sapiens
uuagccggguguguuggcgggc

SEQ ID NO: 35526 - RNA, 22 nt, Homo sapiens
uuaggcaguuuauugauuuuca

SEQ ID NO: 35527 - RNA, 23 nt, Homo sapiens
uuaguaaacucaaugacaccaca

SEQ ID NO: 35528 - RNA, 22 nt, Homo sapiens
uuauuagagauauuugguuagg

SEQ ID NO: 35529 - RNA, 20 nt, Homo sapiens
uuauugcggcaucauucaug

SEQ ID NO: 35530 - RNA, 22 nt, Homo sapiens
uucaaaguaaagggauggagac

SEQ ID NO: 35531 - RNA, 22 nt, Homo sapiens
uucucaguucgguggcagugcu

SEQ ID NO: 35532 - RNA, 22 nt, Homo sapiens
uucucauggaacaucuguacug

SEQ ID NO: 35533 - RNA, 22 nt, Homo sapiens
uucuuuggauaaaguuuuaugc

SEQ ID NO: 35534 - RNA, 22 nt, Homo sapiens
uugaaguaguacuuuauuauag

SEQ ID NO: 35535 - RNA, 22 nt, Homo sapiens
uugagacgaagucucacucuug

SEQ ID NO: 35536 - RNA, 22 nt, Homo sapiens
uugagauggagcuucacucuug

SEQ ID NO: 35537 - RNA, 22 nt, Homo sapiens
uugagauggagucucacucugc

SEQ ID NO: 35538 - RNA, 22 nt, Homo sapiens
uugagauggagucucacucugu

SEQ ID NO: 35539 - RNA, 23 nt, Homo sapiens
uugaggcauguaccaucaauauc

SEQ ID NO: 35540 - RNA, 22 nt, Homo sapiens
uugcaaagaccucuucacuucc

SEQ ID NO: 35541 - RNA, 22 nt, Homo sapiens
uugcacuccagccugggugaca

SEQ ID NO: 35542 - RNA, 22 nt, Homo sapiens
uugcacuccagcucuaggugac

SEQ ID NO: 35543 - RNA, 18 nt, Homo sapiens
uugcacuccugccugggu

SEQ ID NO: 35544 - RNA, 22 nt, Homo sapiens
uugcauaagugcauucugugau

SEQ ID NO: 35545 - RNA, 22 nt, Homo sapiens
uugcauuagugugguacauuug

SEQ ID NO: 35546 - RNA, 22 nt, Homo sapiens
uuggacuuuaagauagagaugu

SEQ ID NO: 35547 - RNA, 22 nt, Homo sapiens
uuggcaagaauguaugccgauc

SEQ ID NO: 35548 - RNA, 22 nt, Homo sapiens
uuggcauugaguuucaaaucau

SEQ ID NO: 35549 - RNA, 22 nt, Homo sapiens
uugggauaaucacaaaguaaaa

SEQ ID NO: 35550 - RNA, 22 nt, Homo sapiens
uugguuaccuucagaaaugagu

SEQ ID NO: 35551 - RNA, 22 nt, Homo sapiens
uuguacccuuucuaugaggcca

SEQ ID NO: 35552 - RNA, 22 nt, Homo sapiens
uugugcuuaaugaguguaaggu

SEQ ID NO: 35553 - RNA, 22 nt, Homo sapiens
uuguguuugaugcugacacgca

SEQ ID NO: 35554 - RNA, 20 nt, Homo sapiens
uuuaagacaugcugaauuga

SEQ ID NO: 35555 - RNA, 22 nt, Homo sapiens
uuuaauacugcaucuuuacucu

SEQ ID NO: 35556 - RNA, 19 nt, Homo sapiens
uuucacacucgccuacuuc

SEQ ID NO: 35557 - RNA, 22 nt, Homo sapiens
uuucacagcugucuuccgucuc

SEQ ID NO: 35558 - RNA, 19 nt, Homo sapiens
uuuccaguaaucuuaugug

SEQ ID NO: 35559 - RNA, 22 nt, Homo sapiens
uuugacaaugugugcuuguauu

SEQ ID NO: 35560 - RNA, 22 nt, Homo sapiens
uuugccaaugggaauuuuccua

SEQ ID NO: 35561 - RNA, 22 nt, Homo sapiens
uuugcuuaaaucuuaaucagau

SEQ ID NO: 35562 - RNA, 22 nt, Homo sapiens
uuuggauagugugguccuuuua

SEQ ID NO: 35563 - RNA, 22 nt, Homo sapiens
uuuggucuuuuauuuaaagcag

SEQ ID NO: 35564 - RNA, 22 nt, Homo sapiens
uuuguaauaccugaggcugggu

SEQ ID NO: 35565 - RNA, 23 nt, Homo sapiens
uuuguguccccacccaaaucuca

SEQ ID NO: 35566 - RNA, 22 nt, Homo sapiens
uuuuaguggaauauuuacaguu

SEQ ID NO: 35567 - RNA, 22 nt, Homo sapiens
uuuugcaauauguuccugaaua

SEQ ID NO: 35568 - RNA, 22 nt, Homo sapiens
uuuugcucuucggaagagcuug

SEQ ID NO: 35569 - RNA, 22 nt, Homo sapiens
uuuuuugguaauugaacaauga

SEQ ID NO: 35570 - RNA, 22 nt, Homo sapiens
augcuacuggacaauggugacu

SEQ ID NO: 35571 - RNA, 21 nt, Homo sapiens
auggaaagacugccucuucaa

SEQ ID NO: 35572 - RNA, 22 nt, Homo sapiens
auggcaauaauagcuaccauuu

SEQ ID NO: 35573 - RNA, 22 nt, Homo sapiens
auggcaaugcgauggugacuga

SEQ ID NO: 35574 - RNA, 22 nt, Homo sapiens
auggcagaaucaagccgacagc

SEQ ID NO: 35575 - RNA, 22 nt, Homo sapiens
auggcuagauuguaugguaguu

SEQ ID NO: 35576 - RNA, 22 nt, Homo sapiens
auggcucaauucuuucccugaa

SEQ ID NO: 35577 - RNA, 22 nt, Homo sapiens
augucauagauaaggaagugga

SEQ ID NO: 35578 - RNA, 17 nt, Homo sapiens
augugaauguucaaaua

SEQ ID NO: 35579 - RNA, 22 nt, Homo sapiens
auuaaucaggcaaugcuugcua

SEQ ID NO: 35580 - RNA, 22 nt, Homo sapiens
auucacagggggagaaggguau

SEQ ID NO: 35581 - RNA, 22 nt, Homo sapiens
auugcaacuuccgccuccuggg

SEQ ID NO: 35582 - RNA, 21 nt, Homo sapiens
auugcacuccagccugggcga

SEQ ID NO: 35583 - RNA, 22 nt, Homo sapiens
auugcacuccagccugggcgac

SEQ ID NO: 35584 - RNA, 22 nt, Homo sapiens
auugcacuccagccugggugag

SEQ ID NO: 35585 - RNA, 22 nt, Homo sapiens
auugcacuccggccugggugac

SEQ ID NO: 35586 - RNA, 22 nt, Homo sapiens
auugcacucuagccugggugac

SEQ ID NO: 35587 - RNA, 22 nt, Homo sapiens
auugcaguuucaacuccagggc

SEQ ID NO: 35588 - RNA, 22 nt, Homo sapiens
auugcuuacuaaucaucuucag

SEQ ID NO: 35589 - RNA, 22 nt, Homo sapiens
auuggaguuguacgcacgcuca

SEQ ID NO: 35590 - RNA, 22 nt, Homo sapiens
auuggucuauuaaaccuaaguu

SEQ ID NO: 35591 - RNA, 22 nt, Homo sapiens
auuggucuugaaaccagagaga

SEQ ID NO: 35592 - RNA, 22 nt, Homo sapiens
auuguaauuuuagagaaagugg

SEQ ID NO: 35593 - RNA, 22 nt, Homo sapiens
auuguguagucuuacugcuugc

SEQ ID NO: 35594 - RNA, 22 nt, Homo sapiens
auuuggcaguauaaugcuuugg

SEQ ID NO: 35595 - RNA, 22 nt, Homo sapiens
auuugggaaugugcauuauacu

SEQ ID NO: 35596 - RNA, 22 nt, Homo sapiens
caaagugcugggaugggccagg

SEQ ID NO: 35597 - RNA, 22 nt, Homo sapiens
caaauacuuucauguugucuug

SEQ ID NO: 35598 - RNA, 21 nt, Homo sapiens
caaugacacuguagcugugcu

SEQ ID NO: 35599 - RNA, 22 nt, Homo sapiens
cacagcacaggcaugaguguca

SEQ ID NO: 35600 - RNA, 22 nt, Homo sapiens
caccugagcgggaugcucgccu

SEQ ID NO: 35601 - RNA, 22 nt, Homo sapiens
cacugcacuccagucugacgac

SEQ ID NO: 35602 - RNA, 22 nt, Homo sapiens
cacugcacuccaguuucgguaa

SEQ ID NO: 35603 - RNA, 22 nt, Homo sapiens
cacugcacuccaguuuggauga

SEQ ID NO: 35604 - RNA, 22 nt, Homo sapiens
cacuggacauguugaagcuuuu

SEQ ID NO: 35605 - RNA, 22 nt, Homo sapiens
cacuggcacuguguuuagaugg

SEQ ID NO: 35606 - RNA, 22 nt, Homo sapiens
cagauacuggaguccugaaguu

SEQ ID NO: 35607 - RNA, 22 nt, Homo sapiens
cagauggucuuaaggcagccuu

SEQ ID NO: 35608 - RNA, 22 nt, Homo sapiens
cagccgggugagguggcuuguu

SEQ ID NO: 35609 - RNA, 22 nt, Homo sapiens
caggaaugugaggguucccugc

SEQ ID NO: 35610 - RNA, 22 nt, Homo sapiens
caggcagucuggcucccaagug

SEQ ID NO: 35611 - RNA, 22 nt, Homo sapiens
gugauuauccacgucuuuguga

SEQ ID NO: 35612 - RNA, 22 nt, Homo sapiens
gugcaguuuacaguuacccagu

SEQ ID NO: 35613 - RNA, 22 nt, Homo sapiens
gugcaguuuugagugaguuucu

SEQ ID NO: 35614 - RNA, 22 nt, Homo sapiens
guggaaaauuauugcuguuuuu

SEQ ID NO: 35615 - RNA, 22 nt, Homo sapiens
guggaaagaacacaaaauuagg

SEQ ID NO: 35616 - RNA, 22 nt, Homo sapiens
guggaaaucucugugugacuua

SEQ ID NO: 35617 - RNA, 22 nt, Homo sapiens
guggaucacuugaggucaagag

SEQ ID NO: 35618 - RNA, 22 nt, Homo sapiens
guggcaagaauguacaaaaggu

SEQ ID NO: 35619 - RNA, 22 nt, Homo sapiens
guggcuagaaugaagguagcug

SEQ ID NO: 35620 - RNA, 22 nt, Homo sapiens
guguaauacacacauauaugca

SEQ ID NO: 35621 - RNA, 22 nt, Homo sapiens
gugucucagcccagaccuauuu

SEQ ID NO: 35622 - RNA, 22 nt, Homo sapiens
guuaagaaguguaacuuaaguu

SEQ ID NO: 35623 - RNA, 20 nt, Homo sapiens
guucacagagguuaugauua

SEQ ID NO: 35624 - RNA, 22 nt, Homo sapiens
guucaguuuugaaauguuaauu

SEQ ID NO: 35625 - RNA, 22 nt, Homo sapiens
guuggucucguauaaaucaagg

SEQ ID NO: 35626 - RNA, 22 nt, Homo sapiens
uaaagcauguaauuagguuaga

SEQ ID NO: 35627 - RNA, 20 nt, Homo sapiens
uaaaugccucaugcuuuauu

SEQ ID NO: 35628 - RNA, 22 nt, Homo sapiens
uaacaagagagucagucagucc

SEQ ID NO: 35629 - RNA, 22 nt, Homo sapiens
uaacuucaucauaagucaagaa

SEQ ID NO: 35630 - RNA, 18 nt, Homo sapiens
uaaggcacuauaggcauu

SEQ ID NO: 35631 - RNA, 22 nt, Homo sapiens
uaagugaauuucacuacugagu

SEQ ID NO: 35632 - RNA, 22 nt, Homo sapiens
uaaguuagugugagaauuuugc

SEQ ID NO: 35633 - RNA, 22 nt, Homo sapiens
uaauacauucaaggugguaguu

SEQ ID NO: 35634 - RNA, 22 nt, Homo sapiens
uaauagcaguguuacuaggacu

SEQ ID NO: 35635 - RNA, 22 nt, Homo sapiens
uaauaguguuaaugcuagagcu

SEQ ID NO: 35636 - RNA, 22 nt, Homo sapiens
uaaucucagcuacucaggaggc

SEQ ID NO: 35637 - RNA, 23 nt, Homo sapiens
uacagcugcagaaucaggcuaag

SEQ ID NO: 35638 - RNA, 22 nt, Homo sapiens
uacaggcaccuggcuaauuuuu

SEQ ID NO: 35639 - RNA, 22 nt, Homo sapiens
uacaggcagguguucccugguu

SEQ ID NO: 35640 - RNA, 22 nt, Homo sapiens
uacaguaguaucuucauuuguu

SEQ ID NO: 35641 - RNA, 22 nt, Homo sapiens
uacagucacauuccugaccaua

SEQ ID NO: 35642 - RNA, 23 nt, Homo sapiens
uaccugagacuggguaauuaaua

SEQ ID NO: 35643 - RNA, 22 nt, Homo sapiens
uaccuguagacuacagcuucag

SEQ ID NO: 35644 - RNA, 22 nt, Homo sapiens
uacuacuuucugacaucuuuaa

SEQ ID NO: 35645 - RNA, 22 nt, Homo sapiens
uacugcacuccagccugccaac

SEQ ID NO: 35646 - RNA, 18 nt, Homo sapiens
uacugcacucuccagccu

SEQ ID NO: 35647 - RNA, 22 nt, Homo sapiens
uagagcaaugacucuggaaacc

SEQ ID NO: 35648 - RNA, 21 nt, Homo sapiens
uagauacuguauuaaaccuag

SEQ ID NO: 35649 - RNA, 22 nt, Homo sapiens
uagcugcacuuacaagugagaa

SEQ ID NO: 35650 - RNA, 22 nt, Homo sapiens
uaggaaugaacgauuuauuggu

SEQ ID NO: 35651 - RNA, 22 nt, Homo sapiens
uaggacacaggacauauguaga

SEQ ID NO: 35652 - RNA, 23 nt, Homo sapiens
uagguuauuugguaaauauaugu

SEQ ID NO: 35653 - RNA, 22 nt, Homo sapiens
uagguugucaucagucuccacu

SEQ ID NO: 35654 - RNA, 22 nt, Homo sapiens
uagugcccuuauaagagcagga

SEQ ID NO: 35655 - RNA, 22 nt, Homo sapiens
uauaugcauugugggguacuga

SEQ ID NO: 35656 - RNA, 22 nt, Homo sapiens
uauaugucugagacugggggau

SEQ ID NO: 35657 - RNA, 22 nt, Homo sapiens
uauauguucuugcacuggaaag

SEQ ID NO: 35658 - RNA, 22 nt, Homo sapiens
uaucaaguuggaagagaaguaa

SEQ ID NO: 35659 - RNA, 22 nt, Homo sapiens
uaucagaguuacacugaagacu

SEQ ID NO: 35660 - RNA, 22 nt, Homo sapiens
uaucagcagagucauacuucaa

SEQ ID NO: 35661 - RNA, 22 nt, Homo sapiens
aaagaagucagccuguccuuug

SEQ ID NO: 35662 - RNA, 22 nt, Homo sapiens
aaagagaucuaugggcacuaug

SEQ ID NO: 35663 - RNA, 22 nt, Homo sapiens
aaaggcacugaucuuauccagu

SEQ ID NO: 35664 - RNA, 22 nt, Homo sapiens
aaagggcuguuucuugacuugg

SEQ ID NO: 35665 - RNA, 22 nt, Homo sapiens
aaagucuagaggaucaugugug

SEQ ID NO: 35666 - RNA, 22 nt, Homo sapiens
aaagugcuaggauuaccugggg

SEQ ID NO: 35667 - RNA, 22 nt, Homo sapiens
aaagugcugagacagacuggga

SEQ ID NO: 35668 - RNA, 22 nt, Homo sapiens
aaagugcugagauuguaggcau

SEQ ID NO: 35669 - RNA, 22 nt, Homo sapiens
aaagugucuguuccuagcauga

SEQ ID NO: 35670 - RNA, 22 nt, Homo sapiens
aaaugcagucuuuguucugggc

SEQ ID NO: 35671 - RNA, 22 nt, Homo sapiens
aaauugcaguuaggaugauggu

SEQ ID NO: 35672 - RNA, 23 nt, Homo sapiens
aaauuugccuauuauuccuaugg

SEQ ID NO: 35673 - RNA, 22 nt, Homo sapiens
aacagcacacccgcugcuucca

SEQ ID NO: 35674 - RNA, 20 nt, Homo sapiens
aacagcacugucugaagcuu

SEQ ID NO: 35675 - RNA, 22 nt, Homo sapiens
aacauguuuagcagauaccugu

SEQ ID NO: 35676 - RNA, 22 nt, Homo sapiens
aagcuccauuucugccaugaga

SEQ ID NO: 35677 - RNA, 22 nt, Homo sapiens
aagcugguuuuauaucugugag

SEQ ID NO: 35678 - RNA, 22 nt, Homo sapiens
aaggcacugaacuuaaauucug

SEQ ID NO: 35679 - RNA, 22 nt, Homo sapiens
aaggcuauuugagaaugugugu

SEQ ID NO: 35680 - RNA, 22 nt, Homo sapiens
aagggagcugcauaaucuugug

SEQ ID NO: 35681 - RNA, 22 nt, Homo sapiens
aagguguagucucuggauaagc

SEQ ID NO: 35682 - RNA, 19 nt, Homo sapiens
aaguaguugugacagaugc

SEQ ID NO: 35683 - RNA, 22 nt, Homo sapiens
aagugcuguaugggagccuagg

SEQ ID NO: 35684 - RNA, 22 nt, Homo sapiens
aagugucagaguugcuaaugac

SEQ ID NO: 35685 - RNA, 22 nt, Homo sapiens
aauacugaaaguauuuucaaau

SEQ ID NO: 35686 - RNA, 22 nt, Homo sapiens
aaucacuuuggcaccaaccuaa

SEQ ID NO: 35687 - RNA, 22 nt, Homo sapiens
aaugacacugagcaucuuucau

SEQ ID NO: 35688 - RNA, 22 nt, Homo sapiens
aaugcaagauguuaauuauagg

SEQ ID NO: 35689 - RNA, 22 nt, Homo sapiens
aaugcacuccagccugggcgac

SEQ ID NO: 35690 - RNA, 22 nt, Homo sapiens
aaugcuguucuuugcuuaaguu

SEQ ID NO: 35691 - RNA, 22 nt, Homo sapiens
aauggcacaagaguaaacuguu

SEQ ID NO: 35692 - RNA, 22 nt, Homo sapiens
aaugguuuuaucagcguccaaa

SEQ ID NO: 35693 - RNA, 22 nt, Homo sapiens
aaugucaucuucaguuguacag

SEQ ID NO: 35694 - RNA, 22 nt, Homo sapiens
aaugugcuucuggcugugguca

SEQ ID NO: 35695 - RNA, 22 nt, Homo sapiens
acagcagugccccacucuacug

SEQ ID NO: 35696 - RNA, 22 nt, Homo sapiens
acaguacaugauaaauaaggua

SEQ ID NO: 35697 - RNA, 22 nt, Homo sapiens
gcccugagauucuuggauucug

SEQ ID NO: 35698 - RNA, 22 nt, Homo sapiens
gcccuuugugucuggcuggggu

SEQ ID NO: 35699 - RNA, 22 nt, Homo sapiens
ggaaagcuagguguggguguac

SEQ ID NO: 35700 - RNA, 22 nt, Homo sapiens
ggaagaauaaugggccuuagag

SEQ ID NO: 35701 - RNA, 22 nt, Homo sapiens
ggaagccugcacucgggcaggg

SEQ ID NO: 35702 - RNA, 22 nt, Homo sapiens
ggaauauaaaacuuuugacagg

SEQ ID NO: 35703 - RNA, 22 nt, Homo sapiens
ggacacaucaugugaccaaggu

SEQ ID NO: 35704 - RNA, 22 nt, Homo sapiens
ggaucacagccagcucccagaa

SEQ ID NO: 35705 - RNA, 22 nt, Homo sapiens
ggaucuauuucaugauaaccuu

SEQ ID NO: 35706 - RNA, 22 nt, Homo sapiens
ggcaagaggagauucugcuccc

SEQ ID NO: 35707 - RNA, 22 nt, Homo sapiens
ggcaagaucuuggcucacugaa

SEQ ID NO: 35708 - RNA, 22 nt, Homo sapiens
ggcaaggaggggcacuuucacu

SEQ ID NO: 35709 - RNA, 20 nt, Homo sapiens
ggcaagguagcauuucuucu

SEQ ID NO: 35710 - RNA, 22 nt, Homo sapiens
ggcacaguuaagugcuaccuaa

SEQ ID NO: 35711 - RNA, 22 nt, Homo sapiens
ggcacgguggcucacgccugua

SEQ ID NO: 35712 - RNA, 22 nt, Homo sapiens
ggcaugguggugugugccuaua

SEQ ID NO: 35713 - RNA, 22 nt, Homo sapiens
ggccggguggccauggcugccc

SEQ ID NO: 35714 - RNA, 22 nt, Homo sapiens
ggcuagaugcuagagauaucau

SEQ ID NO: 35715 - RNA, 22 nt, Homo sapiens
gggagguuguauguaugcgggg

SEQ ID NO: 35716 - RNA, 22 nt, Homo sapiens
gguggucuuccccuggaguucg

SEQ ID NO: 35717 - RNA, 22 nt, Homo sapiens
guaaguauuaggugugagauuc

SEQ ID NO: 35718 - RNA, 22 nt, Homo sapiens
guaauaccuuccccugcuggag

SEQ ID NO: 35719 - RNA, 22 nt, Homo sapiens
guaaucucagcuacucaggagg

SEQ ID NO: 35720 - RNA, 22 nt, Homo sapiens
guaaucucagcuacuugggagc

SEQ ID NO: 35721 - RNA, 22 nt, Homo sapiens
guaaucucagcuucuugggagg

SEQ ID NO: 35722 - RNA, 22 nt, Homo sapiens
guacaguacugaaugaauguau

SEQ ID NO: 35723 - RNA, 22 nt, Homo sapiens
guacaguaguaaaagugaauga

SEQ ID NO: 35724 - RNA, 22 nt, Homo sapiens
guagaaagcauuucagauuugc

SEQ ID NO: 35725 - RNA, 22 nt, Homo sapiens
guagaaaguuugcugucacaug

SEQ ID NO: 35726 - RNA, 22 nt, Homo sapiens
guagagugcugggcacuggcuc

SEQ ID NO: 35727 - RNA, 22 nt, Homo sapiens
guaucauugccuaaugcucuca

SEQ ID NO: 35728 - RNA, 22 nt, Homo sapiens
gucagaaucucagaugacaacg

SEQ ID NO: 35729 - RNA, 22 nt, Homo sapiens
gucaggugcuuacgcggagauc

SEQ ID NO: 35730 - RNA, 22 nt, Homo sapiens
gugaaacuggguggugagagac

SEQ ID NO: 35731 - RNA, 22 nt, Homo sapiens
gugacacagcaagacuccgucu

SEQ ID NO: 35732 - RNA, 22 nt, Homo sapiens
gugaccucuguugcugucacua

SEQ ID NO: 35733 - RNA, 21 nt, Homo sapiens
gugaggaguuacuggcuuuga

SEQ ID NO: 35734 - RNA, 22 nt, Homo sapiens
gugccacugcacuccggccugg

SEQ ID NO: 35735 - RNA, 22 nt, Homo sapiens
guggaaaacauaugcuuguuga

SEQ ID NO: 35736 - RNA, 19 nt, Homo sapiens
gugguauuaccuuuugauu

SEQ ID NO: 35737 - RNA, 22 nt, Homo sapiens
gugucaguggggagugaucuuc

SEQ ID NO: 35738 - RNA, 22 nt, Homo sapiens
guuauuaguugauauuaaguuc

SEQ ID NO: 35739 - RNA, 22 nt, Homo sapiens
guucaaggaauguuggcuucuc

SEQ ID NO: 35740 - RNA, 22 nt, Homo sapiens
guucucacuggacugugaaaau

SEQ ID NO: 35741 - RNA, 22 nt, Homo sapiens
guucucacuggugcugguaagu

SEQ ID NO: 35742 - RNA, 22 nt, Homo sapiens
guugguuuccuguaacuggaca

SEQ ID NO: 35743 - RNA, 22 nt, Homo sapiens
guuuuuggggucacuauuaccg

SEQ ID NO: 35744 - RNA, 22 nt, Homo sapiens
uaaaguguuuguuauuaaaggu

SEQ ID NO: 35745 - RNA, 22 nt, Homo sapiens
uaacugcaaccuccgccucccg

SEQ ID NO: 35746 - RNA, 22 nt, Homo sapiens
uaaggcaaucagucaugguguu

SEQ ID NO: 35747 - RNA, 22 nt, Homo sapiens
uaaguauuuuaauuccuggcau

SEQ ID NO: 35748 - RNA, 22 nt, Homo sapiens
uaagugaauauggacaguuagc

SEQ ID NO: 35749 - RNA, 22 nt, Homo sapiens
uaaguucauucaugaaacuuag

SEQ ID NO: 35750 - RNA, 22 nt, Homo sapiens
uaauacuugucauaaaggcauu

SEQ ID NO: 35751 - RNA, 22 nt, Homo sapiens
uaauccuggcacuuugggaggc

SEQ ID NO: 35752 - RNA, 22 nt, Homo sapiens
uacaaagcuuucugcaaaucau

SEQ ID NO: 35753 - RNA, 22 nt, Homo sapiens
uacaauagugacaaaucagcau

SEQ ID NO: 35754 - RNA, 22 nt, Homo sapiens
uacagccacauaauguaugauu

SEQ ID NO: 35755 - RNA, 22 nt, Homo sapiens
uacaggaaugucagguugcugu

SEQ ID NO: 35756 - RNA, 22 nt, Homo sapiens
uacaguacagugacaccauuau

SEQ ID NO: 35757 - RNA, 22 nt, Homo sapiens
uacauguauguguuuauggcug

SEQ ID NO: 35758 - RNA, 22 nt, Homo sapiens
uaccucaguucaauaacagaua

SEQ ID NO: 35759 - RNA, 22 nt, Homo sapiens
uaccugagcccucugcugaguu

SEQ ID NO: 35760 - RNA, 20 nt, Homo sapiens
uacugcacuccaaccuaggc

SEQ ID NO: 35761 - RNA, 22 nt, Homo sapiens
uagaauggaaggcauguuugcc

SEQ ID NO: 35762 - RNA, 22 nt, Homo sapiens
uagaccauucuauuuccuaugc

SEQ ID NO: 35763 - RNA, 22 nt, Homo sapiens
uagcaccuuagcauuucuagug

SEQ ID NO: 35764 - RNA, 19 nt, Homo sapiens
uaggugguuuuccccucac

SEQ ID NO: 35765 - RNA, 22 nt, Homo sapiens
uaguaguuuuguguauaauaau

SEQ ID NO: 35766 - RNA, 20 nt, Homo sapiens
uaguggcaugcaccuguagc

SEQ ID NO: 35767 - RNA, 22 nt, Homo sapiens
uauaaccauuucuucucucuuc

SEQ ID NO: 35768 - RNA, 22 nt, Homo sapiens
uauaguuuuuccugggaggaaa

SEQ ID NO: 35769 - RNA, 22 nt, Homo sapiens
uauauguuuucauaaggcuaga

SEQ ID NO: 35770 - RNA, 22 nt, Homo sapiens
uaucacagguggacugcacacc

SEQ ID NO: 35771 - RNA, 22 nt, Homo sapiens
uaucaccuugcaggagcuauga

SEQ ID NO: 35772 - RNA, 21 nt, Homo sapiens
uaucagagacauugagaggca

SEQ ID NO: 35773 - RNA, 22 nt, Homo sapiens
uaucagagcugucagccuaccu

SEQ ID NO: 35774 - RNA, 22 nt, Homo sapiens
uaucaguauggauucauggauu

SEQ ID NO: 35775 - RNA, 22 nt, Homo sapiens
aaaagucuguagugaaagguga

SEQ ID NO: 35776 - RNA, 22 nt, Homo sapiens
aaagaguucagguagauuucaa

SEQ ID NO: 35777 - RNA, 22 nt, Homo sapiens
aaagggcuugaauacucuuuuu

SEQ ID NO: 35778 - RNA, 22 nt, Homo sapiens
aaagggcuuuguaaacuucaag

SEQ ID NO: 35779 - RNA, 22 nt, Homo sapiens
aaagugcugggaucacacugaa

SEQ ID NO: 35780 - RNA, 22 nt, Homo sapiens
aaaguggacuaagugaauauga

SEQ ID NO: 35781 - RNA, 22 nt, Homo sapiens
aaauugcuuuugaagacuuagu

SEQ ID NO: 35782 - RNA, 22 nt, Homo sapiens
aaccacauggcucaguggacau

SEQ ID NO: 35783 - RNA, 22 nt, Homo sapiens
aagagcucauccauaguuguca

SEQ ID NO: 35784 - RNA, 22 nt, Homo sapiens
aagaggcuguaggauaaugccu

SEQ ID NO: 35785 - RNA, 22 nt, Homo sapiens
aagagguaauaacaaagcuucu

SEQ ID NO: 35786 - RNA, 22 nt, Homo sapiens
aagcaucauuuggaauuugaga

SEQ ID NO: 35787 - RNA, 22 nt, Homo sapiens
aagccacuguaccugucucuua

SEQ ID NO: 35788 - RNA, 22 nt, Homo sapiens
aagcuggagugcaguggugcga

SEQ ID NO: 35789 - RNA, 22 nt, Homo sapiens
aagguaguuagaaaauauaacu

SEQ ID NO: 35790 - RNA, 22 nt, Homo sapiens
aaguauuagugaggauauggaa

SEQ ID NO: 35791 - RNA, 22 nt, Homo sapiens
aagugcaaauucccaggcucug

SEQ ID NO: 35792 - RNA, 22 nt, Homo sapiens
aagugcucuugaaacugucuua

SEQ ID NO: 35793 - RNA, 22 nt, Homo sapiens
aaguugcuuuagguaagucaau

SEQ ID NO: 35794 - RNA, 22 nt, Homo sapiens
aauaauggcaccaaagcacaag

SEQ ID NO: 35795 - RNA, 22 nt, Homo sapiens
aauacucuauaagggaagcugu

SEQ ID NO: 35796 - RNA, 22 nt, Homo sapiens
aauauguccuugaaauggugcu

SEQ ID NO: 35797 - RNA, 22 nt, Homo sapiens
aauccaugugcuuuaccauuuu

SEQ ID NO: 35798 - RNA, 22 nt, Homo sapiens
aaucccuggacuuucggaggcu

SEQ ID NO: 35799 - RNA, 22 nt, Homo sapiens
aaucucagcauuuugggcugag

SEQ ID NO: 35800 - RNA, 22 nt, Homo sapiens
aaugacugugauauuuuucuuc

SEQ ID NO: 35801 - RNA, 22 nt, Homo sapiens
guaaucucaccuacuugggagg

SEQ ID NO: 35802 - RNA, 22 nt, Homo sapiens
guaaucucagcuacuugggagu

SEQ ID NO: 35803 - RNA, 22 nt, Homo sapiens
guacaggcagcaaacaccauaa

SEQ ID NO: 35804 - RNA, 22 nt, Homo sapiens
guacaguauaguaauaggauuu

SEQ ID NO: 35805 - RNA, 22 nt, Homo sapiens
guagagagaaauacaaagcugu

SEQ ID NO: 35806 - RNA, 22 nt, Homo sapiens
guagcagaauaucagauaauuu

SEQ ID NO: 35807 - RNA, 22 nt, Homo sapiens
guaucccuugcuaucugaaucu

SEQ ID NO: 35808 - RNA, 22 nt, Homo sapiens
uccugagaauagaguugcaugu

SEQ ID NO: 35809 - RNA, 22 nt, Homo sapiens
uccuugagucuuugcucagaug

SEQ ID NO: 35810 - RNA, 22 nt, Homo sapiens
ucguucuugucaguuuauaaag

SEQ ID NO: 35811 - RNA, 22 nt, Homo sapiens
ucucacaccccucucauauacc

SEQ ID NO: 35812 - RNA, 19 nt, Homo sapiens
ucucacagcucuacuaugu

SEQ ID NO: 35813 - RNA, 22 nt, Homo sapiens
ucucagcacaaacaaaauugcu

SEQ ID NO: 35814 - RNA, 22 nt, Homo sapiens
ucugacaaugaacaaucuauag

SEQ ID NO: 35815 - RNA, 22 nt, Homo sapiens
ucugagguaggugcauggauac

SEQ ID NO: 35816 - RNA, 22 nt, Homo sapiens
ucugaguggcagaaugagcuga

SEQ ID NO: 35817 - RNA, 22 nt, Homo sapiens
ucuucagucauauuggccugga

SEQ ID NO: 35818 - RNA, 22 nt, Homo sapiens
ucuucaugcuugaaauaauagc

SEQ ID NO: 35819 - RNA, 22 nt, Homo sapiens
ucuugaacuucauaggucuaga

SEQ ID NO: 35820 - RNA, 22 nt, Homo sapiens
ucuuuuugagucaguuucggua

SEQ ID NO: 35821 - RNA, 22 nt, Homo sapiens
ugaauauuugcuacucacucuu

SEQ ID NO: 35822 - RNA, 22 nt, Homo sapiens
ugaauguacacgcguacuuguu

SEQ ID NO: 35823 - RNA, 22 nt, Homo sapiens
ugacagagaagcauugaguuca

SEQ ID NO: 35824 - RNA, 23 nt, Homo sapiens
ugacugaguauauguuuggugcu

SEQ ID NO: 35825 - RNA, 23 nt, Homo sapiens
ugacuggagacuguugauccuuu

SEQ ID NO: 35826 - RNA, 22 nt, Homo sapiens
ugacuugaggcucgcacaaguu

SEQ ID NO: 35827 - RNA, 22 nt, Homo sapiens
ugacuugaguaacuggcucagg

SEQ ID NO: 35828 - RNA, 22 nt, Homo sapiens
ugagacggagucucacucuguu

SEQ ID NO: 35829 - RNA, 22 nt, Homo sapiens
ugagacugagucucccucuguc

SEQ ID NO: 35830 - RNA, 22 nt, Homo sapiens
ugagacugagucuugcucuauu

SEQ ID NO: 35831 - RNA, 22 nt, Homo sapiens
ugagaggugaauggcaggcuca

SEQ ID NO: 35832 - RNA, 22 nt, Homo sapiens
ugagaggugauaaagcaagggu

SEQ ID NO: 35833 - RNA, 22 nt, Homo sapiens
ugagaugaagcuagaagaaugg

SEQ ID NO: 35834 - RNA, 22 nt, Homo sapiens
ugagaugaagucucacucuguc

SEQ ID NO: 35835 - RNA, 22 nt, Homo sapiens
ugagaugaggucucacucuguu

SEQ ID NO: 35836 - RNA, 22 nt, Homo sapiens
ugagaugaguucucgcucuguc

SEQ ID NO: 35837 - RNA, 22 nt, Homo sapiens
ugagauuacguucggcccacuu

SEQ ID NO: 35838 - RNA, 22 nt, Homo sapiens
ugagcagagaagugcccugcgc

SEQ ID NO: 35839 - RNA, 22 nt, Homo sapiens
ugaucacagcuugacuaaagga

SEQ ID NO: 35840 - RNA, 22 nt, Homo sapiens
ugaugaaguauaggaagggcuu

SEQ ID NO: 35841 - RNA, 22 nt, Homo sapiens
ugauuggagaugaauuucguuu

SEQ ID NO: 35842 - RNA, 22 nt, Homo sapiens
ugcaccacugcacuccaggcug

SEQ ID NO: 35843 - RNA, 22 nt, Homo sapiens
ugcaucacaguacuccagccug

SEQ ID NO: 35844 - RNA, 22 nt, Homo sapiens
ugcauggaagggagggaaagag

SEQ ID NO: 35845 - RNA, 22 nt, Homo sapiens
ugcauggagcucucuuuggacu

SEQ ID NO: 35846 - RNA, 21 nt, Homo sapiens
ugcauugucuugaguuuaaau

SEQ ID NO: 35847 - RNA, 22 nt, Homo sapiens
ugccaagaacauuuucuguuuu

SEQ ID NO: 35848 - RNA, 22 nt, Homo sapiens
ugccagaugcuggugugagggg

SEQ ID NO: 35849 - RNA, 22 nt, Homo sapiens
ugccauugcacuccagccuggg

SEQ ID NO: 35850 - RNA, 22 nt, Homo sapiens
ugccuaggcuggaaugcaaugg

SEQ ID NO: 35851 - RNA, 16 nt, Homo sapiens
ugccuucuucuguauu

SEQ ID NO: 35852 - RNA, 22 nt, Homo sapiens
ugcgauuauuaugucacuuccu

SEQ ID NO: 35853 - RNA, 22 nt, Homo sapiens
ugcgccauugcauuccagccug

SEQ ID NO: 35854 - RNA, 22 nt, Homo sapiens
ugcugcuguuaucauuuuacca

SEQ ID NO: 35855 - RNA, 22 nt, Homo sapiens
ugcuggugucaucaaggcuuug

SEQ ID NO: 35856 - RNA, 22 nt, Homo sapiens
ugcugguguuuaggaauaagaa

SEQ ID NO: 35857 - RNA, 22 nt, Homo sapiens
uggaaggcuucauauguaaaga

SEQ ID NO: 35858 - RNA, 22 nt, Homo sapiens
uggcaagaacaacaauuacuuu

SEQ ID NO: 35859 - RNA, 22 nt, Homo sapiens
uggcaagagcugcauucaucug

SEQ ID NO: 35860 - RNA, 20 nt, Homo sapiens
uggcaagauggcagaauaga

SEQ ID NO: 35861 - RNA, 22 nt, Homo sapiens
uggcagacaaauuugagcauau

SEQ ID NO: 35862 - RNA, 22 nt, Homo sapiens
ugggaccccuacucuuuccaca

SEQ ID NO: 35863 - RNA, 22 nt, Homo sapiens
ugguauuuaauauaugagaguu

SEQ ID NO: 35864 - RNA, 22 nt, Homo sapiens
ugguguccugucucugcgcuug

SEQ ID NO: 35865 - RNA, 23 nt, Homo sapiens
uguaaagcuaugaauuauucuuu

SEQ ID NO: 35866 - RNA, 22 nt, Homo sapiens
uguacccuuagagagugaucga

SEQ ID NO: 35867 - RNA, 22 nt, Homo sapiens
uguagacaccaaagacagcaua

SEQ ID NO: 35868 - RNA, 21 nt, Homo sapiens
uguagcagcaugauuuauaau

SEQ ID NO: 35869 - RNA, 22 nt, Homo sapiens
uguagcagccauaaacacagug

SEQ ID NO: 35870 - RNA, 22 nt, Homo sapiens
uguaugaguuguuuauaaauuu

SEQ ID NO: 35871 - RNA, 22 nt, Homo sapiens
ugucaaaugcagugauauuuga

SEQ ID NO: 35872 - RNA, 22 nt, Homo sapiens
ugucaccauuuguaggugagga

SEQ ID NO: 35873 - RNA, 22 nt, Homo sapiens
ugucaguguaugagccccggau

SEQ ID NO: 35874 - RNA, 21 nt, Homo sapiens
ugucaguuuccagaguucaac

SEQ ID NO: 35875 - RNA, 22 nt, Homo sapiens
ugucauguugguguacugcacc

SEQ ID NO: 35876 - RNA, 22 nt, Homo sapiens
ugugaagaaagucauugguagc

SEQ ID NO: 35877 - RNA, 22 nt, Homo sapiens
ugugacagcacgguucaacugc

SEQ ID NO: 35878 - RNA, 22 nt, Homo sapiens
ugugccacuccagcucuagcuu

SEQ ID NO: 35879 - RNA, 22 nt, Homo sapiens
ugugcucaucucagucaacugu

SEQ ID NO: 35880 - RNA, 23 nt, Homo sapiens
ugugguauuauuccauuuauagg

SEQ ID NO: 35881 - RNA, 22 nt, Homo sapiens
uguguuuuuauguaaaauggaa

SEQ ID NO: 35882 - RNA, 22 nt, Homo sapiens
uguuauuuuguguuagggcaca

SEQ ID NO: 35883 - RNA, 22 nt, Homo sapiens
uuaaauacagcaugguguuucu

SEQ ID NO: 35884 - RNA, 22 nt, Homo sapiens
uuaaaugcauagaauguguagu

SEQ ID NO: 35885 - RNA, 22 nt, Homo sapiens
uuaaggaaagcauuuaauucag

SEQ ID NO: 35886 - RNA, 22 nt, Homo sapiens
uuaaucacagcugaacucaaac

SEQ ID NO: 35887 - RNA, 22 nt, Homo sapiens
uuaauguaucuaucacaucaca

SEQ ID NO: 35888 - RNA, 22 nt, Homo sapiens
uuaggcuuuauugaaaacaaua

SEQ ID NO: 35889 - RNA, 22 nt, Homo sapiens
uuaggugcauggaaguguuuuc

SEQ ID NO: 35890 - RNA, 22 nt, Homo sapiens
uuauguaaaucaaucuggaauc

SEQ ID NO: 35891 - RNA, 16 nt, Homo sapiens
uuauugcauucuucuc

SEQ ID NO: 35892 - RNA, 22 nt, Homo sapiens
uucaaaucuucguuuugccaua

SEQ ID NO: 35893 - RNA, 22 nt, Homo sapiens
uucaauuaauauuauacucuca

SEQ ID NO: 35894 - RNA, 22 nt, Homo sapiens
uucacugggugugguggcucac

SEQ ID NO: 35895 - RNA, 22 nt, Homo sapiens
uucaucaguuauauuggccuga

SEQ ID NO: 35896 - RNA, 22 nt, Homo sapiens
uucauguaauauuucacagcuu

SEQ ID NO: 35897 - RNA, 22 nt, Homo sapiens
uucauguaauuccauaagguaa

SEQ ID NO: 35898 - RNA, 22 nt, Homo sapiens
uucaugucuuggcuguuagagu

SEQ ID NO: 35899 - RNA, 22 nt, Homo sapiens
uuccugcacuugcuugccuaug

SEQ ID NO: 35900 - RNA, 22 nt, Homo sapiens
uucucagcccccugacagucag

SEQ ID NO: 35901 - RNA, 22 nt, Homo sapiens
uucucuguggauugggugagag

SEQ ID NO: 35902 - RNA, 22 nt, Homo sapiens
uucugagguuauauucucucaa

SEQ ID NO: 35903 - RNA, 22 nt, Homo sapiens
uugaagacuaccuaccauacuu

SEQ ID NO: 35904 - RNA, 23 nt, Homo sapiens
uugacuguggguacaaugugaua

SEQ ID NO: 35905 - RNA, 22 nt, Homo sapiens
uugacuuuuaggaggaaaauga

SEQ ID NO: 35906 - RNA, 21 nt, Homo sapiens
uugagacggagucucacucug

SEQ ID NO: 35907 - RNA, 22 nt, Homo sapiens
uugagauagggucuaccucugu

SEQ ID NO: 35908 - RNA, 22 nt, Homo sapiens
uugagauggagucucacugugu

SEQ ID NO: 35909 - RNA, 22 nt, Homo sapiens
uugagauggaguuucacucuug

SEQ ID NO: 35910 - RNA, 21 nt, Homo sapiens
uugagcaacuaggguuauagg

SEQ ID NO: 35911 - RNA, 22 nt, Homo sapiens
uugagcaccaugccuggccaug

SEQ ID NO: 35912 - RNA, 22 nt, Homo sapiens
uugaggaagugguuccccagag

SEQ ID NO: 35913 - RNA, 22 nt, Homo sapiens
uugaggucagagguucgagacc

SEQ ID NO: 35914 - RNA, 20 nt, Homo sapiens
uugaggucaggaguuuggga

SEQ ID NO: 35915 - RNA, 22 nt, Homo sapiens
uugauagguuuuauguauaguu

SEQ ID NO: 35916 - RNA, 22 nt, Homo sapiens
uugauguccaucucuagguaaa

SEQ ID NO: 35917 - RNA, 22 nt, Homo sapiens
uugcacucuagccugggugaca

SEQ ID NO: 35918 - RNA, 22 nt, Homo sapiens
uugcacuguaauuuauuuaugu

SEQ ID NO: 35919 - RNA, 22 nt, Homo sapiens
uugccgggugcaguggcucaug

SEQ ID NO: 35920 - RNA, 22 nt, Homo sapiens
uuggaaaguuguuguaguuauu

SEQ ID NO: 35921 - RNA, 22 nt, Homo sapiens
uuggaaauauguuaagugucau

SEQ ID NO: 35922 - RNA, 22 nt, Homo sapiens
uuggacagaugguuacauuuuu

SEQ ID NO: 35923 - RNA, 22 nt, Homo sapiens
uuggagucaucucuguacugua

SEQ ID NO: 35924 - RNA, 22 nt, Homo sapiens
uuggcaagcuguuaauuauaaa

SEQ ID NO: 35925 - RNA, 22 nt, Homo sapiens
uuggcaaguuucugucagcaaa

SEQ ID NO: 35926 - RNA, 22 nt, Homo sapiens
uuggcagucugaggcacagacu

SEQ ID NO: 35927 - RNA, 22 nt, Homo sapiens
uuggcagugcccgaugcugggg

SEQ ID NO: 35928 - RNA, 22 nt, Homo sapiens
uuggcagugguucugacggacc

SEQ ID NO: 35929 - RNA, 22 nt, Homo sapiens
uugggaauguccuaauaucucg

SEQ ID NO: 35930 - RNA, 22 nt, Homo sapiens
uuggggcacggccucuguugcc

SEQ ID NO: 35931 - RNA, 22 nt, Homo sapiens
uuggucugcucugauguuuucu

SEQ ID NO: 35932 - RNA, 22 nt, Homo sapiens
uugguuccuuagccuaggacua

SEQ ID NO: 35933 - RNA, 22 nt, Homo sapiens
uuguaaucaacacaucauuggg

SEQ ID NO: 35934 - RNA, 22 nt, Homo sapiens
uugucaguguucacucaaagcu

SEQ ID NO: 35935 - RNA, 22 nt, Homo sapiens
uugugaauggaguagcaggauc

SEQ ID NO: 35936 - RNA, 22 nt, Homo sapiens
uugugauugagugauccuuguu

SEQ ID NO: 35937 - RNA, 22 nt, Homo sapiens
uuucaacaggucuggggugguc

SEQ ID NO: 35938 - RNA, 23 nt, Homo sapiens
uuucacagaaggauuguagggcc

SEQ ID NO: 35939 - RNA, 22 nt, Homo sapiens
uuucacagcaauugccuauugu

SEQ ID NO: 35940 - RNA, 20 nt, Homo sapiens
uuucaguacuuucuacuggc

SEQ ID NO: 35941 - RNA, 22 nt, Homo sapiens
uuucccuuuagcuuagugauuu

SEQ ID NO: 35942 - RNA, 22 nt, Homo sapiens
uuucccuuugcuuugucagcca

SEQ ID NO: 35943 - RNA, 22 nt, Homo sapiens
uuugaaccauuugaagaaugau

SEQ ID NO: 35944 - RNA, 22 nt, Homo sapiens
uuugcaugcuccuuaugagaau

SEQ ID NO: 35945 - RNA, 22 nt, Homo sapiens
uuugccaaucagaggcaucuug

SEQ ID NO: 35946 - RNA, 22 nt, Homo sapiens
uuugccuuugugauauggucua

SEQ ID NO: 35947 - RNA, 22 nt, Homo sapiens
uuuggcaugggcuauuugcuuu

SEQ ID NO: 35948 - RNA, 22 nt, Homo sapiens
uuugggaaugguuugucuccca

SEQ ID NO: 35949 - RNA, 22 nt, Homo sapiens
uuugggacuguauuaaaugccu

SEQ ID NO: 35950 - RNA, 22 nt, Homo sapiens
uuuggucuuuuguaaguuaucu

SEQ ID NO: 35951 - RNA, 22 nt, Homo sapiens
uuuguacugagccaagauggua

SEQ ID NO: 35952 - RNA, 20 nt, Homo sapiens
uuuguaucucuggguacugg

SEQ ID NO: 35953 - RNA, 22 nt, Homo sapiens
uuugucauagcagcaggaaugg

SEQ ID NO: 35954 - RNA, 19 nt, Homo sapiens
uuuugcucuuuauaccuau

SEQ ID NO: 35955 - RNA, 19 nt, Homo sapiens
uuuuggaaaugugaacagc

SEQ ID NO: 35956 - RNA, 22 nt, Homo sapiens
uuuuugaguagcuggagagcag

SEQ ID NO: 35957 - RNA, 22 nt, Homo sapiens
cuggaaagcaaguccauugcuc

SEQ ID NO: 35958 - RNA, 22 nt, Homo sapiens
cuggcaaauaguagagccagga

SEQ ID NO: 35959 - RNA, 19 nt, Homo sapiens
cuggcaaaugcuuuggcca

SEQ ID NO: 35960 - RNA, 22 nt, Homo sapiens
cuggcagugcuuguuauccugg

SEQ ID NO: 35961 - RNA, 22 nt, Homo sapiens
cuguaaagaucacagagcuggu

SEQ ID NO: 35962 - RNA, 22 nt, Homo sapiens
cuguuuguuuaggguacucaga

SEQ ID NO: 35963 - RNA, 22 nt, Homo sapiens
cuuaaguaguuguggaaugaau

SEQ ID NO: 35964 - RNA, 22 nt, Homo sapiens
cuuacagucuaucagccacaac

SEQ ID NO: 35965 - RNA, 22 nt, Homo sapiens
cuugcagagcccauggauguca

SEQ ID NO: 35966 - RNA, 22 nt, Homo sapiens
cuuggguaagucauuaaaauua

SEQ ID NO: 35967 - RNA, 22 nt, Homo sapiens
cuugguuacauuuuccuagaaa

SEQ ID NO: 35968 - RNA, 18 nt, Homo sapiens
cuuugcagcuuccagagg

SEQ ID NO: 35969 - RNA, 22 nt, Homo sapiens
cuuugggaccgcgguuuauacu

SEQ ID NO: 35970 - RNA, 21 nt, Homo sapiens
cuuuuuacucguucauaugca

SEQ ID NO: 35971 - RNA, 22 nt, Homo sapiens
gacuggccuauaauggcgaauu

SEQ ID NO: 35972 - RNA, 22 nt, Homo sapiens
gacuuugguagaggaaaaaucu

SEQ ID NO: 35973 - RNA, 22 nt, Homo sapiens
gagauaaauaggucacaguucu

SEQ ID NO: 35974 - RNA, 22 nt, Homo sapiens
gagaugugguucaaggguguuu

SEQ ID NO: 35975 - RNA, 22 nt, Homo sapiens
gagauuauugucucccucacca

SEQ ID NO: 35976 - RNA, 22 nt, Homo sapiens
gagauucuucaauauuuauucu

SEQ ID NO: 35977 - RNA, 22 nt, Homo sapiens
gagcuuggguuaaaguugccuu

SEQ ID NO: 35978 - RNA, 22 nt, Homo sapiens
gaggucaggacauuuuugcuuu

SEQ ID NO: 35979 - RNA, 22 nt, Homo sapiens
gaggugaaggucucaauaaaua

SEQ ID NO: 35980 - RNA, 22 nt, Homo sapiens
gagucagugucuugcucuguca

SEQ ID NO: 35981 - RNA, 22 nt, Homo sapiens
gauggcucugcaggugagggua

SEQ ID NO: 35982 - RNA, 22 nt, Homo sapiens
gauuuuccaguggcccugauca

SEQ ID NO: 35983 - RNA, 22 nt, Homo sapiens
gcaagaguauuucaaggaagau

SEQ ID NO: 35984 - RNA, 22 nt, Homo sapiens
gcaagauuguguggcugaagua

SEQ ID NO: 35985 - RNA, 22 nt, Homo sapiens
gcacacguagaagcaugcauca

SEQ ID NO: 35986 - RNA, 22 nt, Homo sapiens
gcagaucuucgcgguaaguguu

SEQ ID NO: 35987 - RNA, 23 nt, Homo sapiens
gcagucauuuggaaaagguugaa

SEQ ID NO: 35988 - RNA, 22 nt, Homo sapiens
gcagugugauguuuuaaucuau

SEQ ID NO: 35989 - RNA, 17 nt, Homo sapiens
acuuuuugaggaggcau

SEQ ID NO: 35990 - RNA, 20 nt, Homo sapiens
acuuuuugaugaggucguuu

SEQ ID NO: 35991 - RNA, 22 nt, Homo sapiens
agacacugaaauguauugaaga

SEQ ID NO: 35992 - RNA, 22 nt, Homo sapiens
agaucauaugcaguaaugaacu

SEQ ID NO: 35993 - RNA, 22 nt, Homo sapiens
agcaagauccagucgcacagga

SEQ ID NO: 35994 - RNA, 22 nt, Homo sapiens
agcaccacaauuuccugccuaa

SEQ ID NO: 35995 - RNA, 22 nt, Homo sapiens
agcagauguuuagugagcgccu

SEQ ID NO: 35996 - RNA, 22 nt, Homo sapiens
agcagcauauuuuuauaaugua

SEQ ID NO: 35997 - RNA, 22 nt, Homo sapiens
agcagcuuugcauggccuguga

SEQ ID NO: 35998 - RNA, 22 nt, Homo sapiens
agcauagugccuugaaaacaau

SEQ ID NO: 35999 - RNA, 22 nt, Homo sapiens
agcaucacaugggcugcuuggg

SEQ ID NO: 36000 - RNA, 22 nt, Homo sapiens
agcugcaaagggagagaugauu

SEQ ID NO: 36001 - RNA, 22 nt, Homo sapiens
agcuggcuguagcugcaagucu

SEQ ID NO: 36002 - RNA, 22 nt, Homo sapiens
agcuggcuguggagaaaccccu

SEQ ID NO: 36003 - RNA, 22 nt, Homo sapiens
agcuuguguuugucugccuggg

SEQ ID NO: 36004 - RNA, 22 nt, Homo sapiens
aggagguagaacauugccauuu

SEQ ID NO: 36005 - RNA, 22 nt, Homo sapiens
aggagguaggaauugugcuagg

SEQ ID NO: 36006 - RNA, 22 nt, Homo sapiens
aggcaaugugagaguuuauuca

SEQ ID NO: 36007 - RNA, 22 nt, Homo sapiens
agguccacuuacuacuccuguu

SEQ ID NO: 36008 - RNA, 22 nt, Homo sapiens
aggugcucuuccuguaggucac

SEQ ID NO: 36009 - RNA, 22 nt, Homo sapiens
aggugguauuuaaaauuauuug

SEQ ID NO: 36010 - RNA, 16 nt, Homo sapiens
aguaguuuuacagauu

SEQ ID NO: 36011 - RNA, 22 nt, Homo sapiens
aguaucaucuuguuggccaggc

SEQ ID NO: 36012 - RNA, 22 nt, Homo sapiens
agucaaaugcuuauguauaaag

SEQ ID NO: 36013 - RNA, 22 nt, Homo sapiens
agucaguggaguaaauguaauu

SEQ ID NO: 36014 - RNA, 22 nt, Homo sapiens
agugccacugcacucuagccug

SEQ ID NO: 36015 - RNA, 19 nt, Homo sapiens
auaauuagcagugaggaca

SEQ ID NO: 36016 - RNA, 22 nt, Homo sapiens
auacaguaucuucuggcaagca

SEQ ID NO: 36017 - RNA, 22 nt, Homo sapiens
auagaucauugucauuuuagau

SEQ ID NO: 36018 - RNA, 22 nt, Homo sapiens
auaguagagagggcaaaaugcu

SEQ ID NO: 36019 - RNA, 22 nt, Homo sapiens
auaucacaaacaagucuguacu

SEQ ID NO: 36020 - RNA, 22 nt, Homo sapiens
auaugucuguuuagucuguaau

SEQ ID NO: 36021 - RNA, 22 nt, Homo sapiens
auauugcuccuaauaccacggu

SEQ ID NO: 36022 - RNA, 20 nt, Homo sapiens
aucaaagacuuagaggggga

SEQ ID NO: 36023 - RNA, 22 nt, Homo sapiens
aucaaaguaggcauauguuuuu

SEQ ID NO: 36024 - RNA, 22 nt, Homo sapiens
aucaaaguuucccagaaguugu

SEQ ID NO: 36025 - RNA, 22 nt, Homo sapiens
aucacagaguuaaaacuuucuu

SEQ ID NO: 36026 - RNA, 22 nt, Homo sapiens
aucacaguuauaacauccuuuu

SEQ ID NO: 36027 - RNA, 22 nt, Homo sapiens
aucagaaucucuagaggacugu

SEQ ID NO: 36028 - RNA, 22 nt, Homo sapiens
aucagauuccagaggcagcacc

SEQ ID NO: 36029 - RNA, 22 nt, Homo sapiens
aucauaucauuggugaacagug

SEQ ID NO: 36030 - RNA, 22 nt, Homo sapiens
aucauugugcaucuucauucca

SEQ ID NO: 36031 - RNA, 22 nt, Homo sapiens
auccaguuuuaggagauuucua

SEQ ID NO: 36032 - RNA, 22 nt, Homo sapiens
auccugagacuuuucugaaguu

SEQ ID NO: 36033 - RNA, 22 nt, Homo sapiens
aucucaaugcuuuuguaggcca

SEQ ID NO: 36034 - RNA, 22 nt, Homo sapiens
aucucauggagguagagaguaa

SEQ ID NO: 36035 - RNA, 22 nt, Homo sapiens
aucucauuccuucugggcugau

SEQ ID NO: 36036 - RNA, 22 nt, Homo sapiens
augaaaucuuuccugugaggau

SEQ ID NO: 36037 - RNA, 22 nt, Homo sapiens
augaaaugcauguuaaguccgu

SEQ ID NO: 36038 - RNA, 22 nt, Homo sapiens
augacaguaugacuccaaaagu

SEQ ID NO: 36039 - RNA, 22 nt, Homo sapiens
augacuaaaggguuuauguuga

SEQ ID NO: 36040 - RNA, 22 nt, Homo sapiens
augagauacuacaaaugaguuu

SEQ ID NO: 36041 - RNA, 22 nt, Homo sapiens
augaggugcagaggaaaugagu

SEQ ID NO: 36042 - RNA, 22 nt, Homo sapiens
augaggugggagaaucacuuga

SEQ ID NO: 36043 - RNA, 21 nt, Homo sapiens
augagguguacuguggugaaa

SEQ ID NO: 36044 - RNA, 22 nt, Homo sapiens
augagugugaccugccaagaga

SEQ ID NO: 36045 - RNA, 22 nt, Homo sapiens
augauggagguagauuguccau

SEQ ID NO: 36046 - RNA, 22 nt, Homo sapiens
augcaagacaccgauuagcuuu

SEQ ID NO: 36047 - RNA, 22 nt, Homo sapiens
augcuacugaccccuacuuaca

SEQ ID NO: 36048 - RNA, 22 nt, Homo sapiens
augcuacugauaagcaaucauu

SEQ ID NO: 36049 - RNA, 22 nt, Homo sapiens
caucagauugagaucaucuaag

SEQ ID NO: 36050 - RNA, 22 nt, Homo sapiens
caucauugcacccuauagagaa

SEQ ID NO: 36051 - RNA, 19 nt, Homo sapiens
caucccugagcugaagugg

SEQ ID NO: 36052 - RNA, 22 nt, Homo sapiens
caugucacuuccucucugaugg

SEQ ID NO: 36053 - RNA, 22 nt, Homo sapiens
cauugcacuccagccugccugg

SEQ ID NO: 36054 - RNA, 20 nt, Homo sapiens
cauugcacuccagcuugggc

SEQ ID NO: 36055 - RNA, 22 nt, Homo sapiens
ccacugcacuccagcccggcaa

SEQ ID NO: 36056 - RNA, 22 nt, Homo sapiens
ccaggguugcuuuagauucuga

SEQ ID NO: 36057 - RNA, 22 nt, Homo sapiens
ccaguuuucccagcaccauuaa

SEQ ID NO: 36058 - RNA, 22 nt, Homo sapiens
ccaguuuucucacuguugcagu

SEQ ID NO: 36059 - RNA, 22 nt, Homo sapiens
ccauugcacuccagccuaggca

SEQ ID NO: 36060 - RNA, 22 nt, Homo sapiens
ccauugcacucuggccuaggug

SEQ ID NO: 36061 - RNA, 22 nt, Homo sapiens
ccauuucacucuuccugaagga

SEQ ID NO: 36062 - RNA, 22 nt, Homo sapiens
cccagugguuacauaaggagua

SEQ ID NO: 36063 - RNA, 23 nt, Homo sapiens
cccucagaagugcagggagagaa

SEQ ID NO: 36064 - RNA, 22 nt, Homo sapiens
ccugugguuaaccagcuagaug

SEQ ID NO: 36065 - RNA, 22 nt, Homo sapiens
ccuucauugcaucuuuaagaga

SEQ ID NO: 36066 - RNA, 22 nt, Homo sapiens
cggugcaauucuccugucucag

SEQ ID NO: 36067 - RNA, 22 nt, Homo sapiens
cucacugcauuucaguuuuguu

SEQ ID NO: 36068 - RNA, 22 nt, Homo sapiens
cucaguacuugcacagaagaac

SEQ ID NO: 36069 - RNA, 21 nt, Homo sapiens
cucauauugcuuuuccauggu

SEQ ID NO: 36070 - RNA, 22 nt, Homo sapiens
cucugguucugcagugcacccu

SEQ ID NO: 36071 - RNA, 22 nt, Homo sapiens
cucugguuuuucuuccauuaag

SEQ ID NO: 36072 - RNA, 20 nt, Homo sapiens
cugaaugucaaggcagaggu

SEQ ID NO: 36073 - RNA, 22 nt, Homo sapiens
cugaauguucuauagaagccgc

SEQ ID NO: 36074 - RNA, 22 nt, Homo sapiens
cugacucagacacauguauaug

SEQ ID NO: 36075 - RNA, 22 nt, Homo sapiens
cugagacacucuuaucugcaua

SEQ ID NO: 36076 - RNA, 22 nt, Homo sapiens
cugagcaaagaagugauaauga

SEQ ID NO: 36077 - RNA, 22 nt, Homo sapiens
cugagcaagucauuuuguuaaa

SEQ ID NO: 36078 - RNA, 22 nt, Homo sapiens
cugagguagcucaggguauugc

SEQ ID NO: 36079 - RNA, 22 nt, Homo sapiens
cugagguaggcccugagaauau

SEQ ID NO: 36080 - RNA, 22 nt, Homo sapiens
cugaggucugaauccagguauc

SEQ ID NO: 36081 - RNA, 20 nt, Homo sapiens
cugagguugggguccuuccc

SEQ ID NO: 36082 - RNA, 22 nt, Homo sapiens
cugcaagaugcauaggaauuuu

SEQ ID NO: 36083 - RNA, 19 nt, Homo sapiens
cugcacugagaaaaggagg

SEQ ID NO: 36084 - RNA, 22 nt, Homo sapiens
cugcuauauugguucaggcuug

SEQ ID NO: 36085 - RNA, 22 nt, Homo sapiens
cuggaaagaaucaggcuaaacu

SEQ ID NO: 36086 - RNA, 22 nt, Homo sapiens
cuggaauguuccuaaagauuca

SEQ ID NO: 36087 - RNA, 22 nt, Homo sapiens
cuggacaaaucuggaaagaacc

SEQ ID NO: 36088 - RNA, 22 nt, Homo sapiens
cuggcaaauguuuucuguaaag

SEQ ID NO: 36089 - RNA, 22 nt, Homo sapiens
cuggcagucugccucuucacug

SEQ ID NO: 36090 - RNA, 22 nt, Homo sapiens
cugggaucaguucuagucagaa

SEQ ID NO: 36091 - RNA, 22 nt, Homo sapiens
cugguuguuacaaagagccugg

SEQ ID NO: 36092 - RNA, 22 nt, Homo sapiens
cuguaauguaaugagacuacau

SEQ ID NO: 36093 - RNA, 22 nt, Homo sapiens
cugucacaguuuuggaggccag

SEQ ID NO: 36094 - RNA, 20 nt, Homo sapiens
cuugaagacuaugcugcuga

SEQ ID NO: 36095 - RNA, 18 nt, Homo sapiens
cuugucaaaucuuuccuc

SEQ ID NO: 36096 - RNA, 22 nt, Homo sapiens
cuuuaugagguuggauggaucu

SEQ ID NO: 36097 - RNA, 22 nt, Homo sapiens
cuuucacacuguuggugggaau

SEQ ID NO: 36098 - RNA, 23 nt, Homo sapiens
cuuuugcaaugugaucuugccac

SEQ ID NO: 36099 - RNA, 22 nt, Homo sapiens
gaacccuggaggcggagguugc

SEQ ID NO: 36100 - RNA, 22 nt, Homo sapiens
gaacugggguuggguugcgaua

SEQ ID NO: 36101 - RNA, 22 nt, Homo sapiens
gaagacauuugcugcacguccu

SEQ ID NO: 36102 - RNA, 22 nt, Homo sapiens
gacagacacaauugauccauga

SEQ ID NO: 36103 - RNA, 22 nt, Homo sapiens
gagauaacuacuggauuaaguu

SEQ ID NO: 36104 - RNA, 22 nt, Homo sapiens
gagauuauuagauguucugcuu

SEQ ID NO: 36105 - RNA, 22 nt, Homo sapiens
gaggaaguaauuuuaggccugu

SEQ ID NO: 36106 - RNA, 22 nt, Homo sapiens
gaggaguauuuugucgaauguc

SEQ ID NO: 36107 - RNA, 22 nt, Homo sapiens
gaggcuagauggggaugugucc

SEQ ID NO: 36108 - RNA, 22 nt, Homo sapiens
gagguggugguggaggcauagc

SEQ ID NO: 36109 - RNA, 22 nt, Homo sapiens
gagugcaauggcaagaucuugg

SEQ ID NO: 36110 - RNA, 23 nt, Homo sapiens
gaguggagacucauugauuuccu

SEQ ID NO: 36111 - RNA, 22 nt, Homo sapiens
gaugagguaggccugcuuugaa

SEQ ID NO: 36112 - RNA, 22 nt, Homo sapiens
gauuuugguuagggaaggauac

SEQ ID NO: 36113 - RNA, 22 nt, Homo sapiens
gcaaaaaguagugcugguuagg

SEQ ID NO: 36114 - RNA, 22 nt, Homo sapiens
gcagaauugguuucuucuaagg

SEQ ID NO: 36115 - RNA, 22 nt, Homo sapiens
gcagugugugaggaauuugggu

SEQ ID NO: 36116 - RNA, 16 nt, Homo sapiens
gcaguguguuuaauag

SEQ ID NO: 36117 - RNA, 22 nt, Homo sapiens
gcauggccuuuaaaugucacag

SEQ ID NO: 36118 - RNA, 22 nt, Homo sapiens
gccauugcacuacagccuaggc

SEQ ID NO: 36119 - RNA, 22 nt, Homo sapiens
gccauugcacucuagccugagc

SEQ ID NO: 36120 - RNA, 22 nt, Homo sapiens
gcucugguuacaaaggcaaauu

SEQ ID NO: 36121 - RNA, 22 nt, Homo sapiens
gcugagguucaagaagguuaaa

SEQ ID NO: 36122 - RNA, 22 nt, Homo sapiens
gcugcacuuuaaggcauccccu

SEQ ID NO: 36123 - RNA, 23 nt, Homo sapiens
ggaaacauccagucuuucaccau

SEQ ID NO: 36124 - RNA, 22 nt, Homo sapiens
ggaaaguaacccauucucuuac

SEQ ID NO: 36125 - RNA, 22 nt, Homo sapiens
ggaagaauauuaggggauuucg

SEQ ID NO: 36126 - RNA, 22 nt, Homo sapiens
ggaaugcagugagcauuagaua

SEQ ID NO: 36127 - RNA, 22 nt, Homo sapiens
ggaauguuaaagacuacacuga

SEQ ID NO: 36128 - RNA, 22 nt, Homo sapiens
ggcaguuucucaggcaggggua

SEQ ID NO: 36129 - RNA, 22 nt, Homo sapiens
ggccuguaaacuagagacccug

SEQ ID NO: 36130 - RNA, 22 nt, Homo sapiens
ggcuagagacaaguugcugaga

SEQ ID NO: 36131 - RNA, 22 nt, Homo sapiens
ggcuagauauucacauauggcu

SEQ ID NO: 36132 - RNA, 22 nt, Homo sapiens
ggcucaguugcaaaucaguuca

SEQ ID NO: 36133 - RNA, 22 nt, Homo sapiens
gggaaaaugucuauugaaugaa

SEQ ID NO: 36134 - RNA, 22 nt, Homo sapiens
gggaagaaggagugguuuacuc

SEQ ID NO: 36135 - RNA, 20 nt, Homo sapiens
gggaaugcaaauucucaucc

SEQ ID NO: 36136 - RNA, 22 nt, Homo sapiens
ggucaguguuaucaccgaagga

SEQ ID NO: 36137 - RNA, 22 nt, Homo sapiens
ggucauggauaagauccagaag

SEQ ID NO: 36138 - RNA, 22 nt, Homo sapiens
ggugucaguuggccccuacugg

SEQ ID NO: 36139 - RNA, 22 nt, Homo sapiens
guaaucucagcuacucgggagg

SEQ ID NO: 36140 - RNA, 22 nt, Homo sapiens
guaaucucagcuacuugggagg

SEQ ID NO: 36141 - RNA, 19 nt, Homo sapiens
guaaucucaguacuuuggu

SEQ ID NO: 36142 - RNA, 22 nt, Homo sapiens
guaguuuaucagaaagaauagg

SEQ ID NO: 36143 - RNA, 18 nt, Homo sapiens
guaugcacaugccccugc

SEQ ID NO: 36144 - RNA, 22 nt, Homo sapiens
guauuagaugguauuugaagau

SEQ ID NO: 36145 - RNA, 19 nt, Homo sapiens
guauuugguaaacucucca

SEQ ID NO: 36146 - RNA, 22 nt, Homo sapiens
gucacagcacuuuuaguaagug

SEQ ID NO: 36147 - RNA, 22 nt, Homo sapiens
gucacugccugaggcugaugca

SEQ ID NO: 36148 - RNA, 22 nt, Homo sapiens
guccaagacuaggaguuggcag

SEQ ID NO: 36149 - RNA, 22 nt, Homo sapiens
gucucacaggcaugaugccagc

SEQ ID NO: 36150 - RNA, 22 nt, Homo sapiens
gucugcaugucauaugauagua

SEQ ID NO: 36151 - RNA, 22 nt, Homo sapiens
gugacuaagauucuuugauaug

SEQ ID NO: 36152 - RNA, 17 nt, Homo sapiens
gugagguggguaguauc

SEQ ID NO: 36153 - RNA, 22 nt, Homo sapiens
aaagcaucacuuuuccuacuuu

SEQ ID NO: 36154 - RNA, 20 nt, Homo sapiens
aaaggcugugagaacgagau

SEQ ID NO: 36155 - RNA, 22 nt, Homo sapiens
aaaguaguagcaguuucugcca

SEQ ID NO: 36156 - RNA, 22 nt, Homo sapiens
aaagugaauguaucccguaagu

SEQ ID NO: 36157 - RNA, 22 nt, Homo sapiens
aaagugcaguacuucguauauu

SEQ ID NO: 36158 - RNA, 22 nt, Homo sapiens
aaaugcauugagggaaaaggca

SEQ ID NO: 36159 - RNA, 19 nt, Homo sapiens
aaaugugcacuguuuucca

SEQ ID NO: 36160 - RNA, 22 nt, Homo sapiens
aaauucaucaaaugguuuguau

SEQ ID NO: 36161 - RNA, 22 nt, Homo sapiens
aacaccauuuuucugcagccuu

SEQ ID NO: 36162 - RNA, 22 nt, Homo sapiens
aacacuguuuccagucaugauc

SEQ ID NO: 36163 - RNA, 22 nt, Homo sapiens
aacagaccuagauaguauaguc

SEQ ID NO: 36164 - RNA, 22 nt, Homo sapiens
aacagucaauugcugaugaccu

SEQ ID NO: 36165 - RNA, 21 nt, Homo sapiens
aacagugcugaacagacaccu

SEQ ID NO: 36166 - RNA, 21 nt, Homo sapiens
aagaaagcuggacuugccgcu

SEQ ID NO: 36167 - RNA, 22 nt, Homo sapiens
augcuacuggauuuguauaaau

SEQ ID NO: 36168 - RNA, 22 nt, Homo sapiens
auggaaugccauuuauaaugga

SEQ ID NO: 36169 - RNA, 22 nt, Homo sapiens
auggaaugguugggucauaagg

SEQ ID NO: 36170 - RNA, 22 nt, Homo sapiens
auggagaugugcgaacugagua

SEQ ID NO: 36171 - RNA, 22 nt, Homo sapiens
auggcaaugcgaugaugacuga

SEQ ID NO: 36172 - RNA, 20 nt, Homo sapiens
augguaguagcaccuuuaca

SEQ ID NO: 36173 - RNA, 22 nt, Homo sapiens
augguauuuugugauaccuugu

SEQ ID NO: 36174 - RNA, 22 nt, Homo sapiens
auggugugugaauuaaauguua

SEQ ID NO: 36175 - RNA, 22 nt, Homo sapiens
auguaacaguauuuggagaugu

SEQ ID NO: 36176 - RNA, 22 nt, Homo sapiens
auguaauugagguuuuugccau

SEQ ID NO: 36177 - RNA, 22 nt, Homo sapiens
augucacugcacuccugccugg

SEQ ID NO: 36178 - RNA, 22 nt, Homo sapiens
augugucaaaucuaggccaaag

SEQ ID NO: 36179 - RNA, 22 nt, Homo sapiens
auuaauguaauuaguaaaguug

SEQ ID NO: 36180 - RNA, 22 nt, Homo sapiens
auuauuagucggccagcuguua

SEQ ID NO: 36181 - RNA, 22 nt, Homo sapiens
auuauuaguuguugaaugaagu

SEQ ID NO: 36182 - RNA, 22 nt, Homo sapiens
auucuauaguccuaggauuggg

SEQ ID NO: 36183 - RNA, 20 nt, Homo sapiens
auugaagacuccggggcaga

SEQ ID NO: 36184 - RNA, 22 nt, Homo sapiens
auugacuugauauauagcugau

SEQ ID NO: 36185 - RNA, 22 nt, Homo sapiens
auugcacuccagccugggugac

SEQ ID NO: 36186 - RNA, 22 nt, Homo sapiens
auugcuuaagucccuguauuag

SEQ ID NO: 36187 - RNA, 22 nt, Homo sapiens
auuggcaagauagcauaugagg

SEQ ID NO: 36188 - RNA, 22 nt, Homo sapiens
auuggcaauggcaaagcagagu

SEQ ID NO: 36189 - RNA, 22 nt, Homo sapiens
auuuuuggauauagggaaggau

SEQ ID NO: 36190 - RNA, 22 nt, Homo sapiens
auuuuugguugucagcacuagg

SEQ ID NO: 36191 - RNA, 22 nt, Homo sapiens
caaaggauucauuuccaggagu

SEQ ID NO: 36192 - RNA, 22 nt, Homo sapiens
caaaugacaucauuucauucaa

SEQ ID NO: 36193 - RNA, 19 nt, Homo sapiens
caauacuucuuggcauaca

SEQ ID NO: 36194 - RNA, 22 nt, Homo sapiens
caauggcaaugaaauagugaga

SEQ ID NO: 36195 - RNA, 22 nt, Homo sapiens
caccgagguuggagugcagugg

SEQ ID NO: 36196 - RNA, 22 nt, Homo sapiens
cacuaccucuacaggcagcugg

SEQ ID NO: 36197 - RNA, 22 nt, Homo sapiens
cacugcaguaaauugcgucggu

SEQ ID NO: 36198 - RNA, 22 nt, Homo sapiens
cagagcaaugcuuuugcuuuga

SEQ ID NO: 36199 - RNA, 22 nt, Homo sapiens
cagauaguuguagauaugcagc

SEQ ID NO: 36200 - RNA, 22 nt, Homo sapiens
cagaucaucuugagcuuaggaa

SEQ ID NO: 36201 - RNA, 22 nt, Homo sapiens
cagcccguaaucccagcacuuu

SEQ ID NO: 36202 - RNA, 22 nt, Homo sapiens
caguacaauguugauuagaagu

SEQ ID NO: 36203 - RNA, 19 nt, Homo sapiens
caguaucauugcacauagu

SEQ ID NO: 36204 - RNA, 20 nt, Homo sapiens
caucaccuggcaggauuugu

SEQ ID NO: 36205 - RNA, 22 nt, Homo sapiens
cauggcucuuguuuacucccag

SEQ ID NO: 36206 - RNA, 22 nt, Homo sapiens
cauguauagauuccauaguggu

SEQ ID NO: 36207 - RNA, 22 nt, Homo sapiens
ccaaggcacugauucuguacuc

SEQ ID NO: 36208 - RNA, 18 nt, Homo sapiens
ccagugcaaggaaagccc

SEQ ID NO: 36209 - RNA, 22 nt, Homo sapiens
ccaguuuucaagauaaugguuu

SEQ ID NO: 36210 - RNA, 22 nt, Homo sapiens
ccaguuuuucauuuauacuagu

SEQ ID NO: 36211 - RNA, 22 nt, Homo sapiens
ccaucccuuucugagcaguucc

SEQ ID NO: 36212 - RNA, 19 nt, Homo sapiens
ccucaaguacuaauauguu

SEQ ID NO: 36213 - RNA, 22 nt, Homo sapiens
ccugagacgaauggagugaaca

SEQ ID NO: 36214 - RNA, 22 nt, Homo sapiens
cuaaaguauugagugguaaaga

SEQ ID NO: 36215 - RNA, 22 nt, Homo sapiens
cuaaagugcugagauuauaggu

SEQ ID NO: 36216 - RNA, 22 nt, Homo sapiens
cuacagcagcccaguccccgaa

SEQ ID NO: 36217 - RNA, 22 nt, Homo sapiens
cuagacuagacccaaauugaag

SEQ ID NO: 36218 - RNA, 20 nt, Homo sapiens
cucaccagguguaggcugag

SEQ ID NO: 36219 - RNA, 22 nt, Homo sapiens
cucacuggguguaaaacaugua

SEQ ID NO: 36220 - RNA, 20 nt, Homo sapiens
cucagugcacccccauaaaa

SEQ ID NO: 36221 - RNA, 22 nt, Homo sapiens
cucugguuucgcaggaaauaga

SEQ ID NO: 36222 - RNA, 21 nt, Homo sapiens
cucugguuugcauuggauuau

SEQ ID NO: 36223 - RNA, 22 nt, Homo sapiens
cugaaaucagccaguuaguuuc

SEQ ID NO: 36224 - RNA, 22 nt, Homo sapiens
cugagaagaaacagguaaggac

SEQ ID NO: 36225 - RNA, 22 nt, Homo sapiens
cugagaucugaaccaggagugu

SEQ ID NO: 36226 - RNA, 22 nt, Homo sapiens
cugagcaaaaugaagacacgau

SEQ ID NO: 36227 - RNA, 22 nt, Homo sapiens
cugagcaaaguucuauuuaugg

SEQ ID NO: 36228 - RNA, 22 nt, Homo sapiens
cugaggacaucagggaagcauc

SEQ ID NO: 36229 - RNA, 22 nt, Homo sapiens
cugagguuaggaguuugagacc

SEQ ID NO: 36230 - RNA, 22 nt, Homo sapiens
cugcacugagacccucuuugcu

SEQ ID NO: 36231 - RNA, 22 nt, Homo sapiens
cugcccuuucuauaugauguaa

SEQ ID NO: 36232 - RNA, 22 nt, Homo sapiens
cuggagauauuggaagaaagaa

SEQ ID NO: 36233 - RNA, 22 nt, Homo sapiens
cugggaugauguaaauaggcua

SEQ ID NO: 36234 - RNA, 22 nt, Homo sapiens
cugucagugggaguucaggcuu

SEQ ID NO: 36235 - RNA, 22 nt, Homo sapiens
cugugcaugcgcggagcugaaa

SEQ ID NO: 36236 - RNA, 20 nt, Homo sapiens
cuuaucaguggcaaguauaa

SEQ ID NO: 36237 - RNA, 18 nt, Homo sapiens
cuucauugcuguuuugcu

SEQ ID NO: 36238 - RNA, 22 nt, Homo sapiens
cuugcauuuuggagaaugcuga

SEQ ID NO: 36239 - RNA, 22 nt, Homo sapiens
cuugccuuugucuucaaaggcu

SEQ ID NO: 36240 - RNA, 22 nt, Homo sapiens
cuugugauugcacggcugccug

SEQ ID NO: 36241 - RNA, 22 nt, Homo sapiens
cuuuguaugucaugacaacugu

SEQ ID NO: 36242 - RNA, 22 nt, Homo sapiens
cuuuuugguagagcaggugugc

SEQ ID NO: 36243 - RNA, 20 nt, Homo sapiens
gaaacaucuauccucuccuu

SEQ ID NO: 36244 - RNA, 22 nt, Homo sapiens
gaaggcacugugugccacccug

SEQ ID NO: 36245 - RNA, 19 nt, Homo sapiens
gacaugagauuuggugggg

SEQ ID NO: 36246 - RNA, 22 nt, Homo sapiens
gagagaguacuugauauaauuu

SEQ ID NO: 36247 - RNA, 22 nt, Homo sapiens
augcacuguuguuauuggauaa

SEQ ID NO: 36248 - RNA, 22 nt, Homo sapiens
augcacuguuuucuugaugaga

SEQ ID NO: 36249 - RNA, 22 nt, Homo sapiens
augccaagagacaaagggaauc

SEQ ID NO: 36250 - RNA, 22 nt, Homo sapiens
auggaagacuccucuuugggua

SEQ ID NO: 36251 - RNA, 22 nt, Homo sapiens
auggaauguaaguuauguuugc

SEQ ID NO: 36252 - RNA, 22 nt, Homo sapiens
auggagaugaauaucaucuguu

SEQ ID NO: 36253 - RNA, 22 nt, Homo sapiens
auggagugagaauggagguucc

SEQ ID NO: 36254 - RNA, 22 nt, Homo sapiens
auggauugucuccuugugccau

SEQ ID NO: 36255 - RNA, 22 nt, Homo sapiens
auggccgggugcgguggcucac

SEQ ID NO: 36256 - RNA, 22 nt, Homo sapiens
auggcuauucuucuuuugucag

SEQ ID NO: 36257 - RNA, 22 nt, Homo sapiens
auguaaacauuuggucuaaauu

SEQ ID NO: 36258 - RNA, 22 nt, Homo sapiens
augucauagaagccugugaacc

SEQ ID NO: 36259 - RNA, 22 nt, Homo sapiens
auguccaugagcacauguauca

SEQ ID NO: 36260 - RNA, 22 nt, Homo sapiens
augugcacaugcuuacauguga

SEQ ID NO: 36261 - RNA, 22 nt, Homo sapiens
augugcuugagggaaaucaguu

SEQ ID NO: 36262 - RNA, 22 nt, Homo sapiens
augugguaggcccaugagucau

SEQ ID NO: 36263 - RNA, 22 nt, Homo sapiens
augugugaaucccagaaccugu

SEQ ID NO: 36264 - RNA, 22 nt, Homo sapiens
auuacuuugcaccaaccuaaua

SEQ ID NO: 36265 - RNA, 22 nt, Homo sapiens
auuagugaaugugaugucuuga

SEQ ID NO: 36266 - RNA, 20 nt, Homo sapiens
auucaaguaugccuugagaa

SEQ ID NO: 36267 - RNA, 19 nt, Homo sapiens
auugcacuccaaccugggu

SEQ ID NO: 36268 - RNA, 22 nt, Homo sapiens
auugcucagucagggagcucgg

SEQ ID NO: 36269 - RNA, 22 nt, Homo sapiens
auugcuuacccuguauuagauc

SEQ ID NO: 36270 - RNA, 22 nt, Homo sapiens
auugugcuaaaguaauaaguca

SEQ ID NO: 36271 - RNA, 22 nt, Homo sapiens
auuucacugagacaugugccca

SEQ ID NO: 36272 - RNA, 22 nt, Homo sapiens
auuugguuauucaguuguucag

SEQ ID NO: 36273 - RNA, 22 nt, Homo sapiens
auuuuugguugguaggcuauua

SEQ ID NO: 36274 - RNA, 22 nt, Homo sapiens
caaaugcuucuauggacugucu

SEQ ID NO: 36275 - RNA, 22 nt, Homo sapiens
cacaggaagaggcacggucccu

SEQ ID NO: 36276 - RNA, 22 nt, Homo sapiens
cacaggccugucucuuucuaac

SEQ ID NO: 36277 - RNA, 22 nt, Homo sapiens
caccuguagucccagcugaggc

SEQ ID NO: 36278 - RNA, 22 nt, Homo sapiens
cacugcacuccagccuaagagg

SEQ ID NO: 36279 - RNA, 22 nt, Homo sapiens
cacugcacuccagcuugugggc

SEQ ID NO: 36280 - RNA, 22 nt, Homo sapiens
cacugcacuccagcuuugguga

SEQ ID NO: 36281 - RNA, 22 nt, Homo sapiens
cacugcaguggaagauuaagaa

SEQ ID NO: 36282 - RNA, 22 nt, Homo sapiens
cacugcauccucugccuggcgg

SEQ ID NO: 36283 - RNA, 22 nt, Homo sapiens
cacugcauggucuagcuggguu

SEQ ID NO: 36284 - RNA, 17 nt, Homo sapiens
cacugggugcaagagga

SEQ ID NO: 36285 - RNA, 20 nt, Homo sapiens
cagucauagacaucagaguc

SEQ ID NO: 36286 - RNA, 22 nt, Homo sapiens
cagugaauuucaggucaagagu

SEQ ID NO: 36287 - RNA, 22 nt, Homo sapiens
caucaaaguggagggaaggacc

SEQ ID NO: 36288 - RNA, 22 nt, Homo sapiens
caucccugaaccccagaaaucu

SEQ ID NO: 36289 - RNA, 22 nt, Homo sapiens
caugcacugaguccaccucugg

SEQ ID NO: 36290 - RNA, 22 nt, Homo sapiens
cauugcacuccagccuagccaa

SEQ ID NO: 36291 - RNA, 22 nt, Homo sapiens
cauugcacuccagcucugggcg

SEQ ID NO: 36292 - RNA, 22 nt, Homo sapiens
cauugcaguuuuugguguaucu

SEQ ID NO: 36293 - RNA, 17 nt, Homo sapiens
ccaguuuucccucagug

SEQ ID NO: 36294 - RNA, 22 nt, Homo sapiens
ccauugcacuccagccucggca

SEQ ID NO: 36295 - RNA, 22 nt, Homo sapiens
ccauugcacuucagccuaggug

SEQ ID NO: 36296 - RNA, 22 nt, Homo sapiens
cccauuguuaaguugaguaucu

SEQ ID NO: 36297 - RNA, 22 nt, Homo sapiens
ccugagguagaguuuauauuga

SEQ ID NO: 36298 - RNA, 22 nt, Homo sapiens
ccugucuugaagagauccuccu

SEQ ID NO: 36299 - RNA, 22 nt, Homo sapiens
ccuuggcaauggcuggggcuga

SEQ ID NO: 36300 - RNA, 21 nt, Homo sapiens
ccuugguuaucuucccauuca

SEQ ID NO: 36301 - RNA, 22 nt, Homo sapiens
ccuuuguuuaguugaauuguau

SEQ ID NO: 36302 - RNA, 22 nt, Homo sapiens
ccuuuuugaguugccagaguuc

SEQ ID NO: 36303 - RNA, 22 nt, Homo sapiens
cgugaggaaaacagaggguguu

SEQ ID NO: 36304 - RNA, 22 nt, Homo sapiens
cuaaagugcuuaaaaucucauu

SEQ ID NO: 36305 - RNA, 22 nt, Homo sapiens
cucagguaguuccuuauagcaa

SEQ ID NO: 36306 - RNA, 22 nt, Homo sapiens
cucauggauggucuggcagcca

SEQ ID NO: 36307 - RNA, 22 nt, Homo sapiens
cuccuggugauuggagugugaa

SEQ ID NO: 36308 - RNA, 22 nt, Homo sapiens
cuccuguagccccaucaucuuu

SEQ ID NO: 36309 - RNA, 20 nt, Homo sapiens
cucugguugugaauugucuu

SEQ ID NO: 36310 - RNA, 15 nt, Homo sapiens
cucugguuuuucuuc

SEQ ID NO: 36311 - RNA, 22 nt, Homo sapiens
cugagagugguauguuuaagug

SEQ ID NO: 36312 - RNA, 22 nt, Homo sapiens
cugaggcacggcgaccuuaagu

SEQ ID NO: 36313 - RNA, 22 nt, Homo sapiens
cugagguaggugaucagugcuu

SEQ ID NO: 36314 - RNA, 22 nt, Homo sapiens
cugaggugggagaaucacauaa

SEQ ID NO: 36315 - RNA, 22 nt, Homo sapiens
cugaggugggaggauuacuuga

SEQ ID NO: 36316 - RNA, 22 nt, Homo sapiens
cugagguuguucuucucagugg

SEQ ID NO: 36317 - RNA, 22 nt, Homo sapiens
gagagcauuaagccaucaucau

SEQ ID NO: 36318 - RNA, 22 nt, Homo sapiens
gagaugaaaucuugcucuguca

SEQ ID NO: 36319 - RNA, 22 nt, Homo sapiens
gagaugaagugucaauaaggau

SEQ ID NO: 36320 - RNA, 22 nt, Homo sapiens
gagauuaauacacaucaaaugc

SEQ ID NO: 36321 - RNA, 22 nt, Homo sapiens
gagcaaaaguauguauugguua

SEQ ID NO: 36322 - RNA, 22 nt, Homo sapiens
gagcaacaguggcagugguggg

SEQ ID NO: 36323 - RNA, 22 nt, Homo sapiens
gagcugaucuuuucugauucca

SEQ ID NO: 36324 - RNA, 22 nt, Homo sapiens
gagguaggaggauugcuuaagg

SEQ ID NO: 36325 - RNA, 22 nt, Homo sapiens
gaggugauaucucauugugguu

SEQ ID NO: 36326 - RNA, 22 nt, Homo sapiens
gaggugguagguucacagcagc

SEQ ID NO: 36327 - RNA, 22 nt, Homo sapiens
gaguggugguucugaaacuuuu

SEQ ID NO: 36328 - RNA, 22 nt, Homo sapiens
gaucugucuuuccuuauagucu

SEQ ID NO: 36329 - RNA, 22 nt, Homo sapiens
gcaaaauugagaagggaauaua

SEQ ID NO: 36330 - RNA, 22 nt, Homo sapiens
gcacauggccccaucgugccga

SEQ ID NO: 36331 - RNA, 22 nt, Homo sapiens
gcagaauugacucuguuuuuuc

SEQ ID NO: 36332 - RNA, 22 nt, Homo sapiens
gcagguguuaugcaaacaacug

SEQ ID NO: 36333 - RNA, 19 nt, Homo sapiens
gcaguauugaaggccaguc

SEQ ID NO: 36334 - RNA, 22 nt, Homo sapiens
gccaacauggcgcuccauucuu

SEQ ID NO: 36335 - RNA, 22 nt, Homo sapiens
gccauugcacuccagccuagcg

SEQ ID NO: 36336 - RNA, 21 nt, Homo sapiens
uaucccagucacaucuaccca

SEQ ID NO: 36337 - RNA, 20 nt, Homo sapiens
uaucuacuugcaaaugccau

SEQ ID NO: 36338 - RNA, 21 nt, Homo sapiens
uaugagucugcaagaaccaca

SEQ ID NO: 36339 - RNA, 22 nt, Homo sapiens
uauuagguuggggcaaaaguaa

SEQ ID NO: 36340 - RNA, 22 nt, Homo sapiens
uauuagguuggugcaaaaguaa

SEQ ID NO: 36341 - RNA, 22 nt, Homo sapiens
uauuagguuggugcaacaguaa

SEQ ID NO: 36342 - RNA, 22 nt, Homo sapiens
uauugaauuugagcugucucuu

SEQ ID NO: 36343 - RNA, 22 nt, Homo sapiens
uauuugauugacuuuagcagga

SEQ ID NO: 36344 - RNA, 22 nt, Homo sapiens
ucaaacauccccaccagggacu

SEQ ID NO: 36345 - RNA, 22 nt, Homo sapiens
ucaaaugauucagaagccaccu

SEQ ID NO: 36346 - RNA, 22 nt, Homo sapiens
ucaaaugcacguagagaaaaua

SEQ ID NO: 36347 - RNA, 22 nt, Homo sapiens
ucaacaggucaauugcauagaa

SEQ ID NO: 36348 - RNA, 22 nt, Homo sapiens
ucaagaccucacauagaggaga

SEQ ID NO: 36349 - RNA, 20 nt, Homo sapiens
ucacagucacacauaauccu

SEQ ID NO: 36350 - RNA, 22 nt, Homo sapiens
ucacaguucagcauggcugagg

SEQ ID NO: 36351 - RNA, 22 nt, Homo sapiens
ucacugaggucugagcuuuaug

SEQ ID NO: 36352 - RNA, 20 nt, Homo sapiens
ucacugaguaucuacgauua

SEQ ID NO: 36353 - RNA, 22 nt, Homo sapiens
ucacugcacuucaggcuuucuc

SEQ ID NO: 36354 - RNA, 22 nt, Homo sapiens
ucacuggagguuccugaaguuc

SEQ ID NO: 36355 - RNA, 22 nt, Homo sapiens
ucaggcacucagcuuagagucu

SEQ ID NO: 36356 - RNA, 20 nt, Homo sapiens
ucagguagaucuuugagguc

SEQ ID NO: 36357 - RNA, 22 nt, Homo sapiens
ucaggugcagagaagaaauggg

SEQ ID NO: 36358 - RNA, 22 nt, Homo sapiens
uggcaagaucacaauuacuuuu

SEQ ID NO: 36359 - RNA, 22 nt, Homo sapiens
uggcaguuuacaaaugccauga

SEQ ID NO: 36360 - RNA, 22 nt, Homo sapiens
uggcauaugguauuugauaucu

SEQ ID NO: 36361 - RNA, 22 nt, Homo sapiens
ugggaaacauccagcacauacu

SEQ ID NO: 36362 - RNA, 22 nt, Homo sapiens
ugggaacugaggugaaaagaca

SEQ ID NO: 36363 - RNA, 22 nt, Homo sapiens
ugggaauaugauacaggucuuu

SEQ ID NO: 36364 - RNA, 22 nt, Homo sapiens
ugguaagaucugugagccaggc

SEQ ID NO: 36365 - RNA, 22 nt, Homo sapiens
uguacaaauuucugugguggug

SEQ ID NO: 36366 - RNA, 22 nt, Homo sapiens
uguauuuguuguuaaauggaga

SEQ ID NO: 36367 - RNA, 22 nt, Homo sapiens
ugucaggaggguccagagaaaa

SEQ ID NO: 36368 - RNA, 22 nt, Homo sapiens
ugucaguggacugugaaaggca

SEQ ID NO: 36369 - RNA, 22 nt, Homo sapiens
ugucaguggucuggaugcagcc

SEQ ID NO: 36370 - RNA, 22 nt, Homo sapiens
ugucauguuucuacugaccaaa

SEQ ID NO: 36371 - RNA, 19 nt, Homo sapiens
ugugaagaaaugcugcaag

SEQ ID NO: 36372 - RNA, 18 nt, Homo sapiens
ugugauggauauguuaau

SEQ ID NO: 36373 - RNA, 22 nt, Homo sapiens
uguguacaucucuacacacaug

SEQ ID NO: 36374 - RNA, 22 nt, Homo sapiens
uguuuuggaggccagaagucca

SEQ ID NO: 36375 - RNA, 22 nt, Homo sapiens
uuaaaguguuugcagacaggug

SEQ ID NO: 36376 - RNA, 22 nt, Homo sapiens
uuaaaguguuuucaaaauguca

SEQ ID NO: 36377 - RNA, 22 nt, Homo sapiens
uuaaggaaggagucuuaaaugg

SEQ ID NO: 36378 - RNA, 22 nt, Homo sapiens
uuaaggcauucuuugucuucau

SEQ ID NO: 36379 - RNA, 22 nt, Homo sapiens
uuaagguaugugggcauuuugu

SEQ ID NO: 36380 - RNA, 22 nt, Homo sapiens
uuaaguagcugggcaugguggu

SEQ ID NO: 36381 - RNA, 22 nt, Homo sapiens
uuaaguuguagcuacaaauaca

SEQ ID NO: 36382 - RNA, 22 nt, Homo sapiens
uuaauacucuucuaaguagucc

SEQ ID NO: 36383 - RNA, 22 nt, Homo sapiens
uuaauguaauugauugauugac

SEQ ID NO: 36384 - RNA, 22 nt, Homo sapiens
uuacagauggcacacucaaggg

SEQ ID NO: 36385 - RNA, 22 nt, Homo sapiens
uuacaguguuuguucuguuacu

SEQ ID NO: 36386 - RNA, 22 nt, Homo sapiens
uuacaugucuugguaagguuag

SEQ ID NO: 36387 - RNA, 22 nt, Homo sapiens
uuaggcaggauaguuacauauu

SEQ ID NO: 36388 - RNA, 22 nt, Homo sapiens
uuauaacagagacuccugugcu

SEQ ID NO: 36389 - RNA, 18 nt, Homo sapiens
uuauaugcauguguagga

SEQ ID NO: 36390 - RNA, 22 nt, Homo sapiens
uuauauguuucuguuuggaggc

SEQ ID NO: 36391 - RNA, 22 nt, Homo sapiens
uuauauguuucuuagggacaga

SEQ ID NO: 36392 - RNA, 21 nt, Homo sapiens
uuaucccagugucucugcagg

SEQ ID NO: 36393 - RNA, 22 nt, Homo sapiens
uuauuguccaaguuucccuuug

SEQ ID NO: 36394 - RNA, 22 nt, Homo sapiens
uucaaaaccucugcuuaagccc

SEQ ID NO: 36395 - RNA, 22 nt, Homo sapiens
uucaaaggauagauuaagauca

SEQ ID NO: 36396 - RNA, 22 nt, Homo sapiens
uucaaaggauuuagauuagcua

SEQ ID NO: 36397 - RNA, 22 nt, Homo sapiens
uucaagugguucagaagucuga

SEQ ID NO: 36398 - RNA, 22 nt, Homo sapiens
uucacagcuuaauaaggcucag

SEQ ID NO: 36399 - RNA, 23 nt, Homo sapiens
uucaccguguuggccaggcuggu

SEQ ID NO: 36400 - RNA, 22 nt, Homo sapiens
uucaccuugggucccacuugcu

SEQ ID NO: 36401 - RNA, 20 nt, Homo sapiens
uucacugggcucucuguugg

SEQ ID NO: 36402 - RNA, 22 nt, Homo sapiens
uucagggcauuggaguuucuga

SEQ ID NO: 36403 - RNA, 22 nt, Homo sapiens
uucaucaggaauauugaccugu

SEQ ID NO: 36404 - RNA, 22 nt, Homo sapiens
uucauccccuccaaaucucaug

SEQ ID NO: 36405 - RNA, 22 nt, Homo sapiens
uucauguagucaucauccugcu

SEQ ID NO: 36406 - RNA, 22 nt, Homo sapiens
uucucaaggagccuucguaacu

SEQ ID NO: 36407 - RNA, 22 nt, Homo sapiens
uucuuagucauguaauagucca

SEQ ID NO: 36408 - RNA, 22 nt, Homo sapiens
uucuugguuggcaaccaacagu

SEQ ID NO: 36409 - RNA, 22 nt, Homo sapiens
uugaagacuaauuuagauaaug

SEQ ID NO: 36410 - RNA, 22 nt, Homo sapiens
uugaauaggcucaugcuuauca

SEQ ID NO: 36411 - RNA, 22 nt, Homo sapiens
uugacaguggcuuaaauugguu

SEQ ID NO: 36412 - RNA, 22 nt, Homo sapiens
uugaccaaagaagagucauugc

SEQ ID NO: 36413 - RNA, 22 nt, Homo sapiens
uugagaagugucuguucauguc

SEQ ID NO: 36414 - RNA, 22 nt, Homo sapiens
uugagauggagccucacucugc

SEQ ID NO: 36415 - RNA, 22 nt, Homo sapiens
uugagauggagucucacucuuc

SEQ ID NO: 36416 - RNA, 22 nt, Homo sapiens
uugagauggagucucacucuuu

SEQ ID NO: 36417 - RNA, 22 nt, Homo sapiens
auguaguugcucugccuguuuu

SEQ ID NO: 36418 - RNA, 22 nt, Homo sapiens
auugcaccacugcccuccagcc

SEQ ID NO: 36419 - RNA, 22 nt, Homo sapiens
auugcacuccagccugggcuag

SEQ ID NO: 36420 - RNA, 18 nt, Homo sapiens
auugcacuccugccuggg

SEQ ID NO: 36421 - RNA, 22 nt, Homo sapiens
auugcacucugaucugcacucc

SEQ ID NO: 36422 - RNA, 22 nt, Homo sapiens
auuggauagucuuuaucuguug

SEQ ID NO: 36423 - RNA, 18 nt, Homo sapiens
auuguaagauguauggga

SEQ ID NO: 36424 - RNA, 22 nt, Homo sapiens
auuuggcauagaguaucauucu

SEQ ID NO: 36425 - RNA, 22 nt, Homo sapiens
auuugucaauacacuucuucca

SEQ ID NO: 36426 - RNA, 22 nt, Homo sapiens
gucaaaugcacagaaccauuaa

SEQ ID NO: 36427 - RNA, 22 nt, Homo sapiens
gucaucaucaguccucugugca

SEQ ID NO: 36428 - RNA, 20 nt, Homo sapiens
gucugucuccgaguagaauu

SEQ ID NO: 36429 - RNA, 22 nt, Homo sapiens
gugacauuauuucagcuacaug

SEQ ID NO: 36430 - RNA, 22 nt, Homo sapiens
gugaccauuugacauauccuug

SEQ ID NO: 36431 - RNA, 22 nt, Homo sapiens
gugacgucauuguuccuggcuc

SEQ ID NO: 36432 - RNA, 22 nt, Homo sapiens
gugagcuccucuucugcugcag

SEQ ID NO: 36433 - RNA, 22 nt, Homo sapiens
gugagguguuaaccaaccugug

SEQ ID NO: 36434 - RNA, 22 nt, Homo sapiens
gugauagguugucacugucacu

SEQ ID NO: 36435 - RNA, 23 nt, Homo sapiens
gugcaguggcgagauuucggcuc

SEQ ID NO: 36436 - RNA, 20 nt, Homo sapiens
guggaaguagaaacauaugu

SEQ ID NO: 36437 - RNA, 22 nt, Homo sapiens
guggaagugucuggggccaggg

SEQ ID NO: 36438 - RNA, 22 nt, Homo sapiens
gugguaggaaagugcaaaugua

SEQ ID NO: 36439 - RNA, 22 nt, Homo sapiens
guguaguuugagguaugggggc

SEQ ID NO: 36440 - RNA, 22 nt, Homo sapiens
gugucaaggaugccugucaggc

SEQ ID NO: 36441 - RNA, 22 nt, Homo sapiens
gugugacagcuauagacaugau

SEQ ID NO: 36442 - RNA, 22 nt, Homo sapiens
gugugcauggagggggcaguga

SEQ ID NO: 36443 - RNA, 20 nt, Homo sapiens
gugugcauuucagauuuugg

SEQ ID NO: 36444 - RNA, 22 nt, Homo sapiens
gugugcucaucacaugcaauag

SEQ ID NO: 36445 - RNA, 22 nt, Homo sapiens
guucaguuugcugaugcguuga

SEQ ID NO: 36446 - RNA, 22 nt, Homo sapiens
guugaaaucaucacuuggcaug

SEQ ID NO: 36447 - RNA, 22 nt, Homo sapiens
guugcaaaguaauugugguuuu

SEQ ID NO: 36448 - RNA, 15 nt, Homo sapiens
guuuuuggauacaau

SEQ ID NO: 36449 - RNA, 22 nt, Homo sapiens
uaaagcuuagauccaugguggc

SEQ ID NO: 36450 - RNA, 22 nt, Homo sapiens
uaacauagucauauacuugcuu

SEQ ID NO: 36451 - RNA, 22 nt, Homo sapiens
uaacccagugucugugaugggu

SEQ ID NO: 36452 - RNA, 22 nt, Homo sapiens
uaagacacuuaaaauguuacau

SEQ ID NO: 36453 - RNA, 22 nt, Homo sapiens
uaaggcacccuucugaguagag

SEQ ID NO: 36454 - RNA, 22 nt, Homo sapiens
uaaguauuaggccccaggcugg

SEQ ID NO: 36455 - RNA, 21 nt, Homo sapiens
uaauaaugucucagacaccua

SEQ ID NO: 36456 - RNA, 22 nt, Homo sapiens
uaauaauguuaggcuuacucaa

SEQ ID NO: 36457 - RNA, 22 nt, Homo sapiens
uaauagagucauuauuauuguu

SEQ ID NO: 36458 - RNA, 22 nt, Homo sapiens
uaauauguuuugaaaucaggaa

SEQ ID NO: 36459 - RNA, 22 nt, Homo sapiens
uaauccuagcacuuuggaagac

SEQ ID NO: 36460 - RNA, 22 nt, Homo sapiens
uaaugugaauagugcuguaaug

SEQ ID NO: 36461 - RNA, 22 nt, Homo sapiens
uacaaaguaacaguuccuguau

SEQ ID NO: 36462 - RNA, 22 nt, Homo sapiens
uacagcuaugugcaugcaugcu

SEQ ID NO: 36463 - RNA, 22 nt, Homo sapiens
uacagucauaaugccuagugac

SEQ ID NO: 36464 - RNA, 22 nt, Homo sapiens
uacaugcaugggcaugugugca

SEQ ID NO: 36465 - RNA, 22 nt, Homo sapiens
uacccucuggauacccuuguuc

SEQ ID NO: 36466 - RNA, 22 nt, Homo sapiens
uaccugagacaacuuugaggaa

SEQ ID NO: 36467 - RNA, 22 nt, Homo sapiens
uaccugagucuagagucuagaa

SEQ ID NO: 36468 - RNA, 22 nt, Homo sapiens
uacgccuguaauaucagcauuu

SEQ ID NO: 36469 - RNA, 22 nt, Homo sapiens
uacugcacuccaaccugagaga

SEQ ID NO: 36470 - RNA, 22 nt, Homo sapiens
uacugcacuccagccucgguga

SEQ ID NO: 36471 - RNA, 22 nt, Homo sapiens
uacugcacuccagccuugccaa

SEQ ID NO: 36472 - RNA, 22 nt, Homo sapiens
uacugcacuggaggccucagau

SEQ ID NO: 36473 - RNA, 22 nt, Homo sapiens
uacugcacuugaccuccugggc

SEQ ID NO: 36474 - RNA, 22 nt, Homo sapiens
uagaagcacuaucccuccuagu

SEQ ID NO: 36475 - RNA, 22 nt, Homo sapiens
uagacccauuacguaguuucca

SEQ ID NO: 36476 - RNA, 22 nt, Homo sapiens
uagagauaucaauuucauggug

SEQ ID NO: 36477 - RNA, 22 nt, Homo sapiens
uagagccauugcagauguuuga

SEQ ID NO: 36478 - RNA, 22 nt, Homo sapiens
uagaucaacuuugguaagagaa

SEQ ID NO: 36479 - RNA, 22 nt, Homo sapiens
uagauuaucccugauuugucca

SEQ ID NO: 36480 - RNA, 22 nt, Homo sapiens
uagauuauuccuuugaauggcc

SEQ ID NO: 36481 - RNA, 19 nt, Homo sapiens
uagcagcaugauuuauaau

SEQ ID NO: 36482 - RNA, 22 nt, Homo sapiens
uagcaggaaaggggucagaucu

SEQ ID NO: 36483 - RNA, 22 nt, Homo sapiens
uagcauccuucucuaaacagga

SEQ ID NO: 36484 - RNA, 21 nt, Homo sapiens
uagcuacacugugauucaugg

SEQ ID NO: 36485 - RNA, 22 nt, Homo sapiens
uaggagugugaacccuaugaac

SEQ ID NO: 36486 - RNA, 22 nt, Homo sapiens
uaggcacacaucuacuacaaau

SEQ ID NO: 36487 - RNA, 22 nt, Homo sapiens
uaggucuuuuaugaaauauauu

SEQ ID NO: 36488 - RNA, 22 nt, Homo sapiens
uaguauguuuauagcauugagu

SEQ ID NO: 36489 - RNA, 22 nt, Homo sapiens
uagugaaugucacuggcuguug

SEQ ID NO: 36490 - RNA, 22 nt, Homo sapiens
uauaacaaugcaagaauggccu

SEQ ID NO: 36491 - RNA, 22 nt, Homo sapiens
uauacaugugggcaucaggaga

SEQ ID NO: 36492 - RNA, 22 nt, Homo sapiens
uaucacaaacuuagcaguuuaa

SEQ ID NO: 36493 - RNA, 22 nt, Homo sapiens
uaucacacaucaugguaaaucu

SEQ ID NO: 36494 - RNA, 23 nt, Homo sapiens
uaucacacuuucucugugccaca

SEQ ID NO: 36495 - RNA, 22 nt, Homo sapiens
uaucaccuugguagucuugggg

SEQ ID NO: 36496 - RNA, 22 nt, Homo sapiens
uaucagauugcugccaucugcu

SEQ ID NO: 36497 - RNA, 22 nt, Homo sapiens
uaugacuuuggaaaaauuacuu

SEQ ID NO: 36498 - RNA, 22 nt, Homo sapiens
uaugucuucuuuagagaaaugu

SEQ ID NO: 36499 - RNA, 22 nt, Homo sapiens
uaugucuuuugcuugcaaauag

SEQ ID NO: 36500 - RNA, 22 nt, Homo sapiens
uauuagguuggugcaaaaguua

SEQ ID NO: 36501 - RNA, 22 nt, Homo sapiens
uauugcagugagauccaucugg

SEQ ID NO: 36502 - RNA, 22 nt, Homo sapiens
ucaaaugcuguauuguaguaau

SEQ ID NO: 36503 - RNA, 22 nt, Homo sapiens
ucacacgugaacucaucacaga

SEQ ID NO: 36504 - RNA, 22 nt, Homo sapiens
ucaccuggggcacagcugaaga

SEQ ID NO: 36505 - RNA, 22 nt, Homo sapiens
ucacugagcacaggagaugugc

SEQ ID NO: 36506 - RNA, 22 nt, Homo sapiens
ucacugcacuagguaaugccac

SEQ ID NO: 36507 - RNA, 22 nt, Homo sapiens
ucacugcgaccuccgccucccg

SEQ ID NO: 36508 - RNA, 22 nt, Homo sapiens
ucacuggacagaaauaaaggug

SEQ ID NO: 36509 - RNA, 22 nt, Homo sapiens
ucagacacugagcaaacgacua

SEQ ID NO: 36510 - RNA, 18 nt, Homo sapiens
ucagagugcagacuauac

SEQ ID NO: 36511 - RNA, 22 nt, Homo sapiens
ucagagugguuguaccauuuga

SEQ ID NO: 36512 - RNA, 22 nt, Homo sapiens
ucagaugaugucccuguucuaa

SEQ ID NO: 36513 - RNA, 22 nt, Homo sapiens
ucagcagugugaaaacaaacua

SEQ ID NO: 36514 - RNA, 22 nt, Homo sapiens
ucaggcuuuucccagagugaug

SEQ ID NO: 36515 - RNA, 22 nt, Homo sapiens
ucagguagcauuuuggaaacag

SEQ ID NO: 36516 - RNA, 22 nt, Homo sapiens
ucagguccuuacugugcucccu

SEQ ID NO: 36517 - RNA, 22 nt, Homo sapiens
ucagucauguuuaccagacgua

SEQ ID NO: 36518 - RNA, 22 nt, Homo sapiens
ucagucauucaauuguugaaug

SEQ ID NO: 36519 - RNA, 22 nt, Homo sapiens
uucuuuggaaacaguacuaauu

SEQ ID NO: 36520 - RNA, 22 nt, Homo sapiens
uugaaagaaaggagacugaguu

SEQ ID NO: 36521 - RNA, 22 nt, Homo sapiens
aauggcauugguccuuuuggau

SEQ ID NO: 36522 - RNA, 22 nt, Homo sapiens
aauggcuauuucaugugguagg

SEQ ID NO: 36523 - RNA, 22 nt, Homo sapiens
acaagugaauacaggauucucu

SEQ ID NO: 36524 - RNA, 22 nt, Homo sapiens
acacaguaaauauugucuccuc

SEQ ID NO: 36525 - RNA, 22 nt, Homo sapiens
acaccaucuccuuauuucucuu

SEQ ID NO: 36526 - RNA, 22 nt, Homo sapiens
acaccauugcauuccagccugg

SEQ ID NO: 36527 - RNA, 22 nt, Homo sapiens
acacugcugaguaaauaauuuu

SEQ ID NO: 36528 - RNA, 20 nt, Homo sapiens
acagcacugguuucaagcaa

SEQ ID NO: 36529 - RNA, 19 nt, Homo sapiens
acagcugguuuugguuucu

SEQ ID NO: 36530 - RNA, 22 nt, Homo sapiens
acaggagugggauuugaguccu

SEQ ID NO: 36531 - RNA, 23 nt, Homo sapiens
acaguggugugaucuuggcucag

SEQ ID NO: 36532 - RNA, 22 nt, Homo sapiens
uuuugguuguuggguaagagua

SEQ ID NO: 36533 - RNA, 22 nt, Homo sapiens
uuuuugaguaaauauaaauugu

SEQ ID NO: 36534 - RNA, 22 nt, Homo sapiens
uuuuuggaggagguuagaucau

SEQ ID NO: 36535 - RNA, 22 nt, Homo sapiens
uuuuuuaguuagcugggcauga

SEQ ID NO: 36536 - RNA, 22 nt, Homo sapiens
uggcaagaagagcaugagacca

SEQ ID NO: 36537 - RNA, 22 nt, Homo sapiens
uggcaagaaggauuuauuccuu

SEQ ID NO: 36538 - RNA, 22 nt, Homo sapiens
uggcaagagaacaacaucucuc

SEQ ID NO: 36539 - RNA, 19 nt, Homo sapiens
uggcaaugucagcagagau

SEQ ID NO: 36540 - RNA, 22 nt, Homo sapiens
uggccagugucggaggccagga

SEQ ID NO: 36541 - RNA, 22 nt, Homo sapiens
ugggaagauucuguguuuuucc

SEQ ID NO: 36542 - RNA, 22 nt, Homo sapiens
ugguaguuucuguaucucacag

SEQ ID NO: 36543 - RNA, 22 nt, Homo sapiens
ugguccucugcuuccagaauuc

SEQ ID NO: 36544 - RNA, 21 nt, Homo sapiens
uguagcagcauaauuuauaau

SEQ ID NO: 36545 - RNA, 22 nt, Homo sapiens
uguaguuugaaagcucccucug

SEQ ID NO: 36546 - RNA, 22 nt, Homo sapiens
uguauguugggucaaaguacau

SEQ ID NO: 36547 - RNA, 22 nt, Homo sapiens
ugucacaguuuguacuuuauag

SEQ ID NO: 36548 - RNA, 22 nt, Homo sapiens
ugucacugugcagucaugcauu

SEQ ID NO: 36549 - RNA, 22 nt, Homo sapiens
ugucaguguacuguaagaauua

SEQ ID NO: 36550 - RNA, 22 nt, Homo sapiens
ugucauggugcucugggcccug

SEQ ID NO: 36551 - RNA, 22 nt, Homo sapiens
ugugagaucucagaauugaacu

SEQ ID NO: 36552 - RNA, 22 nt, Homo sapiens
ugugaucaugguauuaaucugc

SEQ ID NO: 36553 - RNA, 22 nt, Homo sapiens
ugugcauaugucuuuauaguag

SEQ ID NO: 36554 - RNA, 22 nt, Homo sapiens
uguggaaauggugcuacgaaca

SEQ ID NO: 36555 - RNA, 22 nt, Homo sapiens
uguuaacauggucucagucugu

SEQ ID NO: 36556 - RNA, 22 nt, Homo sapiens
uguuauugagguuacuuauaag

SEQ ID NO: 36557 - RNA, 21 nt, Homo sapiens
uuaacagacaagugucuuccc

SEQ ID NO: 36558 - RNA, 22 nt, Homo sapiens
uuaacagucacuuagcucauuu

SEQ ID NO: 36559 - RNA, 22 nt, Homo sapiens
uaugagguagguaugacuauca

SEQ ID NO: 36560 - RNA, 22 nt, Homo sapiens
uauugaauuuuuaagcccuuug

SEQ ID NO: 36561 - RNA, 22 nt, Homo sapiens
uauugcagaaugugaguuggca

SEQ ID NO: 36562 - RNA, 22 nt, Homo sapiens
uauugcuugaggaaaugguaau

SEQ ID NO: 36563 - RNA, 22 nt, Homo sapiens
uauugcuuuacucucuuauccu

SEQ ID NO: 36564 - RNA, 22 nt, Homo sapiens
uauugcuuuugauucaaggcag

SEQ ID NO: 36565 - RNA, 22 nt, Homo sapiens
uauuugcacucccaucauggug

SEQ ID NO: 36566 - RNA, 22 nt, Homo sapiens
ucaaauguuuguuuaaggcuua

SEQ ID NO: 36567 - RNA, 22 nt, Homo sapiens
ucaaauuccaagucuagguagg

SEQ ID NO: 36568 - RNA, 22 nt, Homo sapiens
ucaacauugcugucaggcaucu

SEQ ID NO: 36569 - RNA, 22 nt, Homo sapiens
ucaagugcauaugcuaacgguu

SEQ ID NO: 36570 - RNA, 23 nt, Homo sapiens
ucacacuuaagagaaaugcagcu

SEQ ID NO: 36571 - RNA, 21 nt, Homo sapiens
ucacagccuaggaccugaaga

SEQ ID NO: 36572 - RNA, 22 nt, Homo sapiens
ucacagccuaguuuuauacauu

SEQ ID NO: 36573 - RNA, 22 nt, Homo sapiens
ucacaguagagcuucuuucaga

SEQ ID NO: 36574 - RNA, 22 nt, Homo sapiens
ucacaguagggaacugacaaag

SEQ ID NO: 36575 - RNA, 21 nt, Homo sapiens
ucaccuguagcugcauguucu

SEQ ID NO: 36576 - RNA, 22 nt, Homo sapiens
ucacucagaccuggugauaugc

SEQ ID NO: 36577 - RNA, 22 nt, Homo sapiens
ucacugagaaugauguuucuga

SEQ ID NO: 36578 - RNA, 22 nt, Homo sapiens
ucacugagcuagaucacuugac

SEQ ID NO: 36579 - RNA, 22 nt, Homo sapiens
ucacugcacucuccgccuugcg

SEQ ID NO: 36580 - RNA, 22 nt, Homo sapiens
ucacuuuguuuuuggauaaguu

SEQ ID NO: 36581 - RNA, 22 nt, Homo sapiens
ucagaguagaaacacuuccaua

SEQ ID NO: 36582 - RNA, 22 nt, Homo sapiens
ucagaucaugcuuaugauggga

SEQ ID NO: 36583 - RNA, 22 nt, Homo sapiens
ucagguugcuaaguauaauauu

SEQ ID NO: 36584 - RNA, 20 nt, Homo sapiens
ucaucaguuggugcucgcug

SEQ ID NO: 36585 - RNA, 22 nt, Homo sapiens
ucaugacacagcauacugacuu

SEQ ID NO: 36586 - RNA, 21 nt, Homo sapiens
ucauugguuggcugcccugua

SEQ ID NO: 36587 - RNA, 22 nt, Homo sapiens
uccaguacaggucucucauuuc

SEQ ID NO: 36588 - RNA, 19 nt, Homo sapiens
uccaugagcccacagugau

SEQ ID NO: 36589 - RNA, 22 nt, Homo sapiens
uccccuuuguaagauggaaacg

SEQ ID NO: 36590 - RNA, 21 nt, Homo sapiens
uccugagagaggaguaacucu

SEQ ID NO: 36591 - RNA, 22 nt, Homo sapiens
ucucaauggguuguagacaaag

SEQ ID NO: 36592 - RNA, 22 nt, Homo sapiens
ucucacagaguugaauguuucu

SEQ ID NO: 36593 - RNA, 22 nt, Homo sapiens
ucucacaggguuauugaggggg

SEQ ID NO: 36594 - RNA, 22 nt, Homo sapiens
ucucagugugguaaaaguuuuu

SEQ ID NO: 36595 - RNA, 22 nt, Homo sapiens
ucugagguuaaauuuuauaguu

SEQ ID NO: 36596 - RNA, 22 nt, Homo sapiens
ucugauggaguugccagggaga

SEQ ID NO: 36597 - RNA, 22 nt, Homo sapiens
ucugucuuugucaggaccagag

SEQ ID NO: 36598 - RNA, 23 nt, Homo sapiens
ucuugguuauagaaaaauaguug

SEQ ID NO: 36599 - RNA, 22 nt, Homo sapiens
ucuugguugaaaauucauaaua

SEQ ID NO: 36600 - RNA, 20 nt, Homo sapiens
ucuugguuggaggucuuuua

SEQ ID NO: 36601 - RNA, 22 nt, Homo sapiens
ucuuugggauauucugaaaggg

SEQ ID NO: 36602 - RNA, 22 nt, Homo sapiens
ucuuuggguguauuucacagcc

SEQ ID NO: 36603 - RNA, 22 nt, Homo sapiens
ugaaauacuuuggcucuuuguu

SEQ ID NO: 36604 - RNA, 22 nt, Homo sapiens
ugaauacuucaaaaaaauagcu

SEQ ID NO: 36605 - RNA, 22 nt, Homo sapiens
ugaauaguaauguguuuggucu

SEQ ID NO: 36606 - RNA, 22 nt, Homo sapiens
ugaauauagacagggguagaga

SEQ ID NO: 36607 - RNA, 22 nt, Homo sapiens
ugaauguauuuauuaccauuca

SEQ ID NO: 36608 - RNA, 22 nt, Homo sapiens
ugacacagugggggauccuuuu

SEQ ID NO: 36609 - RNA, 22 nt, Homo sapiens
ugacagguugauaggugcagca

SEQ ID NO: 36610 - RNA, 21 nt, Homo sapiens
ugacauuauuucaugucagua

SEQ ID NO: 36611 - RNA, 22 nt, Homo sapiens
ugacuugaucauuacacauucu

SEQ ID NO: 36612 - RNA, 22 nt, Homo sapiens
ugagaagcauaccagugucugu

SEQ ID NO: 36613 - RNA, 19 nt, Homo sapiens
ugagagcacaacugaacaa

SEQ ID NO: 36614 - RNA, 22 nt, Homo sapiens
ugagauaguuguagauguacau

SEQ ID NO: 36615 - RNA, 22 nt, Homo sapiens
ugagaucaaggugggcccuggg

SEQ ID NO: 36616 - RNA, 21 nt, Homo sapiens
ugagaugcaaucaccagggag

SEQ ID NO: 36617 - RNA, 22 nt, Homo sapiens
ugagauuaaucuuuaaguaaga

SEQ ID NO: 36618 - RNA, 22 nt, Homo sapiens
ugagcugagaucuuaccacugc

SEQ ID NO: 36619 - RNA, 22 nt, Homo sapiens
ugaggcacucccuagcggggug

SEQ ID NO: 36620 - RNA, 21 nt, Homo sapiens
ugaggucaugaugcugcuucc

SEQ ID NO: 36621 - RNA, 22 nt, Homo sapiens
ugaggucauguucugucagguu

SEQ ID NO: 36622 - RNA, 22 nt, Homo sapiens
ugaggugaaguaauauucuaag

SEQ ID NO: 36623 - RNA, 23 nt, Homo sapiens
ugagguguuaagcagacuugucu

SEQ ID NO: 36624 - RNA, 22 nt, Homo sapiens
ugagguugucagugucauucuu

SEQ ID NO: 36625 - RNA, 22 nt, Homo sapiens
ugagucgagauugcgccacugu

SEQ ID NO: 36626 - RNA, 22 nt, Homo sapiens
ugagucuguuccaaagaaauaa

SEQ ID NO: 36627 - RNA, 22 nt, Homo sapiens
ugaguucaauguuaaugaagca

SEQ ID NO: 36628 - RNA, 22 nt, Homo sapiens
ugauauauugaaugaugaaaca

SEQ ID NO: 36629 - RNA, 22 nt, Homo sapiens
ugauauuuuugauccuuaaguu

SEQ ID NO: 36630 - RNA, 22 nt, Homo sapiens
ugaugacauugucacagucuga

SEQ ID NO: 36631 - RNA, 22 nt, Homo sapiens
ugcaagaaucuuucaggcuagc

SEQ ID NO: 36632 - RNA, 22 nt, Homo sapiens
ugcaagaugagauuuuggaugg

SEQ ID NO: 36633 - RNA, 22 nt, Homo sapiens
ugcaccacugcacuccagcuug

SEQ ID NO: 36634 - RNA, 22 nt, Homo sapiens
ugcaccacugcacugccugggu

SEQ ID NO: 36635 - RNA, 22 nt, Homo sapiens
ugcaccacuguacuccagucug

SEQ ID NO: 36636 - RNA, 22 nt, Homo sapiens
ugcaccauugcacuccagccug

SEQ ID NO: 36637 - RNA, 22 nt, Homo sapiens
ugcaccauugcauuccagccug

SEQ ID NO: 36638 - RNA, 22 nt, Homo sapiens
ugcagcauugcacuccagccug

SEQ ID NO: 36639 - RNA, 22 nt, Homo sapiens
ugcagcucaaauuccuaacaag

SEQ ID NO: 36640 - RNA, 22 nt, Homo sapiens
ugcauagcauauauuguagagu

SEQ ID NO: 36641 - RNA, 22 nt, Homo sapiens
ugccaaggagucagucccuaga

SEQ ID NO: 36642 - RNA, 22 nt, Homo sapiens
ugcccguaauuccagcacuuug

SEQ ID NO: 36643 - RNA, 22 nt, Homo sapiens
ugccuggagagcuccuacauau

SEQ ID NO: 36644 - RNA, 22 nt, Homo sapiens
ugcgccauugcacuccagccug

SEQ ID NO: 36645 - RNA, 22 nt, Homo sapiens
ugcugcacuuauggcucugagg

SEQ ID NO: 36646 - RNA, 22 nt, Homo sapiens
uggaaaauuaggggagguuaua

SEQ ID NO: 36647 - RNA, 22 nt, Homo sapiens
uggaagcauagcagcgugugug

SEQ ID NO: 36648 - RNA, 22 nt, Homo sapiens
uggaauacuauucugugcugga

SEQ ID NO: 36649 - RNA, 22 nt, Homo sapiens
uggaauuuagguugauaguaua

SEQ ID NO: 36650 - RNA, 22 nt, Homo sapiens
uggacacugguggauauggaau

SEQ ID NO: 36651 - RNA, 22 nt, Homo sapiens
uggacaugaagggcacaggagg

SEQ ID NO: 36652 - RNA, 22 nt, Homo sapiens
uggaguguguugcagaugaagg

SEQ ID NO: 36653 - RNA, 22 nt, Homo sapiens
uggcaagaaccacaauuacuuu

SEQ ID NO: 36654 - RNA, 22 nt, Homo sapiens
uggcaagaaccacaguuacuuu

SEQ ID NO: 36655 - RNA, 22 nt, Homo sapiens
uggcaagaacugcaauugcuuu

SEQ ID NO: 36656 - RNA, 22 nt, Homo sapiens
uugaggaggcagucucuccauu

SEQ ID NO: 36657 - RNA, 22 nt, Homo sapiens
uugaggaggcagucugcccauu

SEQ ID NO: 36658 - RNA, 22 nt, Homo sapiens
uugaggaggcagucuguccguu

SEQ ID NO: 36659 - RNA, 22 nt, Homo sapiens
uugaggaggcagucuucccauu

SEQ ID NO: 36660 - RNA, 22 nt, Homo sapiens
uugaggaguacugauuagguau

SEQ ID NO: 36661 - RNA, 22 nt, Homo sapiens
uugauguguuuccaggauuugu

SEQ ID NO: 36662 - RNA, 22 nt, Homo sapiens
uugcaccacugcacuccacccu

SEQ ID NO: 36663 - RNA, 22 nt, Homo sapiens
uugcacuccggccuggguaaca

SEQ ID NO: 36664 - RNA, 22 nt, Homo sapiens
uuggaagacaaugcugauucuc

SEQ ID NO: 36665 - RNA, 22 nt, Homo sapiens
uuggaagauuacuuaguuuucu

SEQ ID NO: 36666 - RNA, 22 nt, Homo sapiens
uuggcaagaaccuucuuccaag

SEQ ID NO: 36667 - RNA, 22 nt, Homo sapiens
uuggcauugccaaacugucaac

SEQ ID NO: 36668 - RNA, 22 nt, Homo sapiens
uugguaaugggcugguauaacc

SEQ ID NO: 36669 - RNA, 22 nt, Homo sapiens
uuggucaggcuaaucucgaacg

SEQ ID NO: 36670 - RNA, 22 nt, Homo sapiens
uugguccguugugaaaaggccu

SEQ ID NO: 36671 - RNA, 22 nt, Homo sapiens
uuggucuucuaauguaccuguu

SEQ ID NO: 36672 - RNA, 22 nt, Homo sapiens
uugucacccucucuuggugucu

SEQ ID NO: 36673 - RNA, 22 nt, Homo sapiens
uugugaagaugugaagcaagca

SEQ ID NO: 36674 - RNA, 22 nt, Homo sapiens
uugugaauggugccacaauaaa

SEQ ID NO: 36675 - RNA, 22 nt, Homo sapiens
uugugaauggugccucaguaaa

SEQ ID NO: 36676 - RNA, 22 nt, Homo sapiens
uugugaauggugcugcaguaaa

SEQ ID NO: 36677 - RNA, 22 nt, Homo sapiens
uuguguacuacaguaugccaca

SEQ ID NO: 36678 - RNA, 22 nt, Homo sapiens
uuguguuuuuaguagggaaggg

SEQ ID NO: 36679 - RNA, 22 nt, Homo sapiens
uuguuauguaucucaagauaaa

SEQ ID NO: 36680 - RNA, 22 nt, Homo sapiens
uuuaauagcagggacuuccggg

SEQ ID NO: 36681 - RNA, 22 nt, Homo sapiens
uuuaauguuacaguauugguau

SEQ ID NO: 36682 - RNA, 22 nt, Homo sapiens
uuuauugcucuaaaguugccau

SEQ ID NO: 36683 - RNA, 22 nt, Homo sapiens
uuugccaauauuuuacugagga

SEQ ID NO: 36684 - RNA, 22 nt, Homo sapiens
uuugcuauagugaauagugcug

SEQ ID NO: 36685 - RNA, 22 nt, Homo sapiens
uuugcuuaaaguccuuguggga

SEQ ID NO: 36686 - RNA, 22 nt, Homo sapiens
uuugcuuaguaaauguagaaaa

SEQ ID NO: 36687 - RNA, 22 nt, Homo sapiens
uuuggaagaugccacuguauca

SEQ ID NO: 36688 - RNA, 22 nt, Homo sapiens
uuuguaagaugcauagauugca

SEQ ID NO: 36689 - RNA, 22 nt, Homo sapiens
uuuugcacuguuuuaucugaca

SEQ ID NO: 36690 - RNA, 22 nt, Homo sapiens
uuuugcucuugguaaugaaaga

SEQ ID NO: 36691 - RNA, 18 nt, Homo sapiens
uuuuugaggcacagggga

(The sequence listing continues in the following parts.)

The invention claimed is:

1. An isolated nucleic acid consisting of X nucleotides wherein the sequence of the nucleic acid comprises:
    (a) Y consecutive nucleotides of SEQ ID NO: 2240728;
    (b) a DNA equivalent of (a); or
    (c) the complement of (a) or (b),
wherein,
X=16 to 120,
Y≧16, and
X≧Y.

2. The nucleic acid of claim 1, wherein the Y nucleotides comprises the sequence of SEQ ID NO: 8385.

3. The nucleic acid of claim 1, wherein X=19 to 24 nucleotides.

4. The nucleic acid of claim 1, wherein X=Y.

5. The nucleic acid of claim 4, wherein the Y consecutive nucleotides is SEQ ID NO: 2240728.

6. The nucleic acid of claim 4, wherein the Y consecutive nucleotides is SEQ ID NO: 8385.

7. A vector comprising a human insert, wherein the human insert consists of the nucleic acid of claim 1, and wherein the vector comprises no other insert but the nucleic acid of claim 1.

8. A vector comprising a human insert, wherein the human insert consists of the nucleic acid of claim 2, and wherein the vector comprises no other insert but the nucleic acid of claim 2.

9. A vector comprising a human insert, wherein the human insert consists of the nucleic acid of claim 3, and wherein the vector comprises no other insert but the nucleic acid of claim 3.

10. A vector comprising a human insert, wherein the human insert consists of the nucleic acid of claim 4, and wherein the vector comprises no other insert but the nucleic acid of claim 4.

11. A vector comprising a human insert, wherein the human insert consists of the nucleic acid of claim 5, and wherein the vector comprises no other insert but the nucleic acid of claim 5.

12. A vector comprising a human insert, wherein the human insert consists of the nucleic acid of claim 6, and wherein the vector comprises no other insert but the nucleic acid of claim 6.

13. The isolated nucleic acid of claim 1, wherein the nucleic acid is a probe.

14. The isolated nucleic acid of claim 2, wherein the nucleic acid is a probe.

15. The isolated nucleic acid of claim 3, wherein the nucleic acid is a probe.

16. The isolated nucleic acid of claim 4, wherein the nucleic acid is a probe.

17. The isolated nucleic acid of claim 5, wherein the nucleic acid is a probe.

18. The isolated nucleic acid of claim 6, wherein the nucleic acid is a probe.

* * * * *